United States Patent 8,067,671 (METHODS FOR GENETIC CONTROL OF PLANT PEST INFESTATION AND COMPOSITIONS THEREOF) - sequence listing, part 9

SEQ ID NO: 7440 - DNA, 4847 bp, Heterodera glycines
agtcataaaaatttttaggaaaaattttccaaatacaaaatttttattcagttttcgcgcgagtacctgttttttagattagaattgttcagaagtatacgtatattgagggtgaccaagtttttttttcaaattcaggataaagaacactaaaattcagacgtagacctcaaaattcagattatcgcaaaacaaggggtcagcagccaattttccaatttcgtgaaggggtctccggccacgtaaattaatcgtaaatcaacgaccttttttcgctttcaacaccgctttttacgcggcacgttttttccaagacttttgggggacaaggagggccggcggtgccgataggcgccgccgggaaaaattttgtaatttttaacgcgatttgttaacagaatttgtaaaaaaaatgaccaattcgattaagttttgggtttttagggtgcttaacatcgaaagaaaaaaagttggaatattttttaaaattaaaatttttaattaaaataatggtaaagaaaacgggagggatatttccatccaagtgggggaaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtaccggtaccaaaaaaaccggtaattaccggccagtaccggtaccggtaccggtaccgctcaaccctattttaaatgcttggactaggtctataacttttcttctttcctctaaagattgtatcttgaaaaaactgagacgttgttggtagggaatataaggtaattaatctacatttgaagagagcaatttttgtaaaatatttttgacatctttcaattttaatgatatccttttttaacttaggattccaaatttcaggtgcgtattcaaggagggggcgaatgtacgtcttgtaaacagtagtccatacccgaattgagcgggattttagaaacttggctatatatctgatccttaaataagcagccttagtaattttaagatagtgatcagaaaactttaacttattatcaattaaaacacccaaatcattaatcgattcaacctcattgataattttgttgcataatttgtattgttgtttagagttgtttttgccaaaaaatataataaatgttttatcgggtgagatttttaaaccatttaaactggcccaattttcaatgttttgtaaagctgtgtttagcttaatgcgctcatttctttttttgtatgaaacatatagtttcacatcatctgcaaaaagaaactgttatgtttttgcttagtaggcgaaatgaatgtttttgggttagtaggcgaaatgtcagtaggcgagatgtcggtaggcgagatgtcgagtaggcgaaatgtccgtacaccgtccaccactggtcacgccagaaacaaaatttcaaaaaaaaaacattgagagacaacaaaggtcgtggatcagcagcagaagcaaaattttatgtgtttatcaaccatgccgaatctgtgcattttgaattgcccgaccgtccgcttcccaacaaaattcgctttaagcgacttttgattacgtatttcaaaattcaaagaattatagtgtgataaagagattccttttcagctacatcgatcattccatcatcacatttctccgtgccaccagcaaatttttgacaaaagcaccgatttggggttcattgttagttgctccgataatgccatgaaagtccagcaaatttgggatgtttttgcgcgtgaaatttggccattgttgcgcccaacattcaccatttggactttcccgatgaccatcatttggacaatttgcatcgtctcatttcgccaacaattctcgccgatctcgatcagttgaattcaatcgactccgatgatttattgcccgattcaccagctgatgatggaccaaatgcaactgttggccaagtgctgtcaaattggttgaacactccgcgaaacgatggaaagccgaagcaattgcgttcttgtgactattgtcatgtgtcagaaaccatgggaatggtcaacagtttcaaagaggtgtgtggccatatttccgtaaaatattttgcttaattgccatttgctttttgtttcacattgtttaggcatttcttcgtgccaccactcctgtcggctacacatttcgacttgaactttatgattcaacggaaattgtcacgccatttgaagtgatgaacgaacggaccaacgaaatgctgacatttgagaaagaaggaaacgatgaaattgtggatgaagatagtcaatttactgatgctgtttggctgttgaagcgatgcccaattggggggacggcgacgattcagtgggaggacagaaagtcggacaaattgaacaaagtcgatattcgtctttatggaaattgcattgggtgcgtggcaaccgtgtcccggcatttgcgtttttgtccaaaaatcgggttcaaaattaagtttttttcaatccctgcttgctgatcgcctaaaacaagcgatacaaagtgatcgtatctgatcatttgatcgtcaatgaatttatgatattaaaattttcaaagagcagagttaatgctctctaataagtgagaagactgtgttttaattttaatgatctttagatcagggatgaaaaaaaaaaattaaatttgattccgatttttttgacaaaggcgcaaatgtcggggttccgtggcaacggcatttttgtttcgtttaaagtcattcaaatttcacttaatattcaggccattgtctccactaaaggcgggccaaatgaacgcaaaaaatcatccgaaaatgaatcccgagcccagcggacagcagaagaaaaagtgaaagaattattaggaaatgacaaatgattgatcataggaatggaaattgatctgataatttttccttatatttatttgttgcttctttcatttgaatacatttaggtaatttgtctggatttttggaacttttacgcagaaaatcttttttgtctttagaaattcattgtctaatgttctattttttgtgctttacttttgcctaatttttcaggacttttttgcatttcttacgtacgttttttgacgattttttatgactttaaaaattaaacaataggattttgtcttgaaattgccgttacgttgagtggttcacctacactttttgtcccagtaaaatgctaaactgctgaataattttttttagtatcaattacctatgaaatgacctttgttggacgcgtaaaatggcacgggataggtgaaatgccgttttggttgaacgcctaattagaaacccaaaaaacaacagttttacaagtcagggctggagcgcgcacagaaaaaaaccgcggccgcggaccgcgcaaaaaaaaaaaaccgcggccgcgcattcaaattgccgcggccgcgcaaaaaaaaaaatgccgcggatcgcggtcgcgctccagccctgttacaagtgtgatacaaggattacagctttattgtccgaatacattcatacaacatatattatgtacacataatgattgggtgttgcattggagcacatacaaatacaatatataggacatacatacatatatcattacaacaattacaacgatttgatcactgatatggacagcgcataaagcttatcacggacaacagatcagagggtgataaagcacatacaaatgatataatttggggggaggggggaaacagcgtcatattgggggatcagcagcagttagaaggggagaagcgtttgttgctcgaattccatcgttcgttcatccgcgggggccgtcctcgagtcgatcattgttcaccgctggagctcttcgacgctttctgcttcttgtccttcttggagccgccgcccgccgatgccctggcccgtttggcggtgtaaatcatgccacagtactgaaaagaaaatgggaacaaattagacacaaaatgaacacgaacggaggcaaaagcgggccaactaaaccattttactagtcatggaacaatgaaattttgggttttcgggtccgaaattggtcaaactgaacgttgtatatgttaatggcacttctgaaaagcctcaaaatcaatttttggattctaaaatttggtttcgtctcacaccagcaaaaaacacataaataagccaaatgcattttccgtgcttttatgagtctcgaatttaccctgcttgaaagctcaatcccgagaaattttgtccattgttttaaggacaaacaatacattttggaatggatacaaatttgattggattcagaaaaagcagcaacaacgcgaattccccccacccccaaacccaccgctccaccgccgaacgcaaccgcagccacgaacatgtagaagaggaagcccattgtgttgattggagagcagcagcagcagcagaagtgatcggagtcaacgtgtgcacgggcgatggatgtgctgtgttgaagcgttgcgcaattgtcgtcgttgctgattgtttgttgttgttgtcgctgtgaagggaatgagagaccaaccgacattttccctccttttatacatcccaaaaccaaaaagattcatccggcgacattttgggtgctgcagtgcccagcagaatttgatataaaaggctcacattttgatgactcctgccatt

SEQ ID NO: 7441 - DNA, 3319 bp, Heterodera glycines
ctgaaagtggtgaaagatgtcgcactccttggatcgaagcagtttaaggatctgacttattgtaattcggaggcagttaacattggcgctcccgctctgctgcaagcggaattggataggatctttgtaagcaaagaaccaaaaaaatttgcagcaacaaatcgtttactcactttagggtaagactgacaaggccaccagttctgaacaagtgcaagatatggtcacaaaagtaacacgggtttggtgtttgggattgtttgttagaacgctgctttagaactatgcagcgactgtgagtctgatcgccatcatgcagaagcaaggggatctgctgaaacacctggaagatgccttcgtgcgccagtttcggctcatgaacacgacggtccagaaagcaaacgacagaattgcggcccttgaaacgctgctcagaacccgtccctatcaaggtgcattaaatttgcaaaaaaaaaaaaatttattaattttggcgtgcagattattccctccgagggcgcggccgcggttggcatgggcgacatcgatggcctagggggaatgggcctggaggacaacgaggagctgaagggaccaggaggaagcaaagatggtggagttcgtcgttttgataaccgtggcagtcgcggcagatacgctaaggtaagaaaacccaagagttgagaagtggggagggggtcggcggtggttattataacaactttcatggatttgaaacttttagatttcgtcgaaaaaaaagagggtgggcgctcaacagaaaggtggccggaggaagcggccctgcggatgatgaaaagccagtcgacaacaaaccaaagttgaacatcaatttcgaaagccaaaaatggaatgaaaggaaaaaggaattggacgcactgcaaaaattgttggtgcaatcgccgagacttactgattcgccaaattaccgggaggtcatcgaacgcttaacaaaggttataaattaaaaaaaaagtgaaatgaaaaaattggaatgaaaaatttataaaattaacattttgtaatttagattatggcaaatgacgcaaatatcttttgtcgccgcaagtgccaccaaatgtgtgatgcttttcgccaagggattgggtgccaaatttactcctcacgtgtcgtttgttgtcccggtgatcttcgacaagttcaaagggaagaaacagttgctcagagatgctctcgtcgagtgcatcgatgtcatcgcagcaaatacagtaaaaatgcataaacaaaattgaatattttacgactttttttagagtttcggtaaactcagcaaggccttactcaatgctctgacatcaaaacagaatctgagtcagaaatcacagacggatttgttcatctaccgcctgttccgttctcttccggccaaagacgttcccaagggtttgctgaaggatttggtggccattctgagcaaagtaacattttatttgattttctacctaattttcagccctttagcatggctttgatgccgcttccgaagtgagggactcttcttttgctgcgttgggtgccattatgaaatgcattggggaaagggacttgtgctgtttcatttcgctcgaattggccaaagatgcgaacaaaatggccaagattgctgaaaaacgtgacactgcttaggtattttttttatttgtttagaaattttcccatatttttgttaaattttagaccatttattttctattttttttacccctttttccatgtatttgataaatgagacactcttcggattcggtatttttggtcatgatgtgttccactttagtgttcacaatatacctatatgttaatattttggtccacggacgctaattgaccattggtgtaacggtaaatcggttccattctcacgggataattccccaattgcttgcaaattatttgcagaatggcactcacactttccatgtgctaatgtgaaaatttacaaactctcccaattcaaagccatcgcagccgctgaacttcaaaagtccactcccgtgcaaaattcgccggctgatttatgggcacctttccagtcattaaataatttcgctgaccatctttttaatttggttttcagctttttgatgcccggttatctgtccactcgtgccgttttccaatgcggcacattttggcatgtcgaaatgcacgcgccacggagcagcagtgcaaagtgacgaactgaacaaattgggggaagggaatttgtttatttgcaggatggagaacaaacacttcaactgctccatcgccaatgccttccctttgtgatgcgccgacttaaagtgatcagaaaatggccaaatcatccggggaattgccattgtttgctcgctttttcagactgatgttctgacagaactgcctgaaaagattgtgcaagacctttttgtttggctagaaagttatagattacttgtaaaaatgacagcggatatgcaattctatagtgtagagcaactagtgtatagactcactacactacactctacactactctccaaaagtctatataagcgcagcaaaattgcgcatccgctgtcatttttgcaagtactatagtgtagagcaactagtgtagagactcactacattacactctacactatagaagcacactacactagttcttgcacaaatgatagcggatgatcgttttcgctagccgaaactggcgcacgaaggcatcttccaggtgtttcagcagatccccttgcttctgcatgatggcgatcagactcacagtcgctgcatagttctaaagcagcgttctaacaaacaatcccaaacaccaaacccgtcttacttttgtgaccatatcttgcacttgttcagaactggtggccttatcagtcttaccctaaagtgagtaaacgatttgttgctgcaaatttttttggttctttgcttacaaagatcctatccaattccgcttgcagcagagcgggagcgccaatgttaactgcctccgaattacaataagtcagatccttgaactgcttcgatccaaggagtgcgacatctttcaccactttcagcacattgctcttgctcagaaaagaaattttttttggggggggggggggggggggggggttcaacctgccgaaaacatatctgaacagaatttttattaaaaatcaaaatatgcattagtagcctgttcaaatatccacattttgaatcaataccttatggaagtcgaaaattttttccagataatcggtatagtcctggactctatcaatcacctgcaaatttgaacaattacataacg

SEQ ID NO: 7442 - DNA, 2712 bp, Heterodera glycines
tctccaatatagaggacgcgagacgactgacaaagtggcgttttgggggaccaaatgaaattttgtaaggggcccagccatgtaaatagttgggggggggtattgaggaaggcataaataaatggtatttggacatttacccatcgattaattaaattaattattttttatatcatcaggagccaatgttggccgaagcgatcagcatcaagatggaacatgccgccgcaacccaaacgtgcggatttgagaactcggtggagcattgcgaacaaaacaaaagtgtaagtatcaaattaaatggaccgatcgggagagggggggggcggggagcaacagatgtgatgaaaaatagaaaaatcatgtacaaaaattattaattaaaaaatgaagattgtttatgcggtcatcgacgaaatggacgacgaagacgtggatgaagccatggcgccaccaccaccccaatcatcatcatcgcataagggcacttgcagtgtagcgacgcagacaaagatgagttattgaataaaataaattaaaaattaataggtgagtgctcagacactcctaaatttaaaaaaataattaaaaaaaggtagagtgctcaggcactcctaaatttaaaaaataatttaaaaaaggtagagtgctcaggcactcctaaatttaaaaaaaaaaatttaaaaaacagtagagtgctcaggcactcctaaattaaaaaataattaaaaaaaggtagagtgctcaggcactccttaatttaaaaaaaaaattaaaaaacagtagagtgctcaggcactcctaaattaaaaaaaaattaaaaacagtagagggcttaggcactccgaaatttaaaaaataattaaaaaacagttgagtgttcaggcactcctaaattttaaaaaataatttaaaaaaatagtagagtgctcaggcactcctaaattaaaacaaattaaaaacagtagagtgctcaagcactcctaaatttaaattaaaaaaatttttaaatttaaaatataatctaaataaatatccaaataatattttttttttcatttttagaagcgaacacgaacgaacagacagaaaacaattgcgcgcttatggaaagaagagatttacaacggaaaatttttttttccacgatagcgttgttttatttttaattcaacaaatttgttcaaaataaaaatggattaaatgattaaattgcatgaaaaacatttatgtattaaaagaagagttgaacggtaatcggtaccgataatttttggattgaaaaagcggtactttttggttgggaaaatcggtattaatacaggtaccggtcaaaaccggtactaggtacacaattttagtttttttttttttttttttttttttttttttcagaaacagcaccggaaccgctcaacccataatttaagggggggagggacaatgatcataatagggttttaaattacggaaattttaattagggttgtgctaaaagccaaaattactgtaattctcaatacatttttaaaataaaatcattgaatgaaagggagatggcatgtttagtagtgctgttcaataccgaacttgtaaactaaacttgaccccgagacagagatcaaaaagctcgagaccaaaaaaaaacaaacaagggactattcttattttattaaaagcgtttaaaaatttttagtaccgacaattttgttgagcctagactcaagactgatacactctcgaacagcactaatatttaggatcatgttacatcaatttaattttttctgtatttttcatcgatgttaagatcctaaatattccaattgggtgacattctcgaaacaaatcaaacatttgggttcatcactggcaattatcggtactgaacatggggggcagcaaaaaaagtggccacatttcctactcccgaatgaaactggaccctcccccaaacaccattgacaccgattgctgataattatttttgtctccccctcttttttattttctttttctccgtccccctttgcctccatcagctgaccaatcacctcagaactttgagttgcgatccgctgtgccctttgtcgctctttgtccatcagcgaagtccattttttatccaatcgctcttccatctccaacatttgccggcgaaactgctgatccatttctttgcgcaggatatcggtttggagctcgacttcctcttttgcatcgtcctcaatttttcggacccgctcttccagggcctgggtttgctcagaaaccagctgcttcatctgcgtgaatgcggcaattgtcaaagatgcggcatctatacgagcaatcattacataacaaaaatgaacaaatgtttatttataaataataataaatgagcattacagtacctctgtccacttccgataagccgtttggcaccgaagtggacaataacttccgcttttttgatggtgaattatcaggtagcggtgatgatgatgatgataatgatgatgatgatgaaattgttcgttttaatgatgcgagggcagtttgcacaactgcaacctcaacattgccgtggcgcagaatccgatcggccatgacgtcgtgcacattttcttgttgcttcaacaaatcgaacgattcacggagaacggctggtgaaattgatgaagtcgtgtcgagcggataaggcgaaaagtgctaaaattattatcacta

SEQ ID NO: 7443 - DNA, 3635 bp, Heterodera glycines
aaatttaaagaaagaaatatttaaaaaaatttccattaattattgatcactgaaaaaaattcgtctttcatgcattgttaggctttttcttcataggcgcaatgagatcggttgcgcgacaattggcccacgcgcattcttcacagagctcaaagctcaccgcaaaacggccatcttccaagcgcgcgactttctgttgattatggaacagtcggtcccagtcgtctaaataaattttattaaattaataaaatttaaatttaatattccaatttaacctgcgcataagtacgtcgcgagcatgaatttcccttttgccaatttccacagttcccggtcctccaccttgcgcttctttgtagtgtctgattttggtggctccacttccgcgtttggttgattgatttctttttgttcgggaacagcgacggtaacggatttcttcattttggcaaaaatgaattgggattcgggatggtaatttaaatttgcttgaaaaatgggtggagtcaaatttgaatttggatgggcgtggccaagtttttgagtataaaatgagtgtccaatttgcaactttatgtaatccctctgaaatggttcttgtcactgtattttgctctaaactgctgaactgtcagcccaagtcgctgcgcgatcggttaaatcatcccgaggatcggagtcttgttctgaagcatcttattggtcgtaaagtgcgcacgacctacaacgacaggaacggaatgaccaaaacatttttcgtcggcggcatttcgactaaagaggcggcatttcttccagcatatgggcagctgcgcagtccatttaacatcaatgtagcagcgcatttctatgcgcgacaccgcataaggcttcactttccctatttaccgtgcattgttgaacactttgggggaggaggtgagaatcgctactacccaatggagcttcttgacctgattgatgacaacaacaacaataacaacaacaacaacaacaacaataatgaacaatggttgggctgccttttcaccgaaattgggtcaccatcatcatcaaattcatcgtcaactcagacactgtgcctatccattgatgaagagatgacagaaaacaatgggcgtagtgagtgcagccaaaattcgtcattatattggtgattttttaaattgtttcttttaacgactaattttgcaattttcctccttaattcaccgttctgcattcattaattaattatgcgttctaaaatatatttccttcacactaattatgcattttcccacccaaaaacgacatcttcttcttaataataatgctttatcagaaataaaattgttataaagtgtgaccaaaattcaaaacattaaaattaggaccaacaattcccttgcccacaaatggtcgatagcacttttgcataggcatagagacaacccgaccgccctccctgatgtttggccggagaaagtttggatatgtgacgataatcggttcataatctcctcttgttgcataattgatcacttcctctttgaatcgttcatagcgcagtccctggttgttgacgacgtcgtaattgagcgtcatcccccggacttttagcacgtactccgactcagcatcgggtcccgcctctttcctccgcagacataaaccgtacttaaacaaataacagtaatttgtaaaatgtaattttacaaattttacttgttttgaccctccgctgcagtactccacgatgtcgtgatcggggtactcatccgtgaactgacccaaatgtggaccagttttgagtgggcaacattcctccggatggacgaggatcagactgtcggtgtctgtaatttttcaaaaattattgtacgaagatttttgttcatttacctgtgtacagtagctcacatcgctctgacctgaccaccttttgcattgcctttagcaaaacaatccgcgcagcggaagtggtccacaaagaaattactgtaatttttgattaagcaatatttaaagaaaatttctcaccaatatttgagcaagcgtgctcatccacccagtccttcttgtgtagatatgtgatgagaatatgctccccatccagctgatcaattgacgaaacttcaatcgatttgttgtccaggtactctgctaatataactgggttgtccgtaatcagagtctgcgacagcccgtagtttcgtagtgaaaagcgcccccctaaattaaaaatttttaaagataactaaaaataaaaaaatgcttacataaattgtttaggcacaacttggccaaggaccgctttcctttgttaaccaccattttggttgggtccacatttataccaaacatttcctcgcactctcgtacaaactgctcctccatagcggcatttcctttgatcatgctatcaaacccgctggcttggatcttttgcgccataaattccgcgatgtatgggcggaaaagttggtcgtcgctttgctcgtactccaacacgcggaacaccttcgtgacgcggtagccctcatccaaagccgcattcagctcaattgatgtgcatgtgctgacccatcccctttgctggtcagtgtgctcgcagaggtagtcgttgttcactcccccagtcgggtactcctttgcacaactgatgcacaatgggaagcacaatctgtcgtccactttcaccggcaacaccgggacatcgatgcgacggggaggcacaacccagaccttcagcagtgccaagggatatgggttgtccaccgcactgctccagtccacttgttggttcagcacatgtactttcgggtgtccaatggggtatcgggttgtgaagctaaaataaagattatttatctgtaaatttaataaaaaactcacttcacgtatgggtaaagggatgtgaagtcgtagtaggagatcttctctcccggtccagccctgcgcagcaatttcatcggtccagtccgtcctcccataaacgcatcccttatcaccaacggaccgtcgtccacgtaattggcaaagcatttccgcattgctttgctccgggccagcatttccgaaattcgacattcccagtacacatccacgcgattgcaatatcttctgatgtactccatcctcttgccgtctcgctcccgcacctgtcccgctgtttttccattgggaagcaccatgttgtcatttgggtaacatttcttacatccgtgccacgtacatccttaaactcatgattaaaaaaagagggaaagccggccgccttaccgttgacttcgattgcgcggctttccgcttcgatccaaccgtccaggaagtacggcccgatccgcttctctcccccggccgaatgcgcggtttgtatgtcgacaccgtactcctcggaataccaatggaaaaaccgcagtgccagtagactttggttctgcgcgttgtcgtaaccacgctcgggcacaattgcgaggtgttcgggagggagatgattcgtgcgaaaatgccgcatgcacgctcccgcaattgtcatgcactctcggagaacatcaattccatcgtgattctcacgctcatcaatcccgtcaacgtattcctgtcgtcgagaaatctcgaagaactcgcgacggaacgcaatgagggca

SEQ ID NO: 7444 - DNA, 1390 bp, Heterodera glycines
ttttttgaaccttaaccaagtttttctaaattttgcaggctaatagaagacagatagggctattgaataataccaagattgttagatttggttataaaaggaaaaagttatagccaaaaccccgctggggtccaaacgtgccggggcccaactgagcgagtccgattttgtggggttttttagaaactaaaaatgaattattttggcagtttttagcaactataaattggagccctactcatcagtgccagaataagcccttaatacatattatctagtaaaaatggcaaaagacattccgccgatcaccaaatccatcaaaaatttccaattcttgtttcgccttgctgatgacttttttatttacggataacaaataaatttgtctcagaatcgcatttgaccttttccgtcatcactagggaagcaacttttagtgaaaaaactttttgtttgctcaattgttttgaagaaaggagctcaaaaaacgcatttctgcgttaaaattttttcatttggacgtcacttttcgtcactagaaatcactattttggcgatttcgtcactaaaatagctaaaaatcactattttggcgatttcgtcactaaaatagttaaaaatcactattttggcgttttgtcactatttcttcattattttggcatttttactcactattttagttaactatttcgggatttttcgtcactaaaagttgctaccctagtcatcactcatcagcaacggcatttcccgtgccccgtaactgctcaagtttcactcgtcattctcattccaccgccattttcattgtcctctctctccctctctcttccgccctgtttctttcattttccgttggttcgtcgtcactccgcccgattaatttttttcccacccttttcttaatctttgatcttaaaatgtcacaattattttaagcaatttttagcaagaggttgaaaacggacggtaaaacccaactcgtatgtactgctaccgattcgtatactttttttgataaaaaaaatattgtatcataatttttgtcaaaattttcattcaaatgaagaaaaaaaatcttggtttgattcgatagcttcttaagtttctctatttgtatggaaaatttcaaaaaatttatcatctttcaaaaaaggtatgtacgaaatctttttttgtaacgattttcgtcaattttatcaatgtgctgaccgcttaattgcacataattatccacataaattcagctggtcactaatgatgatcaataccgaaagttccccgtactcgagaccgagacaaaaaaaaaacacgagacttttctcaagacgagattcgagaccgagactctcgagcatcacacaacactatccaccacagaaatgac

SEQ ID NO: 7445 - DNA, 1463 bp, Heterodera glycines
gggggggggggggaagtgccaaatcaaattcaccaaattgttttacttccctttgctgccccctcaaaagcggctcgcatttcccgtcaatgctcattaaaaaagccccacaaattggcaatttgtttttcggcaaattgctttaactgccctatgccaaaatgaggcaaataatgccaaccgtatataaaacagtgaagtgaaaaaaatgccaaacgcaaattggcacattctcatccttttggcattaacaattgttttgagtcaaagcgtcaacaatttgatgtgtccaaaaacggcatcatttgttgccccattttttttgcgggcaatttatgtgggcttttgcaaaggacggcacaaatgtgccaaatttagctgagcaattactttggcgaatttgtccattttacccactacccccactcacatccatcatcaacaggatatgctatatgaactttcacctttactccctcaaattgcgttttttagtgggtaagtgcggtggcgatgggttgaaatattgtgaaaattgaaaattcaacaaaaaaaatttagtttggctaaaggtccgtccatcaaaaatgaaattttccaatttttgtaaattgcaacttttctgtttgtttttaatttcttgatggagttgtgaggtgctaaaaaattacgaaagttggaaattccgagactcgccaaaatttcggaaatcattactcggattccgaggcctaaaaatatcggaatttgtaaatttcatgccatccttgtgccacgtacctaaaaaatttcctcttctccccaaaaattctctacaaaatcaaaagtttcgcatttgaatttacgatcttttttcatcgtttttatttccaacgcattccatcgttttattcgcttttttcggttcatttcccggggcggcaccgccggcggcactgctcaaacccaacgcacgcaacatggccatccgatctgtccgtccaaaaaaaaaattcattacgtccatccctaatcctccgcgtgggcaccaaagtcccaaaccccccccccccccctcgtccaaaaaatgctttccgctcaattaaatggcccatcaaccccttttgggtggcactttttatgccatccttttctgctaatgttgttgccatcaaaaatcccattgatgtgaaccctcctcttccatggtgtgtatttaatttcagttgctgggaaaagatttcctcagggcacccgcgattttgttgctcattgtgagaatgcaccctcaaccattttaatgccatggcatttgttttgatttgggcctaaatttttagggcctaaaaaccgttaaattagcctacagaatttaaaaaaaaatttgttaaattttccaaaaaaattgtagctaaaaatttcaatacctgatcctctgaaaatttttggccttactaacttgtttaacttgaaaatttttttga

SEQ ID NO: 7446 - DNA, 2156 bp, Heterodera glycines
ctcacagtccatcacatccgttgcatgcggctttacaattttccacgtttttttgtcattctcacccaacctcctgttgctgacaaatttgtggggtgatttttgggctctcactaatcccctttggtccccttgccccccccccccatttgccattcccatccaattttgatgatggctttttgttgttgtgcgccaagggggtggcagtggtgcgaaaaaagcgcggaaagggggggggaaggacggggagcagctgcttcatgtggatattggtggtgggattatctagcaacagtcgaagcgccaagcaaaaaaaaaaattggacttggccaaatgagtacggaggcaagcggaaatgggaaaactgcggcccaccaactgcgtctcccctaccagaaggtcatccaccaccggaaatttacacccgttcattttgcgcctctaccaattgcgcccacatggggaacagaaggagccctttgccccgcgctcaattggcccgcactcacttggcatgtgcaccccccgccccctcccaactcaaaaattgtcgggtctatgacggttccggccccggccttttcggctccggggacgtttcggctccatacgtaaaaaattttcaattttcaaaacccataggtctagggctttttttttaactaggcttagttattttaactgttaattgaccggatgagagtcgggggccctggccgaccagcgaccagctggcagcagcatataattattatcatcatcatcatcatcagctggcagtaagcgcacgcccccgccgccgcgcatttgcaccagccaacagcagcagaagcggaggaggaggaaaagcatctgctgcttctgaacaatgcccctccccccacccccgggcgggggacgaaaagcgctttttatccctccgcccccgccaccctcgtgtaaaaaaaatgcttgcgcttcttctgtgtgcttctctcctccccctccattcaccccattgtgttgcggtgatggatggctctgttgatgacgaattttgatgggattgggtgggccattccattcaaatcccctcaaatcccccccccttttccctctcacttttcatcctttttttatccttccaatgtcaattgttccgatggatggaattggaggaattgggtgagaattgccgcctcccctccttccctcgggagactttttatagcgcgtgatgatcaaatattggcgcccaatttttacactgtggaagccaattttagaaacacagtgttttctcagcagccataaattcggcacctgccccatttttccatttttgaatccccacttccaatgctttgtttcgattaggttttgtgattgtgtgttagccgcccttccccattcatttttgccgttttatcatatagtattgtactttttttaatttttgactaattcgagaatctcgacctaatgtataaaaatcggcacaatttcaaagcgcccggctgaattttacaaaaaagtagatacgggcgctagcgcccgtatttcaaaaaattttaaaaaattccaattcgcttttatatccaatggcatatttaggtagcgaagctctcaaagcgcgcagggctttatcccagcctagacccgtctattcacgcacccgcttgttttttaaatatgctaatttgctagaatttcaatcccaaaacctcgagatgtcggtgtcgaaacttcccgatttatccaacatgaaatcccgaaaggtagaccaatgccgagacctctgcgccgggatactttactcatgtcgagatattgcttttggcccaaggccacttgaatatcatcacattatactgaccccgaaactctcggccaagtgagttttccaccaaaatcccacacgaattttcacccccttaatttcctacaccaaccgtcgaccattaggcatgtgccgtgccatcattcattcttcatttcccgcttttctcccccgtcggcatttccgaccccatcaagaaaattctttgcctaattaaagccttggggcgctcccccccccccaaaaaaaaacgtgcccatttagtagggcattttatcccatggccacgccccccgggggcatccctcaaaatatcaaacaaatgttttttgg

SEQ ID NO: 7447 - DNA, 2274 bp, Heterodera glycines
cttgtgccagagacttgtcaagacttggccacaaattgtccttggtagagactttgcttgcccaactcatacgcttagccttggcttcttttgcttggtttggccattctccgcccttggccatcccttactcttggccaacttttgatgttgttcgtcctccccctcccgccctcatcaatcccatttcatttccgcctcccccctcactctccaatttcccactcttcccgtccaccaccactgtcacaaaaaaaaacagctgccgttaacaccacggcaccgggactcagtcggacggcgctggtgcggcgagccaaaagccaaccgaggcccggtgcgaaggcggaggcaaaagcagatgttagttgttgtaatgggtggcacatctgttttttgctgctttctattgccactttcgtcctgtctttctctcccctcccccttttttggtgcccccgccttcgtcccgagggcattctaatttgtgtgtcagtgcctctctttgacatttccgcacacccccttgggtgccaataatgaggccaacttgacgaatggaacgggcacaccaaaggttatattggcacaaagcgatgagtgatgggcaaattgacaggacctcccccccccccccccccccccggggggggggggagagaaagttgtgaaattccgggaaaaatccaccaggaagtcaaatgccgcataatttggcgggcgagggggagggagtgccggggcggctggacatcattaaaatgccgataaatgggccacttcagcctcaacttccggcccttaaactcctaattgtcccacggggattatgtttggagcagtccaatccaaaccaatttctgcgtctgaattcattttaaatgtaaaaatattgccaattttatgtgtgacagtgccaaaattcaaaaactatgccaaaagccgtgtgtgtgttctttctctgcttttcaagtgccaaagttaaaggtgccaaatatctggcgctcgtctctaatccaaaaccgatggagaaaagtgttttcaaaaatttggaatgacaagcgaaaagtaccaaagttcaaaaacattcattcgttaagtgccaaacacaatttgactcacagtcttaaaagtgccaaagttcaaaagggcaaagtgccaattttgaaagacctgtcaaatccatttttaaatatattttttatctgactaatttctctaattacataggcatttgtcattacctacctattttagggagttcttttttcataataacatgtttatttggaggattaaactgtttgtttttatgatgaaaacgattttgcacccaaatgccaattaaatgcgctaatttctgccatgctttttccgctttataatcccacttaattcatccgtccattaaaatgccaccatcggtatttggcattcaaaaaaaaaagattaatgtacccattaaaaggctgacatttgccgtcaacaatagcatttcataaaaagcatcgtaatattaaattttcccaaatttttatgccaaaagcacaaatttatcccatccatccaaattacaaatcaccaaaaaattaatggatttgaatttattgtaaggaattgggtgcttcaaaaataaggacagtccttacaaaaggacatggtctttaccaaggacaatttgttcgttctttccctctaagttcattattcattatgctggtgccgcattttgccggcacccgccggagccattaaagctattagacggctcattaaatatttaattttggcaccaaaattagcattttgtgccaaaaaattatagccattataaattttcaaaaatgatgaactgcacattaatgcaacattcatcacatcatcatcatcgccagctgccattccatgccattcattggtctttcatttgtttaattagcgcccattcatcccctcggggggcgtgggacggcatttatcgtcacgcggcgtcccctcaggtgccattttatgccgctcctttttttgcattttcccatttcattttgtccatggtcctttgtcctctttatgtgccgtccgcctctccaatgagcaacatcagcagatgttattgcttcttctgttaatggtgggccaagtcccgtttttggccaaaaatttctcttggccattcagtcttggcaatgatttttagcaaagttctgtttgagggcacattgcatggcattcccgaggagtggtttaaaacttggcatgccatggaaacagttt

SEQ ID NO: 7448 - DNA, 3292 bp, Heterodera glycines
tagaaaaaattaagaaatttagaaaatcgaaaaatttgcgtggacgaagcgtagagtttgcccactaaggtccccaattcccccattcattcatttttgcaatgccttttctctgccctaaaccaaatatgccattgtttcggactgccaacccacacgcactgaacagcaaagtcgtccgtggcattgccaagcagcgcggcattacgcctgagcaagtgttcttccgattcaccatggacattggcatcacaccgctcagcggcaccaccaacgggtgggtgccggtttccgcgagagcagttcgcccccaccccccgtatcaaacttaaaaaatttttaagagaagttcaggagaaagtttttgaaattttttagcaattttttcaaaattttatgatatttactaagttttaaagattttttttttgtttgaaagatttctagcttgaattttttaattttcgaggggaaatgatacggggggtcgaccctccctgacttcattcgtatgagaggctgaaaaaggaggggggggggggggggttggaacttcgtattggtttggtggacaaaaatgtgaaaagatgtggggaaagattgaagaggaagtgtaagagagagagagaggcgacttcgtaaaaacgaaaacaattaaacaaattaatcaagatatttacttttttctgaaattcaaagcacatatttgtttgcttgttaagcgaacacatggcacaagacgttctggtgccggatatgccaccactgagtgccgaagaaatcaagcaaatcgaatccattctttatggggatggctgaagaggacaaaatttaaacttatttccagatcattattgataatcaggaaccaattcactaattgctttataaaaaagcgaacacattctgttgaataatatttattccaattaatcacaataaatatgaaaatgctaatttataaataaattttatgcaacaaatcaacagaatcagtcactggaacaatgggttctcttaaaatggatactgagtgtattttagggttcggacctcgtgggcgagggtggcttttcgcgggggcgggggtcagagtcgcgggggtgagaaatttctcgcccccgtggacgggggcgggggtttgtttttaattagctccaaaaaatctcacaaaaaatttttttttttgaatgatgtgtttggctccacattcctttattcgatgtatcgcctcgattcaattcttttttggtataattgcatagatattgtctaaaaatgaccaaatttaaggattataaattatgccaaaatagtcaatttttatgggtgtttttgtctaaatccagggtttctatttcaaaattttcaaaataagaataaaggccaaaaaataagattttagggtcaaaaataagaacattttgcaaaattgcttcaaatatttttacattttattcgatcaaaaatgtattctattattatatttttcataaatttcagtgcattcgggatcactaaatcagatttttaacattttttgcggcatatttccaaaaaacttggtgaatgtgcgaggggagaggtccggtggtgccgattggcgccgcaagcggaaaatttttaagactatatgaattttgttagaaattagccaaattttttagaaatttcccttatgcctataattttaggcttatattttaaaaacttttatcgaattagctctcaatataaataataaaattgcactgaattttataggcatattccccggtaaaggactattaactagagaccggaaatttcaaatttgcggatcccgctgcgggactggaatccaaaattttttgcgggacgggatcccgcgggattaatcccgcaaatcccgcatttaaaatttgcgggatcccgtgcgggattgcgggattttggaaaattcgaaaaaatttcaattaaatttcaaaaaatttccaaaaaacaaaaaatacctgacattttgaaaaagaaattttttaggggctggggtgcatttaaaggggctgatgggtcgactaagattttcaaatggatcagcagactgtaaaaagagatcgggaaccaaaatctcctaatgatccataaatttgaatatttttgcttttcaaaaccgttttttggtgcgctattttttcaaaaaactaggaacagggtggggggggggcccgccgtagaaattctttgaaatttaatacgatttgttaatagattttgtaaaaaatgaccaaattttgtaattttgagtgaattttttaaaagagaataatgtggaggccatccggcgggttacctatcatttcgtcactgagaaataattttttaaaaatgttggcaaaatgtcattatgtaaattattttcattaaataaaatatttttatttcggaaatgtttattaaactagcggggagataattatattgaaaataaattctgttattatttttttaaatatatttttttaaattctttgtttcaagcgatggaaaatatgcacaaataagagtgcgaattggccagtaaattttaattttcggctaaaggatcgctatcttaaatctgcacatctgttgtttacttttttatttgaatgaaattgaagaaataacaattagtacatattattcggttcatcgcagcaaataaacgaaaataagagtttttttaccaaataataactctttctgataagcaatttcatttttctgttttggcttaaattgtttttaatttgtgtaaattattagtcccaaaaatagtcttaaaatggacaattgggttcaacttcaactgaaagggacaattgcgctcaatttaaaaaaatatattaaaaaaataataacagaatttcttttcaatataattatctatttaataaacatttccgaaataaaaaatattttattaatgaaaataattagagatcgacattttgaaaaaagcctggacctggacctggattccatgttggacctggaccttgatttcctggacaaaaatccaggaaaatctaggtccaggaaaaatccaggctcctctagacctggatccaggcctggacctggattttttgaaatttattttaacaatcaaaaaaatgtttgaaaaaattaattatttgctagaaacatctaaaaatatctaattaataataataataatgtgtttttaaatttatttaatctgtttttgaaaacttgaaaaaacatcggtcacttgaaaaaataaattctaaaattttgtccagaaaatcca

SEQ ID NO: 7449 - DNA, 1411 bp, Heterodera glycines
  misc_feature (721)..(721): n is a, c, g, or t
  misc_feature (772)..(772): n is a, c, g, or t
  misc_feature (780)..(780): n is a, c, g, or t
  misc_feature (785)..(785): n is a, c, g, or t
  misc_feature (792)..(792): n is a, c, g, or t
aaattatcactctggggattttttagatcgcttaacatctgcttaatgatagtttctaaacacttagtgcttccgaataacataaattttataaaaatttgtagaaaaagaaaaaagttatgaacaaaagattagttttctagaaaattttttccagatgaatttttctcgaaatttttattattttttccattttcaaaatgattgatcagataaacgcatgcactgattttgcagagagcaaaatgcttgggcaaaaaattttttccaacccaaatatttcctatccatttcaatttgtcgtgacggaaatgcacatgaataaaaaaacgaataaaaaaaacgttgtcagacggatgcaaacaacattaataactaaaaaattataacagcaaatcaaaacagttttattcgaaatatatttctgataatttttagattcgaaaaaatgtatttgtcaaaaataatttttttatttttttataattttaatggtgtatttggaatttatgaaattgatagtaaagaggatcttaaagatttaaatgtaaaaacggaaaattgtaaaaaagtaaagatagagaatttttctgtttctgtaaaaaatgagccaatttttgatgataaacatttggtggggaaaatcggacattttgcagaaaatgcgactgatcaaaagcatgaagagtttgcgattaaaaaagaatctgatcagcagagnatttattgtattgatgaggataatggggatgaaaatgggaaagtaattttngttatttngaganaaatttntttaggtgtataaaaaaagtctcggtcttgagtctcgatcgaaaatgtagactcagaccgataacttgagccgagcccaaaaaccgccgcgagacaaataaattttatatatggcaatagttatgttaataaatttagccaaaaaataaataaaatttataaatgtttaaaatgtagataggtataactccaaattagtaaattggaaaaaaatatcgttaccaactttaaaaaaactaaattttttcgtaaatttttttatgaggtttatttttggtaaataatttttagatatcctcggcagaaacggatgaattggaaatggtgaagcaatttgacgtaatgaaaaatgaattgcgactgaataaaaactataaacaattatcaaaaagtaaatttgaagcaattgtagcacaaaaattgggcaaaagccgtgcacaaatttatgcattaaaaaggaaattgaagaaaaaatatggaaaaataattaacacaaaaatggaggaaaatgccgagacaaaattaatgataattaggcaatttgatgagatgaaagcggaagagaagcgaaatggaaaacttaagacggaaaacttagtgaacattgaggaacaaattg

SEQ ID NO: 7450 - DNA, 1220 bp, Heterodera glycines
attctgtatttttacacaatttttggcattttttgatggttaaaagccattttgggtaatttttaaggcatattttagtgcatatttgggcatttttcgggtttttagtgcatatttgagggatttttagtgcatattttatgcgcatattttcccattttttagtgcatacaacttataaccctaatgatcagcgagcgacccctaaaaccttttggaatagcgcccataattttttttttctaattgaaatattatctttttatataatttttagtcttttttttcttccaaatattttaattgaaaaaatatttcatgcattgaaaagtctgattacttttttttacttcattgtccgtccaacttggggcattcattccttttttaaacgacaaattccttcgccaaacattttttctgcacattttttttttgcgattggcttttcgtctcccatcatttttctcttcttcttttgctgcttctgatcaaatttttacatcattttttttatcacctctgtctgatcagcccgcttctttttgtttgatcacggataagtccagcacatcgccaaatgtgctatttttaaaacagccgttaacccctgtcccgcccgccgctttgttcctctttttccaagccgaagttggttggggcttcatcatttttaaaagcagcagagtgtgaaatgcaaacttaaaatttcaaaatcttcattttcaatatattttatgagaaagtttggaatttatatgatatattaacaatttttagccaaaaatgctagagactatgaatattattaggtaaaattttaaaaatttgcgcccggaaggtgtgctgtgaatttttttggcatttttatgcatttgtaacagattttgcctaaaaatgccatttttggacatctttgtgcccaaatttttgcatcaattaacagaattgataatcttcggaagcagtgccgacgacaggcgccgccggagacataatttcaaatttagtgcttaaatgggttcataaaaaatatttatcctcatttaaaaaattgccacaaaatgcggataaaatatcctcagaattcacagctttgctttaagcggtgttcgtatcacaacttaaatttcacagcctcccctccctgaacattaagctttcccacacaagcaaaagcagcttttcccaacatctgttcacacacatctctgtttact

SEQ ID NO: 7451 - DNA, 2678 bp, Heterodera glycines
cattttagaaaacattttgctattttggatatattttattacgtaatttcccgtctctaattttcgcttggatcggatttcctaaagtcgtgactaagtatccttaccattagcaatccattagaaaataaatgatgtgatatgtataataagcagataagttgtggaattcagccatcatagaagaagcagaaaaatgacgaatgatgatgaaaagcctctgattttcacagtgacataaccggcgaattgaaactcaaataagcacaagaaatggatcataaaattgcatttaaatacaggctttacatatttttgaccgaaaaagtaaatcctcccaaatcccaaggcctaacaaaaataatcatattgtcatatccgagaaaataagctggaattttttctggctccacaaccatcagcttatgcataaatcgaggacgagaccgaatgaaacaatttttaagaacaaacttttatagaaaatttttttctctttttgggttattatacaaaagttatttcaccaaaatctaaaaatttatatagattttatgtccttattttattcaagccgttttcgcaatttttgtcccaaaaatcttatttttctataccatcaacatcattattatcatcatcatattagcagcacccaattaaatgtaatttgtgtggactgagacgggaaaaagcgtggaaaaaaaggatccacatcccaccaacgaacgaacgcccttcccaaatcccaatgggtggatttgttgtgtgagaagaaggcacttctgttgaggacacacacaaattttctcaattcatcgtcgtgaaggggatatttgggctttttttttattgatttagccatcccttcacaagtgagcatcccttaatttggttgaagcaaattaaattcaacatttcataccaattttcgttttaatgaaggtaattactaattggcaaatatataacctatttttaaacttttaattaggtaattatgaattgttgaatatatgacctattttaatttgttaattaggataattgctattggcaagtacattacctgttttattggttttaattaggtatgtaattatgaattggtaaatatacatatgtacgattttttaatagttttacataattagggtaattactaattgacgaatataaatgattcattatgcacttttagaaagcctaagggtcgatttttcaaagaaaaatattctccacataaataaatccttttaattggcccaaataatttacagcatctttaattttttgtgtattatatacatatacattttaaatatatattgaattttatattatttatttttaggctaattttttcaatcagtttttcttaataattttattaaaatcccctaaatgtatgtagtacatatatcttaatttaatttgataaattccatcatggtaattcaaatttttaaaatttggtcaaatggagactaaaatttataaaaataaaaaataatatttttaattatgtataaattcaacttttatttattatatgtacaaacatatgtatttatttactacagaattatagtggtggaaaatgatctctgatacattaaaatatagtgtgtctttctcgtttattttattttattttcgtcgcattgttttccatctctttttgagcgtggcaaccagcagcagaacgtaaacaaactgtttccaaattataaatcattaaaattcacattttttctccgaaattttacccgtttttctattttattttagtgtttgaaatttttttttttttttttattaatatataataagggggtattccatgaaaaatataccaaagtttttttttcgaattgtagtgaattttggtaagaaaaaaatgaaaatcttatcaagtttgccctttccatagaaaaaacgaattaaatttttcaaaaaatcgtttttcaaattttaaattggccatttttctctatgaaaatttaattgttttttttttctttgctccggcactcatggagtgaaaatatgggaaaaatcgttttttcttcgtttcgttactcactcaactatacttttaaatattgtttataatgattctcattaatttattattttttttccaaaaattttaattaaaaataaaagaaattttatttttaattttgtttaccaaacaaaacatcccaatgagagtggaaaatatatatgttaggactccttcttttttcattgaattattgatgagaaggcctcgccaaccgacgcctcatgcatttaatggatgagtcttttggccatccaccgcccgcccacccattggcaaattccagccgaaggcacacacaccaaattgtgcggcacattttgttgccccaggcagagagaatgggacggattagcttcacgcaaaacagtggtgggtggcactatgtctccctccattttagtgaaattttgacaagaattcttgggccatgtatccaaaataagaatggaaaaattttttcccatttttcttttattaaatttttgtttttgttttaatggattcttccttttttaaaaaaaaaaaaaaaaaaaaatttttggggcccaaaattttttcgggtaaaaataaaatttttttaatttaaaaaaaaaaatattttttgaat

SEQ ID NO: 7452 - DNA, 828 bp, Heterodera glycines
tggttgacaaagaaaaaagttatagtttttaaactcgccccacgcgaaaacggcccacgcgaaaacgaccccgaccctaaatagagggtattatatatatgtatggccttgatcacattgatcaacatttaaattttaaaggggaggatcaattggggggggaaggcaatgctgtttttaaatgaatgaaaactgctgatcacattctctgtcattgcccgtgttgatcttgtgacgacgacacactttgtcagaggtgatcgaaaattttcatgaaaattttcttccatcaaaatccgtcatcaaattttataattcttgtaaatttaattgcctctaatagtgttgtatgaatatttgtaattcagcagctaacagtttaaaaaaacaataaaaaaccccccaaaaaaaacttgataaaatgccgtagcctcagagagcattggcatcaaataattaatctgatcattttttaactgggaattctggtacctaaattttatcgatattcaaaaaaaaatacacatgaattcaaaggtttcgaccaattggtccccaaaatgggtggtgggggtttggcaaataataatgatgtttaaagagtgaatttttcgacgacaaaaaatttttgattgattatgggagcacccgcccgataaaaccgataaaatgggggctgatcagcaaacagccccccggggcgattgggtcagagaggaagccgccgacacaccaattggctgctgactgatgactgactgatcatcaatgattatgatgatgattatgacacaaacaaacaaacagcggtagttaggacgtccgggt

SEQ ID NO: 7453 - DNA, 1563 bp, Heterodera glycines
  misc_feature (1132)..(1132): n is a, c, g, or t
tttttggggtccaagaattcgaatatcttttcggcaccttatcccgaccctgatcccaacccttttttccttgcatccatagcattttttggacccggaattcagtatttcgaaaattgatatcccgaccgtggtccaccaatctcccttttccccaacaaacattcataacgcaacaaaatttggggctggctctccattgttcaactctcatcaaaaccaatgaattttgcttgggcctgacttgtcccgtcccaactgagtacacaagagagccaaaaaataaaacatttttcgtttgcccattttggcggattgaaaatgttcagtctccccgttctccgttcacaaacacagctcccccccaatctcaaatttcgcgcatcaaccaatttcactctcggttagtttcacaaataaacaattctttgccaaccccgcgcctccggggacggcggacggggcggggatcgggcgagatgagtaataaataccccaacccaacccccgcccccccctctctttttaatgtcatataattcacacaatgttcttcacttcctctcgagagtctcgacaacggatgagggcatatacatatatgtgattctgatcattttgcgttttcttcaacaatccaatcactttctctctatcctccttgaaaagttgttcccactagcccccaaccaaccttttgtgtgccacctattcttgagaatatttattttcgagtatcacctcccctccaccttacaatttcaaatcataatttcgggcaatctggctaaatttgacaaaatttaatatttttttaattgaaaaatgtgctagctaaattttatctaattatttttcgattctttttcttaatgttttattttaatttttgaattttaaagctagaaaattttgccttttatttcgtttaattaactcaccatcaaatcatcatgaaactggtcttgttcggcgttattcttctcggcaccctgctgtgccagtgccattctgactcggtggctgttgaacaggtgttaattgacattcatttattttataatatgaattttttaagtttgtagaagcctttttttacttagtattgatgcaaatttataacaaaaaattntaattttaattaatgtcaaaaaaataaaaataaatttgacgttttgccggtttttagtcaaaggtggatgccgtcgatgttggagacgcgccgcacatgatgttgacgcgggcaaagcgtgccagcggcggccgatggaccacgcagcagatcatcgagtgcattttcgcaattttcatcccgcccgttgctgtgctgatccatggcggccacgaatgggtgctccatctgatcatcaacatcgtgtacgttttgcctttttttgtgggcgattctgatcactacttaactgagttggattaattggtgtcagtcatcctgattctgatcaatgcttggtcacttaatgtcagtcgtattgatcataatgtcagtcgtattgaccagtgtccgttgtcctgattccatgcttgatcacttactgtcacata

SEQ ID NO: 7454 - DNA, 5401 bp, Heterodera glycines
  misc_feature (13)..(13): n is a, c, g, or t
agcaacatcaaanttggcttgaagaaagcattcaccgaatcagtacctctgttgccgtccaggttcggaattgcgttgagtgtcatcgtatatgaaaaaccgtcgaggcttcgaatggcctgtgccatcatgccatcgaataccagcccagggtgggggaccggttgctgattgcactcaggacgattttgttgattggctcttataggtaggttttttttgaaatttgggtgttgctgtccttggtgaaactcaaatccttcgtcctgggaccgacggtgtccttgtgtataggcatgtggcggaggaattcgccgaacgtgtgattgttggtcctcaacaaccggttgctgtgtgagccttatctgctgttctctctgccgctcaaaattaaccgcagcgttttcgtacaactggccattgggtcggcaagcaatcggattcaatgcagggaaattatgcgcgactgggtttggcatttgattttgcatgaaattcataaccctaatttggttttgtatgacgctcaaattttccggaagttgcattcttaggtctcgctgcagagcgcttagattttgctcgttaagcggcgttgaaaacgctcgcaacccatgtgcgtccaatgcatcgtttccaaaactccctctatccccagcttcaactccattttcgaaattttgttgcaccataccgttgacattttgttcgtcgccgttttccatttcgtcgtactccaattgttcctcaggtgcgctttgttccattcctccgtaaagcaggcgacgacgaatctcagtctctgctaaaacattttcatgattgtcgtccagtcgctgattttcgttgtttgctaagggcgagtcggcctgccccccgaaactccaaaattttcagccctaattgcgtttccatcgcggtcaacaatgattccctggttgagtgccctcgtccgggttagtggtggcgttcggagaacaggcattttgtttgagctaccgcagaggtactactcaacaaaacaaaaacaaagttaaacggcgatcctcgaaaaacggcccgatttgtcggtgatttgtcgatgtccacacttatcgcaacaatgcgttatttgtgggacacaaatgcaactcgaagaaaagcgcaacaatgcgttatttattcagaatcgcagctatgcgtttttctgaaatgtcccttgctcctcgtcctcactttgttgctttattgcccctggcagacaggcaagcaataaacggcgagataacgaaccccggcaaacgggctattcgctttgatgaacaactaagtaaagctccgacagacggactacttcacttttgttgaattcccgtgaaccacaaatttctcccttccaattttgttcccgagctcgccctttttcgaaaaaccaaaaattcccggcaccgcttactcagttgaccaggagcgccacgtgcaaaaattggagtccaattggtcggaggggctcgtctcttttgctttgcttcgttcggcttttcctcttctcgggccaaataattaattagcacagaaaggacaaacggggccaatgcttattaattaaggacggcgaaatagtcggggacagttcaatttatttaatttaaattcaatgcgaagacgacgaaaattaagagtccacacacaaaatatttagaggagaaaagtctgaggtccaaatttgtgaacaccaaatagaatgaataaaggaaagcacaagggagaagaaaagcaaaggaatatcgattgagaaaaataggaatacattagagagaaaaacaaaaggaaaatagcatataattagagaattgaattaaaagaataaaaggcagtcagaggcaaaggaaatggcacataattagagaagaaaaatattatagaaaagccaaattatttcccatttaacacataataaaaaaattttaaaaacaaaaaaaaatttgggtataaattaatcacttatatattttagtgaatttatgagaagcgattttcacgcattgcaaatcacggacgttggcaatgcttcttcttccaatccgtcgaattttgagccattggcacaaattgtccgttggcattgggaccaaaatggggcacaacaaatcattagtgtaggtttaaagaaatgatcaaacttaaaaaatgcataaattaatcaattaaatcatttagacccatacacttaacaagggcagtgaagttaattacgacaacattgctaatgattcatcaattgttatccgaattctcaaaaagcgggagacaaaaaagtaaatgtgattgattaataataagatcgaaataactgatttttttaatttgagtcaattagaatttccatatatttttgaaaaactaaatgcgactgacgcgttttctactgaagcatttttgggatgggtcctcccgatcactaattgatttcattttccgttttttcttatttttccccattttttaagtcagttcccggcgccttccagcagcttacccgacgacgatttgacgatgaaaattggtgacaaacaggtgaaaaacagaaagaacaacagcaacattaagcatcaccggtttttcatggttccatacaaaaaattttgaaaacaatttgtgcttgttaaatttaagtctgcaaaaaacaatttttcggcacatgaaatttagataataatttatgtatggatactgtacattaagtaaggcctgttctgtcaaaaatctatcacaaaaattcatccgcaaatgtgcaggatgtgtaattgccaaattatcagactcattgaaaacaatgggggcggaaggggggagggctcaactttataagggggatgagggcgtaatcacaacaatgattttgatcagatcactaataattcttgatcaaatcgttgatttatcttggtcagatcacttatcaattttgcttacaatcagcagatcgctgtgtccgcccattggctgtcgtccgtttccccggtgatcagtcgcatgatgaaggagaagcagcagcgaatgatcactttggacgaattgggcgtggacatggaccaattcaagcagtttttggaggccatcacttatcttacaatgatcggaccttttctgcccaaccgtaatgccatgacatgatactgtatttattcaataaccccctgaggggtgaaaaatgatttttaattttcaattttttttttaatttgaattctcaacttttagctaaaaatgtgctgatgctgctcaaattggccgactatttccaggtgagttcctctgatcacttatcaaaacctcatttaatgtttaaattttctctatcagcctgtaaaatttttatgaccaaaactattaaaaaaatttgtgtttttttctaatttttttgtaacctaattaaaaattctttaaaatttggaggctaatagagaacattaatggccataaatgaccccaaattcgctaattagtttgcttataaaaaagtgtcgcttcgctttgaggtgaccgcgttgaagtcgcgctgtgaaaagcatctgatcaattgcgtggaaattccgctgatcgaccgtttccttctgattgaacgcttcggactcggcaatttgaaagtgatttatttttcaattaatttaaattatattttcaatttttagtattattttttggattttgatgtcatcaaattgcgtacctttttcaacgcgaaccatgaacaagtctttccttttatcagcaaagaattttttggtgaattattgctccgagtttgtggatgaatgaatttgttaaactcttttgatcaaattgattttggcattttcaatttctttacgaaattaattttcggtgataaaatttgttttattttttttctgatctggattaaaagtatttgttacactgattgtaggcagggataaatatctaaaccaaaactatcatatcatttcatatagaaaaacatttttcttttagatcgtttttctatttttcgcgcactttttggcacattgattaaatcaatcattgtgcccattgaatgcctgatccactcactcaaagtgcctaattcattatcccttcaccctacacaaatttagttttcacctaatttatggatttatttttaaaaagcaattctcttaacaaaatacattaaaatttccaaaattcccaggcggagtttacaccagcaccgtacctcaatttactatgtttttgagaactggagactaaactggtaaaataggcattgtttggcaaaaaacaagtaaaaccctgcaaaacccacacccctaattcgggatttctaaaaaaatgaaaaataatacacctagaaatcttcttttttaattcagcctccccccccccccgccgaagccaagggtatgtaactttacgctttacgcccttcatttgagatacagtacacaaataggtcataagatggataatgagggatactgtaggaagatatttaaggcagccttgttttaaaaattgattgaattggtcatggtgattccataagtttgaaaattatattttttttttataaatttatggttttgtgctctaaaggaattgatgatgatcgacaaagcgatggttgtccaaaccaaaaacgaaggtgaacttataaaaaaataaaatgcaataatttaataattaaaattaaattaattacgctttttaattttaatagtgcctcgaggcgacaacgctgcacatggccgccggcggtggtcacgcaaaaattgtgaaaattcttctggaaaatggtgccaacccggaggatgagaatgctgttgtgattaattaaaaatttttaatattaaaagattttttaaaataatttttatcaagcaaaaaattaattaaaagaaaaaatgaaaaataaatacagtaaataagccagccctaattattaaataattgataagttttacatttctgtcgtaatattattttggtccaccgcacttgaagaacactcacaaccaaatgaccaaataggctttcactttattaaaacacacaaaacaaaataaaacaaagtcggaagacgaggtgggaaccaaacaatcaatcaaatccaaaatactgagaacagcaaaacatgacaaaactctaaggggggagaagaagtgcatgaaaatgagaatgaataaaacaaacatcaataaatggtcaaaacgccaagcaattacgcactaatttaaataataacacatccccggccgctgacgagaggcgtccctgccgatcagctgcacatcccgcatccggctgtcgaaaggtgatgtccgtttgggatcagctcactgccatagccttgaagcacgcgcatcattggttgtcgatcagcagaaggcgaagt

SEQ ID NO: 7455 - DNA, 5492 bp, Heterodera glycines
ccaaaaaattttttggaaaaagcgtaccgcaaaaaaagagtgccaattttgtaagctgtgtaaatatgttataatcaacaattattattattattattattattatgttataatcaacaattattattattattattattattattatagattatactgttattcgttatatatgttaattgttctctaatatataagtatgaataatataatttggtaatactgtcgatggtacccccgcccttttttttgaaaaaaatttttgttttcaaaacacctgaaacatgtttccgatggttttcggggtcactgatgacgaatccggtatccatttcgaccaactccaaatcacagacccgaatttgaacaaaggttcgaaaattattatcagatttttggttcaaagtgatttaaataatcgtttattaatgagtttcagttgattccgcgtatttagcctaattctgaactaaaaagcaaagtttgaaaaacttgaattttcgaacctttgttcgaatccggttcgggttcgtatttggtcgaaatcgatgtcagaatcggaaattccaaatcaaaaattattcagttaatttgatcaggaagtttttgggatcacctgaaatactgagacaaggttgtttaccttaacacataaaccctttttgcggcacggttttttcaaaaactttgtgggtcaggagctgtctggccgacagacgcgccggagaaatttttgaaaatagattttcaatttgttaacagttttctccaaaaaatgaccatcattgattttttaccgagacaaaattctctgatctggtgtcacatcagcgatacatatgacgtcagatgagtgatttgacggaaattgaaataggcccctggttttttacaataaaattatgtttaaaagttaatttatccaaaaagcctattcattaaaaaaataaaattaattaatattgaagaattgatttattcaatagtgaacaattgattcacccaaaaacaaaaattgattaaaaaatcccgataaaataaataaacataataaataagtattaaatgtctggtcaacatttgtttatgccatttaaaaagcctaagaattgaaaaaattttcataaaaattattctctaaaatattaattttttttcttatatttaatttaagattttccttattcgaaaaaaacgtttatatatttaaattaatatgatggattattttattccaatatttttattattaatcattgccttttctttgcatttacaagtgataatggatccgtaagtttctctgctaattaggtgacaataattaagcatttttttatcaatttgtcagatggaagatgacgcaatggttgagcttgcaaaaggacccgaatattttaacaaattttgcgcggataaaggattaattatcaatgagaaaaaccaatttgtgtctgataaatatgaagtccaccttggccttttgtatgttatgcgaatgaaatggaatcatgtgatggaaacgcgagtaagcaaattctctgtatattaattaattaattaattaactcgacttgacaaatggttagcgataatttgggcaatggaaccactgggcccacagtgaacagtttgggaaattgttgtaaaaaactaattttcaacaatttcgtgatttaccggaactcagaaatttttactgtactcctccacattcagtctgatcactgccccaaaattatccacggccacaatcaattgtccaaataataggcaaaaccatggccaattactaattataccggagacaaaatttaaaaaagccataataaaaggcaacgtataagcttcaaaccaattggaaaatgtgtttttttatgcttaaaatatcggaaattttaccatcttatttttaagcataattcaagcttcattaatgaattggaaaacattcgccaatttgctttcattctctacgaatacttcttctggcaatatgttgctgaatatgtaaaaggtaacggaatttcgaacccaaattttaaattgaaatttcaaattaaattaaatcccgtaaaattttctagcagtagacccaactttagctgaacaaatttccattacaaagaatcccattaaaccaaaattaaaaagcaacgggagagaaataaagttttgtgaagcgatcctagattgggcattcgtttggaagaatcaaatgtggggcggaaattattctaaaacgacacgcttaattaataaagaaacgctaattgaaaattatggaataaatttaaacaattggtatgagcaagaatcattgtttgacatgacaaaattgaaattggaattgaatgccaattcaaaatttgacaattcatttccccgtcttcgcaaaatgttcgatttcaacatggcaaaatgaaagaggatgacactggagaaggtgtcagtaattgatatgctaattgaattttcttcaataacaaacgaaacattgatttggcatattaatgacaagccattttatgaaatagacaaagcggtaaatgaactggaagtatttttggcgctttcagtgatgcttgaggagagtctcaactcgagacaagtggtctcggccttttatgagtctcggtctcgggaaattttcggtctcaagcatcacctaggtactttgcgccagggaaggcacgggattccgattcttgtttgccgagatttatgggatcggaattcaggttcctgaaaaaattttggaggttcgttggcattccgatttccgaaatttttttcgacacaaatttttcagacataaaatcttaaatggcggcgattcactgctaaaatgagtcatttttctattcatcgaaaaatttttgacaaatcctctcatgaatttcaaatttttattttatgtccaaaaagtcaatcctgggggagatgtacgtatgtttctttcgattttaagaccttttattatttggttcttgtccaaaatagtaccaaatttccggtaaaagtcaaaaaatagtgtgaaatatgacttttattcttgtatagccctaagcatacatataaatataattttagatcgaagacaacatatttcttgttgttctgaaagaaatgcgtgttgaaaagtttggtgccaaattggaaacggcgccattaagtgccaatgccaaatcattgatccattcacagaaattggaaatcaagctctatcttaaaatcatttatttgatgagactcaaatggcaatgtgcggaaattgagaattaccgaaaagaatgcacaaaattccgaaaatatttcaattttttgtatgaatatctcttccgaacatacaatgaaggtattgtgagaaactttgtttaatgtggtaagacaattgtccccaatttcggcattcttttttgacccaacttatgcaaaagaattcgattacaaattggacaaatatttcaaaaaatatgcggaaccaaaattactaaacgaatcggaagtgagcggtgaaaagacaattggccaaaaagtttttgaaagtgtggcaaaaataggaaaaagtccaaaaagggtggaagaagaaaaggcagctgcagcagttttagcagaaaaacaacaactcacatttgacttaagccgttcaaatttttgacaatttgttgagagaaaactttgaaaaattacaaagagaaaatgattatgaaacggcaaacggaatttataaatggctttatttgccgacaaataaaaaggcggggaaaatgccaatgttccaagagccatagcccaaaatgccactgctgcaagtgccaaaggcccaactcaacgatggcactgatattattagccttcccgatgacgagctatttgtcgcatttgttgaagacagttccaattttgagaaccattgcatgaaatggaacgccagaatttgttggcgcatgtcggattactatcaaagcgaaagggcaaaggcaggtacgatattggagagaccgtacggtatttgaaactacagtatgaagcataccttggcgttgtgcatttgttgaaaaagaaatggaattgtgatcctatgttaagagaatgcgaaaaatttaaagaatatttgcttgttttatatgaatttttgttcaggaaataccttgaaggtaggtaacaattttttattaagtttttgaaaatttattattagttaggatggaagtttaatctaatttttccatgggttctacgtcctctgaatattttttcttaaaagtaaaaaatccgaaatttcggaatattttgtataaattttgtttttttacaattttgacatttttgagaatttatagaaatttcttgtgaagttcaaaaattttatgcacccttattttttcatcaaagagataacaataattaatttttaaaactcaaacgttaatctaaaggtcattttatggcattttgcgccctattttgacgcatataatttccatccctaattattagttaattgtccatcgttccaattcgccaccacagtacaaccaatttttgtacttggaaacagcaaaacaaatgcgacaataattgacgttttggacagtcttggcattatttgggcattcttttttgattatgaatatggcaaaaaatatgagaattacttggaaaagttattcaaaatgaaggcaacattagaaccaaaatggttgaacgaagaaacaattgggcataaaattgtgaacaatttacaacaaattaccaaatatgccgcagattttaagcaaatctttgggagagaaaaatccgataaaaatgaagaggagcttaagcaaagtttattaattgatgaggctacaaatgagcattcttcaaaggcaaattcagacaaagcaattcagtcattccgtgaagcatttgatggcataatcgaatcgatggcggaaacggcaaaaaccatggaggaatcggaggaaggatttggcaaaacgaaaaaacttttgcgttatctattcctttgaaatggtgctaggacgaagttacaaaagtatcaatgtgggcgaagttacaaattatcaatgtgaggtgatcggaagaggggggtcgtttcagtacggaaaattattttaataaataattatttgattaatttatgtttgctaatcataaatatttataattttttttaatatttacaaattcaattaataattatgcaataaaatccataatcacattttatccattcaatatttgcactttatctttattaatattgtatcttaatattttaataaaaataatattgagaaataagcatttttccttgtcatgagttggcaaattcttttctctaaattattttattatattttttaaatttatttttaaaatattttagaatgaagaatttatttctgatattttaaagtgcaaatataagaaatgaataaagtgggaatagggaatatattgtataaatattaatttaaaaa

SEQ ID NO: 7456 - DNA, 926 bp, Heterodera glycines
attagataagtgactgaaagaattgtgtctgataccttaatggttgtaaatttttttgaaaaatcatcaattattcaatcagcagaattgacggaaaaaacttgatttaaaattttttaatttttctaaaaattcatggccagcataaaacacataaggaacatatggattatatggtgaaaattggaggaagagaagggcgataaggattaggatgaggggtcaaaaattgggaatgattcagcaaaaaaatggtgagaagtgaaacgagtgaagagaaaaaggagcccaaaatagacgataaacaatacttaagtaccaaaaaatttccccctgggggcaaagattaagatgcgaaaaggccgcgccgaagggtacaaaaatcagcgtggagaaaaaagccaaaacaaagggaaaaatgagatgaatgcaaaatggccaaatggaaatggcgatctgagaaagtgtgaacaaaggaatcaaaatcggaggcagatgtgaataggcagaaaaggggggaagaaaaaggcaaaatggcgaagttgaagaaaacataattcaaataggcaaaaaatggaaataaatgaattttaaagaaaaagacacatgaaaatttagtaaagagaaaaataaagaggggtgaaaatgtcgacaagaaaaaaggggggtcgcttaacacggtaatggtctttatccgggaatgtcccctccggacttttcgatcagcgtcgtcctcctcggcgcttctttcctcctttgttcgggtcccgcggttgcacgggggggggtggctggcccactcattttcctcatcctctgacagttccctcgccgtaccgtcggcgttgaacaccaagattccgcttcgtcctcctctggccctctcgtcggcaaccaaatgccgacagagccattaacgtaggaga

SEQ ID NO: 7457 - DNA, 4176 bp, Heterodera glycines
  misc_feature (417)..(418): n is a, c, g, or t
  misc_feature (426)..(426): n is a, c, g, or t
  misc_feature (428)..(428): n is a, c, g, or t
  misc_feature (449)..(449): n is a, c, g, or t
  misc_feature (1468)..(1468): n is a, c, g, or t
  misc_feature (1656)..(1657): n is a, c, g, or t
  misc_feature (1663)..(1663): n is a, c, g, or t
  misc_feature (1669)..(1670): n is a, c, g, or t
  misc_feature (1702)..(1703): n is a, c, g, or t
  misc_feature (1717)..(1717): n is a, c, g, or t
  misc_feature (1729)..(1729): n is a, c, g, or t
  misc_feature (1785)..(1785): n is a, c, g, or t
attaaaagaggtacaatagtgattaaaagaggaagaacagtgattagaagaggttcaacagtgattataagaggtacaatagtgattaaaagaggaagaacagtgattagaagaggtacaactgtgattaaaagaggtacaatagtgattaaaagaggaagaacagtgattaaaagaggaagaacagtgattagaagaggtacaactgtgattaaaagaggtacaatagtgattaaaagaggaagaacagtgattagaagaggtacaactgtgattaaaagaggtacaaaagtgatgagaagaggcacaacatggtttaaaattaaataaataatgaaaagtttttataaaatcgattgcattttaatttaaatttttttataataaaatactctttttattcattaaatatatttnntgaaattnantaatttgaatatttattttgnaaatgaattccattttttataaattcaaaaaaataaataattgaaatttaaataaattatattaaataatttaataaaaaatctttgaaattaaatttaaaacctttaaaaataacccaaaaaattaccaaaaaaaaaattattgttacccccccccggggtccccaacctccccccttatttgaatttttttttattcaaaaaaaaaaattaatttttaaaaaatttttttccacaaaaaatattttatttttaatttaaaaaagtatttaaaaaaaaaaaccccctcttttttatgttttttaaaaccttttaaaaaaattctccccacaattgtttttcaaaaattttgttcccccccccccggtttaaaatttccccccccccccccccaaaaagggctcccaaaccccccccccacccgggttttttgggggtgtaaaagtaaaaaaaaaaaaaatttttccctttttttgttgggcggcaaaaaaaaccccccaaaaaaattttttttgatttttttgtggaaaaaatttttttccccaaaaaagtggcccccccccccccgcgcgcccaaaaaaaatttttttttttttttttttttttcccaaaaaaaaaaaaataaaaaaaaaaatattttttttttttttaaagaagaaggggggtttgttttttttttgttttttttttttttttttttctttttctctcctcctcccccacccataattttttttttttttttttttataataaaaaaaaaaaaaaaaaaaaaaaaaatttttttttttttttttttttttttttttttttttttccccccccccccccccccccaaaaaaaaaaaaaaaaaaaaaaaaaaaaaaaaaaagaaaaaccccccccccccccccctttcttttccccccccctggtctccaatccgggagggcgggggggttgggcaaaaatttggggggggggggccccaaaatttaaacccaaaatttttcccatttcggccagaatttttttggcnaattaagaaaattttattgctttttacgggggctttatccatttgtaacgaaggaaaatagtaccattctcctattttattgttttttgaataataataaaatattatttatttagtataaaattaaaattttatgttttcaatctttgctataaaaaatgaaattcaaagcgaattgatttagtcannttactnaatgtnntaaaaattagataaattttttggctaaaatcnnaattcagtgggaanaattttgcgaanatcatccattcttcgaataggtacttaatgatgcattttctatttttacccctttntaagaatttttttaaaataatggcacacaaaaatatgcaaatatccgtgtactaattaattatatttagttttaacgcttcaacaaaaatatttttatttggcatttaaatgccatttttgacgagccgatttgaaatatcgccacaaaaatattttattatttattcacccatcaccaccattttgagatgcaaatttttgtgtgtcaatttatttacggcgggcgatttaaatcctaaaacttttaggcgcacaaatttattcaattttaaagggggaaacaatcattgacaagccgtggaaaactggaatttaaaatgcaaaatgagctttcccttttcccacacaaaatttcatcgatccgtcggaatatttttaggaaaataaaataaaataatatttaatttattaaattgcttttttaattgatttagctaaatcaattaattgcggattttttgaaaagtttcagtcgtccgcctgctcaagccaagaggaaatttgggtcggtggtgccaatttggagcgaccactaaatacccaggtaattaattaaaaaaacaaatatgaattaattaattcatttcatagtttaaatttaattttttaatgtttttttcatctttacgtacccaaattcatcattattaaatttcgttttttttattaattttcaaaagctcttaaaaaatttaattttcaaaaataaaaaaccttttttacattaaaaattaatttccaaatttaattttcaatttttgcagctttacttttcgccctccgctgctgacagccgccggtgttcgacgttggcatcgccgcaggtaaaaaagtgaaaaaaagtaaaataaaatggcaaatcgatttaagagtgaatttgcattttgttcaccttttttgaatcgctgtgaataaattagcattttttgtttgtgccgccgccgaaagcgtcgcggcatttgcgccgcgcgctaatgacacaaaacactttggcaaaacggggagaaaaatgggacaaaacaatttttaatattcacaaaatgccaaaatatacaaataaaaccaacgattattttcgggttggaaaaagtaaaaaaaaaactaactttttaagattttaggactaattaacaatttggcattttttttagatttttgtaatttttttaaatttctaaaataagaaatatccattactttttaccgaaattataaaaattgtttaatgtttcttttttttccaaaattagaaatattcctttttatttcacagaaatgattccaaaaatgtttagtgttttcccaaatgttcagagtctactcagttccggcatgcattcggcgagcagtgccgtcgcgtggagtccgtgctcaagccgttcactttcgccatgtgcctcgccggccaactccctcaaggggtcatggtcatacggtaaaattagctaattaattaaataaaaaataaataataaaataaatatttaaattcacagacataatcaatttgcctgtccatttggaacgacacatcaaagtgctaaaggtaagcaaaaaaagaagacatttttaatatgctaattttattgtttaagaatttacaaaaatataattaaaaatttaaaaatattacttaaaaattataaaatatcaccctaaataaaataatttattgtaatgaaagaatattttaaatttactttcataaaaattaaaatatttagtattttgattaatttcgaataaataaaataattttcacaaaaaaaataatttttctcgcaaattaatgattctaacaattatttaattgacaattcaaaaacttgacatggtaaaataaataaattaaattatcaaaaataaattaaaaataatattttaattttattaattttaatgcattttcaattttcaatttaagtcccatttgccccttggcgttgtgttggatgccaacattgacaaagcgatcaacggatgcgtggtgaaaagcatttgcagcaaaaaagcactggccaaagacggacgaattcaggtgaaaaacaaaaagcgcaaaaaattaattaaattttttataaattcgaatttttatattttttagcccggcgatcacattgtgaaggtgaacggcgaaagtctgcgcaatgtgacaaatgcgcaggcgcgtgccatcatgcgacgggcaaatctcgtcggggcacagtgcgggtgagaccggggggattggcacggaatcagtcgcggaaaattgtgcacatttttattttattttttaatttcttgctacaaatcccggaaattggacacattttttgttattttttggcacgagtcttggcaaaagttggcacaacccaaggatgtgtcggaatgccgatttcctactt

SEQ ID NO: 7458 - DNA, 3463 bp, Heterodera glycines
ctgtagcatttcgtacatcaccagtgcggacgccaaactgtggaaggagcggcttcaacattttgttgttggcattggcaccggcggcatttgtgccgaaactgcgtcaaatttcatgacatcggatgagcaacaacaacagcagaagaagctgcttgaacagctcgaacgttcccggctgtcaccaaagtaaattgtctttcttttcaaatttgtttttgtggcgaaatgtaccgaatttcgtaaattcgttttttttgtcagagtttatccaaagttttaccggagcccaattttggataaaccattggaatcgccacaaagtgaagaagaaccgcagcagcagcaacaagaacaaccaggccagtcaaaatgccaaacccattttttaattgttttttgttgttctattttaaatttaaggcccaacaaccccagtggatactgtagctgtacagcctactgtagcgctaatacaacaatttgtggaccaattgctgaaggcaaattttaaattaattttagtatttttccttaaattttaaattaatatttaattaaattttttaaaatttttggcatagtgccaattttggagtttaatttattttgttctccaagaccttctcatgtttttcagtccatttttgcggatgccattttcgacgtgtacattttggaccggtcggaattgcgcgcccggcgctccgtccgccgtccaattcgttccgcttctgtggccgcggaagcggactcagtgccggcgccgtctccgtcattgccaaccatcgcttccgtgcggtcgccgccgccaccaaaagcgacggagttgcgcagtgcgtcgtcggtggtgcacagactgatcagaagcgcctcatcttcgctgaggcggaaggtgagaaatgtgatcaatgctggtctgatcactttttttctcactgatcagcagtcactgaccaatattgctaatcaacaaaattgattgatcatgtgcggttcagaaaaaaagctattaagtggctaatttaatcacttatttttactgatcaatttgaattagctggttatcgtttggatttaggtatctttgccacaattaatcaaggagtaatcaaagtgatcagtgaccaccactcatttattggcattttctgatcatttgaagcacaaaagtcaaatattggccacagaaactgcctcagccccaaaaccttctttaaactacataatataatttaattatctcatgttttaaacgtaaaattaacccccattttttacaaattttaaattttccgactcattcattaataaataattcaaaatttgcctttaagtttttttttgttttttcggcttttttatgcatgccaatggcgaggcattggatgtttttatgtcctccgccggcattgaatgccgtgccatttctcacactttttgatgtttttaaggccccgggggcgccgtcgcttttccgcccaatgaaccagcgaaatctgctgcaaatgagcagacccatgacataaaagcatgaacacattgaccacattttgtgctgaagggcacgaaaaatgccctccttttcaatgccaaattgggtgccatttttgctgaagtggcaatggcaaagcgaaacaatggcaatttaatgaatgaattcgccggcggagtaatggacaatttttttcgatttttgccatatttttccataaaatgaaaaacaaaatttcaaagaatcattttttccgtcctttttatggcttatttaacagttttttacgctgaaaaacctattaatatttttaaatttctttattttgtttttgcaataaatttttcactaattgttttaagaaatagaaagcattttctttattacttaatttatttttctttactttttttaatgaaaaaattttttaaaaatttaattttattaaatttatgccaattttcagaagcatcgtccgccggcttctcctccgatcagcaaaagtcaacaacaaattgaggaagctgccgctttgatttcgtcttctcgaaaaatgggcacggatggtcaaaaaacaatggcacaaagtgaaaaagtagcagcgaagacaatgccggaggcaataatttaatttaaaataaaaataaattaaattaaatttagtcagccaaatcgatgaacttttggagtgaaccacgcacagttacattgagcagaaggcacaacgaaacattcggtgggtttttcgcattacaaaactataaaatttagagttggacattttgaaaaaaaattggaaaattttgaatatcagaatgaaaggaaaatcgaatatgggtaaatacattagtttatggtaccatacggtacataggatggtagaaacatttcttattgacatttcttgggtaaaattttgtaaaatttcgttaaaatatgatcagaaacccccgacgatttaggctaataaatattaccaccgcattttgcgccacaaattattccaattttaaaaaattacattttccgccgatcaaaaaagccgtatttggcattatgccattctttgttttgtgtcacaggtataagcattgttggtggtcgcgtggaagtcacccaaagggacagcattaccgacgccggcggcactctgccgacgacggcagtgccaatttgcggcggcggtgccgccgctgatgaggagggcacagcactggtggctaaaacggtgtccggcattttcatcaaatcggtggtgcccgactcgccggccggccgatcggggcaattgtttatgggcgatcgggtgcttagggtcagtttattttaaagtattttagaaaattcaatttaaaaaaattcaaattcaaaattttttttaataattatattttagcaaattcaaaattaaatttaaatttttttttaattcaaacttttaatataattttataaaacctttaatttttttctaaaattataaatgatgtttttcttattttcacattaaattagaatttttacaaatatttaaacgtattcccttttcattatcttcatagattcaataaaaaatatttgttaatgtgtgcaaattttagaatattttataaattaaaaaagtaattaatgtttttatttatttttattttttttttggcttaattccaaaatttcccttcgttttctgcaggtaaatgacaccgatctgagcaacaccacccacgattatgcggtgcaagtgatcaaaagtgccaaaaacccagtcaaatttgtggtccaatcgcttcagtccctccaggcgtttgtgccgagctcggtaaattgtgacggaaatgggacaaatttgggaattaaattctaaaaaaatagcaccaaaaagccaacgatgtgttggccaatcacggcacaacgtcagccgcagcagaaacatgtgccgaaaatgtcgaatctgatgacatcgacctg

SEQ ID NO: 7459 - DNA, 1490 bp, Heterodera glycines
ttttgtatagttattttattaaattttcaaaatttcgattttctcgtatattgaatatttacttaaaaattttttacctcttgatgctgatgatgttgatgatggtggatgatggaatgatgaattgattgccccggctctgatgtccatttctaattgaatggatcggtcatttgccaacttgcacatcgttgcgcccgcacacttaacaattcaatgataatgctttttttgcacaattatatatattttttttgcttaacgaattcaaataaaaattattgaataaatgttaccgaaattaataagcggtttttactttggcttaatcaatggcacttataaatgtccaacgaccacaatttatgcaaaatcttttgtgaattatataccgtatgccctcccatttgccacggcaatggcacagcccaatttgctattcaaattggtgccgtccgtcgtgtgtattcatcaaacattattcacgccaaagcatttattggtgcggagggtggccgctctcgactctcgccctgccgtggcgaaattcgccggccaattttcctcgccaatcgaatgaccaattcagtggcatcaacagcaggtgtgtgtggtgccacactttttatccctctcaaaattcattatttgttgaatgaatggtgccgcaccacctcaatggcacattggcgtattatgtcttaattacatgtcctttctgataattcgacttttaattatgaatattttagcttcgagaaaatttaaaagcagtcaattctgtacgaagaagaaaagtaaagatattaaataattttttttaatttccgagcgctaaaatatgttcgaagtttagtcttccccgccccatatttttgcttttggatgaaaagccttgaacatttatcagcttatcacccagcctattcccaacatccgtcaaaaaattagcaagatttttttttgttgatttattgttgtttcttattatcttttcttattggcaaccgttgcttctggtgatgattgattacggattgggaatgctttttttgagtttgccgatgagtgcctctgctgatcatcttcttgtggttttgatggattatgctcacttttctgttggtcattttgagactcgacaaaaaaacaacactaacaaaccaaataattaagcttcttgatcacattttctctcgattatattagactgatcagaacaaacgttaagtcactgccgattttgtgaattcaataaggtcaatcttacgaatttggcaccctaatttattccattattcctagtatttctgctcaagaatttcgcgccatttctcggtctcgagcctcgggaaattccagtttcgagcacactattaatttgatcagacaaacacaatgagaatgccgaaaaattttcccgcaatgatccaataaaatttgaatttaaagctattaattaagcactgatcatttgtagccaagaacat

SEQ ID NO: 7460 - DNA, 2470 bp, Heterodera glycines
agctcaaatccatttgccgaaagtgtgtaaatcggagaaagctgccgccattttggcgatgaaaattcataaaaacaatgagtcattgaatttcagcgattcatttttgaattttatgcctatttccccatttaaacccaattagaatttgaatcaaaattgtttaaaatacatggccagccccagacttaaattggctcaatttttcaaaaaattggcgcgtgaatttttttttccattatttaccttttacgtaaccccagaaattcacaatttaaatattattattttttattaaaaaataaattgctagaattaagggccaaaacctgctgcagctgtttttgtcataaaacaaaggcaaaaggtccgcagaagcgagccgaaaatccgcattttcaataaatttttatttctctgatcaattgcttccctatggtcgggggagggacagattctctgatccgccaaaacaaacattttgtttccgatgagaaatgaatgaatggccaagtgcaaaaaaattgctttgtatgcgccgcaaattgcagagagaaagtgaaaaaacggaggggaataaatgatcagaaggggactgactgctgcctgatctaatcgctccattctttgagatcggcaaaaaatatgtgacggcagtgcgaaccgccgccgattgggactgatcggaaccatcaaaatttatgaacatttttttacacttgccttgggttaatgatgctaaattttgagcacagtttattttgttttaactttaccaaaaattttaatgacaatttttagaggaaattttaatggaatttatgttcgagttaagccatagaaatattgtaagcttatgaaaatgcttcacaaaaaattcgaaattttcaaaagggtcaaagattggaatttcgttagattagaaaaagcgtccccacattaattaatgtccttccaatctcttctgtgcatgtacatgcgtaatacgctctcccatggtcattagtggtcattaattggttgttgttcgtccattcgttttcccattttttttgtttgcccatattttgccattcctttcgtttttctcttcttctcttccaatttttgccgttttttttgttactttcaaactgataaaaatgcacaaacatacatatacactgaacacatgtattattgacatattgaatgaatggcttaataatgccattttaggagttcaaaaacataaattgtaatatttaaatatttttggcgtttacattcgttttttaaatttaatttaaactcttcttggtggtcttccaatgtatttccctagggagaacccgagttccccgaccactttagccttttccccgaccgcgatccccgatctgccaaaccccgcgctccccgagaatttcttccccgacggacgggtggggtttcccccccccccactccgaaaaaaaattgaactgactttcccataattattttctgtccctccaatcggcagaccaatccaacaaatattgcgcaatttctttcctcctatttccatatttatcttcttttttttttgcttccttgaacaccaaaaatttctgatgaaaacaactgaatcaaaaattgcgtaaaatgacaccaaaaaacagtcaagaaaaaaggaggaaaaaatcaaagaaaaaatggagaaactcagagcagaaattggcaatatatttgaaatattttatgtggcgcgatttacaatataaatacaaaaacgcacagaaaggactatttccttaaaatggtacaaacagtgagatggttaccttttatggaccaatgttaacggaattttttgggttgaaattccgacgggaaaaaatggctgaatccaaccggtagaagggtgggttaaagggatttttcaaattaaaatttatcaaatataaagtgtgtttttctatggtttccattgaaatcagccaggcatgaatctcgaatgtccaaaagagtggtgccgaaaatgcgctgctgttggcaggaaagttactgttgcccaaaatggcatttattggctgtgccgaaaggacggccacgccccgtccccattgttagtgccgcttctcctccgctctcatcccaacaaagggtcatttggctgactcacaatcgtgcgattgttaaaaagctgttttatcaatttttaaatctggataatttcagcagtgtatgaattctcttgcaaaaaaaagaaggtcgaaaatttattgtgccgaagagaaaagtgccgtcgttgaatatgaactatgttttgaaaattcccataaaatttttaaaaaccctaattttcagaaaaaatccttgatatccatccccaaaattaaagtgagaatgagttcctacgcgaattctaactttgattttactcaccaccatccttcgagcactacatttcttgatcttatcgtactcatgcacactaattaaccat

SEQ ID NO: 7461 - DNA, 855 bp, Heterodera glycines
ttccttatcccccccccaattagcatttaattccattcatttactcatacaaatttgaatttgattctttgtttttttagttaattattttttagattaaattaagccaaaagctaagtgcgtgtgaaatggtaagcaatagcaacaacaaaagcgcctgctgcttcgccttccctcttttctgctgccttcttttgccgatgcttctcctttttgcacttccaaaatgccatttttgtgccattgtttttgaccatcatcagcccaattctgtgccatcatcatcatttttatcacaattatcgtccccattattttcgtccgaagttcgcttcatgcaaaaactgttcgatcgctttaagcgcggaaatggcatcggaaacagtgccattggctacgcaccgacagtttccggtgacattttttactgtgaataccgtacacgggaaaaagggcttaggaatgatattttggcggaatatttcatgaaccctcggataatttgataattttccaaaattattttttttacgccactaaattgctttccccattaaattctctatttgagttgaattggttatgtcacgaacaaatacaacaaatgtcattggattacttcttctgtccattgctagcgatgttcaggggatttctgacctttctgttgttggcaaataaacattggcacttttcgtttttgtccacagccccttaagtggcatatggtattaaattgcaaatctttctgtgtaaataaaataaaatacttttataatgtatatcagggataagacggaatgccgatttacgacgtttttggacccggattccctattggcaaaaattttttgc

SEQ ID NO: 7462 - DNA, 2571 bp, Heterodera glycines
tgcttttttaaaaacaaattcctttaattaaagaagcaagtaaaaaagtttttggatttaaaaagggattaaaaattttcaaagtatgatagtataagtttttaatttcaaattacaccattacagtatatacgtgccgagcttcatcttcacggccgattggactcctttttggatgctaaatggacaaaatcaacaacaccaccacttcacattgtccaatttatgtgcagcagtaacaaatggacgcaaaagattggcaaaaatggaaaagactatggcaaatggccaaaaaatgggaccggcggcacaatttggccaagtcggaaaatttcgcttggattgacacgaattgatcagatggacgagaaacagcaaaagaagaattatcatcgccaccaccaaattcactccccgggatggtcaacttttgacgcgatgactccccttttgtacgcatcgaaggacaatgccgagcagcaacaggacgaactgcacataaacgtacaaagggacaaatgattgggatgggcaaagggcgaacagaaaaattgttccgagactccatgcaaacgaaatttttgaacaatttaagccggattcataggttcaaatcagcgaaacattgaaaaataaaaaataaataaaattaatccggtccgtcttttgcctcgggttttttgctcacctggttaatctgggcatatttattttgggaaaatattattgttcttactgtaatttgcacagttccatcgctaccgtaaaccgctggatgagcgacagctgaaccgttttattaacatccatcgtccatttttggtggtctacacagaggaattagcatcagcgaaaaatggagggaatgaagacaaatttgcaggaagacgtgcaaagcgcgacattcgcgcaacactgactgattacggtaggactactgtaggatttatgacaaaaatttaaaatcttttaaaatttcataatacaaaattataagacaaaaaaaaatttcatgctctttttagataactttcggcatcaaatggacaaagtgcgcaaaacggcggaatatttttcttacggtatggccaaaggcaatgtgaacgatgctgccaatgatgcgcaaatgccgacagaaagtgccggcgatggaaacgattttgacactttccgacgattgaaccgacgccgaaaaatggtgcaaaaaactgtgcaaagcatggaaaatcaaaaataatcactatattaaaaagttaaaacttcattgatcattaatatccaaattcttccctggggccaatttgtcatttaaatcggcacgaaaaatcgaaatttcttaaaattctatttataatttgaatcagtctattagttttattttagagaaaccgaaagtcaaaatccgcgcaaaaaaaataccccggctttgatgccaacgacccgatgctcggctttggcacgcccttttcgccatggcaacggatgtcgccgtcagtgaatcggcggaccaaaatgttgcaaagtcccaacgctggcacatcactgaacgacattctgggcttgcgagaacacggctattggttcggcaccgaaatgggtccgaaaattaattaattttttaacaaaaataattaataaatttatcgaaatttaattaaatttctgaaggaaatggcacaaacagagctaatggtggaggagaagcagcaattgatgagacaaagctattcataatggacgaaaacccgcaaaaatcggatgtaattaatttgaaaatcattaattacaaatttgcgaaaaaaatattaaattcctaccaatgcaaaaggaagccctaaaatgattaatttcacaatttccgttccgacagagatgcgcttggcacaacatgaccgtggactttcaccagttgggttggtccgaccgaatcattgcgccgaagagattcgaggccggcttttgcggcggacattgcgattatccgttggaaaatgtacgacaaaattattaatttatattaattatatttataaatttatttaaaatttttatcaatttattttgacttcaaacaaacggtaaacaatttaacttcaatttattttatcaaataattattaaaattttccattatttacaaaaataatttctttgtttttgccaaggagtccaacccgtcgaaccatgccattctccaatcactaattgcaacccaacagcaacatgaaggacaagcaatagcagcagcacaaccacggcgccgaacaatggcgtcgccttcggccgtttgttgcgcaccggcggagtttgactcgctgacgctgctgtactttgacgaacgggacaatgtggtgctgaagaactacccgcggatggtggtgatgtcttgtggctgtttgtgagaccaaaacggcagaagaagagacacaaaagcacaaaacaacgaccaaaaaagcatttctgctgatcagtcagtcattcgtttatttgtaaatccgagccaccatggatttacaaaatcatggaaacatttaatttcctaattagtgtgactctgttagtctgctaaat

SEQ ID NO: 7463 - DNA, 3042 bp, Heterodera glycines
catttttttcttacatattttaaggattttttactgtttgggaaattctcaaaaaaatccaaaattttggttattgcttatttttcatttttctttatttttgaaatttatagaatggctcgtgaaaaaataaaaattaaccaaaaatcaagttttcaaatacttatctggttctacgcctatttagctaattttatggcattttagcaaaatttgcaattttgagccatttttaattaaacgattttgcacataaaaactttgttaaataaattgaaaattaaaatttttgaattaaaatattcctgttttttgtgttcccatttttacagtagccacaaattgagcacgacatgagaaaatgacaaaaccgatgacaatgattcaattttcatccatgcacaagagggacggacatgaaatgaattcatcgtaaataataaatattaaaattaaattataatattttatgaatttaaaataaaattatagccaaaatgcaagaaatggtacaattgctgggccatgcacttcgagtccatgttgcgctgaaaaccaaaaattcacatacttttgtatgtacaaattcactaatgtaaaaaacattcgattttgagacaaattccttttgttttgccaattttttaatgttttgtcattaattgcagtggaaaaacagaaagaagtaaaattgttttttctgtgttctctttggcaaaaatggtttagccaaagactcacaaatcaacgtcatttcaagtcgttaagaaattcgtaatttgaaaattccaaatttagcattttggcaattacaaattttttgcgttttgttcaaaaattttttgttcaaaaatttatttatttttggtgcaatttattgggcattttttaataatattggttgattgattataattgtaaacatttaggcatcgtctcggcaactgtttgaacttggccatatccctcatttttgggaatctgtttgttgtgccgggaaaatgcacaaatcacaaatttgtaaaaaaaatctgttggtaatttagtttatttttattttttagcaatgctcaccatagaatatcttttgtcacaacatgtttgttatgccatgcaagaaatttaatgagaatctaaacatcatacagtatcaataatattttattttaattaaaatttcatattgaaccttttttattttatactcattgtttaattaataattgttattgtttgtttggttgttgttattttggttgtgactttcacagcttacaattttcgtgttctttcattcttttccaacacttcgttatgattttattcaatattttaaattaattaccacattatttgtttaattgttaaaagtaaaaagagccagagaaagtaaagtataatgatattttattatatttaagattccaattacataagctgattccaaaattgattcgcgaatttttctaatacttctctttatctaatctccctctttctaatttttctctaatctctctcactctctctctctctttttccactcccccccccctccttctcatacatctctcctttttctttctctttttctctctgtctctctcttttcttttttttctccctccccctcatttatccctcctttccggtctacctcagttcggcccccacggttcggccccagcacgtttcggccccaaataaaacaattaatttttcaaataaaatttcacgtaaaaattagcaagcaaaatgactacttttttaaattaatagtgttattcttatttttatatttttaattttaattcgaacataaatttaaactttttaagatttattatgtaccgtatgcaacatcaaattgacgccaaaagaaacaggtcaacgctacaacatgatggccatctttacaaatttgctaagacaagtaccgacgggacgattaaattttggcgatgtgagttcaaagacagcggtgtggacaagttcaaaggacggatttggacttcacttcgagatgaattcatccgcatggcgacacctccctcacacatatgaacggaatccaagccacgtcattgcgcaaaaagtcacgactgccatcaaaaggcgtgctgttgagacgatggaagctccctctgtaatccgtgctatttctcttcaaagcattagttcgcctgcactttcagaagtgccgtcaaaaaaggcaaccaattttgtaaatcttttcaatcaaaatttgttaaaagatctttcggccgatgcccgaattctggcaaaggttcagatttattacgtcgacatgcccaacaacgatgatcacaattatattaaccgtcatccccgtagaatcgaatatttgaaaggtatttcccgcaattaccagatgaatccttgatcagtttttgtatttttgtttttttaaattttaatattgttattagtagggctgctaattttaggtaaatacttaaaatttttgcacacttaatacacggagataggcgcgaaaaacgagtttttagcttggtttggagcttctatacccacttttataatacctatttttacctatttgggggtttttctacctattacctaggtacctatttttatacctatttcggcatttttgttacctattttaaggattttcaaaaaattcttaacaaaaatgcaataaaatcaaaaaatatacccataagaatcgaccaaaaaaattttcaaaaatgcaccctaagaattggaaaaatttctcaaaaatttatcccaaaatttatttatttttttcaattgacaaaatttttaatttaaaatgtcaatattatctaagaaaatattaatatatttaaattttcgtttacaaaagagatatgtagaaccaaaattttttccctctttgtttgctttttccactaaaaaatcgttaataaaaatttttatttacctattttggaatttttatacctatttgatgcctattttgatatattttttaacctttttaagtacctattctgcgatttttcttaccta

SEQ ID NO: 7464 - DNA, 3296 bp, Heterodera glycines
aattttttttaaagggcaaaaaaaatttcacaaaataaacagagggcggttgctggccttttaaaaagcaattttatttttggacatgtctcgatttaaataaaattgaaatttgctctaagcatatagagagttagttatttttgagaaattttcaaaattttttcattgtgtacttttcgatttgcataactcgcaagcaggatgaatctgtgcaaaagcccagtccaagccttagtcaaaattaagaatttttatttcctcttgtcgaatgttttttgtttttttcagaaatacgaaaaatttttcaaagtgagtcttatattaaattttttttaatttttttaaagaatttccttttaatattgtgcaaatttcagcatgacgctgggaagatgcaaaccaattagcctagaagcagaaatagaaacaaagaaaaagcttgaaggcgcgacatgatgaacattatttgttaaaataattgattatttaattgaaaaatgaataaaatggtggaaaaaaacattcaaatttatgtaaatatgttttattgtgaataaatatttaatcaaaaacaattttcaagaatttaaaaatatgtttttgacgaataaatgggtaagccgacaaaggtcagaaattaactacagtttatggttccacaaattaacacaaacttaaaaatttttaattaagtcagctaatattgaaaagcgtagaataatattgaccaattaaatacaaatttttacattgtttcattcattgttatctttttttaaaaaacgattttaagtgctcgaaataagtaattgtttatcgatgaaatgttaaattgctataaaacaattttccaagacatttgttagcaattcagtcaagtcctgggatgattcgagagtgtatgtcgagactaattcgcattggcattgtgccgcattcggctattgaaattggcctgcacagtttgaactgtcattgtttgagttccacgcctccgaaacggcacaaacattttccgaatcatttgcgcaaattgcacacgcatgtccatacagacggccaacaaaaagagctgcaaaaataattttggacaattgacgggcgaattaatttagttttaattaatgttttaacggtgctaggttgaaccaaaaatatattgtcagtgtgggctaattcgaaaatttgcctcagtgtcaataaagtaattaaatttataattagacgattcaaatttggtgtccaaaaataacaaattctatgtcattgcaaagaaaccttttttcaatgccgatgatgcttacagcatttcattaattcatttatttatttgtgtttttcaagcagttctctcacagcggaataaaaccgcaaaaaaaaatccgttaaaaacaaaaaattcgcaccctaatgatatttaattaattttaaatttttttgattccaaataattaaattgtaaattaattgcctcgtctgatatgtaaaacaacgatgtgaacgcattgattgggtaatacaattgttgcaagattgggtcgtaatttgtacatatcgtcaacatcgtgtaccatggcgtaatggtgagattaccaagtaacacaaaacatatgccatggatttggacggcaatgcataccacagtgattcgcgcactttccttgtccaaaggattttgtgccgtcgccgcatcagtggcggcattattccaacggcgcttttgtgcttaaaattttaaaatgtactggtctcatttatgaaaaaggtgaggaggaataattacaaaaaaaaattctgaactatttaaataaatgtttatgaagaataatgccaaaaaatttaagaaaatattaaccaaaaattataaatttagagcaaaaaaaaaaatttgaaactttcacttataattgaaataaaaacatgcaaaaaactattattatttattgtccattttccatggttaagcccaaccgatttcggcaagaataattttaaatttagttctacagggcaaaaaaatttcgaaaaattggatttaattttttgtaattaggccaggatcgaatattttttgtgtttaattatttaaattttaaaattgaatttcattaaatattattattattatttattattaaattatataaaatctgcaaattctttaccaaaaaatttgtgatgatgtgccaaacatagtagaagttaccgtactttctctatttgaatgcccgggcattgtattgttcaacccctccaagcatttaattagagagaggcattctaccagagacgggcattcaaataaagaaactacggtaaaccaattaattgtcagaattgaatatttttttgtatgaaattttaattaaattatttgttataaaatttgttcattttatattttcaaaaatttgcaaatttcctatcaaaaatgagttgtgccaatcttttaggaaattaaatccttaattaacccttaatccatgccagacgaattacaattgccaaataaaaaagacaagtaacgaacaaataagaagtgttgaagaaaacatcttaaatatttggcgaaaaattatcttgaaacgcatatcataaacttacactgataaaatggaattgaaatgatggatatcagatgaataatcacacattggacgaaaactttccttaaattaagatttgtttccaaaaaaaaatatttccatgaaatgccgaaatttggataaaaaatggactgaaatgtataaatatatggaaaatatgtattcggtgcccttactgaaatttttactggatataaaaattcgaaaataacttccgcaaaatttttcaaaactttgcacaacatttcaggagtcggaatcccgcaaccgaaaaaaacaaaattttcggagccggaaattttatccattccttgtttatactatggattcgcacggaattccgagttgctacatttttgtgaccggaattccgactttcagaaaatttttaggactcggaattctgatttcccttttcagaaaaatttttgtgccactgagtgcttgcaatccctggtttgtaccaaaaatgccattttggtcatgtaaaaaagcaaataattcggattccccggaaccggttatccctcgaggtatgaattgtttattttgtttactttttggtgatggtttgtgcataattgaatgggaagagctccgcatgtgctctatttgccgccatcacaacgtaatgcaaacgaatacaaacattaccgtattgctggcaatttaatgcaatcgttgcaa

SEQ ID NO: 7465 - DNA, 1992 bp, Heterodera glycines
tatttatcaatcaaaactggcactttacgaaacgcggcgatttagcccgagtgatcatgaccaactctgatcaaatcaaccctgccgatgaaaaaccataccttgctgatcaccatgtacaatgtcaggcgttctcgagccaacctgtacattggaaaagcgcacaaaatcataaatgctatacaaatcagaaaatttgtgatccgaaaggcgtcgcgcactttcgacagaggtgacaacgaatttatgatagtgcaattcatttgctgttttttgacaaaaattaggttaataaatttatttgaaaataaattacaatgaatttcacaaaatgagatgttgaaaatttgatgattagaaaactatttttgtacacacagtcaatgcccattctttttttataatcatgtaccaccaatttaaaacaatatttttgtaattttttaaaatttttgactgctgaatttcatattaaatcgattaaataaaaatacatataaatatgaatttaaaaataaataatcagttattttatatagcatatatgaatggattttatgttctcttcacaattgtaggggggggagggattagtaaaagaaaatattaattatttaatgagcattgtgttgtggcaaatttgcttgattattaaaataatatttattacttagtgagcattgtttgtgtggccaatttgcgtgattattaaaacatatttattacttaatgagcattgtgtgtgtgtgtgtggcaaatttgcgtgatggctttattttttaattttacaatgattaaaaatacctaaatttcattaaaattctcgttaataccaagtggcgtgtgtttacttacaattagtgataaaatgcacacctttattaaatacatggaaagttaattaagaattttttaacggaataataatgaagaactatgtcgagaaattttcatgtttttttggtgcgtttgagttatagggatcaaatttaaaaaatggtgcaataccaagaataaagtgctctatttttctgccaaagttcaaaaattttttgttaaatttcccaaaaatgaattgattacttaaattgaattttctacaggtttgaataatttactttctctctgccgcttcggcatttttttcattaactgcaggtcggcccaatacttttgatgaagtgatttttgtattgatgctgttggattacaattggttgttatttcatttctgaagtgttgaacctgtcggtcggccactcaactttttgctcactttcgagaaaatcactacatcaataagttttattactcatttttggttcattttttggcccattgatcaatcatccctcatttaacccatttattctactcaaatttattttcacctaattcttgattttttttaaaaaggaaatcttagtgtccaattttcctttagtgtccaaaattccggcggtgtccatttttccgcttggtgtccaattttctggtgtccaattttccggtgtccaattttccggtgtccaatttaccggtccccattcgtatcgcatcccttccttattttcaccccatctttaatccatgagacacagaagtgaaatttgccaacgttttttaaaatgtattattttgtgatgcacactattgtgcctctcatgctttagagagagcacatgtgttgaatttgtcaaaaaattatttgttattgtattgttatgagatgaccctgattatggtgttatcgtacctttgataagcccaccacagaaagtacaatatgtggaataatatcctttattccgatcggtacatgtttaacaatggtgagctttcccgattcggagcggggagtgagggggtcgggatccgaatccaacggccaggtggagtgatgtgtgtatggacaaaggaaaagcatatacaagcacattgggggaggagacaaagggaaggaccgccccaggcaaattgtcatatggctat

SEQ ID NO: 7466 - DNA, 7037 bp, Heterodera glycines
tttttttatttcttattgttaaatagttacatactaatgttttttaaaaatattttgttaattttttcattattttttcccacttgaaatttccatttgcattttcttctccatttctgcccttctcttcgccctgtctttcaaatcatatctgcacattcccatatcgaattggtcattttttatcagatgttctattttgtttccaatttctttttgtaatttttcaaattctcgccaattatattttcctggcggtaattggccaatgtttggcattctgaaaaattttaattcgaacaaaatgtccataaatttgagtgtcattcgtggaatagacattttttgcatcttggaaaatttatacaaagaattgacattcgaatgctgaaattgaattttgaattaattgttggcaaagtgtttgttttttgttcccatggcattctctgctcaccctgcaaagtgtgcagtggagggattggtccgcgcattggtcgccccttttggcgtcgctttggtcgcattggaatttgccgaggacatttcgctggtcaaagccatgcggcaaaatgccaatggcgtcgatttggtccaattgcatttgcaaatgcattaaacttgagaattgaattcgcacctccgccgactaaattggcaaattaattactaattgtttttccaaatttggcccttccctttctctctcacccaattttgaatgattttctccaatttttccgtcaaatttttaagcgtttcttttgaatgatttattttttgcgtctcttttaaaatcttaaatttggctaatgctttactcaatattatgcaataaaacagcaaaacctgctttgttttttcctcatttatttttgaattttctccgtattttatttcttgccatccttccggaaattgtgccaatttcgtcaatcggaatttctcacgttctttttcctcaaccatttcaatcaaattcgcttctttggtcaattcgttaaacaatgtttggtctaaaaattatttttaattcaaaaatcattgaatttggccaaaaagtaaattaattaaaatccaattaatttaattgcctaattttctctgcccatcaaagtgtttgacggcctttaattgctcttcgaattccgctcggtgctttggcattccgtcctcgcgcccatcgttttccgtttgaatcagtgccaaaatcactttgtccattttgcgctttaattggcgttccgtttcgctcttggccattgtcttggccaattttctcgagtgcagctgacttttcgtctcctcaatctctgtccataaatttgtgccgttttccgcacaaaatccgtccattgaggccacaattttcttcagcaacaaatgcaatttggccatcaatttgttcctctcgcataagctaattatcttgcttaattcaaccattttaagcttttcccattgcttttcaatttccaatttttcgtttttgccaattattttcaattcctccaaagtgccaaaaagtccaatccgattcgaaatttcgttggcataaactccaagatggagcgtccaacacaaagttttgactgttaaagcatcgttttcctcgtcattttcccaactttctttgcttactgcccaaaacagttcgccatatttcaaactcagcaaattatcgtctgaaaaatgcccgattttcagatgaagcaattcattttggtccaatttgtcctcttcttccgaattttcttcactttttgtttcccaatttgccatttcctgttcatttctgttcggcactttgccatcaaattttggcattttgccattgcaattttcttcttcttcttcttcttcttcttctgattcgtagttcgcttttctctcactttttaattcgtttaaatttctcttcaaattgtcttttacttctgagctcagttcttcttcttttgttttccttttttcgtccgctttttctcctcgatttccaattattttgttaccatttgtcgtccctttgtcactccctaatgtttgatcatttgtcctactttcattttgatcagctgcatgaatctgttccatcatttttccacctcttactgattgaatgtcttctaaattttggccatcaccaatttcttttgtcgtcactttgtcctcctcttttgtcgtcactttgtcctcatcttttgtcgttattttttcatcctcttttgtcgttactttatcatctttttttaccttcattttgactaatgttttgtccttttgtccgtcgtcatttttctgcgtttcttcgtcgcttaatattttattttccatttcattgctatcgcttttgctaagttcgctttcgtttttccttaacgatccaatttatagcaatttaaaaatgggtttactttgtttccgtttttgctcctccattttcaattcgtccatttgtcggcttttccttttgcttctttttgttttcctttttccttctgtttttgttattcttttttatcccattttctctttctttctctgttatttccatcaaaatctcttctaccgattgttcttttatttcttctctcgttccacaaattatcaatatttcatttgccctttcaatgccaaaacgattcattagtgtttttatcgcttcttccgatgactcataaacttaaaataattttcgcccccttttatttgtttgttttttaaaccaacctttttttaaattgctcttcatctgtccattctcggccattaatttggtcaaagtgtcgaaatgtaaattgtttatccattttccataaaattccgcgtcggccttttgttcggtcttttgtctgtccgacgttttatcatccgaatttaaacacaaaagtttcatcgctttgtcttcctccccatttaggctcatttccatgcatttcttcatcactttgtccatgtattcatcaattaattccacaaattccatgactctcaattctatttctgatatttcactgtccaaaattcggtcgaacaattccataaatgaatatttattcttttcccaaaactttcccaagggctgtagtcgtttggcattttgctccagtgccaattcgatcttttgtgcaattacgacaacgtccgcctttaaccaatttgccatctgatggaattggcacttttcgtccaataatgcttcctcataaaattggctcaaaggtgcattcaaaaaagctaaatattccaattagcattttgtttgcttttgctttttccatccttcgcttttaccttcgcgcacacattccggcgttctgaacattgcccttattttctcggcattcgcttcttcgcctttgtctgtgccgtctgtcagcagttttcgaattcgctcttttgccccgcttattttgttgaatttggccctaaagaattcttcgcttaaaagtcggtccaaatattcgaaatgagtctttcgcattcgctgcctttgctccgccagtgccctcttcacgcccttttccgtttcgcattctgtcggcttccatttcacaatttttgtcacatttttcgcattaattccctgagaatttctgctgtttttcatcaaaaattgctctacgaattttgccatttcaattaatttacacacattttgcctttgcctttgttttcccatcttcgaattttgttgttcctcaaaaaattgccctttcgcattcgcaattttttccaaataaatattttgtgcattcgcggacaaattgggcgcaccatttgccagattagcttcgtaaatttctaatgctttgatcaaatttggcgccataatccgagcttcaaaaaattcggcgcaaagtgtgccgctttgaaattgcatttgtctcgtcaaaagggagaggtactgagcagtgaggagatgttctgaatgaaaagaaaagtcatttttgaaattaaagtattaattaactgaaatggaaaatgtccgggtaaaagttctccaacaaaaacattatttgcacattgaccattttcactaaattctcctttattttaagaaagttccgttcggaagtgcctttataaaaaaattctctaaattttatgcttcgatcaatcaaatttctgatcgcaaaaaagtggatttgtccaatctttgtcgaatcagttatttgatcaaaaaacatttcaacaatttgatcattttcacagtccatatttgcccattcagtttcgacattctctggcagaacagtcatttgctaaacccaaaagtaagttagcgctgtttttaaagtgttgaacgaaacacgggagcagagaaatggaaaatgggagaatggacggactttctaattgtttctaattgtttttaatttatggaattattcaaaataaataatgtaattctgaccgtatatttgctcaaatcttccttttctttttgcacaaatttttcaatctccgttttccaatccgaattcattttgatcagcgtctgatcagtggccaattcgtaagccaatttgtacgtcatgcacaattccctctttctgccgttactcttttcactgttttggcccgataggttttgtcctttgagtttgtacttgtctattctgtccttgaatttggcattttgttgtccatgttgttcaattagcgtatcggctaattccaaaaacgagttgatgcattttcgataataccaatgtgtcgcatgcattttcaaattttgcataaatggcgaatcctttctcaaattatcagccgattcagtggttagaagctccatgtactgcttcatcacgattatggcatcttgttctgtaaatggtttggaattatcaaataactaaatatttttaattaaaattccctttcctaccgcaccttttgtgttctcaaattcgatattttggtccttcaattctttaacaaaacttctgttggcattattaataaaatcgtctttttgtggtttgctgattccttaaatcaaaaaatataagtattttgaattatataacttccatttttcaattttatttgatactacgactttcaaacaattccattgttttgttcaacaacgaatcatcacagcttgaagaaacggcggattcaaagagcttctaaaataataggcattggttgaaggggcaaatgccagaaaggcacccaccaccagacgcctctatttaaatttatttttttaattgcaaggcaaaattaactttctaaccaatttcccttctcttccccccccctcacattcactccttcccaattttcgggttgttcacgaaaattgttcctgaatgcctcattttccaggtaaagttcgatcagacatctcccaagatcattcagaatcagtttcaatcgttctgtcactttcgatgtgccaaattcgctgtccattttggccaacagttcgtcaagttgtgccaatattttctgtttgttactttctttgcgccattcgtcgtttttgcccataattttgtcaaattgtttccaataaattttgtatttgtttatgctgtctttcttttgacaatttgcaaaatgtgcaataatttttgcgaataaaatggacagtttgatgaacatcacatttccattaaatccatttttgttaattccttcatataacattcgaaaaaagtcatcactctcaattcctgaaaattaaagtacgaaattgtgattagtgttgattagtgctatttgccctaccaatcgccaatagaattgggttgttcaattccaattggtccacgctgctctgatccatcaaaaaagcaatcattatccttttggcatgttttatctgatcaaattcattctttgctgtcagttctctgaatctttgcgtcatttcactttcttcgtccgtttttctgttttcaatttcaaaaatttgcctaaaattcgaattctttcgcatttccctttccgtcaacaaattgtccaaatatacgaaatgacaatccgacaaaaacatgttaaattgctttgcaaaattcttgaattgttctggatgctttaactccgttacgtgcatttccaattgctcacaaaatgcgttcatttcttcaaattccaccgattttttagtttttaatttttcgacgtataaccaaaagttgcgcagaaagcacacgtccatcagagtgatgtctccgttttttgcttcaattttttctataattttgttaaattgcgcttttaattcgtttttattggtcgtttttcttccgttcgctttttgcaaaaatttcatttgtttttcaatttccaagtgaactcgaacggcgctcagctgaatagcaagcaaatattgttcatcataattcaaactttggtcaaacattaagcgcaagtaattttcctccaatttttttatttcaattcctttaaaattaattttttaatggtaattaaagatcccattaccgtaaagtgtttttggcgtttgagcacaaaatttaccgaagaaatttataattaaatataaaaaaggaatataaaaaatcattgctctaaaaaatgtcattttgtaaaacgcaaaaataatttagtattttatgaatgataattaatgctaatattacaccacagaaaaaagaagcaataacgaattgatgaattgtacaaattttaattgattttattgagaaataaaaccacgtaatgtttaaactgcaaacatttttttttattatatttattaaaagcaatgaaatttgtaaataaggaagaatcattaaagagaaattatcaatttttatttataaaggattatttcgaatgaaattcccatcagttcctatggcaccgtagtcattaatagggcttccaaaaatatggatataaaatcgcgaaatatggccatgaaatatggaccaaaaatcgcgaaatatggacataaaattgcaaaaatatgggacataattttttcaaaattaagggtatactttctcaaattttcttcaaatttgctaaatggaaagaaaaacgtttaaaaa

SEQ ID NO: 7467 - DNA, 3803 bp, Heterodera glycines
  misc_feature (3708)..(3708): n is a, c, g, or t
aataaatggtgtgaagtcaaattgggttcacaaaaaaaaataggttcaaaactgaccgaaaaggttattataaaaataaatatgtgcaaacaaaaagaaagaattaaaattctatgattggacgtatcggaccgtacaataggttttggcctttagggttagtaactgatagctgcggtcgtccctgtggggttcaggtcgccactaacgcaaaccgcttggaatgagacttaagcgggggttggttgcctgcgcaactgtgaatgaatgggccgttgggagataggggtttgagaccagactgttagtcgattaaacaatcgactaattgacacgcgagggatagccggttaaataaccggctaattggccagttggctgtgcttgacctgatccaacggcgtcaattggtcctcgacttgtgtgtgcagcgatcagttggtgacggacggcgattggtgaacaccggacctggtgatgctcggacagaggcgaagagaggtccaagtggtgatcagttggtcaacggagacggtccaagtggtgatcaattggtcagcagagaaagatccaagcggcgatcaacggagtgaagaatggagagcaacaaaagggggaggaaacaattattttggaaataaataacacagtggacaaaaatgccaaacgatggagcgagactgatcgggcaaaggaccgatcaaatgattaaccgggatttcaagcactagtgcttgatgtgaggggataatgtgctaaacagcaatcggcgaatggaaaccacaagtgatccaaatcgcttttaccgtaccaagtgtcttacggtaccgttcttggtcccagggttgggaattccctgcttacagtttttaggcccttttctaaaagacgattcccttccgggatttaatttagaaagggaaccccgaatctgatgtttattcaggattagaaaaagccgactttttccccttgtttgacaatttgacggagcaaattttattgtcagttgagatgagcgaagcaaaattattagaatgaaaacggggaaaagaaaatcgtccatcggtgggggagggggcggatcgaagggtcgcaacagtttaaacgatgtgaaatgtctttcgtccgtcgttcttcaatggcattgtccaagcgttggggccaggcggagatggtgcgaatgatgtgcgatggagagagagtgggggcggatgagacggcagatgggacgacggatgaccaagcagtgggggagcagagatgaagcgatggatgtgcagtggagaaatgcagattggcggaacagagagggagggggcaaagacggcgatttcatcggctgactgttgcttctgctgaaaaaaaaggaggaaaaagggaaaatgaatacattagcgccgttcggtcgcggcggtcgctgaagaccaatgactgaacagccaatagaagagagactaagcaaaggagagagagtcctttgcttaacatcccccgggggagagaaaacatagaaagaatttgtaaatcgaaaataactataaatagttcattttcgacactcccattaagaaacgaaagacacgctaaacagcgttgttaggtttttacgtttgccgacccctcttaatagttttccgtaccttcctaggcataactgccttcgtgtcgaattcagaatcgcttccactgatcacttcctgaaaaggaattttttgggattttaattttcctatgcgattattttccattttctcttttggtttatctttcaaaaattcacttaattcaatttcctttttcgttgcccttttcacttcctttttcacctctagttctatccatttcccgaccaaaattttgtatattttccacatccattctgctaaaactagcagaatgaccgcgttgaccaaattttcccaagccaaaattttgtgtcctattaattttaaaacatttgtttccaaaactggaaatttcgagtgatcattttcacatgactcactcgaccctccccgcacggaagctgaatccaacggaaattctgaaaaacttgctctcagcgcctttaactcactcatcatttttgtttgtgtttctgtcagattacttatgatcaaaagacgaaagatttgcagagaagttgacggtacagctgatttccaaattttgttactgatttctatctcacttatttccttaacaggactcttaatacctaaaacttgatcaatctcataaagtcgaccttcaagaacgatatgtttgtagcgatctgtctgacaatcaacttttctagcttctgcacttattatgagggtttttgggtccaaataagccagaattggcttgtctttcctaactaatgtcacctttactgggattttcttgtaacatttatccttggtttgtgcgaatccgtactcataaactggtgaacatggccaaatttccaaaatgttctgtgaaatccattcggcttcgatttgctggttgtccgaaagctgacgaatcaaaaaattcggattgagatgtgagagatcagtgcccaaaactgagccaaagatggagtcacaaataagtttaaaatatgcctgcaatacttttctcatttctttatctgcgaacatcgaacgtgctgtgagttgagcatctaattgtgatgtgcgaacttcaccgtccaacggttcatcaaaattaacatttcggcgagttctgtccaattgtcggttgaattttacaaattctctttcttcgattgcgaatccttgttggctaactaccaatcttcttaaacaagaagtaataaatgtcggatcttccccaaatgttagggctaagtccggtgggtcactgatccaacctattcgataaatggttccatttttctttgaaaaacttttaaaaacgcaatgtccgtgtcgagccgcccatggttcagatgtgtgataccgatcaacatcccaaactacaatagaatcgtgtaaactgcatctgccgtcgtcgtattgacaatgttggaggtctccgacaatcgaatcaattctttgggatccgggatatccaatgattgttatattgttgactatgcaattaaccgtctcaacagactttttaccccaagaccaccaagaatgctcataaatgagtttattttctgttatcatggtaccgtctgagtcacctactagaatgccgaatctgcattttttggttttggagatttcttggcattcttcggcagaaatcggcatcatttcttgacttttgatgtcgaatggatcattcagtaaattcgtccaaaattggaccgaatgtttaaggagtaaacattgatgcccccaaaaggtgtattccttttggttaggacgatacaatgtaagttctaaattttttgtacctctttcaaatatttgagatatccctgaacaggcactattgtttcgaccaattttgacaaatcttgatggcacgtttctgtgacaaatcattggtttttgacataaatttacgcccaacaacataaaaaggcaatgtgaatttgctatttgtaaatgttctcaatcctcttgactgaccttttgggaatccgaagtttctctcgaaatctcggtcctcagtttggcttctgtgcacattatgtgttgtttgtacgttgtctggcttaattcccgtgaattttttcattgactcattcatttgctncacagcaattttatcgaacgaatcgtcttctgatttcgtcgtcattgaccatgctacatcaatttaccgggttttagctaaacaggcgttttact

SEQ ID NO: 7468 - DNA, 2444 bp, Heterodera glycines
ctgtgcttgctatttcgagatttttgaaactttttacgtcgaatacgtcttcctcaacaggaatattttgaaaattttcttccctattttttggccatccataatttggctgaacagcccgtgttgtaccttttggtgttgcctccttcaaatcatctctgagttgcatcaacaatcgtcctagtgtgttcgaaccgttccactgttgtatgtccgctgttggccatttgtcataaatgagtcccggtctacaacccaccccccaaaactggtcgggtgataattcgcaaattatggcagatccagtgctcaacagcacatctttaagatcgggcaccgaaaacttggctttaagtgcttcttccataatgccaattttgagctcagtccattctcggacagtcacttcgtcctccccgttcatatttgcgaatttcttcatctcaaatgcgcttattcttttgccatatttgtttgtccccagcataatcgcatccgccgcgttgaaacgtttcagatacaacgctttttgggcacagtaatactgctccacacatcggtaggttctttcgtggatgacgaattcatacgcttcgttgaaattcgaaaagtaaaattgctgattaaaaaatcctagcaattctcttttttcaacccggacacggcggcaaaatggtgctctgtcattgatgaacggcggaattggcgggatactttccaatttccaaaaatcgtaaacggccttgaccggaaactgctgttggcggtggagacgtggatttgagctggactgatgttgctgcaagtcctcaacaggacggattggtcgaattgcctgagtccattcgctgtgcgatggttggtcctcaacaggacggaaccttttcgactttgttgcgcccgaactatgatcatcagaaaatggttgttggcatcgcttcttatacagcgcacttcctcccctttgagtgattcgcggagcaaatgcgaggtgcgcgagcgaagcgagcgcatctgcgctagttgatattaaaaatttgatttaatttcacatcaaaaattaaattttactttttgagatattcatgaaaaaatttttcaattcttccctggtaacgcaaaccgcttggaatgggacttaagcggcggttgcctgcgcaactgtgaatgaatgggccgttgggagataggagtttgagaccagattgttagccgattaaacaatcgactaattgacacgcgagggatagccggttaaataaccggctaattggccagttggctgtgcttgacctgatccaacggcgtcaatcggtcctcgacttgtgtgtgcagcgatcagttgttgacagacggcgattggtgaacaccggacctggtgatgctcggacagaggcgaagagaggtccaagtggtgatcagttggtcaacgaagaacggtccaagtgtgatcaattggtcagcagagaaaggtccaagcggcgatcagcggagtgaagaatggagagcaacaaaagggggagaaaacaattattttggaaataaataacacagtggacaaaaatgccaaacgatggagcgagactgatcgggcaaaggaccgatcaaatgattaaccaggatttcaagcactagtgcttgatgtgaggggataatgtgctaaacagcaatcggcgaatggaaaccacaagcgatccaaatcgcttttaccgtaccaagtgtcttacggtaccgttcttggtcccagggttgggaatttcctgcttacagtttttaggcccttttctaaaagacgattcccttccgggatttaatttagaaagggaaccccgaatctgatgtttattcaggattagaaaaagccgactttttccccttgtttgacaatttgacggagcaaatttattgtcagttgagatgagcgaagcaaaaattaatagaatgaaaacggggaaaagaaaatcgtccatcggtgggggagggggcggatcgaagggtcgcaacagtttaaacgatgtgaaatgtcttccgtccatcgttcttcaatggcatggtccaagccgtggggccaggcggagatggtgcgaatgatgtgcgatgtagagagagtgggggcggatgagacggcagatgggacggcggaaggccaagcagtgggggagcagagatgaagcgatggatgtgcagtggagaaatgcagattggcggaacagagagggagggggcaaagacggcgatttcatcggctgactgttgcttctgctgaaaaaaggagggaaaagggaaaattgaatacattagcgccgttcggtcgaggcggtcgctgaagaccaatgactgaacagccaatagaagagagactaagcaaaggagagagagtcctttgcttaacatcccccgggggagagaaaacatagaaagaatttgtaaatcgaaaataacta

SEQ ID NO: 7469 - DNA, 3651 bp, Heterodera glycines
tttttatgggttttttggtttaaaaatttactaaatttgaaaaaaattattaaattaaaaaagaaaaccgtcccccgattatggacctttaataaaaatttggcaaaatgtgtttaaaaaattcaaatttgtatatatttttttgtctttactctaacgaaaatgccattcttagggtgtatatttaaccccgaccccgagttggggttaagggtcggggtcggggttgggagcgtcggggtcggggtcggggttaaccccgaaaaatggccaaaaaagtcgggggtcgggcggggtcggggtcacaaccctaattataagcatgggatcggaatttgggacatttcggggacagaccgtaaaagattttcggctatttttctaacaagaaagtgctgaaaatttgggatggggaaatgccgaaaactcaaaggatcaccttacttacatagttcagcagggagcaaaagtgtctgcacgtctgtagttgggggatagatcggagattcggggtcggggacccggttgcaaatggtgccaagcacaaatgtaaagattcgggaataccgaaaaaggtcccatctccatatgtgacgggtgatcagtcctagagtttcgcagattcgagatttgtcgagatcattgtcccaacatgctgaagccgatgttcaggaagcggggggccagcccgccaatgcggcgcctgtgccgatgcgtcaaggccacgccggcacgttgctcggaatgggagtcaaaaatataaagagagaaatagaaaaaagggagagaacgagagagaggagagagagagagagagcgtgaggcaagttgggagaaatgtgagagaaatgtgagagaaggatgaaaataatttggttttaattttgactagcgcgaggtgcgcgagtgaagcgagtgcgcctgcgctagttaatacatactaaaactcttgaaaagttatttataaatttcgagttttggttttttgaaattccgcaaaaaatacataacgccaaaccaagtgacactacagttggccgctcattagtagctccgccgccgcccgtcttggggtcaatgcggccaactccttcgggagtcattttttcggcttggggaccaactccatctcgtcaacaccatgggtaaagacgaataataatttaaaagattgaaattttaaaaattgggacaatttggtggaaattgtgccaaaaatggtctatgtgctgctgctggctaatgtcgccccctcagtcgccccaaggtcggaatgaagtcgtctacgagtcgccgtaaatgccaatgccgtacaatgacatgtatcgcccaaccaaaacaccactcactgacggtttggcaatagcacttttataggttttttaggtgctgaaaactgaccaaaatctgtggaaacgcatttaaaccggtttaaaaacacggaaaaaggaacataatggggcactcttaatttaaacggtaatatccggacattgctatcatcgacagctcttttgtctatttcactgagactcactgaccaaggtctcagattgtttggttcgacttcttcccctgacggactctgtcagatggacctcacggttcggcggcgcccacggttgggccctcacgtttaggccccagcatgtttttgattattacttttttctttgccatccaaatccaacaaccttggtatcattcgaaagcttaacttgctagaaaatctttttgtaggctaatcgagagctttcgaatgataccaaacatagctcgccaatagcttacgaattatccaaatttgtcagggttcgattgtttttaaaaagttagaagtgacaaattctcgctattttcgagaattttgaacaagcgcaaaagccgttcttccacatggtctcatcgagatcttccgattgttacaacatttgttcttatccgtctacaaagaaaagtcccctatactccgtgttagcctacattcttagtatcatttgaaagcttaatgtctcgggaatttataaacacaagaaatgagaaaatactataattaagaaaaaaattacaatggattttttcccggatatattcaaattgaattttttttttttttttgtaggttccttttaactcggaatttttgagtaaaattctacatacttctgagctttcattggataccaagaatataggcattaggcattcaattgtcattggttcaattatttccaattttaattaattaattaatcccgttataggtttgtcgcttgcggatcgacgcacattgtgccaagttcaaaaatatacattggtaagaataagggtctgggttaaattatagacatagcagaggaaataaaaaatgttagaaaaaataatttcaaatttaatttaaaatgtcattgaatattgctcctgtgtggcaaagaggttattctcttgagttgtatccctctgctcatgttcaattccttctaattgcgtttaatattatctccattcaaatttttgttaaaatctacttcactttataaaatatacaaagtctaaatttatttttgggtaaaatctgtaaacaaatttagcaaaaaaccttaaaaaatcttcccgttgcaaatatattttttagaaggaattttttttaatgacctcttcattccatgaaaataattatttaaaaaaataaaatttcaaataatttgaaatttaaattttcatatcttctgaaatttttagataaaaaatatttgatttgctaggaagcaattgaactactatttttattttaataattacaaatcatttcgtgaaatatttttttttctgagtatttttttctcgacgcagacgcgtccggttgaaaaacttgggcctggacccggaatcccagactcggtttttgcccgaatacccgacccgtgtaaccaactctagtgcatatacctaagtcctccttttaaatgaaaaaaaactaatgagacacgagaaaatatgtgtgctatagctcttttgtcaacccacctttttagctattttttgacaaaacatggtataacttttgtttaaaaggaccaatcaaattttacattctaaatatcattcaatagtccagctttttgattttaagcaaatttatgccatgttttatcgaaaaatagctaaatggtgggttttatgaaacaatccaacacggaaaatatgtgccaatttcctttttctctgtctcagtccgctctcttccatgtaattactaagatgaccaccatcacaaatcaattaacaaaaaggggtgctgagtcgttatataaaactatcaataagagggcgttatgtaaaaaaccatcaaatggaaatttccaacaaaaaactgcccataatttttgtctaactaaaccaaattaaacattcttattatcattggaagccctaacatttctctattagctcgcctaaatttaaaaaaatttggccaagtttgagcaaagttatggccaagagtacacaaggaacctggttttcaaaattttttggctataacttttttgaatcttaatgaattttttttttgaaaaacaagggatggttaattgattagactcataaaatacctttggactcataaaattcgattggactcataaagtg

SEQ ID NO: 7470 - DNA, 1639 bp, Heterodera glycines
tggggggaaagcgaattcgaagttttttgatcatttgcttattttcatttgttaattttctttttcttttcacttctctctcttctttctctctctcttctctctctctctctctcgctctctgtctgtctctctctctctctctctcctctctctccctgcagttctaataaaaagccttttctgcttcgttttttattaattgtgttcttaaaaaacccaatcaacagaatggaatccgttctttggtgacggacattcccctaaaaatgaattaacaaaaatcaaatagttccaaattcacttctttcttctcgactttcttttcgatttgatcaatccatcatttatctctctccaaaaacaaagctttgtccgcttttccttcctgtgcttttgcccccccccctcccccattttgtccgtttcccttcacccccagcgaattgtcttttgccgattttgtcccaccaaaattgccataatagtattccttaaaatcattcccatggccccaccattcgcgtgaatttttatcaatttgccatcattctttgatcccaaatccggggcttttctttccttcgctctttccatcgattggcttaatccctccgctcatttttaggcactgcaggaaaatattgaaacagaaggacgaacgaagcactaatagctgtgtaacaacaccagcagaagcaggtccattggaatgacacgcgaaaagaaaaaagggaatgaaaaggaaaataaaagaatggcattttcctaaaattaggcaaattttaactctttaaaaaaacattacagcaaaaccaaaacaaacggcaaaaggacgttggcaaagtcatttcggacgagtgtgcgcagcccgaacaacgctatttggcactttggctggaatccttcgagagtttagaactcatccatcactttacggcacttttcttaaggtaagttgggtttttgcttttacaaaccaaagggatggtcaattaaagcggtgtcatcaatcgcttaagcttaaattggtaataaaagccgtggttggccacttcacaaaattttatccttcgtttttcattcacttttattttttggctcggatttcacatttgtctgttgctgggcttcgagtggagtgggccgttggggctgtcatcgccgccgcccccctcccccccccccgacaattctctcataaatttccctttccctcaattgcgatggcttttggttggactggggggaaagcgaattcgaagttttttgatcatttgcttattttcatttgttaattttctttttcttttcacttctctctctctctctctctctctctctccctgccccctctcccgtcgattttttggagaacaatataataatttttaaatgtttcaatgaattttgactaattattttaaagaatttttattttagctcagtctcactcactgatcttgttcatccttcctcctcccgctctctcccctccctcgctcccctccctcatccttcctcctcccgctctctcccctccctcgctcccctccctcatccttcctcctcccgctctctcccctccctcgctcccctacggcatcggtcctcctcccgctctctcccctccctcgct

SEQ ID NO: 7471 - DNA, 1673 bp, Heterodera glycines
tttcaagcaaaagtatacaaatagtgattaagggccaactcccccatggacaaagatacggttttgttgagagactttgaacatcagtacttccaacttacacatcccgattggtatcatcataatgccattttgcgaactttgggacaactggacaatgcggaatcagggcgaatctaacgactacccacttgaggactattcaacgagcggcattgttgcgtactattttcaagggtcgttttagcacagctgcgaaagttatctcttttactttacacgtaacgatgaaattatattgtttaagacgtttaattgacacttaaacatttgttgagtcatatatttccgtagaaaaaatgcaattgtatgttgaataataatatttttaattggaagaaaaattagaagaactggcacataaatattgaaaaattcatttttgcattaatttatgcgttggatccttattttttcatttatttatcattgcccatttttattatcttattaaatttatgcagcgccacacactgggaagtgtaggttatctggagttgcgccggcctttaaaatatgaaaaatcaaaattttaaataaaaaagaaaaataataaaataagaaaaaatattttttctataattaccgggtaccagcggcaatgatgagtttgcattccgaaacaatccatagcagttattagaccaaaacaatatgcgtgagagttttggcaccgatttgtctgaaaaaagacgaaaacgaaattgttggtcataataataatacggattttaggtattatgatgaacattttttaaattaaacaacatttacaaaaagttttaacaaacaaaccgaatcgaccgaacagaatgggccctgaagttggcaaatacatcaagaaaatcgttcatttttgaaaaaaattaaatcattagatttactgaatttagtttttttaattttgtatattttaagattttaaataaaacttacgagaaggaaataagttttttcaaaaaatttttccaaaaaaatcgctaaaaatttttcaaaaaattttttcttgaaattttcttaataaaaaatttcctaggaatttttcttttatatttttgtttgtagttttttttaaaagaatttcgggggggggggggggaggaagtgactgttcgcccttgcggtcttaatattacgtccgtacaggctttgggtgacaaaaataacgctgacattccaattgtgggaaccgcgtgtgaacagcaaatccaaaaaatcgttccctacattaagcatcaaatcatcaagcacaagaagcaatggtttcggctgactctggatcaatgcttgatccggaacgccattatgtgtctcgattccgcgcttcatcagctcaatgactgattggttcatctcagagtagcaatacaatactttagcaggcggaggatcgataagttcagcgtagcttctcagcaatttcattagccattgggttttaccgctcccagtggcccctgacagaattagagtgaatggggcaataaacatttttattttttgcaatttgtaatttgtctttgtcatttatatacattttcagttcaaaatgggcggcgattaatcattttttcctgttaaatactttaaaattatgaataatgaaagctgtc

SEQ ID NO: 7472 - DNA, 2375 bp, Heterodera glycines
aagcattaagcttttattgtttttgtcatttatcgcttttcaaaattttaattttatgattttaccaaaaaacaaaaatttgaatcgaaaaatataaaattattaaaagaaaactcaaaaactgcaaataacaatgaaaagaaacattttcgctttaactactttttgctctaaaacaattttttacggaggaggcaaaatttaaatatcatttattttattagcattttaatataatttaaattttaaataccatttttgtggatgaatcaatccattaactatttttggattttcacaatcttctgggtcgtgaaagcctgggcaatagaccggttttccaacaaataagtaccttaatgatttatcattttgggataattaatttttgaataaatcacccagctcgcggatgttcaggctgtgccatgccaaaaatgtacaacaacccgaagagggttagcagttgaagaagcatcatttttataaagaaaaaattcaattaaattgaaaataaaaaagaaatttcagtctttaaaaacagcaaaaattaatgctcattaatattcaatgtgagcttatttatttaaaaacgcattaaatacatttagtttttagctttaatttattgaagagattttattatgtttttacttttcaaaatgaaatgacaaattttaatgctcttaaaaatggatttaaaataaattattctgggcagcaatccttttaaaaaaacaataaaaaacgctttttaatatttatgactctttaagagagaaaattattttaaaatacccttttcattattatttctttaaatgtataaaaaaaagaaaattatcaacgatcttcgacttcaaaattttattaaaaatagcaattcggctagctccatttccgttgagctgcgccttaactcaacgtgtgggagatggcacggcttaatcattgaacaaaatctggatatcgaagagcgaacccttgacatttttgctgaataactaacaaaaactacgacgataaagggtcttgtattaacgaatctagtggtaaatctgagcaaatattcaaaattttggggaattttgtaaaaatagactagaaaatcttgatggaatattgttaatacaatacaatacaattctatgtaaaaaattgatttgtcgcatgaaattttattaaattttactaactaagattataattattattttttggttttaatttttaaataattatttcgcttttatttttataaaatgattatttgtctattaatttgatcatttgcttttttagtacttcattataagttgtgccattgaaggacaaattttaaccaagctgaattgcggtaattggcatttcattttttgctcatttgcaaaatagtggcaaaaatagtggcgaaaaagttctaaatttaggggtgtaattttttaaaaagctgttttttaattgtaaaattaaggcaaacaattttattcactgattgcagttacaaaatattttcttagcaaatattgagcaagaaaaaaaatttgggggaagaatttttgagaaaattttccaattcttaggggtgtaattttgaaaatttttagttcgatttttaggggtgtattttttgaatttcttaggtcgattcttggggtatatttttcatttttattgcattttttgggaaattttccaaaaaatgccaaaatagtgacaaaacgccaaaatagtctgcaaaaaattattttagtggccaacttacaaaataattttttttagtggcgaagctccaaaatagtgattcctagtgatgaatagtggcgttaaaacgaagaatttccgagctaaaaatgtgtttttcgtgcatttctcgtcgaaataagccgcagaaaaaaaaagttaaaaaactaaaaatcccagccctactgatcattgctgctgaagaattccacgcgatatacacaaagaaaattgtaattataaatcatttataaaaaaaatagaagagtttcataatgggaaaacataacctgcgaatatagaaataggaaattttgtaaaaaataaggacacaattaaattgatgtatgtatagggtgctaggtcgtttcgtaacttccgccactatgggcgtttcgtaaatccgccaaaaaataataattcatttaggccaaaattttcataaaaattatatttttgaattttatctatagaacatttgttggatgcactaatatcagtctagacatatttattaataaatgattgttttcactaaaatttagtaaatatttgttaacattattgtcaacattatctcagttataatagtatggtcttccgcatatctaattgagttatatatgtattta

SEQ ID NO: 7473 - DNA, 1957 bp, Heterodera glycines
agtgaaaaggaatttgattttatttttcttaaaaatgttaatgttctgcatagaataaaaaataatgtatatttttttctattatatttttgttggcggatttacgaaacgcccatagtggcggaatttacgaaacgactcagccacggtatgtatgtatatgtgtatttctgttggatcaccttccatttatagacaaataaaatacggaaattgtataaaattatggaggtcattatggttggttattgaccgcgctgttgtgcaaaatttttgacacttcaattaagttaataagcttttgttaaaagcttagtaaattttgcgatttgaacccataaaaaattttggatgaaaattaaaaaaatatatcttttgcgtccgacggtcccggatggaataaaaaattggaattttataattgcattattttatccaaatcttatcaaattatatgtatgtattaccgtattttctctaattatgtgcccgggtatattgttttcaacatcctcagaaagggggcgccaattggagacggagagattaatggagacaggcatatgtataattcaagaaaatacggtttatctttgaaatgaagttaatttatactgaatttcattcaaaaaaaaattaaaaatatatatattttttgaccatatagagcccatcaattggggtgcatttttgaaaaacttcgtttctgtttttggcctaaacaagatgtttttcggtttttggtgaacgaccataattttcctaatttatatacctaatgcataccgcatttccctcgattataacccccccccctcgaataaagccccacttgtgaggggagttgaacaatagcgcccctctcgattagaaccgccctctcgaacaaagccccccccccttcaatagagcccccggcggttataatcgagtaaatatggtaatcttagacttagtttaagataacatgcatctatttaaaattaagctcacccgatcgttttgaagaaatccttttggtgccaaaaaagcgggttgcgacatccattttatttttttacgaattgatcattttttaaatttcgttttgtaatttccgcaaaattcaaatcaaaaaatttgagtattttctgtttttttttacctatcttaaattagaggacgaattttaatatacgaaaattttgtagttgcaaataattggagtgacgtcaccacactcaaaattgattataccccacatttttctcattcacatcatgcaataaaaatctcaaaaattaattacaattttctaaatttaattttttaaaatttgtttttcaattcattctttttttttacattttcactattattctcttttcgtcgtcgtcaccatttgaaagaaatgtacaataaaaagaattgaatggtccgattttgtggtgcaatgaatgaatgaatgaaaatgaatggaatgaatggccgccgctgaacaaattgggcgaaggaaattccgcgcaaattgcgacgcattggtcaccgcatttttcagtcctgaggagttttttttattagggcctattttctaattttttataaaaacgaaaagcataccccgaacaatcggccgcaaaaatttcagtatttatttatttattttatttttttggcaagaatttttggtgttaaaaattatgtatgtgttgtctcaagcaaatcaatatttaaatacctatggtttttttttctacacaaaaacataactattcccacagccaccggactcagttgtccaagatactcaaaattgctgggccacagttggcgccgcgtaattgcgccaaaatgaatgtccctcccacccatcgccttgctgacgatggtccttaagcccagtcaaccaaacaacaaccaaagccatcagcagtcaacaacaaatgttattttctcagggcccgtgtggggggggggg

SEQ ID NO: 7474 - DNA, 1160 bp, Heterodera glycines
  misc_feature (83)..(83): n is a, c, g, or t
gtcccgacccgtccttattcatatcatgcctgccggggattcaattacaattctcgagttttcgcaattttccgtgagtttcncaggattctcgcgcgttctttcgcagtttccgggactcgatctcataattctcgagctttatctctccaaattggccctgggttgatcataattctccaatatattttttttcgctatttccccacgattcgagtataattctcgggtttcatccgcttacatattttgattttttgtgtttcgaatctctctttctgtctgtacctatttatatagaaatttattttggggcaatcattttttggtccttgcttccccccgccttcggcccttcgctaattaattcgccatttatttgttgtctttcataaatagtaattaattgcttttggccgggtgtctctgccgcccacccccaattttttcccgcacaaatacaaaaccatccatcaaacaatgcattttttttatcaaatatttcttcccgaatttttataacaatttgtgtaattaatttatgtcgtcgtccgtccatttccctccctccgcgcaaatttcgcgcacattcatttgccccccttaattagtatgaatcatctccgcctcccgtcctccccccgcccttaaagcgcaatatttttataccaaatcgtaatgacgaggaaaagatgaaagaaaaattgatttgaaaagcacggctgggtgagtctcggcaatttgagtcccacaaaactcacttcagcggcgaattaattgatcgggtcagtggttgtcacagaaaatttggttctgatcagaattcttgggttattcgtgggactaaagatccgattaatctgatctgattcgaatattttccaattataaggttttggatcattagatgggaatgaaatccttggagttcatttggccttagtttttgaggccagtggaatgagtccgatcagcatttttcgtccttgaaattcaatctgtcagaattcggatcaatctttggtcgattacctattgaaattgtgccgattaatactcattgatctattccaaccactagccaatcgcctttaagactgaaattctcgggaccaaaattgctctcaaaccgtccgatgtcgccgtcatacaatggcact

SEQ ID NO: 7475 - DNA, 1364 bp, Heterodera glycines
ttgttaatctacttttcgagttattagagcctatctcttaaggtttacttttagagccaaaaaagcttttctatttactttcatttggcggtttatagagcctaaaaattggctagtcataattaaaataaatgtttcgtttttaattactcaatttcgcctgaggcgatgttcgggtcgaccaatgtaatagtcgcgcatggaacgccaacggcgttccggaattgtgccatttgaaaagcaagaaaatagtagagggaagagagagagaaagtgaggagggcggaagagagaagtagagagaagagaggaaggaggaaagaaagaaatgagagagagaatagaaaaagagagagacagaaaaggggagagagaagaaggggaaagaaaaaaaggaagaagagaaaaagactgcagaaaataaacaaaaaatgaatttgaaaattgtgagttgggtgaacgtttcctacccaaaaagccgcatttacgggcaatttgctcccatgccaacgcttttctgtaaatggatgggcaattaattttgattttacagcctttcccttcgaatcgcattcaccgattgttgtcccggtaatgagcgttgcccggtcgtacaattcgggatgacatcgaattgcattgatcagcagcaaatcgcgctcacacttcatggtggaattttcaaaatggttctgaatttaatgaataaaattaaacacattttaaaaggaaaaatggagggattacggtagcagggccattactaccgtaaccgaagcggctgctttaagcccctcccccaccttctgctgctgctgattgtcctcctcaacgaaagaagttccgctttccctatttatttgatcgatggagtttctaagcgcaaaacaaaaaattattggccaaaaatttttgtattgaaataaatttttataatttaattcattttaaatattctctatttttatgaaagtcttttcactttaatggaagtcactccctaataaataaacaaaaaaatgcacccaaatcattggccgccgcaggggaaaggtgaaaagattcagcgtaatggaatttgtaatgttctctgaaaggggacaacggaatgagacaaaaaaaaaagtcaaaaaggtaaaacacatagaataaacttttcctttaaaacatcgaatggtgctaggtcgtttcgtaaaaagtgccattataaaaatatggttgagtatagagttatgaattcaaaaatttatgtttgtgttatacatatgagtagtatatgtccacaaatctcggtgtaaaattccggcccttcctagacaaaccccccacccgtccaattattaccgagctcccttttatgaacg

SEQ ID NO: 7476 - DNA, 2851 bp, Heterodera glycines
aaaatgtctcgtttctgccctctcgttgaaaccaaggaattgggacgcctttccgctccgaaggggaaatttagtgagtttgaaatcactttaaattcagcacaagatttgcaaatctttaacttttgtttaggcctattttactcccttgaattcgcacgaaattaccgattgattggaaaggagataacggaagacaagtttcgttatctcatgaaaacagagaaaaaacaaagagaaatggctgtcaaatatgggcttcaaacaatttgaaacggttgcttttgctcattatgctggacggttcgactcacatttcgtccttcgtgtgctgacagaaagggggcttaacaccgaactgatgatggccaaagaccttagggctgagcatcccggcaaagttgtactttcctcataagtacaataaaaatgagaattttgggaagagattgtcacacctgccgccttttgatgattacaatccaaatgctatgaaggaggaagaatatgagaagtttgaaggatggtataacgagaattttgagaccgaatttgagctaggttagagaaagtgtgttttaaataaaattttgtatttttttaggagaacagcttaaggtttactgtgaaaacgatgtggaaatactgatggaggcaattatgaagttccggcaattgtttttggatattactgacgggatggatgtgttgaaggacagtgtcacaattgctggggtcgtgatgaggatattcaggacgaaattcttgaaggacaggcacattccgatcatgccggagggaggatatgaaagggctgataatcagagcaaaattgccgtgaagtattttgaatggttggcgcaccgggaaggcataagggtcagacatgcggaaaatggtggtgagattaaattcggtgacctcaaagttgattgcgtcattggtggtcagaaaagaataattgagtttcaggttttcaaaaataaaagtcatccgttaatgtgagttctttaaggggtgtgcataccatgggtgcaaaaattgttttttgccctgggctgttggaccgaatggtttatgcatggaagagaattacagaaggacagagatgcggatggaagtattgagagaaatgtgtaaaaacttctcggtggaggaagtttgggtttgccaatttccaacagttattgattattgattgaacaaatttaggaatgtgaggtgaaagcggaattgaagaaaaataaggagatgaagaggttctttgaaagtgtgccggataagggaccgattaatccgagggatgcttacgcaggaggacgaacaatgcctttttgcttgtatgcaaaggctacggaagcagttgagatttcgatgtttgatattatcagtttgtacccctttgtgaattatggtaaaaatccgcttgcatttttaatattgccattcacttaagacactccttatcccgttggtgtcccaaaaattgtggtgagcaggaattttaatgtgaattggacggtgcccgacgatgtgccctatgatggactgctaaaggtgaaggtcatccccccgaaggaactgctgtaccccctcctccctgtgcacattgatgaaatgctcctcttcccaaattgtggtatttgtgcgagaaaggccaagaacgagtttgttacgacgaaggatgtgaaaaaatgtaaccatcggccagagcagagagcatttttggggacgttcacttcgattgaactgcggaaggctttagagctaggatatagaattgtgggattctatcgagcgtatcactttgagcaatttgacaatcaattgttcaaaggatatgtgcggatgttcttgaaaataaaggtggaggcgtcggggtggccggcggaggtgaaaagtgaagaggaaaagagagcattcaccgatatgtacaaggcgaaatacgatatctgccttgatcatgacaaaattgtctttaacccaggccttcgtatgatagcaaaattggtacgaaatacgcaaatattaatttatcagcaatgaaaattaaggggttgaacagcttgtgggggaagttttcgatgcgcaacacgctttcgacgagtgagatttttaacagcatggaacggtgggtcgcattgtcacaagacaatacgcttgatgtttcgacaccaatacaaatatgtgaaggagtagagcgtgttgtatatcgtaaaaaggaggagttcataaaggagcataaggtgtcgaatatagttttatctttgtggactacgagcgctgcaaggataaagttgtacgagtatatggagcaggtctacagggaggagggatgtaaaccactgtattgtgatacaggtgttttattataaacaaaatttccataaaattttatatttagattctctggcctttgctcatcggaaggggcggtgtccgttgaaggaggggaagtttttggggtaaaatacaaatttttgaaactctttaaattggctttaagggagatgactcgagaatattccgatagcgagattttggaatatgtgtcagctggtccgaagcagtacgccctgaagctcaggaggaagaaagatggggagatttgggaaaagaccaaaattcggggattcacgttgaataggtccaacaagatgcggtatgaagaattcaaggagatggtgttgggctatcaggaaggagtgaaaaaagtgtttcgttatccggaaaagattgggccgacaagggatagcaggatactctcaagggatgtaaagaaagaatatgggcccgtgcagaggaaagggattgttgatgaaaactttaatgtgttgccttttggatatta

SEQ ID NO: 7477 - DNA, 2034 bp, Heterodera glycines
  misc_feature (30)..(30): n is a, c, g, or t
agaggaaagggattgttgatgaaacttttnaatgtgttgccttttggatattattgaataaacttttgcttttattcctccgccttgtaaaaaagtaaatcatcctttatataaggcatgaattgtatcaatcatcatctatttaagggtagaatttatcaattaaaaatactttaagaatgtcgttccaaaatacgccaaaagaagttcggcgtgcgagaaacacacgtcactttttcaaggcaacccctgacaagggaaagtgtctcgaaaagattgagagccatgtcaacgagcgagccaagtttggtataagggagcacgtaactagtttttatttcaaatgcccaccaaatgaagatgcggaaaataattttagaataattatcgataaactaatacaggaggcaaaggaaaaagaacctgcacaaggatggaagacggaaagaattttgctgaatttatattgtgctgctttgtctgatcctgttatgataccattgagaccactacaccaagtaacttcggatgttgtgctaaacgaatttatgcatcgtcagcaatcatttggcgacgtaaaccttatggacgaaagaatttctgtgatcgtgaccacttttgcatatcctctcaagtgatcttatgtgaaaataaacttataaatacattttttcgctaattacaataaaataatgtcactatttggtagtttttataatccgattggaagctgtgtaagagaaaacgaaaaatttgggataaaagaacatgcgacaagctttcattttagagttgtagaagatgaggacaattatgcaaattttgagcttatcttaaataaaatgttaaatgatgcacgaattaacaagccaaaacgagggtggaaaatggaaaaaatttctgtcgacttttatcgtaattgtctcaatggaccaataagtatcccgttaagtccgctcaacaaaatcacagccaacactctttttaatgtatttatgatgcttcctggtgatggaataatacttgacgatattggactaattactataattattagtacttattcatttccaagaaaaatgaatagaaaaataaaaaatgtaacgggaaaaaatgaaaatattgcttaatgcacataacaaatgaaaaaaagtctttaaccaaacataattttgaatccaattatcgtattattaatttgccttatgatgtcagactttaaaacagaataaaaccttccaccgaacatttattaaaaaatgcccatgaggttgggagccgatggggctaggggtctggtgatgggcatgtgcccatggggctgggggctgatggggctatgggtttggtgatgggcaagtgcccattgggttgggggatgatggggctagggatctagtgatgggcaaatcccatggggctggggtctggtgatgggaaatgcccattggtttggggactgatggtgctggcggtctggtgatgtgtcatagcaggtgaaaaaagggcagaacaggtagcaggtgaaaaaaagggcagaacaggtgaaaaatattgtcataacaggtgaaaaaagggcagaacaggtgaaaaatattgacatagcaggtgaaaaaaagggcagaacaggtgaaaaatattgtcatagcaggtgaaaaaaagggcagaacaggtgaaaaatattgtcatagcaggtgaaaaaagggcagaacaggtagcaggtgaaaaaaagggcagaacaggtgaaaaatattgtcataacaggtgaaaaaagggcagaacaggtgaaaaattttgacatagcaggtgaaaaaaagggcagaacaggtgaaaaatattgtcatagcaggtgaaaaaaagggcagacaggtgaaaaatattgtcataggaaaaaagggcagaacaggtgaaaaatattgtcatagcaggtgaaaaaagggcagaacaggtgaaaaatattgtcatagcatgtgaaaaaaagggcagaacaggtgaaaaatattgtcatagcagatgaaaaagggcaaaacaggt

SEQ ID NO: 7478 - DNA, 5866 bp, Heterodera glycines
actatcactgagtttaaacgggaataaactcgaaaccgaagctcgcaagaattgggatcgcttctacaaaagaaattcggacaattcttcaaggaccgaaattggacaaagcgagagattgagcaaatgtgcgcaaaagacatggaactgagtgtaatagtgaagcgaaaatgattgaggggaagaatgactcacgaggaaagggggacgaaagtgaacttcaaaaatggaatttaacccacgggactctctttctctccttttctacgccttttgcagcggaatgccctcctcacaaattcacaaatcaggcaacaaattccaattccgtggcctcgtcacttctcgggtttcggttatgatacaaaaaacgacctcacgttagtcgtggtttatatgtacgaaattcacccaactttctgcccaattcttttggttccaaagatttttctcggcctttactttttaggctcctttgactttgcttgacgccggttgcggctgtggcaacactttattcccattggccaaattcttccccaattggactttctgtggcgtcgatttttcctcaaatgccctctctttgcttcagcaaagggctgtacaaattggaactaacagttcggccgtttttctcattccattccatttcatttttgccttttcagttcataccgaattggtggatctgtcgggcgataccctcgtcaatttctcttcgcttcctaaagctgatctgatcactctgatcttcgttctctcctccatttccttggagcatcattcaaaagttgtccagaatttgagaaaacttctcaaaccctcgggcagtgtcattttccgcgattacggcgactccgatcagttgccattgacttttgcttaattgtttaattatagcgaattcagtgctatgcatcgattcaacacaaagtccaaaattgttgatcgtttcttcgctcgccaggacgggacaagggcctatttcttctgtccaggttaaacgaactgaaaaagaaaacccaaacatttccgtaactacaaatgcagacgaaacgaagaaattattcgaaagttgcggcttcgaaacaattaaaagcgaatacactcacagaataacggaaaacctaaaggagcaaattcgcatcgaaagaatttttgttgagggaagattcaaggcaccagcgaaagagtgattttccacttcacatattttatcgcttgtttagcactttgcagtttattaggcccgatgaaaagtcatagaggggatctcttgatgattttttttctttacaagggtcgttgatcatggacatgtatttattttgttgtaccgcaccaacaaaaatagaaaaattggccattaataaatcacaaatttatcatcgccctcaataattaaaattagagattgccttaacttgtttcaataccattcataacattggaaaatccggtttttcttggccctattctcacgacaattgtccacagtcagcgatcataatgtctttcgaagcgcgcccggactgagacccctgagcttcaacagctttcaccacatccattccatcagtgacgcgaccgaatacgacgtgtttaccgtccaaccactaaattaccaaatgaccttattatattagtgaaatcgaaatacgatagtttaataattaggtgcttcgaaagggcgtttgtataagcatttctcacacaaactcacttcggtcttcacagtcgtaacaaagaattgtgacccgtttgtgttgggcccggcgttggccatcgagagaatcccgggctgggtgtgtttctctttgaaattctcatccacgaacttctcgccatagatcgattcccctccggtaccattaccgcgagtgaagtcgccaccctaaaatattttttagtatcctttgtaacttgtcagttttacctgcaacatgaaatttggaatcacacggtggaatttagaccctttgtaatggagaggtttgcctaaaaacaaaattttgaagataattatactagattgtcctcaccactctttcccatccccttttcgccggtacaaagcgaacgaaaattttctgccgtttttggaacttaatatttaaaaaaatgaaaatgattagtaactgtccttatgatttaccaatgtccgaataaagctccatcacgatacgcccagctgcttttccaccaatggttatatcaaaaaagactttaggtctcgacattttcagttttcttcttataaaataaataagaattgattactcaatgacaggaaatgaaagataatagttttttaataagcaaatgttcctgagaagctagaccaaaaaacctagatctcgcacctccctaatgaatggaggcaaatggcgaatacattatgggctattggtcaactccactgtgagaaaaaccttgtactatttcgttgtttctctttttcttgcatttttttcattttggcgtactatcacttcattttttatagaaaaatagtatttactttttttatatgttaaattcactttgcatagcaataaaacaggaaaattactatattttttcgattataagacccctttgcgaggggttggaaatagaagacctttgtctaataatcgaagaatacggtaacaaaattttagtgttttcggattagaaaatatacatttttctttttctcttcctttggcatgttattttcaccatatctctaacaaataaaggaacaagaaattcgcaaatctaataattttgtccagcgctcagcctcgcttcaattgaaattatcaaatagctcactcctattctggctattttttaaagataaattaattttaattctctcagtatttgatattccttttatataaacgatattttacttcaaaaatcggacatgggcgatgatttggtttttgcaggttaatatgcataagagataattattttgcaattccaacccccacccaaattttgctcctcttttaagtgcgtggttctttcgggtattctttacaatgcggtataaagtctcctacggaagtgattagcgaaaatctgtaattttttttgaatttactaaaaatgcattttttttcagtgatcccaaagatagttcttgtcgctgtttcacatttagcaataacggcgtctacttcgcttattgtaattcgaataggtaatttacgctgttaaatttccttgttgagtgtatttttttttgttaagcactacaatcgtcgaatcatccactggccgaaaatgtttttccgcagatttgggcaaaactcaatgcattattttttctcctaaagacagttttatggtcacttatgaaccgtaagtcatggctgttaataggttaccctatttgaataaaggtacgtgatctacgggtctcgtaagaattccgatgggtccctcaaaactccgaaccccaacctccgtttctggtcagtgccaaatggcgagctgttggccacagttgttgcagacaaacaggtgcagtttgaaaatactgaattccaatttcaagacaaaaacttaaatttattaaggcagtttggaagccttacttttccgctgatgagtccttaatgttgcgggtgcttggttcggaagttcatttcttcaaaaatggaaattttggttcgttgaatatcaattattaaatcggtcgtggtttagcaaaggctgcacacaaagttgtggtcaaagacatcgcttccttttcgattagcccgggcacggcaatgccgcacttcgcctgtttcattccatcaaaggtagcgcaactgttgcaaatacttttggttacttttggaatatcaaaggattgtcatttggtccatcaattctgtctgtggttattgtgtgaaaaaaaagttaaagggaacccaaaaaactacatttttgttgtactttgaaacttggggaaaagcatatagagatagcaaacgatacgaagaatctcgtattttattccaaaaaaagtcattaaatttgttttatccttacttttcatggttctgtaaatttttttaggatagggtaaatgcaatggagcatggttttcagtgattttctcgcatcgtccccattgtatgcactgttttccatttcttagaatcaaccggcgatgattcagcttcgaagtctttccgactcgttggaggttctcttctccaaggcgtcgttcacttgcgaccgttgcattatgaattggaactcgaagggtctgtggtcattctgtcactgcttcaattccttcccttttaagggaatgctctgctggtgaccgcttctgttgacgtggacaaatccaacaaagtttccaatgtcttttttacctcattttcaattctttctgtcaagtcgtattacggggtcagccatttgtactgtcttcttaccaaatcgtatggcgattgtttcaatgtactgtgactttggtgtagtgccaatcaaacgaaattaatttaggtcactttgaataagcaagggccggtgcattgtgttcaatgggccccaaattcaaaagagttttgtgtttgctatggttttatgccttcaaaggtttgcaaatatcgacaaactttgtttcctcctacgctttttaggtttcaattttcaacacccgtggcgacaccgtttgggagctcagcgaagggcaccgcaacgaagtgtacttcaacccacagagcacaattctggtcacttgtggcttcggaaacattgcttctggcaagatggagttttggaatttggaaacccgaagcgaaatctgtgcattttgtgctcctcacacgactcactttgaatgggcaccggacggacagcacatttggtgattttttggttttgtccgtttcgcgtttattttttcttaatatttatatcctgatacagtaattagtgttaatgaaatacgtaaaatcgactagaatcttttttttctgataagcctttataattaaatcgttttttttgaagcacgtcgaccacagcgccaagactcaggacagacaacggatttaaactttggacatatcggggcgattttgtttatgaacaaaaatacgatcgagaggaactttgggaggttcgctttatgtccaaaaaaaagaaaatgaaatcgcatgttcatttaatagcccccccccccccaccaccgaaaactaaaagattaaagtttaaatgaaattttgttatttggaaacgatgaggtccaaactcatctttttcaagaacctgaataccattcaacctccaatcacagttaaaagcattacccattttgttcgctttcagatcaaatggcgaccgtgcgcagcgtataacaaattcaaaattgaggagcccaacagagagcaaagtacatcaaattccagccgaataaacgacggaaatgccaaaacgcccttcgacaatttgccgaagggatcgctgacgcaaacggcgcgttacgtcccaccgcatctgagaggtgtctcgagaaaagtgaaacggtggaaatttacaaattcaggaaaaccgcagaaaaaggaagaaaaagggaagaacgagacaaattcggaagagacggacgtggggaagaaaattcggacattgcagaagaaattggacgatatttcgaagctgaagacgaaaagggccgcgggccatcagttggagttgaaccaaatggacaaaatacgcaacgaagaacgattgctggaggaaatggaacgactgacggccacggccaactgctgaaagaattagcatttaatgtcattgtttccttttgtttgttgcccttaatgtctattccatttcattacatttgtaaagatcatttatt

SEQ ID NO: 7479 - DNA, 599 bp, Heterodera glycines
aatttggtgatgaaaagtgtgaattggtcattggccactcaattaaaagcgtgaaattccccccccccccccgcttcttatccccgcgttcccgcttcttcaaacttttgttgtccgtttggcgccgctaatcgttgggggaagatggattgacaagagagaataatggaaaggagaaatggcaaaggaaatgagacgggagacggggagtgtcggggttgagagtgccaattggggggggggggcgacaggtggcggaaacaaagggaatttcggagacatccaaaggggtggtcaatcggaagaaacaatttggagggcgggtgggagagttatggggggagaagaaagagtggaggccggggttgccaattgttcgcccgattctttgagacgggaaaggaaagggcgggccgatcaattcgatgtcccccgtcgccccgggggtcattccgatcgaatttcccctcgggggggggggggttaatttgggaaagggtcaagcaaaatcgattatttcccattttattccctttatttcttcccgcatatgcgccattattttcaccgcttttggcatcgcttcagagggggcggag

SEQ ID NO: 7480 - DNA, 4024 bp, Heterodera glycines
tgtgttgcattgtcggtagttgtgaagtccatgattgttgctttgtgggcagttttttgatggacacgcacatggcgtctgatcggagttgctgacaatggccttgggcttgaacgcgggccttaatttaagtttttcttataaaatagtgatttattgacttacgaaggtcagaagctgacgttgacggcccactttcagtggcttgggtcgatgtcccctctccatctgctgttggcgcggcattggtctgctttagccctggaaaatgcagtgtttttaaaataaaattaattttggtcaattttcgtcactttttggtgttcaaccaacactgcgaccaagatcccggcgccattccttccgctttcgccttgcttctacaccagaattgctcatattctttaatttttcgctttttttgcgtgtcaagaccatttttagctgaaaaatgatagaaatttattgaaattttctagggtcaaaaaaattttcctagggtcagattttcttgaaattttgcgtaggcatattttttggccccatctatcgaattctattttgttttttgaaagtatattttttaactcgagatcggctcttctatttttacaagggaaaatcccaagaaaatttaaagttatgcaaagttttggcgttctgattactaaataaaaaataagcataattgtactgggagcccaaaattgggccgctgtgaataacagcaatatgaattttcaaaaagagaaccaaagaattaggaccgacaatttaccgagagcaaaaattttcccaaaagtctccgcccctaaacgagcaaaggatggccgaaacgaacgcaatttgtcgcagaaaccgatagagtcagccaatgtttcaacaatttttgctggtctttttgcttcatttttggttgttgccaacgcgttttcgaatgtgaagactaaaactcatagccgccgaatcagctctacggctagtagcagctcgagattgccggcattatgaaatccgttgaatgttgcatttgaaaaattgaggaaaagggaaaattccaaagaaaacagaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagttacgctatcaggcctgttcaaaattgtagttttcgttttttccgcacattttacaggtcaaattatgatattggtctgtgccactgctgattgtccacccttactgccccttttggaagccgaatgccctgccgatggatttgaagcgctgaggacatcgctttgtagagggcgaggatgtcatatcgttgttgatttgaattattttggcgttttgttttagtttttgtgaccctttattttattttgttttgtttggagtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgtggcgctcctgtacaaaggtggctcagcagtggcaataaacgacaaatttggacgagcaacaacgattttaaaaggaaaagtaaatccttctgcaatttgtaacaggaaaagcaaatcctggtctctggaaaagggaaacaaatccctactgaatttcttcattggttgtggaccacaaaatcagtaaaacgggaaaactaaatccctcttcatatcaaaaaaaaaacgcagcttagaaaaggaaaagccgtaaagtgtgaaacaaatcacgaaaatttgtcagttcggtaaattaactccgtctacaaaactgacttcaaaaccgggaaacgaaaatcccatttcaacatgcaatttcttcgtcaacacaaaatttcgcccgaggaaaattgtaaagacaatcgcaactttttggtttcattacaaaatggtggatgcgaaagtgagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgcaaagtaagtggaaaggcggaacgtgctttcagcgccgctgcagtgaatcggccggcgaaatttgatgcaatacgaagcgaaatggagtcacttttggacgaatgggattgtaccgcaattcaagcattcaacgaattgtgggatggaccaaaacggcgaccaggcgaaaatttggaagaatttgcagaacgagtttaccaacttgtgctttgtgcatatccaggtttgccgttggatttgtacaacgattatgcggcaaaacacttcattcgtgctttggaaaatgccaaaatttcgattgcattggaaatggctcgtcgtccgggtttgagctacgacagcttggtcgcgttggctgtgcgtgcggaaatagcgcaaaaagccgcaaagttaattgcagaggatgaaaacgcacacatagcacgcagctttaaaccaaataaggcggaaaagacgaccaccgattgggaaaaattttacgtccgaccgacaaataaaagcgtctgttataactgccgtaaaattggccacatcgcgcgaaattgtaaggtcaaattcacttggaaaaaatgcggctttgaacaaaataacagcaatatgaattttcaaaaagagaaccaaagaattaggaccgacaatttaccgagagcaaaaattttcccaaaagtctccgcccctaaacgagcaaaggatggccgaaacgaacgcaatttgtcgcagaaaccgatagagtcagccgatgcttcaacaatttttgctggtctttttgcttcatttttggttgttgccaacgcgttttcgaatgtgaaggctaaaactcatagccgccgaatcagctctacggctagtagcagctcgaaattgccggcattatggaatccgttgaatgttgcatttgaaaaattgaggaaaagggaaaattccaaagaaaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagtcacgctatcaggcctgttcaaaattgtagttttcgttttttccgcacattttacaggtcaaattatgatgttggtctgtgccactgctgattgtccacccttactgcccctcgatggatttgaagcgctgaggacatcgctttgtagagggcgaggatgtcatatcattgttgatttgaattattttggcgttttgttttagtttttgtgaccctttattttttttttttttggggtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgttttttttcttgccgttttggtttttgtcattttttcgcgtcctcgcgacgacgttttattagctccttttagatatttttaatttaatttaatgtacttttatttaacctttatttttcatcaacaataattttattaattattaaatgtttcaattaacattaatcaataaaaataaatatccaattattaataaaaattttatattaacagagaatttcagttttatttttg

SEQ ID NO: 7481 - DNA, 1039 bp, Heterodera glycines
ctgctggccccgttttggaggcgttcggcaacgccctgtaattgcagaacaacaacagcagccggtttggcaaattcatcaaggtacgtattacggtagtagaagtacacggtattttttataattaaaatgacaaattaaacctacttttcaaaaaacagtagtgaagagtattaaaaaaactataaaaaaaaacatatttgaatttaaccgcatccatactaaattaagataaattttaattaataaatatttattatactattttatgttttcttaggtgaattaccgagaaaatggcattgtttgtggagctaatgttgaaatttatctgctcgaaaaatcaagaatcatctcacaggcagttggcgaaaggtattggtttcgagttacgtgttgagatttgtcgtatccctaatttgtaaggttccagcagagactcttgctcttgactttcgaagtcaattatccattaattaacaatttataggataaaataaatagaggattatatgtaatccaaaaaatcattcaccttatacctggacgctaaaaataaaatttatttgtaaaattctttttttttatgaattaccacgtgttctactacctgttggagggtgcgtcggaacaagagcgcaaagatcattttttgttggagccaaaggattattactatctgaatcagaacagtgccagtgatagctgctgccccatctccaatgatcagtgcaatgaaaagcatgaatttgaacggcttaaacatgcgatgggcgctgttggattttcggaaaattcgcaacaaaaaatttatggcatgatttcagccgttttactgctaggcaacattgagtatataaaggtattgttgaaattttttggaatcttatgaaaatttaaatcggtaggctctgagaaaataagtgaaattttgttaaaatttgttaagaaaatagtcaaaatttgggaaaatgcctaattttcaacaaaataaattgttttccataaataaagaaattattaattctatttgtattta

SEQ ID NO: 7482 - DNA, 4293 bp, Heterodera glycines
tgtagataattttaaattttaaaatatcttaaattaacataaaattatttttaaggcattgacaatgcgacggacagtgctaaagcatgacgtgctggtcacgcgttattcagtggctgaagcaacccaaacacgtgatgccatggcaaaatgtttatacaatgcgttgttccattggattgttttgcgaataaatcgtaaaatatttttttattttaattaaaattaaaaaatgtatttttaatataatccttttttagattcattaatttgccgagaatcaactgcaataaacaaaaatggcctttatattggcattttggacatttttggttatttcaatttaaatgaattaattataatgattatttttagaaaataatatttaaaataaaaaatgataataaaaaaaattctcaggttttgaggatgttggagctcaatggaattcgtttgagcagttgtgcatcaattacgctaatgaacggctgcaagcctattttaaccagcacattttccaatttgagcaggaggaatatttaaaggaaaagttggtatttaactgtctatttttagaatgaattttggttaattgaaattttattttattggatttaggttaaatatagagccaaaaacgggaggaggggggggggggtgtaaaataatttttaatttaattaaattattttttctaaatttctataaatagaaggcttttcatggatattttattaagaaaaaataaattaatttgaaaacaatgcgcgtttttattattattttgcgattttttctattttaaaaaataatttaaaaatttacataaaatattcctttttagtatccattggactacaattcaatacacagataatacagaatgtgttcaaatgtttcagtgtaaaccatacgggtaaaatttgtttttacaaaaaataattatttaaatcaaaaatcaaattatttaagcttacttcgtcttgtggatgaggagagcaatattaacaatgaaatggtttcaggtacattttaatgcttggtgataatttacgcaaaaaaatgaatccatttaaatcaatgaatatttctaatttttttaaaaattgggttttttctgcttttattggagtatttgtgttttgatttaaagcactaagattaatttttgtttaaggacatcaaaaccaagtcattatgttaaggcatagaaatttttcatcattttcaagaaaattaaacggttttagcggttctataaaatacggttgtttttaaacaccgtaatgcttgaataggttaatgttttttgttagctaattgttcatatatttatcaaatacagttctataattagtgccggattttgacagaccaatccatgctggacaaattgaaccattttttgcgcacaaatgaatactacgaagtgccgcataagcgtgaagcagcattcatcattgcgcactatgcgggaaaagtgaaatatcaaattgctggttttcgtgagaaaaacaaggatctgatgcgccacgatgtggtcagagtttttatagtcaaacccaattaataaattattttaatcgatttaaaaaatcgattttttcaatgaaatttgtcaatcagaacttttgatttttttaatttcagaatttaaacattttaaaaatccttaaatttccaaaaataaatataattaattttatgaaattaatttttttaagtttactaatttggaaaacttttttaaaataacaaaactatttttttaattgtagatgaacacgttgaaaggcagcaaaagtgcctttgtgcgcgagttggttggtgaggatccgcttgcggtgttccgatgggcacttgtccgtgcaacattccgtgccgcgtatgcattccgcgcagctgggaagcggaacaaacgcgcgggtattttattttccaaaattcccaattttctgtatcatataaaatgatttaattaatttaaattttttttttgtaaaattagagacatttaggcagtgttgaccgctatgggacttcaaccgttggcaatcatggcattattggcacaaaaattaatggcgactgtgccaatggaagcccaaaaatgttgcatcggcgctcatcagactcgcggcttaacgcctttctgcgaggggaattagcgtaagtttggtatttccaacagtaactatttgatactgtaaaaataatatccctttatttttaatccaggcccagcattgtgcccgacttttgtgacacttcagtgtttaagacaattgttgagcgggcgagaaaggtgtgcgaaatttacctgtcataaggctattagcaaaataataaaaataataagccgactaataaatataatgttgatatttattaataaaaattaaaaaaagtttctgatttttaacaaagaaaaagctcgaaagaagcttaaattaagaattttattttttgtttgaggctatttttattttcttcaatttgtaagaaattatttttaattttattttccgtttttagaaaatttaagtgtcaaaatgatttataaagcatgtgctatgtttaaggcgccaaagaagccgcacaatgacaggttcagcaatttgagaacactacaacaactcaagggaatcatgtccaaaaagaagcagctttctaataagccaagttcggtaagaataatcgcaaaaaaacattattaattaaaattattgaaaaaattataattaataattaaacacaataataaaaaacatatttaaaatgccaaaaaaaggaaaaaaatcagtaaaatatcttccgaaggaaatggtttcataatgttcttccgctttttatattctttaaattcaatttttcatcacgctaaaaacattcccggatatgtttactttttgctaatgaatttaataaacataaaaattttattttttggtcagcaaaatttcaattagtctatttattccgattctttgttccggcaaaatttaaaaaaaatgtttccacaaattttatatttatttaattgaatctattttttttttcaattttaaattgggttgatgattgattattcgatattttatgaaatcaaataatttcttcgtgaccataattcggttttgattagaatttattctaaaaatttgattaataattaagcttttttgtgaataaatttttattcatgcgactttcaatgaattgaaaattcttaagtttttcaaattttaggttagccgccaatttggcgaatcgctatctcgactgatgaaaacattggaccgggcatcgccctacttcatccgttgcatcaaatcaaacaacgataaaattccaaattattttgatgacaacatcattttgcgccagcttcgatacaccggtatgctggagacggtcagaatacgacgggctggctacagtgtccgcattgaatacggggtactgtacaaaatacaatagaagcaacaatttgtatatttgataagatatattgttaaaaatttttttttagtctttcgcaaatcagtaccgtactctgcttccaaatggccataatgtaagttttggaattcgtaatttattttccgccaaatcattaaaatatttgaatgaaactcgaattcccgtctttgaccttgagtctcgaccttaataatcagaccttgcgaattcttgaactgttgtatcggattttatgctcatctcgagtactaggaaaatacgactctcgaacatttgtacatattagagaccggcaattcaatcggtatttttcaataaagttccgaaaaaatcgataccgaaaaacatgtgaaaatttctacatcaattttttaaataaaatatcgaaaaacacgaaaatttcttgatgggtttttttaattatcgtagtcatcgatattaatatcgactgataaatcaatcgtgccggtctctctctgtctttaacccaaagcgcctgacacctcaaatatatctctgacaggtcgaaggatattttttttgaaaattctcatttttagtcgaccaaggaagacatccaggagttcattcggtccatcccggtcatcgactacaacaatttacagtatgggaacacaaaaatttttatgcgtgacacggagaaattgttgctggatgaccacttgcatcgggtgataatgaagaacatcgtcacactgcagcgctggtttcgtgccaagttggagcagcaccgttaccagaagttcaggcagggcatcatcaaattgcaggtgatttgaatggcttacg

SEQ ID NO: 7483 - DNA, 2810 bp, Heterodera glycines
  misc_feature (2399)..(2399): n is a, c, g, or t
aaaaccctttttttaattcaaaaaatttttaagaaatttcaagaaagaaaaaattaggaaatttttttagcgatttttttcaaagtttaatgatgaatttttaaaaaaattgcaaaataaaaaagtttcaaaatttttgaaaaaactttcatttattttttttcttgaaatttttttggtaaaaattttttaaagaattttgcttgaaaatttctgtttgaaaatttttttagaagcattcgacggcgagattttgtagcgacttcgggcggcgagattttgtcccgccccataaaatagcataactaaaactccaaaaattattaatttataattttcataattatgttaaacatttaagcgaatcttctgagcttgatcttgacgccagttttgtgctagaaaatgcgcgtttaaagctgatcaaatcccatgatcagaaacaatttgagaagttgatgcacagacggcaatcattggcgataaccgtttccacgaaaaaagtaaaataatcttttatttttccatttaaatatttattattattattattataatttagctaaaaatgcttcgtcgagcagctagcacagaaagtgatcaaattcaacgggaagaagaccgaaacgctatggttaaggtgggggttatatgaaattcaaaaatggcacagatttacaagaaatttcaaagaattttttaaataaatttttgcaaattttcgcttgcacattttcagattaccaattccttttcaaaagtggcaccacgtgccaaaagtggttttatgaaagcgaagaagcacctgaaaactttgctgaccaagaccgggcgtcagggcaccacggaaggcacattcagtgaggaaagcctgaacatggaaggaccgtcttcgtcaacaagaaggtcacaaagtgtgaacaactccatggatagccatggatacaaattagaacaaatattattaaacaattattaaatacagaattttttggcaaaaatttttttgcataatatgtttttttcttggcacaaaaaataaaaacatcgaatttctgagtctgtttggaccagggctggccgtgatcacggctcacggatcacggaaatcacggggtttttggggtgccgtgatctcggatcacgggtcacggattttttcaaattttccgtgattttgatccgtgattggcattttatatagggaatttttattgagacgaaaataggaaagtggtgtgaagaattttttgagaaaaataaataaattctttcctgcttacaaattagaaagtaaacatatatatgtagtctggtggttaagccttctgtctttcgttgtctgtcccttgggttcaattccccattgggataggacaatttatatattttgttttgataattttaattgaaatttaattaacaagaaatttcataacattgaaaattttttttctttattttttaaaacgtccatagaccaataaattaaccaatgattggacatattttggataaaatctgttaacaaattcactcaaaatttcaaaatttttcccggcggcgcctgtcggcaccaccgacagacggacccccattttaccgtatttttgaaatgttgaccccaaaatggcagaaaaattaccatttttggcatataaactgctaaaaaccctattttttctctccgtcgcttaaatttaaaacgacaggcctaatcaaaattttcagaaaattttcccaaccctctaagaattttttcaaaaattttcccgactttcagtatcttttggggtgttcagattgtcatgaaggactgagcatgttggtccaaaagattttttcagcatcaaaagttagcttacaaattagaggaaatttttttctctacataaatagatttttggttaaatttaagaaaatttgaaaaattttcttaataaattagttaaaaataaaaaattttccttggagatttctacaaaaagctctaattttcctcaaaaaagtgccaaaaatcgtaaacttagtcattttttggaaaaggtcgccgcaaaaaaagcggtttatatgttttggtttctttaaaacattttttgggaatttttcccgcgattaaattccgttttttaaataaatttaaataaaaaatcattagaaaatttttttttataatcacggatcacggctcacggatcacggaaatcacggggattttggggtgccgtgatcacggttcacggatttttttaaagccccgtgattacggctcacggatttccgtgattggaaattcaatcacggccagccctggtcagtacggctcttcattcagatatgtataaagagaataattgtatttttttattttcaggtatgcctaagtagttaacaacaancttatttacaattcaaaaattaaatggatatgacatcggctaaacttgaggcgttcaacaagcttgaaaataaaaaataattatttaattgtttgctttttatatttaatttgttgaaatttgctttttgtttatgtgactctacgggatgaatccaaacatcaaattgtgtaataaaaattcaaatttacgttcatagtttatttggatttagaagagccgtactgaagaagaagcccacttttccatttattttttcaaatgaaacattttttcacgaattttgcgcaaatgtccgcccacaaattccctctgcggattaaattcagtgccgtaaatgttttctgattatcataatgttctgatttggaaatttctcccatgggccttttggcaaataaaatttttttt

SEQ ID NO: 7484 - DNA, 1069 bp, Heterodera glycines
cttgcaggaatggcacgtgaacggcccgggctcgacgcttttcgaagaggatggagggactgtaaggaaatgggggacgatcagatcagaataggacaaattctgatcaaaaagcagtgatcagaaagggacaaatattgatcaagaagcagtgatattgtaaggaacagagaaaggaaaaaggatcggaatgggaagaattggaaccaaaaatagtgatcagaggaataacatgccgaccaaaatagtgccatcccacctggtgcttctgctggagctgcttcctcctcccttttgctgtgctgttcgaagtcggccgtgtcagtcccttgctcgcgacggccgttgccgctcggccagcagcactggtgttgttgtgccgattgcacgcgactgctacagcccgtgctgggcgtgtgctgcagcagcaaaccgttggcagaatttgaacggtgtaattgtcgaggattatgctgaatggggtgggagtgaagtggtggtgaggtgagaaaggtgaaatgatttgggaaaggggggaggggaaatgccgaaaaaggataagccaaaagagagagggggagggagggataaccgaaagccaagagggaaaggaggggaaaggaggacaaacggatttccccaacgaaaatgccatccctcccacaattctccgatcaccgaccatttcgtattgtctttgccttcgctgtctttcctccttggcgttgtgcattgaacatgtttgggtgggcgagaacagcaacaaatcgctgtggtcgctgaacgaagtttgttctgtgggggctggcggcagcggaggcgacgcggcggaaaccatttcatcagcggaagcgagcagacccaacggggaggaggaggcactcgacttgtccgtctgctgaatgaaagtgattagcttaaataggaggggggaaatgcccgcggggagtgcccaatgaattggtcaagggcaaattctaccgtatcacactacagtacacccaacaacatttgttgtacctgacagcgtacaattctgtgctcgatgaatgcgctgaactcgctgatg

SEQ ID NO: 7485 - DNA, 2921 bp, Heterodera glycines
cgctaaattttttttttataaattcctattttgataaaatttttagggcgggagatacgggggtgggggtagaatgaactgttctcgaccgataattgccaatttgatcggtcgcccccccccccatccaattgtccttaaatgtccttccgtgccgtacttcttccatcggctcttcctccacctcctcttccatgcctctcctgctgctctcttccgcttcgtcctcttccatcgcttcttccgcctgtttcttccgtggccgtcccctccggcgctttgtccccgcgacatttgtcctgccgtttaacgcttcgccagcactcgtcgactgcacaaacaaccaaatgaattttctttatgactactgtactaccgtaacggggttgttcgtcgtccgttgcgtttgcctcggcgtgccgtaacttttggcaccgctcgcgcctttccccggcggtgtccccccattcggctcctcctccgcgatggatgtcaaatgggcgttgttcacattgtggttgtggggctgctgctgatgccgtgccattgttgtcaccacaacatttgtgcacaaaaggccttcctccgccgcgttggactcggaaattccgctgtcggaagaggccaaaggggtgccatctgacggaatgccaacccggtaacaatggcattgccaattcaaaatgatgattggcacctccttgcttcgtcggtttgtccgaagcctgcgcttcctccttcggtcggtccttctgctccgtctgatgcccttcttgcccatcgtctttgttgttcatctcctgctccacctgctgctgcacaattcgctttcggcccctccttttgggtccattcgtcgccgcgggggcgttggccaacgacggggcgcttctgccgctgccgcttgggttgcgatgctttccaagcgcagttggggcggagcaaacggaagaagtgaccatctcaaaacaacaagcaatgttttttgagtgcgcatttcttgcatttctccaccaattacgcttttcaacctttcgatcagttcctttccttcccttggcttttgcccgtcgacttttcatcctttttgggcttttccaatcactgatcagtttttgtattcctcgttcccctccccatttatcttaggctttccttaattccttttcccacttccgatcactttttctgttcctcatcccccccccccctcgcttcccctccccttccgcttcatctcctcctttcccctctttttccccttggccatgtcccacttgttgctgttgctgcttctgttggaggaggcggttgcgactgcgcagtcgcgccccaccgccgcctccgctgcttccgccgctatttgcgctttgtctgtccggcgaaggcgttttggcggatgaatttgttgtgtgtgaagaaagtgagcagaagtgaagtgaagagggaaatgaagaagaagaaaattatggggacgaagaagagaaattggcaatgggaaaggaaaaattgggagaaaaaagggaggcgaaaagggcgaggaattcggagaaaaatttgaggacgaccggcgatcaccgggaaaagggcaattattgtgctgcagggaagagtggtaaagtgaggatatgataattggaaaaacaaaaagcaaatgatcagatggggacaaaaccaatggcaaaaggggagagagggggagggggggggggtgaatgatcagatcaacttaggaaggagaggggagggaatggacagcaaatgatcggatcaacgggggctggacttataagctttgccattgccgtttttcacattttgccatttttgccgtgttttctgagaatggtcccacctttctctccccactacatggattctctgcttctgctgctttgtttgagaaacgtggccatttttactgtgccgcgtttcttcagcgaatggtcaaaagaaagaaattggcgaaaatgtcagaaattttggcgaaattttgtagggaaattaaaaaggaaaatttattgatgaagaatatctaaaagataataatttttaatcggaggggtgccaaattcgccaaaaaaggcctcggcccatgctatgccatgtccacaccccaacaaaaacaacaaatggataaaatcgttggtttttcgtaaaaatgcccctcaaaaacccctccccccccctttccccctttctctctctctctttggcccttccgtctgtccgtcggttgtttttgccgtcgttttctgttgtgtgtattttttgcggctgtgtttagcgggcaaaattggcggttggttcgatggatgggctgacgggggacagagggaaaggggggggggggagtggccgcctcttccgacggcgatgccgtcgcaaaaggactggcaaaggaagaagcaacggggaaaggaccggcggaccctcaggggacactttcgtccgtctggaccgtggacaagcgcgggtggcaaagagagtccccagcatcggagggagcattttgcgaataaacgaagcgtaacaaaaatgccatttgaaatgaatgtggtggcttaattgttcggattcaaatgcaattcgttttggatcaattaattaattatttcaataataatcagtcgtagcaaaattacaaaataattcttatgtttttagttgttttttgttttgtaatggcaatttattcgctttgtctttggtactctttcggcccctctcactcttttctttccctcgggccactaaaaagggactcgccgtttctttcttctctgtctgttgtgtttttagtacaacggacaaagcggcggccggaatgggcacagaatgccaatgggcggtgggagggggggggggggaagcgggcgaatggacagaacgaacgacgggcccacgggggaggggaaatg

SEQ ID NO: 7486 - DNA, 2042 bp, Heterodera glycines
aaaaaaagttttgacctgagaaggtttaaaaacccaatttttttttaccatttttagtcatagcttttttgaatcttatgggaaatttttgaaaattttgtagggtaatagaaaacccttaggcctatcgaatgatatcaagaattaaaaatttagatgcttttgagcaaaattatatcaaaaaatattttcatttgatggttttttgactaacgtcatagcaccgtttaatttcatttttaatttacatttttcatcataatttttttttcttcagcaatatattgtaaatggaggaccaagacaaacaaaatcaacaggaaaggaatgataaaaacgacagccaagaagaaccagaacaaaaacacaaaaatcaggaccaaggtcaacaaccacaacaacatgagcagcaacagcatcaaacttcacaggatggcaatgggcatgcgaacggcgatttattgagcagaactttatcaatgccggcccgtgtgactggctcagatttcgtatcagcggatgtgaatgaagtgttggaggatgcacgacaaattatgacaaattcgcaccaacgaaaagacgaccatcatcaaaatgaacaagtgttggtcagtcagtttgatgatgacaatttaaatatgggaaagctaaaaaagcgcaatttgttaggacgaatcaatgcgggtcaaagtgacgaagacaggaggtgacgaagaccctttggaagtgtcggtgtggcggtcaagactgctcagacgtcaggccgaagaagaagcgacggaggctgctgatgctgatgcgagaggtaattcaggggggggagataaagccaagagggaaaagttgggaggaaaatgacaaacatggcataaatgccggtaaatgaccaaaagggaccatttaaagccgctttaaaggacccctcatcagaggaatgaatttaaagggtttgaatacaaaaacgaatctttcgccaagagaaatttgaattaaaaaaatgccaaatttcacgcaaaagtccccgaataaaaaagggagaagtgacgggactcattcacttcactcatcactgctcggaaaagtgtccctctctctcgcgaggcgttcgatcggtcgattcgaatgccttcagagagcccaagagaattcatccattggtacagctgctgaaggaggggagggaaggacagaaaaaagagagaataaaagaaaaaatgaaggggaattggagagggggtgagagaaaggggcagatggagaggttataggcagagagagagagagagaaagggcattattggaaaggtcatagccgggcaggagaggcagagtgagtgagtcggtgtccatcggctggcgcgaaggcggtcggcgaacacaaatcggccaggcccaggccaggacagccacgtccgtccgtccgtccgtcaccgctcgctaagcgtatgaggaagaggaagagaaagagaaataaaaagaaatagcgaaggaacagagagacaaaggacagtgatcaaaaggccatggccttttccttttctctccttatttttactctgctattctgtcggatgtgttcgtcatgctctctctttctctctccgtttctttctttctcatccacctcttctcccccattctctctgtttgataaaatgggccgtggccatccgagcgtggccatggccagcagatgtggtgccctgagggcactcattcgccgctgatgtgttggaattagtgacagccgatggcaaaaaaacccgctcagttcaaccccttgggggggggggggggagacggcccatgggacacttcttatgtctctgcctgtccctcctccctcaatgcactctctcctcccatgcccactttctttctctttcgcctcattggaaaaaaaaggggagggggagggaagaggaggttggaaagtgtcccgtgaccatcgaaagggaaaaagaaaaaggacatatacaaaaaggaaaagggggagggaaaaggagagagcggaaaagaagtaagaggaaaaggaagaagag

SEQ ID NO: 7487 - DNA, 3114 bp, Heterodera glycines
tgctaaattttgttcaatttccgaatatgaagagatttatcaccccggctaacaactactttttgaaattgactccggaaaaggaaaatgaggggtttgttgaactgttttattattattcttattattatttaaatattattcattaaatatttaaagtgtaggagaagcaaatgatgtgggtggaaagaagaagaagccaaaaattggaaatgaggacgaaaagagcactgagactcgtaaggaggaacatcaacaacagcagcaagaagtgcaagcagatgaatcgcctgcaaaagaacgaaaagtggaggaccgcgagttgtggaagctttgcaagggaaaattcatgctttctacctacttatgccagggtaattgtataattatacctataaatgtgaaatgacaatttttaagatgactggaaccatctttaccacaacaagcaaaaagtgacacgtttggaaaatggacgctactccgtcagctatgagctttgtcccgagtgtgtgtgggcaaactgtcgagcaactgaccttgtggcaccaatgaagaaaaaaggaaaatgaccaaaaaataataacaataacgaacgattgattgattgaccgatttattttgctatttatttttatttaatcgaattaatgtaataaattttgagaacatctctcaatttttagtctttcgggcatcgcatgggttattactgaatacttaattagcgtctttattgccaatttgaatctgtcaacggattgagagacaagggatgggaaggggacgaaggggagatggctggtgtggttgagacatcgctgcgcatttcatttgtctttgttgtgctctcggttacccccaaaattatttaattaaatttaaggaaaattatttcaaatggagagtgagcttattgctcaagtaaaggaatactgcgacgccttcctgtcattgaaagtccatgttaatgacttgaaaaacatggcaatcaatttgtcttcaagaacagaattaattgaaaagtgggccaccaattcggtataatattagatattttacttttatacacttgaataattttagcgctatagcccatacccaaaaggaattggctcaacaatggcaccggcagttatgcgggaatcatttcaactgttaaagcaacagtcgaaccaacgacaacaactggaacaacgaattttgcgcgacggcaatttcgaagaaactgtcatgcgcactgcgattgcgtcactgaaaggcacaatcaatgcggcatcggctgcccaatcatcatcaccaacgccacttgatgatgcaccgacttcatcatcatcatctatgccaaaaattgcccaaaagcgcaaatatatggccaccgatggtctgttgtcggaagaggacaggggtaatttgattttaatttgaataaatttataaataaatatttttcaaaagaagtcgccgccctcgcacttgctgccttcaatcatctgaaggtgcacattgagcagaaacaacaaactttggagctaaaactcaacaaaattgagcatgagtcaaaggcaaagagcgaatggcagatgcgacaactgatgaaatcattggaagcaaatttcaaactacagattatgagtatggagcaacggcttgacagaaaatggtcagcattgattggaaaagaaaaggaaagagctcagcgaatagcgacacaggcggctacggtgatcggtgagttgattgcggaaggaggaggaaaggggaaggaaaaacaatgcagtggagtgatgtggagtgacaaatgtaagtggtgtctggatgctgggaatgtatgttttggatcatcaaactgtggtcatgcttttgtttgtcctcagtgttctattactattgcgggatctgatcaaccaaaatgtctcacatgtttttgtgaatctactgaatttgtgtacttaggtatggaaaaataatcataaaaaatgaataattttttttaacttaatcagcatttgttgtttttatattccttaatttctaatgcattaattaatttatttattttgtccatcatttactttatcatcacttattgctttttattccttaatttcaaatgcattaatttatttgtattgtacttccatttatttaatcaacatcttttttattccttaatttgaaataatgttgtacaaccttttatttaatcaacgtttattgcttatgtatttcttaatttcaaatgctttaattaatttatttgtattgtgcttgcatttatttattcatcatttaacttgaaaatgtaataatttaattatttgattgtccatccatccatccatccatcaatttacttaacatcatttcaaatcattcattcactgctcttcctcatcaacatctttatgaccatcctcgctaacacatttcgccatgcaattgggaataaattcccgtgtcaattcggccttggccttcaaaattttgttttaaaaacccctttaaaaatacaccttttttttcatgtcggcttccacgtcgcacccaaaagtaacatttaatcctcgaatgtacggcactgggaccgtatgtttgttgcaaacgaaaaggaaaaaaatttttattttttaatgtcattaaaaatgcctttttggtagcggggattagcctcaatgtcgctcatgaggctacccgccacgcgctctcccaagagcaggcgtaataccgcgtcaattccagcgcgagaattaaacttgccaacagattcggaacattcggtatcactggccaatacccagcactcttctccgggtgcgcctgacacacacattaattaagcatcaataatcagaactacaccccccccactaaaaataataccaaacaataggagcatttcagtattttattggttaactctcacatttgttcaatttgagtgaagcatgtaggctagtcagacagctaacccgcaccggagtgtaggctagacaatcagccaacccgcacacccaccctaaccaaagaaatgtatgagcaaaaacactaaaatattgaaaagttcctattatttttgtgttatttttatggtggagggaaatgacgtcaata

SEQ ID NO: 7488 - DNA, 2824 bp, Heterodera glycines
  misc_feature (159)..(159): n is a, c, g, or t
atcagctgcagtaaaaaggcccaagaatggccctcactcgaaacagtccttttttgttcggtcctgtcttctttggtctctgacgcgccgtcgatttgacaaacattcctgtgcccgttgatttgttgctgttttttcgtcgtctttttgcgctttctntagtctgggacagttcctcaaatagaattttttaatttacaagtgtgtgtgtgtgtgtgtgtgtatgaaatgattattgacaaattttaagattaaaaaaaaggaaccaagcgaaattggtataaaaacattttttttggctttccgtttacccgacagcttgttgaccccgtcccccgttgtccaaatattttttttacaggcacggttgatgatgccaaagtgccaccgctgcccccgtcgctttcatttccattgttcgtcgggtccttttgttaaattaaatttaattaattaatgtttggtaagcccaaaaccacccattaccatcattttaactgccgcccgctttcccaattgtttttttggtgccaaaatgtcgcctccatcgctttcttcttcattgttctggtcctgtttatgttaaattaaattgataccgtttggcaaacccaaaaccacccattaccatcattttaactgccgcccgcttttccagttgtttttttggtgccaaagtgtcgcctccgttgcctccgtcgctttcttctccattgttcgggcccagttgctgttaaattaaattgaggcgcttgtcaagcccaaaaccatccattaccatcattttggctgccgcccgcttttccagttgtttttttccaggcgcggttgatgatgacaaagtgccgccgctgccatcctcagtttccgattccttttgaatttaacaatttttaattgtactttgcaaacccccccccccccctcctcaccgtcattttggccgcacgttttccagaccgcaaaaccatagccattttaaaaacaattacggaatggctaaaaaatgtagcgaatttaaatgagcaaatgtaattcggaacattttttccaatggaatgaccccccgcctccctcacattttccaacataaaaatggcgtccttttctccgttccattccataatcgattgttgagctcccccctccccctcacatatacatatatttgcacaaaaagttttttattttgttcagatgacgtaaattcaaattagaataatgattatatttgaatttttattacaaaaattggtgattaaaaaaaaaccaggcgtcccattcccccccccgtccgatgcataaattaaatattgacgacggtccctgccctccgggcctccccctccccctcctctgacgacggtccctgccttccgggcctcccccttcctctgacgacggtccctgccctccgggctcccccccatcgcgtgccgcccgcctctgacgacggtccctgccttcctttcccgcacacacccccaccccgcacaatgcgcgacacctcccccctcccggaccccctcccccctcctctgacgacgctcccggctctcccacaggcacgggtttgtgcgcgaaaaacaggcggcgcgcgaaagcaggcggcaacatcaaagacccgcaccgcccccacaggctcacgcctgacgacggtgcgggtgggttaactactttccatatttcgcgatttatgtccatatttccatatttgtccatattatggcatttttatccatattttatgtccatattttggaatttttccaaaaaaccaacggcccccagcagctaaattggcctttttgagcccaaaaaccggaaaattttccaaaaaatcattttttcgccaaattttctcgggaatattgaataaatttaaattttcttaaaaattaataagtttatgtcaaaaataagcaaaaaagataaaatgtaacttttctggttgatttttcgctaaaaatgagtaaattttagctttatcgtgtttttttcttctaaaatgatttttaataccatacttagccatttttgaagggctttactttatattaacaaatttaaagaaattttgggaaattataccctcaatttgaaaatgtatgtccatatttttgccattttatgtccatatttcgcgatttttggtccatatttttggccatattttgcgattttatatccatataattccccgccctagttataagttgtatgattttgcatattttttctacgcatatgccatgaagaaaggggctcaaaaatagcatttctacgttaaaattctttgatttggtgaaggtttttagtgcatataaaagcatatttttggggttttcgagaataaatgcatatttggccatttttgggttttgagtccatattttggtcatttttgttaaattttcataagaaaatgcgaaaaaagcgaaaaatacaaccctaaggatcgacgttttggaatttttaaaaaaatacacccttaaaaatcgaaaaaaattttaaatttttgtaagaatttttggaaaaaaatttatgtatataaaaatgtttgtttgttttagcatataataaaatttataaatttggaaatttcaatatttttgcaattgtctaaaaaatgctccttagcccttgttttggtgttttaaaagtcaattcttaatttatacacaatttttggcattttttgaggcatattttagtgcatatttgggcatttttcgggtttttagggcatatttgggggatttttagtgcagattttatgcgcatatttggcattttttagtgcatacaacttataactagtcaa

SEQ ID NO: 7489 - DNA, 4637 bp, Heterodera glycines
  misc_feature (55)..(55): n is a, c, g, or t
agcgcactgccacccatgaaagcacaagacgacagggcaactaaactactcatanaattattaaaagaattttcaacgaccattgaagagctaaaagtttgttgacaggataaacggagctttggcatcaaccgccctggttaacattagaaataaattcgaataagattgtccccgaaaaaaatgcctttaatgagatgatccctagctttattcaagattttatgaccccgattattcaaattaagggacaatggaaggagggaggaggggcagatgagcgagaatgagcgaagcaaatttttaaaatgaatgaccggctgcacgaaaggccatcgaaatggcttagaccacgcccaattgaaactcaattagtgccaaatcgtatggaggtgccgggtgcttgcactacagcatccatgcgataccctaacatgagctgtactcatttcattttgccattcccaaataatactgattcgccaaaatggcaggcaagagaagccaaggcaacaacaacatttcactggcaaaaaaagccaaattgcataaacaactgccgacagagttaatttgagaaatgatcgattttgtaccaatgatgcatttgtttggcggcatttcatgcaaaccaggttctcgaattctgacttttaaatttttattgaaaaattaggaagcaagcggccaccaactggtattgcggtcattaatcgattttttgaatttttacgcaacaaacgacactgcaattttgccacaatggtacaaatgtttattaaacagttaaatgtgatttattaatatttcagatgagaattcgtttgaattttgaaatgcaatgtgcgaaaagaaaacttgcatgtggccaactgtgcatacagtatcggttgcaatacaaacttttggactccacatattttgccgattttgctcgttatctctgttatgggagatcgggacgtatcgaatgcactaaaatgttggtcaactcgccaatggagttggtgaatatttattttttaaatcaaattactaaatgttcaatctagtcttgcacaactggggctttgtgcactgctatccttgactacatattgagcagccaaaatcctctgacaatgaagaagagaacggcaattgctcttgttcagcgtgagcacttcccaccaattttgagaagcaatgttcgcgaaatggccgaaatgggcattggacaaatgccttgttctgatgtaggtgaagcgtaccgtctgatcaacccacaccattcaaacgatgtgggctatcttaaaatctatgctcgatcggatcttcgtgaaacttttgttgggatcgattttcccgaattttatgttttttgcttttctcttgactaaacatttcaaagaaacgatgctcaaaacttatcgatttaacattcgtttgagaataattaatgagaacatatcggggcttgtacaattactgagtgctttaagaaaactgtcaaacgaattcccaagggacatgtagtaaatgaacacgatgcagtgggcaccacaagtagacaccaacggggattgatatggatttttgttctttctcactccctttggaaatttgttgagaaataatgtggtaatagtggatggaatgggttgggcgagactgtcaaaatagagcactggtgcatccaatcccttcgcatagacagcgcaccaatgagagccgtccttgtagtgtgcgtctctgttcacaatgagcgctgcgggatactgtagtgcggagggagatggcaattggtcactggcgtagcaaccccgaaatattcgtgtggtcaacggatttcctttcaatatcgttgcgatttgcacgctgtccattcttcagccaaaaaattgaacaaagttgatgcaacactagactgacaattaacatcaaatataaagcaaagagtgcccaacagacgacttgttgaaaaaggttgctttcctctggtctatctttgcacagttgaattaggggtggaaggagagcagatattgactcttgttcgtcaattaatttttcactttttggagtcgttgtggaagagctaaaggtagttggggtaaaggttgtgatggaggtggtggtgacagctgatggtttagttgatcgagcgaatattcttggatttgttgttgttgttgcagtagtagaaagtcttgataatgataaactttttaggtactctgcataataaaagtcaggttgtttttgcggcggctgctctggatataaacagacaacgggaagagaaactcggagaatgaacaaaataaaactcactttttttgaaaacatttttatttgtgcacaaatgaaatgacaaaccgtttaaatagtagtgtctgtgcttattgatctatttttgtctaacatcacaagtgaatcacattctcccatcaccaccagcattattccaccttctggcactggctggttaaattttatgctcacagcggtagtcccattcttgatcaaaatcaaacaatgtcgcttgatcgtctccgctgttggtcaaattgaacacgtaaatgcagtgtgttttaccgtattgggcaaaagttataccgttgctctcggatgagtttgcaaaccccactgcttcattcatgtcattgaaagggcgaatatactttccgtttgggtagtccaggtcgtagggcgcttgtggataagagcgtccgctggcaacaatggaaatttcgcgcacattgaaaggttgaaaattgaatgggctgcgtctaattgtaccgacatagtcagtattagccaccaatcccattgttacacgacggggaatttggtccatgaacaaattggctgtaaactcatatcgacccggactgatgaacattgatttcatcattgttttcctcactgcataacgggcaggcttcagttcaagctttcgcgcaatgtccaatgctaagccatccattagagaaactttcttcacatacattttcaaacccaaaacctcaaaatgatagcggggtgcacccgctgtcggagcaattagcacaaagtcgttgtcatgaggcaaaatttcaatgtccaattcacaaaaattaatcagatacaacggttggttaaataagtcggtgtcaattttggcaatgaattgagccacgttgctgttagcaaacaaattacgccgcgcgatgcacccgtctcctgtctcaagtgcatcacctgtgtcccgataatagcccgcagcattcagatgggagtcctttgccgtagtggaataggagagttcgtgcgagaaatatgtcttataggccataagagcatttgaattaaaaatttcacgcccattgatgctcattttaatattacgaatgaaagtttggcctatcatttggatcggtgcaatgtgtaggtcgtcagctttcatgtcaatgagctggccattaacgttttccttccggattctgaactcggtgagcaaatagcattttgaaagatcaatataattttggctggagtgaagtttgaagtgatacggtgtgtcggtcagagggttgctagggagcagttcaaacactttggatgacgagacgctcacatttgtgggcggaatacggaaaaagtccaaagcattggtgattgaattcactgaatcattgtcgattttgtggaaggccatttatttattaataaagtccaaatgcgtctgagcgaatgcgcttttttgtctgctttacgattggtcgtccaattattgtttgatgagcaggtggaagtgctctctttctttttatactcctttttccgcttccaaactgtttaggcagaccacctttctccaatacagtgtctattcctcgctttccctctttgacaaacgcttccttaagcggcactccctcgtttccgactcgttctagcacacgttgtccagtgctcagtgcctctgagcctaccgtagtgcctacgcgacgaagaataggcaggaaaaaacgccaaagtccacgaaacacatccccaacgcccgcccctcgttgaataccgtaacctctttggaaggggctcgacccccggaagtagtcgaaatcatctttctctaatccgccaccgtactgcacgtactcatcatacccagtaatgcttgggtcaaacacaatatgaaccatttattttaattatatgtcaaatgaaacacaaaaatgaaagaaatcaaaaatttatcactttcttaaatatcaacacgaccatcgttgtaccgtaggcgaatgggaccagtcgacctttgtccattgtgcgcagttcaatctcaatttcgttgatctctcgtggcagcactcgcgcaaatattggcgagtcgtaaatcttctcattatactccccggggattgcaccgctgatagacacaaccctgagcaaggagctcagtgaattgccaattattatattctcggtcagcccttttgagtagactgcaaaacttgaaatgcctccgcgcagatcacacccgtatttggcaacctcatttgacacaacatgttggggattttcgagtcccaacacatagcccagctgaggcgagaatgacaaatgacttatgatctcttcgttaaagacaactttgaatttttccaaatcat

SEQ ID NO: 7490 - DNA, 1706 bp, Heterodera glycines
actctcgtgactcctacgattggtctattgtgggagtttgttgcaggtggtccactaaccaacgcggctgccactggaccggatgattgtttagcatcatcctgttcagtttttgtgggactaacggtctgtttatgaacagtttcgggtgtggtggaggtagtaggtgtagttgctgactttttaacagtgtttgtggctttaggttgggcactaggaggtggagctgacgtagtttgttctgcactagctgtagatgctactgttttaggagttgtaggagtttggactggatgctttgtgagagttgaggattttgcagctactacaggagctgttgtattaacaggagtggatgacgttggactaacagtagcagcagcagccgcaggagttgatggtttggttgcagggttaggggtaattggtggcttaacagaggcagccgactgaatagaagacggcggtggctttgatgttggaggaacaggtgtagttgcagttactggtttagcagagctttgagtgggcggcgtcggagacggctcttttgatcctacagaggttgttacaccatctttttgtgtttcttgataaagaggcggcgaatcaatcacattttcctccccttctttgtactttgggggagaaccgagcggtttcccatgctcatctaaaattggtggtggttgtggtgatggtggttgtgacggtgttatggtgccggtatctcttttgactctctttaacggtggtggagattcgagaggctttgtgcgattccgatcctgctccacttcacgagggagtggcagtagttttgcatcgctatggttccgcaatgttacggtcaaaaagtctttcagctgttccgctctattatgtgccgccttgggcaccggcaccctaatcactcgctgtttgtcctcatcaggagcgttgcggtcggtgaagtgaatgtcaatccactgttcgtccaatgtaccaatggttgaccatgagaaggggtaactgatactgtgcagcccgcacacccatgtaccattaaaatgcaaaggcttagggagccgaacacgaaatttattgggttgattttccgggtaatccgttacattgcttggcaaaaacacgaagaaactgttcgacatgattgtttattagcataaatagtgaaaatgtgaacgcttttatacaagctgagactcatgaatccattcccgattgggatatcctataaattttacaagcatctcattggatccatccgttcttttcctctttctgtacaccttctcaatgcggtaactggtctcggcatcttttcttacgcgcgtcagctcctgctcataaaagttgcctttgaatttctcaccatgctcatcccgcagtttgtaccggactggaagcatcgttttcaacacctcatcaatctccagaatttcgtccccataatttggcaaatatcccttctcaaattgtcccttctctctgctcatgcgtacaaattcttctttacggaaacgtggcgaccgtttcggtaggacagggtgtccgtacaatctcttccacactttttgcgcatttgaaaagtcaacatcaatcggacgcatcccatgaacacgagagggtgaactgttaataccatccaccattatttgtactgcatccacccaattcagtgtctccttttccgcgaaatatcggta

SEQ ID NO: 7491 - DNA, 1364 bp, Heterodera glycines
ttttgattaattaaacattcttaataagaaatacaaactttcatgtaaagaaaaaaaagaagctaatcataccaatcgaaacaattcaaaagcagtccgtcaaatatgaaatacttaaattttagaaaaaaacaggattcgacaaagaactaaatcgaaaacgtacgtccaagataatttaacctttaaataaaaaagccaaatataataaaaataaaaatattgttattttattttttaaatctttttctttattataactcagttatagaaaaatacgaaacatttgtcaaggattaattaaaattaacataactattaatattgttttttaattgtttaagcaaacgaaatttctacaaaacagtataacttttctcaaacgcaaccaaatttttaattcttgatatcattggatagcagtagaatacaaattttgtcaagtttgaacaaagttatcaagatttagtgaattactattcttactttgggctgggacactataatctgaccagtatagtctgagccgagtttagagcatcataacttttttatttgttgacaaaatccaacaaacttgctatcattcgaaagctcttaacaagctctctatcagcttcccaaaaatcacaaagatataccgacatgtaaaaaagctataaattaaaatatgcacaaaaattctgacttttgcgcagcattaatgttgcaactttttataggtttttcaatcgcttagaaatagcttatcaacagcttctaaacatatagggctttagaatgatgccaaatttataaaatttggccagctgtgaaaaaagttatgatactttaaactggctcagactataacggccagactatagtgtcccccacccgcagttgaggccagcagaaatgtttttttttgtctttccgtccttcgtaattacttacttaccttaccaattaacaattgactcccaatctccctctcaaaatattttttttgctcaaactatgttagaagatcactatttgatcaccattatcaatgtgtctctgttttagcatttcgagcgatttgtgaccgattgctgcgccaaatttgtgtgaatagaaatgtttgaacttttacgaaatgaatttttatgtcaaaatctaattttaataatgtgttgtcctgaatttgaaaataaaataaaaagagttgcgagtccaattacgggaaagggtcattttggcgtcaacgtttcggcgcaatgccaaaaattaaaaaaattacaaaataaagggttttaaaggtcggtgaaccagatttggacactcatttcaagggcgtaggcaggggggggggatgttttggaaaaaattttgacattttt

SEQ ID NO: 7492 - DNA, 2862 bp, Heterodera glycines
ataatatgtgcttgggcggggaatttttgcgtggaaaaagaatatagcggagtttgctaaaaatgcaaaaaacaaaaagtagataaaattcaaataaaaatgcatagttagaaactttaaagtttaaacagagtttagagtagacccctttttaagtaattttatggcatttttggtcagcagaaaaaaagtcacttgatttaaattccaatttcatttaaaaaatgaaaaaacattgttacgtaaagcaaaagcgtcgtatattatttagaatttcatcggtgcatttcgcgtaattgacatgaacacgtgatttctgataattttctttgcttgtttatacatagtgcgcgaaaaacaccttttcctttttattttataagatttttccaacagattaaacacagaaacagtaaaatataaaattacattttcaacaaccctctttaaaattctttgggcacaaccatcttctgttcactgagtagaaacggtccaacattggcctgaaaaatagtgtgccgaaatttagagatgttaacattcaaaattagccatttaaatccccactcgaggaatggccaccgagttcacccggcgccgttgccgctcatcaagtattttgtgaaacatcagggcgatcactgcctgtacaaaaaaaacaaaacaaaattctcatttccaccatctataagaaatttaacacccttaattagtcgcacatttattcccaattttatttatttatacaatatttagagaccggacgacaattaacggtaaatatttaccgaagttcgcttttttaatttaaaaaatgtgacgagaaatttttgcatttttataaatcgaataatttttgcggctttgtttttgatttaaacactcttaggtttcccaccatatcaattttttttatacttttctcaccttttttgccagctttttccattcgatttcgtcactttcgtgtccaacgctcgcccctgttagcattatttcagctgcttttccgccccgcatgccaattttgatttgagttgtgccagtgtgtatgttctttgtgtgaagaacattgtgtgtccatcagatccatctacttagtcaggctggatactgacctattttcaaaaaaaaagcatttcagctcctttaaaccctcttttttccgatcatatatatattttttggccacaaatagaaatatagccgccaaaatctctcaacccgaaatctcgccgagacaaaaaaacagcgccgaaatttaaaataagcatcagctaaaaaatcccgtttcttcgcttcactagtcgctttttgactatgtcaatttttttttgttgttatataaaatttgccataaaacgtcacttaaaatctgagggtggtaaatattctcctctatccaaaattcaatttcgttgtcaaaaaaatacccattgcatgtggtccacgctgtcctcgtcccaccaattcacgccaacatgcccaatttcatggcctgcaacacggactcgacactggttggacattatcatcgttatgcgtaattcgcgcttgtaaattgcgcgtcgttcccatccgtttagcatattaaataattttgctaaaaaaaccggaagatggattaagaaatcgtaaattttcttacaaatcgactcttatagctagacaaagtaattagcatcgaattagattgaaattaatcagcaatattacgtattttcagtcatttatcgattaatttgtggtactaattttgtacatattcagatcactttttccctatcacattttgcttatcactctgattcatcacttctcaaatgctgctgctgctgaacgtcgtcgtcatccaacagttcatccccgtcctcggcaccacttccggcttcaacatcgctgacgcatccgtcttcggcacattccccgtcggcattgtccatggcattccgtttccgatgcttgtcaaaaaaggcacagcgcgacggttggaagcaaaaggtggccaacaaagagacgaaaagcatctcgacacagagcaaaaagcaaatgtaaactgtgggaacaaatgaaaatcatttaaaaatactgtaaaagtgccacaaataatttgtgccatttttccccgctgctcacattgtgccaccgccgaagagggcaatttggcgggatcatgcgatatgctcggcaccatgtcgataatgccgaagaagtcgccgacaaacttttgcacggaccaaaacagttggcagaagtcgacgatacggaagagcagcaaaaaactgaaaatggggaaaacccgaatttctttgaaataaaattgaaatttcacataatttcaattgaaaaaaatgtgagacgtgccgatattcgtgcaacagcgaagcgccgacgggcacaattacgtaagagccgtaggtccaataaacatggaaatcatagcagcaaaattggatatttggaagtacatgtgtttgcgactgctcagctcctaggtgacagaatgccaaattaggaaacatttaaaaattatgtttgaagtgccgcaaaaaatttaatttccaaactattcaggatttgtttcacacacctctcaggaaatcgctgaagatgcacaaatcgagttgctcatcatatgaaacatcacaaacaatggcgaaaccggagctactggaaccttgagtcaaaaagaacacaaccacctccctgcacctcagaaacaacaagtttgtataaatttaaagccaaataattaatgctttgttaaaggcagagtcaaggcgacagaaattcaaagaatgtgttggtctcgtgcatttgtacggcgagaagacagaatatgttgaggcagttcgcaac

SEQ ID NO: 7493 - DNA, 2787 bp, Heterodera glycines
  misc_feature (62)..(62): n is a, c, g, or t
gctgctggtagaagtgttggttctggacgccgtcttgccggtgcgactacaaactctcgttntcgtttcttcagagaggatttgtttcgggggttagctattctatctagttaaccatcacaagcctgacctaaattaggatgttcctgccggacaatggaagcatgacaagtttgcagagctctatggaggtggcaagaagcgcatgggtggagctagcctgggacctctcaaggcggtaaagggcggtgcggggagttccattggagcacgcattgcacggaatgcaatcgagcggaattctgggggtatggtgaagctccaagtttctaacttgcccggatcggtggtcactttggatttagaggtttggttattctaactggtaaatctcatgttaaccttcaggaacttttccaagacttcaatgttttcggagtcgctgttcattatgatgagatgggcaatcatttgggaactgctgacttgttcacagaccaacaatctgccaccaacatccttaacgaattcaaaaacatcgctatcgatggttgttcttaatttaagaatttctattaaaataaattttaaggccaagaaatcaaattttgtttggttactgaaggcgctgattctgttggaggtaaaagagggaacattcgcgaccgtcttcaacgaattagcggaggacctaatccgataagaaaaaagcccatggttcgtaaacgaatttctggaggaccaatcagaaaagtgtcgcgcactgttggaggacgacttaaaggttaatagcatattttaaatggcctacactaaatttgtttatatttattagttgctggagctgggactagcaaagcggcacctaaggcaaaaactgctgatgaattggacaaggagctggaagcgtacatgaagaagctgtagaaggaagtcacttttctgatgatgaggaatttcatttgggtcttcctttgtttctgtccttaccaattcacattttatttcatttattcgcatttggatgctcttttccagtatgagaagacgttaccaaaaaagattactctcattatctatttcaagcataacaatgtttgtcatttcaatctgttgaatggggggaaacaatgattgtgagatatgtgtggtgtgttcttcgctatttttctcagttgcataaattccttcatttcttcctattcagtcagtgtatcataaaatggtgatagtttaataggaaagtcaccggaagattggaaattgggtcaaaggtgtgcgagggaggagtaattgaaggggaggggatggaagatacgctggtggagatgatcagatcaattgggtaggggggaaagagtcgctcgggggtgtgcactttggcgattactcaaaccgcttattgaatgacggcgggctacggatccgcgcctgtgttaaaagcactccttccccggaaatgactttcgctgttgaggaaggggagtcccttttgcttggcgaggacctttctcaattggctcgaaatgacgccgaaaccattcacggttcgatttgtgcacggtacgaacggaagaagcgcttttacgtaagttttaaaaaggcagccgcggtggcacaaattcccgattggcagagtcgcattggcttctccgatttgctggcattgaccaccgaagggcaatccccgactttggccttctctgacccttccctttttgccccctttttgtcttccgatcactccaacgcccacatttttgcgacagcttcccaaacactaaatgaactctgcggagatggaaaagaagcggccattgtcttctgtggagaggcgggcgcgggaaaaacgacgaatttattcaacgcaattcgatttttggcatttgcggaggaaaagagggaaaaattgggcaaaggtaaaatatgaggggattaaatgaataaatcgagcaattgacagaaatggggaactaatggaaaggaacattcagtaaaaatacttgaagaatcattagagaatttggagggagaggggaagagaacttttgccatcggaccctaagtttggcaatttaattttaaacgaggaattgtagacctattcgtgttcaagccgatgttattggcctttctttaatcacgtacagtatatcagcaaatccttttacagtatatgggtgacccacaaaaattgaccagattagattgccaaaatgaattacctattcgagaaaaactgtaaattataacgagcattttatttcacaggaagcaacaacagaaatgacgcaaatgttacgcgcaatttattgacaataaaaacaataaatgccttagagaaaattttgggcgcattcggcgcagcaaaaacactgaaaaatgagcagtcgaatttgcacggatatgcgattgaattgcattacgaagggtaataaagcagaaaatcctaaatcataatggcaaaaacaaacacaggaaagcattggtcggtctctcttttatggattcgctggttccattggaattgtcgagaattattggccagcgaaagggcgaaggcaatttcaacgttttctaccaattgtgcgaaggaataaaccctaagcaaagagaaatgttgggaatgagcggagcggagaaatatttctttctgaaccaagtcggacgattgtcaaattttatgccttttttaaattttaagggcaattgccggaggggcgttggtgaaaaagccgactttgccaaatgggccgacgcactttcgcaagtcggcttctctgacca

SEQ ID NO: 7494 - DNA, 2240 bp, Heterodera glycines
aattgactttgatcagctcgagaggcttttcactcattcttgaaaaaggtgcaaatcgcaacagaacttccgatagctcattaagaaatcattaattaatttacgaagaccaaagactgacagtggaggcggcgttggatatgcgagatgctttcgccaaaatgctttacgatgggctcttccagtggattttgtcccgtatttcgctgtttcttcgaccggcttcatcgaaagaaaaaaatccggaattcgttgctgtttcgcgagacagaatccttttattggacttgccaggaccgagacgatataatgccaatggctttgaagagttttgcattaatttggtcgccaattcattgctaattttgcaagggtttggtcaaatttaaggcgaacgaacggctcgaactgttcttccaacagcaacggtttggccacttcaaagaagaacaactgcagaatggtgggccatcagcagcagaagagcgattgatggcttaaaatgcgctttttcagtgttcgcatcgcgcggaggcgattttggcctacgaaattggccaaatagtgagcggacgatggaattgttggtaaaaaggccgatgggcattgtgccgttgttggacgacgagtgcaaattccccaggggcgcggaggagtcattcctgcagcactgcaacctcaaccacttggacaaccccatctacgcaaaagtaagtttcgcttggcattccgcctgtcgctgctcaatcgtcgctccgtttcccttttcaggctcgggtaaaaggccgtctcgagttcggcattcgccactatttcggcttctccttttactctgtcagtggcattttgaacaaaaacagattcatccaaccgccctccattttggccgttctttcacattccaaagacacttctatggcctcgatttttgaagaaatgacggcaaaacgaacaaccgaccgatgtgaatctgtggccaacgaatggcacaaaggcatagtcaaactgtgcgaacagatcaaaaagtatggagaagcaccgaccatccaaatataaatgattcattaagaatttcctttgattagggctgctaaatgcttttcctcccttttcccacagttttcgcctgcatttcgtccgttgtattcgtgccgaaatgactgacggcaaattgaatccgaaggccctgcaacgccaacttcgcattctctccgtttcggaccattgcctcgccgttcgccacggattccaacacaaaattccaatcaaaaaattcgccgatttgtttcacgtccttttgccagaagaagtgttgttttcgatattatatttttaaatttaagttatttgaggtcgtccatggccaaaattcacaccaaattgccaaggatattttggatgcccagggcattcgttatgccggcctatttgaattcatcccgggtcatctctttctgatggagtctcttttcgctaaattatgccaactgaaacagtccacgctcactttggccgccttaatcatccaaaagaatttccgaaaatttctcgcgcgtcagcattttcttctgaaacggacggctaccattcagatccaagcggcttttagaggatggaaatgccgaaaaatgtgtgggagaaaggcatggacagagaaaaaaatgaaatcactgatggaagaaagactgagagtaggggcaaagaaagaggagcaaagagagatatcggaggacgaagagagcgatgagggaggaaaagacatgatgagaacaatgatgaagatggaggacatggaagaggagaggcggcgagagatcagtgcgatgctgaacagaactgattatgccggaaggaaggccaaagccgagcacaccaaatgggctctcttccgggagtgctccgactacgtccgatcgacttggccaccagcaaaagcaaagggcccctccttcggtccaacaatcacttttgaacaattcgccgagcaaatcaaagtaaatcagcataagtgaaagacaatgaaaaaacatcatttgttaaagtagaaagtgccattttcgttttgcctttgccatttcatttccttcagacagtgccaattggcgcccgccgtgagcccatcatcgcgccctttttggccacagattctgaggaagaatttgtgcagtcgctggacatgttcaaattggtcctcagctaccaatgccaacccgagggcattgatccccgtcgatggccct

SEQ ID NO: 7495 - DNA, 748 bp, Heterodera glycines
agggacggagaggaggaagagagagacacagagagagagggagatagagagagagagagagaagagagagagataaggagagatagagacaaagagagagagggagagagaggagagagagagagagggagggagaggaggaagagagagacacagagagagagggagagagagagagaggagggaggggagagagagaaaggagagagagagagaggtagagagagggagggagaggaggaagagagagacacacatgctggtatgcacaatgctaaggatatttatctgtagctagcgatatgtggatagggtagctgcagataaaaaaatctgcagataaaatctctatgcacaatgctagcgctaactatctgcagctgaagatttttttatctgcagatacccatccgcagcaactctctcgtcacacatctttttatcttttctatccctcaagagaaattttctaactcaaatttggttagcaaaattttattgcataaaaagccgtaaaaacttattcctggggcttttctaggtcgctgatcatgaatctgacatttatttcaaccaattcctaacccgaactcgaaaggtcgaattttcgggttttgttcaatcatcatgaaatgtaaatcaaaaaattttagaggtattaaaagtcatttagtacaatttttccaatttttaaacttatttttgggattttaatcgacatttctatcgaaattatcctcatctcgat

SEQ ID NO: 7496 - DNA, 975 bp, Heterodera glycines
gttgaaaaaccgacaattcagtgtcagaaaatttggcaaaaaaatttcaaaaaaccactaaaaatacaatataaattgagtggagagaaattctgcatgatctgtattgttatactctatgctaaataaatctggggccggttccgtctcaaatatttttggacccaaatttttttaaatttcagaatgtgaacagaaagttgagatataattaacagtgctgccaaaaatatgcacgaaaagtagccaaaatatgcacaaaaatctcgaaatatgcaaaaatatgcaaataaaaataccgatttttatacgcaaacacaaaaaaagaacgtgtttttcctattatttatagcatggaaaaggcaggaaaaaaatacatttgcatgtttttggcagccctgatatttaatatgcctaatatttttgggtgttcgtccaatctgacttttatgagtcctatgacaatttatgagtccaatatttttttatgagatattcgaaaataaaaattttttgaaatgaatttaacacagggcgcgtatctgtcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaatttggttatttttttaataaaaatctgttaacaaatcgattaaaaatcgcaaaaaattttccggcggccggaccccctgtccatcctccaaaattttttgaaaaaatgcgacgcaaaaaaagcgtttttaaagcaaaaaagtcgtcgcttgacttttaatttaattgcaaaattggcattttttggtgaaaatctgttaacaaatcagaacgaaattacaaaaaaattttccggcg

SEQ ID NO: 7497 - DNA, 5468 bp, Heterodera glycines
tattcaattctaccaaggtagcaacaggctgagtgtgactcgaccggccgctttctcaagttcatcaaaaaaaccatgcagatcaccatcttcattgaaagaatcttcggccaaaaaaaattccgtttttttggtccccgcacggttattgggaaatagtacggagaacgtgctataaaaatttagttgtttgatgcgatttaagttcatttacttttcggtctcagcatgttcgccgctgtttcagccgctgctcctccaactacccctccagcaaaattactgcccaaattagtaccggtttttttaacgaatgttttaagccggaacttccagatgaaagggctcgccgcaaagcttggctttcagccacatgaattgagtaacttctgcctccccgactaaaaaggtgccgcagtacagcaaaaatcgaacgaaggatattgtggtcgccatgaacaacaaaaaagagccaaaaagacgaaatattttagataaaaggacattggattataatagctgtttgccatggaaacggctcttttatagaaggggaagcttactcaattgctttttgccggcggggtgggacagacggctgtcacaaattgctttttgccggcgaagaacggaaatgtttttacttatatttttcttggccattgccttcgaaaggatttcttcacaagctgatcacacaacaaaagggactgatttagttttgcgagatggatttgaatggaggaaaaaaatttaattgcggctggcgaaatacaagtgtggacttgtccaaggaaaagttgtatgggacgggcacatgctcctgttggatctgtcgatttgagaataattacgcaacacaatcatttgcctgatcaactaaagcatactgtatgagactataaattcgcaaatatttaaaatataaaaaaaagtttccgtatcgtacaatgcgttaaactaatgtttagtcgaatttattgtaaggtacgtgcgcgaaaagagaacctaaagtcgcaagcgcgttactgcattgaaagtggaggagcagtatcagcaaaatcgattacgcccatttgaaatcgacccaacaaggggactgagtcaaaatcgattgaaaaaatatattgaaaatgaccaagccataaaagaattaattcaacggtatgacaatctcgaagaaagaaatgatgaaatattattgcgacatttaaatgctcttcagtatcgtctcgccaatgctggctttgaagattggtagtttgtgtgcactttagttattcattgagaaaaataaatgtgctggttggagccttcagcaagctcttttaaattaaataatcaaattgtgaaaaaaagttaaaaatatttcgaaaaattagttgaaaattattataagtcattgaacaaaataattggtgaaatgtgttaaataaaaatatttggtataattaatttgaaaaaggaatgacaatttggcgtttcgttggccgcaaatgtccgattttcccttgggccgcaaatgtccggccgcaaatgtccgaaaatggccctaaagaaacgggccgcaaatgtccggaccgcaaaagtccgaccgcatttgtcgggccgcaaatgtccgatttccagcaggccgcaaatgtccggaccgcaaatgtccggaccgcaaatgtcctataaccttttcaacgtacactgaatcgtcgtcatgaatcgtcggcactgaattgaccggctccgtacaattttattcaactttgtagattttttcattcaacaataaaatgaataaataaaaaatttcactttgtttgatcaagcgctagaagactttgtgtttgtaaatcatcagatgcctcggaattccgatttccgaaaatttttcaaaatattctggaagaaattcgataccattttccggtggcaggtgatttcgccagtgagtgaattcgccagtgagtgatttcgccagtgggatttcgccagtgattgatttcgccagtgagtgatttcgccagtgaactatttctctttttctcggcgtctgtatttgatttcgccagtaagtgaactcgccggtgattgttttcgccagatcggaccaaattcatcccatgggcaaattaatactaaagataaactgcgtgccgatttgccaattgaagttagggcagcttctgctccttcaccatcaaatatgcgttggaattacaactatgccaaacgaaaacaccaagaagaggtggatgaattttgcaaaaaaaaaatattttaaaaactaaaatacagtttttcctataatacagtactccattggtaatgacgttgacccgttcggcaatgtgtacactttcaatgcgggcgaaggcatttacaaaatgccattttttgtgagcattccgtttttaaataatgcatatacaatattttctttttaaaagtaaaaggtttaaaacctccttttttgaggtcaatgactttgccgacggagtgaacagagtggcgatggactcctcaacagcgggcaaaacctacgaatttgtcgggccgcactgctacgaaatgtgcgagttggtaagtaaatcgaaacgtattttcatgtccatgggagtcgaacaaatgacgggattgaaatttaatgaaaaggaattttcattatgtggttaacgaacaagaaagacatttgtcgtttattaggtaaatggagctgaattgtatgtcataaatggacggggggggtcagaaattgcctttaccaaataagaaatatcccccatcaggccaaaattgaaaaaaaggctcaacatttttttaaccttttttttgcgtggcgcgctttttccaaaaaatttgcggaaggggggcgggggggtccggcggtgcgaatagacgccgccggaaaaatgctgcaatttattaacagatttattttcactaaataatccaaattccataaatgattgaagaggataatatgtgggcaaacagaattgcagattttcaggccgctccagcggatggcataagaggtccacacgaccgacggaaggcaaaatacatacggcaagacaacaacctgcaagctttagtcgctaattttgaccagcgtgatccgcttgaataccttcgcgcatgtgcctaccacttacacttttaaaaaattaagaaaatcattcaaaaatatatcacaatttaaactatgtaattattttaacaaaggtattccaaatatttgtgcgataaataaactcatgaaattaagtggaattcggttagaatacatatgctataatgttagaaaattaaagatagaaatccaattttatatagtattaatttgcccatgggatgaatttggtccgatctggcgaaaacaatcaccggcgagttcacttactggcgaaatcaaatacagacgccgagaaaaagagaaatagttcactggcgaaatcactcactggcgaaatcaatcactggcgaaatcccactggcgaaatcactcactggcgaattcactcactggcgaaatcacatagcgcccattttccactataattgtggctttactttgtatagctgacagtttgaaaatacaaaattggactcaaaacttaattaaaaatcattggactcataaaaaaattattggactcataaattgtcataggactcataaaagtcaaattggactcataaaactcgattggactcataaagtgcactagagccaaggatccttggggattacctttgatttcgcgataaaaaattgccatgtcgcgctccttcatagatttattcatcacttttttgccaaatcctcccattcggtaagccaacatccgctgaagctgttttcttgtggaagggaacctgctcaaaaaagtgaaaaatggcaacagaaaacagacagaaacgacctgtcggaatattttcgaaaccaaatgctcaggtccaagtaaatttggagaatttgattcattttgcgaatggcttcacttgaaacttcagacaacatggcaattgacatgagattaaaggtgagctgaatggcatttaccggaaataattaaagcatttttcaaacgaaaaccaaatgacggagttcgatgtatcccatcgacgaatcggccgaccgtccgcaaagaaaaagcaatttgtcgagctgagaaaatcttttgagcagaagtgctcccaaataacaaacgcctgtaaattttgctcaaataaaatgaaatttctcgaaaaacaaaacctttttttgttggttcgtaaacatatccgctctgttttaatttctaaaaatagttgaaaacacaaacattttcttatcaaaaaactatcatgtttcaattgaatattttccaaaagcatattgctggtcaaaaataagcatttaaaaaaattcaattacctaaaaaaggattttgcctgattaatggatttagtggaaaatgccaaatgtgggtttttagtcttaattttaatttaaaactaaggatatcgaaatttccgtatttttcatcaaattccggcaatcggaattccgacggtccgaaaaatttctgaaggaattccgagtgcaaaaatgtcggaatagacgagctaaaagggtcgacatcaccagaaaaattcaaggccggcaatacttgtgtgaatttgtaaaaatgtccaatcatttgctgtccgttgagttttttcagcattcgataaactctaagcgccattttccagaatttctggtgcctattcgaagatccgaatttgtaggcaattgcttcgtaaagtcggcagctcatttgtccaatgcttcctaattgacatttttgcatttcattcagtgcacctttaaattgcatgttcattttcttcaagtgtttgttgctttccttcattggtttcgatttaaacatttttccgttaccaaaacataggcagcggtcaacaaaccctaaaaatttatctatttttgggttactaattaaaatattgttgggtccgaaaatttgtttattcaatctttatctattcccttcggaaggaagtcgaatgttaccattttcatgtcgcgagctaggtcgaacttaaaagtctcaatggtagtaatatttatattttatttaaatttattcgcagaaataaattagaaattaggtagctcaaaattattaaaattaataagtctcggtattgggcgagagttctaagtgccctcttctattatgtttattaaaaatataataaatttaccaaatattgaaacgaaaaatttcggaattcgaaagactaattttgtccgtaatttaaattcatgtctattttttaaattaaagaaaaatagtagatggcacgcaaagctatcattgttccaatactaaaattgaggtaaatatatggttcgtacgcaacaaatttaaaaattttttgataatgcgaatctgagctcagcttttgtaaaatcactgatt

SEQ ID NO: 7498 - DNA, 3081 bp, Heterodera glycines
tcccgggttcctggtgtcgtaaaaaaatcttaaatttctctcaatcatgcagaaacagaagagtggggtgcggcgataggtggcaatataatcagaatagcggctttcgtagtccctgtgtattataattttataatttgaagcctcaattaacaatgcctccacttctgctctgtttttctgccagaaaaaatcttctttttcgagagcctcctcaaaatatttttgaaacgagtacattttaactgaaaaattaataaagaaaaaaactcgaataaataataatggaatgaacaaaaaataatgaaagggaaaaattaaaaaattttatttaacagggaagaataagtggcaataattattgaaattctctggtctaacaaattcacttccccaaatgattgctgcctgtgcatgaactcgttgaaaacaatgtctgggttcgattattggaaggggcgggcagggatgatcactgggtctgacagggcactgcaataaaggtccactgaaattttctcaattttccagcccggctcagcttctcggctcattgcatcccccattaattttttcaggatttttttaaacattttttcgggatcttcattttcggggcatttaaaatagaaagttgtcacgtgctcttttatcccaaattttttaggccaccccgacgcttccacctttatcttcaaaaacatccgcacatatcctttgaacagttgactgtcaaattgttcaaagtgatacgctcgatagaatcccacaattctatatcctagctctaaagccttccgcaactcaattgaggtgaatgtccccaaaaatgctctctgcgctggacgatggttacatttctttacatcttttgtcatcacaaactcattcttggccctttttgcacaagcccaacaattggggaagaggagcatgtcatcgatgtgcagggggagcagggggtacaaaagatttttcggtgggatcacttttactttcaaaagtccatcatagggtatgtcgtcgggtgttgtccaattcacattaaaattcctgctcactacaattttcgggactccaacggggtatggggtgtcttaagcgaaaggaaactaacaaaaattaagcagatttttaccataattaacaaaggggtacaaactaatgatgtcaaacattgatatctcaatttcttcggtagcctttgcgtacaaacaaaatggcatcgttcttcccccggcataagcatccctcggatttatcggtcccttgtccggcacactttcaaagaactttttcatctccttatttttcttcaattcctctctgacatcacactcctaaaacaaacaattaataaatatttctaaatgttttattctacccaaacttctccgatgaaaaatttttgcacttttccctcaaaatttccatgcgaatttcggttctactttgattctcttccattgtccgtccgtttggcgctatagtccaaggtaaaaaacatctcggacacccgtgaaatgcacacccctgaatgaataacattaaaatattgataaaatataatttttcttaacctgaaactcaattatttttttctctgcccctatcacacagtccactttcagcccaccaaattccacttctcctccgttacacgcatgccgcacttttactccttttctttgggcaagccactcaaaatatttcaccgctattttgctctggttctctgctctctcataccctccctctggcataattggaatatgcctgtccttcaaaaattttgccctgaagatcttcataacgactcccgcaattgtgacactgtcctttattcatccaaagccgatgtgtttttggaggggggagagcatcaattactcctgttatccccaaaataaccgccggaacttcaaaattgattccatcaaaatttcaacatcgttttcgcaatacgtcttgagttgttccccttaaattttattttcaaagaaaaaatgctattttccctacctagttcgaattccgtttgaaaattctcattgtgccatgcttccaattttacggcttcttccttcccaaaattctcattcttattgtatttgtgtggaaaatacaatttagctgcagtttttaaccccaaggtttttggaaggtccgccaatttattctgactaagcatccaaaaatcccgaaagtacactcttcccgcctttatttgataaattttcaaatcagccatcatcaactccgtcgcaatttccttctttgttagctcggacaagacaaagtgtgaatcgaacctcccagcataatgcgcgaaagcaatcgtttcaaatcgttgaaaacccattatccaaacgataaactcgctcattggctcaaaaccatccgctactgaccatgtgattttactggggccttcgcaaatctcacattcccgctcctctcccgcacaaatgttacaagtacgtgcaacactaacaagattaggccggtgttctcccccatctacagtcgtctccaggtcgtatgccacaattctgtaggctttctgcggtcgcacttgaatttttttgatgaaacattgccgccctgggtgacaaactttgcacagtttgcaaaacttttccccgcacgtgtgtttgttccgagtattgtgtgtctctcggcacttttcgcattttttgtactcaatacaagccgccttcttgtgcgcttcaaaacattccgggttgtaaaacttgagattgcattcgccgcagtgaatctcatcgcagacatccgtacatggaaacccgaaccccatccgacaacattttttgcagcgttccttatactccattctgtgtctttcaggtcgatcgtacgtcacttcacagctgacacagaagtatcgaacaccaaaaaaccagaagcccgattgatcccatcccatggtctcctttctctatcacacccacttcatttttacgaacaccctctccccttgaaaattggcctaagccccggtcttctaaaattatgtaacttttataatttttcaagcgaatttttgttaccatttcaaaa

SEQ ID NO: 7499 - DNA, 2005 bp, Heterodera glycines
  misc_feature (47)..(47): n is a, c, g, or t
gttacaagtacgtgcagcactaacaagattaggccggtgttctcccnccatctacagtcgtctccaggtcgtatgccacaattctatatgctttctgcggtcgaacttgaatttttttgatgaaagattgccgccctgggtggcaaattttgcacagtttgtaaaacttttcccccacagacgtgtttcgaacgtgtttggtagacttctccgcatttttcacatttttttttactctttgcaggccaatttcttgtgttcttcaagaagtctcgatggcactcgtcacagttaatttccgggcagtcttccgcacatgggaacccgaatcccatccggcaacatttcttgcaacgctccttgcattcaattcggtgtcgttctttggtccaaaaggtcacttcacagctaacacaaaaatttttgacgcagaaaaaccaggacaccgatttgatcccgtcccagtgattgacttctcttatcacgcaaacttcatgcttacggacaccttcccccttgaaaattggcttaagtccaaatttctaaaaaaatgtaaaaaatgggttaatttcaagctaatttggttaccatttcaaaagccgcaatgcgaaacatatccgggaattccctgtcccaaaatttttgtacagcctcaaggtgttggattccaaaagttttgccatctgtgcttatccctgccttttccatcagttcaatggccaattgcctttgtttcttctccgttttcatcaaataacgaaatttatcttccgttatacttttccccataagttggtagtttcgagcaatttccaaagcataaaaaagacctaaaacgattatcaaaattcttttttaatttgatatgtttggaactcactaaatttcccctttggtgtgttaagccgacccgattccttgatttgggcgagggggcaaaagcgagacattttatgaagggagtaaaaaaagccgatgagttgctactgcgagaaaattcttttgggaaaaatacaattttgtttaattatcagaaatatcgattaaaaattatcaaattaaaaaataaaaatttataaatttatttaaattttattattggtagagtggaaaataagtagggggagtacaaacatcgaaaaagaaataaattccggttcttcgggccattggtattgatatatgatctgggcgaaacaatcttctcctcatggaattaaaccgacatttaacaaagtatgccaaaacaaaatttacgcgcaaaagccgatttgtttttggaggggggagagcgtcaattatttccttgatcaattcagcgggaagcgggcaggatatggggacgtgaaatgttttaaaatgaagagaaaaaaccaattaattcattcgacaatatcttactagcaccaaaataatgcacatgaaaaaaaaatccatagataataaaaagaaggaacattcctaaaatttcgtcatttcttttcattttttcataatctttgtcaaaggttaggtttagcatctaatttcttaaaattttaatgattttcaaacaatttaggtaacgggatttaacccttatcaattcaaaaaattaaaaaacaacaaattttatcaaaatcaaaattccattcattcattgaggcggacgtcttgggtcccttggtcttcctctccactcgcccagccgtcggatcacttccaacactctcggggggttgggatgcatttgcttaagaaaagatgtttcggtgctaagtaaaaagacagggtctgaaattaccggtccgtttggcagcgggtggtcgaatagtggcacgtctctcagctgtcgcggtcgttgccgtggttgcactggctgaaaaacatccggaaatatgagaaacgcacgaaaaacaagacccaacattaccggaacgtattctggtggatgatacggcacctttggcggcggatggggcaaattgcggtacggcgtattcacgttgaatttgtcgaacatgaa

SEQ ID NO: 7500 - DNA, 917 bp, Heterodera glycines
  misc_feature (20)..(20): n is a, c, g, or t
attaatataaaacatatatntaattaataataaagaagttataaaaaaactaataaataacgccaattattatactatcattacaaagttattgtattgtcaatcatacaaaataataataaatctcatggtcctttgatgttcgggatccgttattgcacaaatgccaaagaatgttatcagaaaaaataagaatgaataacaaaaatgtgcctaatttttttaaataaataatcaaaaaagagatttcatttaattcgaaatttataaaattgtaaaattttattaaattataaatatgaaaagatgaaactacaaatattaaaaattaataattaaatatacaaaactaaaagttccaagcattttaatgattaaaaatatataattaggtaaatttttatttgtgcaaaatctggttttttaaataggatatagctctatttcgcgctaaaagcttaatataacaaattgagattaattcaaaggaaacaacttaaagactcacatttcacgggttaaatttatatttcaggtgaaataataataaatttaccattgatgattattaattagacaaaataaagaggacaatattggagtggcaaagctccacctatacaagagaattattatatcaaatcgttacgtttattttcgtgtttataattttaaaaaaagcatttataaattaaccttaaaaattataaataaaacgattagttaaacttaaaaaatatttactatgatttataataaaacaattaacattatgtataatatattacacaaaataatgtaaaaaaagcaaatacagaatgcagagtatatgatattaaaaaggctctattctaaaataaatgcttttttaacattaaatcaaaatttatttccgaaataaatactttaaaaactta

SEQ ID NO: 7501 - DNA, 4682 bp, Heterodera glycines
aattttccgcttacccgccgtagttttctcgtcgttctcttttctccgactccttctacagcaaattcctatgctttgtattgcgtttgcgtgacttttttcgcactgaaattcgcgcggacactcggcgaatgccccgggcacacaattcttcggcatttgggtgagctcttcgactaaaaatggagagcccccgcgacaaatcgctaaacgttgggatgaattcaccattgaaatttcgaaaaatttacgttcgacggagcaacaatggccttgagagtcggaagagacgcgcgattgacacgaaaatccgtcggggcattgccccaacggcgttatttcactcgtgccgacaaagcaacgcaaaggtcggagggatttgggggtacgatagagagaatggccaaagggacaaacggctgacagaatgagaattgacatttaaatttagaaagataaaatgaaagtgataaattacttccattccgcggagcgcaacaaaaatacctaaaaagggagagaaaaacgaaagtgacaaatgactaatcaaattatcaatcaatcgatgagctaatagatcaattaattgatcaatcggacaaatcaataataattgacttgttatgggctgcggaaaaacggcaaaggaaattggaagggcacgagccggcgacattcgcttggcattctcggaccttcaaaaagaacaaagggcagtccggcggaagttgtgcgctttctcttcgctttcttttcccccttttaccgtttcgtccgccgcttcccaaaaaggcttttcgccctcggcacaaacggccgaagatggcgacccgcagcacacgtggcgatggcccaattcgtcgcgaacgcaaagaaagtcgcgcgggcagcgcaattgggcggcattggaatcgcattggaaaatggaggaaaaagcactgacaaagaaacaatgggaggggggggggggggtaaatggtggaaaaagggcccattggcacccgtcgccgctccttccgtcgccgtttccctcccggcgatagacaatttcacccggggcacaagctgaaaaatgagggcaaaagatattggaaagagccgcattaaggcaaagagaggaaaaatgagcaaaattaaaacggaaaggcaaattcgaatttgtaggaaaacacctgccgaagaacagaatttggtgcactgctcgcgactttcgaagttgttcatgttgccgttgcacccaccgaagccgaactcgccgcactcgcgcgtcacaatgttaaaataccatcgcgtcaacgacgccttgcgacaaacggtgcccacttgagggggcagcgaacaaatgaaagctgaaaaaaggggcggaatggcacatgcagcggatttacaagcagagaatgccaatcgacctttggtgggacagcagcgatgtgcgatcactccgtttgcgttgatcggcacgcactcgcgcgagtcgcggcttgggcatggctgcgagtcggcacagctcagaaactgattgctggtctggtcgcgcaacggctgaccgccgttaggacagccttaaaaggacgaaacgaacaatgccgtgccgtccactcactcacccccaattccgcaatattcctggcaaatgtccaacgattggaaattgttggcattcccatcgcacccttcgtattggaacgactcgcagctttgcttttccgcgttgaagaagaagcggaaggaacggccggcgccgcattgggtgccgcggtcggagcctaaggaacaagtccaagcccggaggggacagcagccgaagatttgtccgtcgaagtgacactcgtggttcagcggacagccttcggccaatgaacagcgcgtgaaaagaccggaaaggtcgcggtgggcacgcccctggggacagcgcggttccgctgaattggcaaaattggcccgaaatggcacagcaggggaacagacaggcgatattgcggcatttcatttggcactcaatcaactgctcaaaattgttgtcgttgccctgacagccggtgaagtcgaacaattcgcattggcgagtcccctgaggcaaaacgtcattaaaatggcactagcacccaaattaaaataaatgctaattgctcaccgcattgtaccaatatcggctgacacttcccgtgcattcgcccactctcttcggctgtgtgcaaatcgtttctaatgaaaagagttcgaccaaaaattgaaaagtgatcgtgcgaacgcgcggtagggcagcacactctgtgggccgagtcgcagctgtgcgtgttgggacagtcggcagctggcggaaggaaaaggcgccaattcaaatggccaaacgacacccttccccccccccgcctcttacttacccaattcgcacctttgccattggccctcggccacgcgcaacggttggcccaattcgcagaccactgaaatggaaaggaactgagggaaagccaaagaaaggagcgcccacgcttggagcagaagtgttcgcagtcctgcttggtgacgaagttgttgaaattgccgagtccgccctcgtaaatgaaattggagcacctcaaaacacaaccatttccaattttggactgcttctccttcctccttccgctcaccttccctgctccgcgtcgtaataaaagcgactggtcggtgcgcttccggcaatttgaatgccagggtcgaacaacgcgtcggcaccaccgctcgtgggcaatgccccgaaggggaaagtgcgcccacccgcggcactgcacaaatgggctgagaaagggacggacgcattgacagacgaacagaaaacgaaaacggaccgacggtggggcaacactgctgcagagagccgatttgcacgcaagtgttttcgggggcacaacttccgctttgccgcacgcaattggcgacggggaaatcgtcggagagcgaagcgcggagagagcgacggaactgagcggggccacgccgacacgctaaagacggactaacgaacggacagcaggtcgagacggagcggaacaaattggcaaaaccacttactgtccctgcaaaatgactcgcaatgctccatcgtccgaaaattattcggtgaaactccgtccgattgtgccggatccttcagacttttttgggctttttgacttaactgtgcttacccaaaggaattgtgtgcaagtaccggttacggagttgtacctgagcacaaattacagaagaagcgatgggattgattcaacgccaatggctaaaaaagcgaatgggtgggccgatcaattcaaatggctacgatcatttcgaattccgtcgctaataagggcctcaaagtgtccccttttgcctttgcctcaccaccaccgtgggacggatggctcttctccctgttccatcggttggatgcacacaaatgctatttagagagcttcaaatcaaaaacatcaattttaattgatggcaatgcctcggctatgacaacaaattccgtcgacagtcggtgcgtattcggggaaatattcgggccgaacttgcgggtggggcacgcaattgtacaaatccacaatgggcacatcgcgttcaccatccgggtaaatacaccttggaatggcaaaatcagtcagaaaacagtaccttttgacagttggttagcaaattccattccattcaatccattcccaacgcccttttccctctgggaatcgtcgattcaattcgggacgattcatttaaagaaatttgattcttgccttggcagcaagcagattaatatctgttgcactgcttggttcagtatccccttctccccccgtttcttaccaagtcgacccgtcgcctccatttgagtcgtccgtctcggccgaactgctggtacaaaggacaggcatatacgaaccgggggccaatgggtgtgtcgatggattggccaacaaagtgacgggggacggcgcttctgtggccggggagagagagagggggggggggagggataggacaaagttcggccgagtgagtctttcggttcttaggcttttcggctttacctgcgttattcggctcgggcaaaggacaagccggtggaacgctgctcttatatttgtaaaaccagttttaatgtgttcttcctctgctgtgcttcttactgcaacacacattgtgccgtcccgcgtctttgccggcacgtaataatcggggcattggcacagcccacccttggcacaacgcgcgccgggccacacggattcgcattggacatcgccaacacagccgctgtccccggggttaacttcttcaaacggaaaacaaagtcaaaatgatggccaaagaagggggaaagacttggccaacaaaaggaggagataggcacgtaattggacaggcaaatgcattggccaacggagcagaacatgccggactggacaggccaaccccaaatggatggagaggggaaaaacggagaaaacgccacctgacagtcggtgttttgagtacacaggtcgccaactcggccaccacctttggggaaaatgaaaagtcattgactgttctgtatcgcgactccaaatttgagattcgagaccgatgcccccgggcaagacccccttcgtcttccccccctccccccccacctgtgaatgtcggtctcttcaaatgccactcatcaacttcgtcag

SEQ ID NO: 7502 - DNA, 3157 bp, Heterodera glycines
  misc_feature (2483)..(2483): n is a, c, g, or t
cgtatttgttcagcagtttttccattccgaaatgcctccccccactttcgtttccgtgttcgtgtgctccgcgacaagtcgtgcgattcgcgtttgcagcacacgtacggacgctcgcagctcctcgattcgttcctccgccgtttttcgctcttccggcgcattttcgtccagcaaattgtctttgcgtaataattcgcggcccttcagaaaaagcgattggttttctctaattgtccatcgccttcgtttgccaaaagccctcggaggagtggctaattgatttgcctacctttcctatcataatttttcgtgcctcggggtattcgcgcaacgcttaatgagtcaatttcatttgttgagttaacggtcccttcaaatattaccggtccaaaggtcatttttgttcaacacaaacagatcagtgtagccaactgatctcacattcgcagtccgtcggttgccatttttgctgcccgcgatgttcaaaatgcttaattcaccgaagacggcaccctccgacagagtggcgaacactttggcgccgtcgtccgccaccacctgcggcaaataagcgattgacaaacggccgatcgatcagtgctttcgagtgcgactgatcggtcaattaattgcctgcagcattccccgcttcacaatgtacatttcacgaccgatgtctccctttcggcaaacgtagtcgccgggagagaacacttgccattgcaacttcagcaccaattcggcgaggagaccagcctcacaatcctaattaggaaattaggagtgattaaaattacaaatcagcgattataagtttattttagagactttgctatgtgtaaaatataaagcatataccgccgatggacattttgaaaatgttgtgatttattagctaattggtgtcattaattgccaaagcaactgtcgccaatgttttttaattttccgattagcgcctaattaaaaatttaatgtgttagtttagtaaaattgaaattttctgcccttttaaccattctctcccctcccacagttttcttcccccgcttttttctcgcctggaaaatgcggactttgcgcagcgtctcgaaatggacgtgcattgcgatttcggcctgcagtttgtccggcaacactttgagcacttgcgcgtcggtcagtccctgcttattggcccacaaataatcgaaccatttgatcactcgcacttccaacttaattttcggaatgtccatcatttcattatcaaaaatgtcattcctttttgcataaatttccattatttttccaatttttggtcttccatttgcttttctttctttctttggcactctttcacctgtttgccaaccccgcgtaagtccatgtactgcttgatgttgtcgattcggttttggaactcggtccgatcggcactgatattggcgatcatgctgaaggggaagtgatcagttcggacgaaggtccgtcggcaagtgatttgcgaggtcggctgaccttccgacatttccgacgatggtggcgaagatcaaaacaccgcacatcaaatcgatggtgacgaaggcaaattcgatgttctgctggggcccgggcacttcgccttggaacgggacagacagagatcagatcggaggttgactgacctttgccagtgccgtaccgattgtggtgaggatcagcgtggaccagtagaagctgaacactccgaatggcaatgccctccttttctgctcacctgtagatgtaccgtcgggtcagcgtgtcattgatgccgtccggcatgctttgtttgttgtttttgccgtacacccacgggtcagagcccaggccgatgttctcggagatcatgaagtaaaagctgaataaatgttcgttagtgtccgtcccgttttgtttcccttcccttggtcaattcctcccgcccccgcctctcccccgtgtctccccccacctttccgccgccttttccccgcgtctcccccccccccccgactcgccaagcgttccaatggatgatcaccgcaatgtaccacaccaccacgccgactctgaacgcgtttggccgtgccgtgcgcgtctccgtctgttccataaagcgctgaatgcgttcttttcgcagcaaacggttgagccgcaaaatgggcagaggacgccacacaaaaaaaacgagaaagtcaagcggaaaaagagaagcgctgtcgacgacgaagtggcggctgcggaggtaaagcgagcggattttgcgcgcgtcgcgcaccaacagaccctgctccaaataacctgaatggcacaaagtgattttgataatgataatgggttgactcagaaaaatctctgcccgatgctgccaaatggtgcgacgagtgaccgaccgcaaaaaagcggtcttttggccctcccccccccccctttagaatttccgatccgaaattcgcccgttatttttgtgcgtccattgccaaaacatcggaaggtgnttatttgcttacctgttctcgaccggacgaacatgtcaaccaggtacaccgaatcccatgcaaaggtccaaagtgagccacaaaaagagcagtcggccggcagccaattcgacaaaaacactccgagcaatgaccacctgtggtggtgattaatttgagggtaaaaagggataaaaatgagcaaacggaccaacaaattgtacacataagcggtggagaccaaggcattccattggtagaagtaattctcgttggcatcgaacacaaactttgcccactttcccttctccatttgctgctgttgttcggcagagacgagtgccggcgccgttctccaactgaacgccggccgcgctcatgccaaacctcgacatgaaattggcctgctcttgggccaccgcgtcgtttacgcgatttctgccacggaagcgccaaatggacttaaatgacgcatttttgccaattgagcgcatctcgaggcaaaagcaccttggaaatgcctctgatcagagacgggttcgagccccacgttcggctgctgctgttgctcaacttcgatgtcggcactttgctcaaccacaactttgcccaatggtgccgtgtcctgtgggctggtcaccgtaatttgtggtgaagccggcaccggcactccgccaacgaccgatccgtttaag

SEQ ID NO: 7503 - DNA, 6853 bp, Heterodera glycines
  misc_feature (53)..(54): n is a, c, g, or t
  misc_feature (59)..(61): n is a, c, g, or t
  misc_feature (64)..(64): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (106)..(106): n is a, c, g, or t
aatttcggtaaaatggttaataaaaaattcaaatttttcttagaattttttgnnttttnnnaanaaaaatggcatttccctttaggtatatatttaancncgancncgagtcggggttaagggtcggggtcggagttgtcggggttgcaagcgcccaggttcggggtcggggttaaccccgaaaatggccaaaaatgtcggggttcggggtcggggcggggttgcaacccaaataaaatcttactcaattctgactttcacaatggacttaattgtaatatttaattaaattaaattatactaaataattattaatttttctttattacactgtttccgttttcaatttttcgctcagtcttgagtccaaatcggccaatgcctgccgtaatgttgccaaaatttgttcgggcgttggcatatttttccggcgctccaattcttcttgtaaggcagaaaatgtggggaacacaaaaatttgctgctcagtcaaatcaaaggcataatatttggtgaaatcaatggctttttcgccatttggcgcctctaaaacgaaggcatgcacagtttcctaaaaatttcaaaaattttgaaaattttaaaaatccagggttggattttcgaaagggtataaaattgggttcagccgcctgatctgatgcaggaaatttcgaagctcaccgttactctccaaactgaataaaaatgtcttgaaaatgagtttctaaggctttttggtttaaaaaatatttctataaccttttttcgatttaagacaatttactccccgattaggacaaaataaaatattttttgatataagtttgcctaaaaagcaaccaaatttttaattcttaatatcattaatagaaaacacatagggctaccgaataatatcaagatttataaaatttgattcattttgtgcgaagttatgaattattttctgtaaaaattttttattttaatggttttttgagtaacgacacggtacctccatgactaattaacttaatttataaaatattgtttaccattattattattattatttttaaattaaaaaatatttttcaataaacaaattttatgtatgtgttattaaataatatttgcctttgttgcacggaatccaactgacaacccagtgaccattttattgatgttcacttggagctaaattaaaatatatttaaaattcaaaattcccatttttggcattacgattggtgtgttgtttttcagcttcatatacatccaaaattgcttctcgtccttccagtcaagccttgtttcaagcaccgggaattgcacatcatctccaatcacttcgacgtcataataatccactgcatcattgttatcccaaatttggcctcttaaatagcgcgaaagtgttgttggcgctaaaaaaattattaaaaaatttaacaaattaaaattaaacagaaaatttgaagccctaacaaataagtgtattctactaacctgcaaaaaattcaattttttttaggttcaaaagtttgaaatcctggtccctgattgcttttggccataactttgttcaaagttaaataaattttttgaatttttttaggctaacagaaaactcttcggggtacgaaaagatattaaaaattaaaatgttagttgcttttgagcaaagttatggctaatttttttgttgaaaatttttatagcgattgggcagaaaccctaatttaaacaaatataaacaaacaaatgatgtaattaaaatttggataattgtttttttttttgaaatttgaaaattatttaaaaagggtttaattttggtattaaaataggttttactaagaattttttttagcaacttacgttctttgtaaagacgttcaccaattgcgaaatggtaattgtcgaaaaatgccaaaataaatactttcaacagaaataaattcgcaaatttcatttctgtaaatttttattttttcggcaaatttttaaataaattttttacattaaaaacataaaatgaagaatattgatatacattaaaaggccattaatattgttggcatatcaattttgaatatgctgacataaagcattttccggtgttattaaaggcaaatatataaaaaatatatttttatgaaaaattttcttttataaaattaattgctatattttataaatgatttcataattattattttacacgtgaattttatatgttggaaaatgctcagaaatatttccgatttatgagacatgacacgattttttagcattggaaatccgccgtatgcactagataaataaaaatatttaaaaaaaatttaatttgcatttttttttgaaatttttataggaaataatgtttaaaatttcgagttttattttcgtgttgtgtttggttcgcttatgtgtgtccatggttagccaactttcttcaccaaaaaatgtggttaagccgcgctcgacaggttaaaaaatctaaaataaatttaaaaaatagaaattaatttattaaaaaaaaaatgaaaaaaataatatttttagaattaaattcaaataaaaaaataatgaattcattatcaatgccgacaagtcaaaaaatgtccaattcattacgaacttatggccataacagccttttgtacaattttcagacttacaatggtaaaatttaaaaaaattatttaaaaattataattttagaggatttaaaatacccaaaaaaccggagaaattctcatatcgtaaaatcatccatttcgagaggctcattttgggatggcattaaaattcgttttaattacggcaatcaacttaaaataatgttggaaaacagcattgaatataagaacaaaagaaaatttttgtcacttcaaattgtcggcacaattgaagaacaatcagttagtttacagaatattaaaattaattaaaaaataattatttttatttttaaatttatacatataattagatttgcatgagatcaagaatttgggaaaagccgagatcgggatttttcgggatcataaaagtaaaacagaacaggttacaatatttaactcggaaattttgaaagtaaattttttttaatattttgtttgccgtattaatttttccaaaaaatttttggtagacggggcgaggcaggcaggccggcggtagcgatagggctttgccggagaaaattatgaaaatttatttcgaaccccatttggacaatcttaatttcaatttttcttttaatcttaactcttccagttttacacattctaccagtgcttatttttcccggttgcccaaccggcacccggaccggaagtaaacttaaaaaaccgtgatagcgacctgggaggatcggtaattcccaaatcgatcccggtcttggtcacgtgaaagcctacatataacggaacttttttttacgaaaatatataaaatcctattaagttatttgcatttaaaattcaattcaaaatataaaataattaaaattattaatacacttcaaaaaagaaaattattaaaatttcaaatttttaataattttttttaattgtagcctggccaaggctacaatgtgtcggcactccaagcagcggtagagaaggaagaagaaattttaatgggcccccaaattggtggatttgaacatattttaaaaattgctactgtaatgatggaagcaatcaaccagttaaatgccgcagcaattggaccggtaaaatttcaaaaaaaaattatgaattttttttctagtattccactggcgtcaggttttctgtagtttacgggaaatccggctaatctgaattgcgaattttctaacaaatttgcgcctaatcgcgtgacagatagataaatatattaatccatagcaattctcgagagtcttaatctaaagattggttattcaaagttatgcgtccggtgtgactagaacccacggcatttatgctgtgaaatgccctaaccgactgagctacggcgcccacctttagaggttcccccataccctaaatcccactttctcccacattctgcgtacttctggcaccacaaaaaatttataaaattttcaacaaaaaaaaattcccagcgaattttaaaaaaaaattaaaaattagaaatttttcaaattttatttttctacaagataccagaccgaataaaagtggaacagttgcgcttcattggcctcgtgcttgcccaccttgtgctccgtgatgacccaattgttgatccggagactggcgattatgtgttcattgcgcaaatggagccatgcattgatccgatggatccgcacgtgtggcgacaaatgcgcgaagagttggacatacaagtgagcgtaattttgaaattataatttaataggcacgataaaatttcaaattttatgatttttttgttgtatttttcttttgtccttaaatttttgaaaattttgttttcaattttttgaaaataatttctttttttctagccatttcttaaaaaataattttagaaactttttcataaaaatccttttttttaataaaatcgtccgttttggctcgtggcctggaaccaggcctggacttgaattttttgtttttgaaatcaaggttttccgtgccgaacctggacctgggtttcttttttactatttgacctgaatcttgattctggacaaaaatcctggaaaaccaggtctaaaaatgcatgcctgggtccaggtccagttcgaactctagtttttagtaattttctaataaaattcaaaataattttataataaattttttaaaaagttatcgatcttaaagattcgtgcccaattcgacgtgccagcaaattttggtcgagcaaaagcatgcggacggcattttggctcgagaaggaactcgtttgagcatttgaaccgcaaaattatgcgtggcattccgaagagcgcggaattggtcaaatggcgcgaattggcggaaaaatttcgactgatctcactgaatcaccacaaattgccacattttaatctcatttttcgtacattcatcgcttttggtgaagaggcacccaaacttattcttcttgtctgcgcaagtttttttaaacaaattttaaattaattaaaaatattacgaagttgagacaacaatatttcaaaattttgagttcatttcagtttgatttttcatctaagtatttatctaaagtggagactggtgacgcaaatcgggatcttgctggattctcgggatcccgcgggatttgctcgggaccggaatttggacaggatcaaaaggtccctccctccctctccatcgtttttccaaaatcatgggattgatcggaattttgccgggatcccgacatgggatccgtccaaccaagttgtcaggtatacgggatcccgaccttggggttcctctcgagccgttttccaaagtctttgggatgatcggaattcggtcgggtcccgactacggattcatttgaccccagttatccggtctttaatagaaagtttatcccaaattattgaaaaacgaaatatattcggtcaattaaatctctatttattcttttaggtgttattggaaggagcaatcaatgaatatcaatttgacaattttttaaaaaagggatcaaacgcagacttattagcattcattcatcacatgccaagcgaaatcttgtcaaaacaactgaaatctgtcgcgaaacaattcggattttgagggattagatagatcattagacattcacataaatttgttgataaaaatgtttagactaaatgctaattttactcggataaaggcatagtgataaaaatgttgttgaaattttgatcatcacaactctccaaaagtgatcagataaagaaaaattggggactatagtaatttttactaaaatacaaaccttaaaacaaaaatgtaaataaaaattcaaaaaatttaaattcaaaaaaatgtgagccaccttcaagattagcgggccaggacgttatcgtaccgccgttttcgtaccgccattttcgtaccgccgtttttttaaataaatcatttttatgtctctgaaattacaattattgcaacgaaattatctaaaaaattaaaattatataaagtaaaatgatttattaaatttttttattgtaaaaaaaataatttcgaatgaaatgaaaaattttaatataacaaataaaaataattgaatcattgtgatttaaagtagcattattatttgattgatttttttttttgtttttacaaatttaatattcatttccttatttcaatttatttttacacaattttatttaatttatacaaaaattaaattatttactttttttaaattctttttcgaattcatatttgaataatgagcgctatgttaattaaaatcgtagatttcgaatttttttaaaaaccctaaggggggactctgttgatgtgcaaaatttatttaggttcggaagtcggtattggttaaaactgatgtgagattcgtgatcagggatcccaaaacccctcaagaacaaattttctttagtagaaataattttacaaaaaaaaaaaaaaaattcaaaccaaagcccccctaccccttttgtttttaataacattcaaatcagacgacttttcaacgagcgacgaataatgaagcaatttattattttaaatgattagataattttgttttcatcatatttgtttatttgttttcgaatgcaaattttatagatatatttttaaataaaattattattattttccatatttctttcgcaacacaaaattccatattttttttatatttttagctgattttcattgaaaaaaattcttaattttgt

SEQ ID NO: 7504 - DNA, 3971 bp, Heterodera glycines
  misc_feature (49)..(49): n is a, c, g, or t
  misc_feature (51)..(51): n is a, c, g, or t
  misc_feature (53)..(53): n is a, c, g, or t
  misc_feature (60)..(60): n is a, c, g, or t
  misc_feature (66)..(66): n is a, c, g, or t
  misc_feature (68)..(69): n is a, c, g, or t
  misc_feature (71)..(71): n is a, c, g, or t
  misc_feature (73)..(73): n is a, c, g, or t
  misc_feature (92)..(92): n is a, c, g, or t
  misc_feature (95)..(96): n is a, c, g, or t
  misc_feature (104)..(104): n is a, c, g, or t
  misc_feature (3900)..(3901): n is a, c, g, or t
agggcatatatgatgaatgattgggattttcgaagtctctaaaggggcncngngaagcgnccggcnannangncgaccatttcgaccaggangannacacaaanagcgggcttaaaaacagagcgtcacgttttgctgatggtgccaaatgtgaaaccatggtgaaacctaattttgatctcgcccgtcagcccaatctattgcttaataactcggatgtcatttttagcatacaccgtaacaccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcagctacaaaccaccccggccaaatacccgattagaaaaattgagatcaggagtcttttcatcccacggggcacttctgatctctcacacaatgtttttaccagcattgttccgagacgtttaatcgtcgggtttgtttcaaccggtgcgtataccggaaatcctaaagagtcacccttcgtctttgaacatgccaaaatacgctctatcagtgtcgaagcgaatggaaacattttccccgggtccccctattctcttaattttgatagaaacaaatacattcgagcatttgttgacatgtatacggggctcgggatggacgacggagaaaggacaatgtcgatcaatatacaaaaatttgtaaacgggtggtgtttcttcgtcatcccgatgacctctactctagaggacacccccggttttgaattgattcgaaacggaacgaccagcatcaaggtgcaatttaatgagcctataaaggacggcgggtatgagatgatcgttctgggggaatttgattcgattttgtctattaatgctaatcgtgtgctcagtagcgacggaagcatatgatgaattcttacgagattgaaatatttctatccaaacatccgacaacccgaaaatattttatcggcgtttttgcttccgacaagatgccaaaattgaaggacaggcattttccgtactgttttgtggcgaataccgaccgggtgggcacgataggtgaacactgggtcgcctgttttgtaaattcgccgacagaaatagaatattttgattcattgggcgattatcccaacgaagatttaagttcatatcttaacctattcaaacgaattctcattaacgaccgcatcgtccaacatcaattctcagatgcatgtgggcaattttgcatttatttcttgacacaacgatgctatggaatcacttattgtgaggtcattgacggtctatataaggttcgcccgagggccgatttattagttaagcaatttgtcagtaatgtttaatttaattgttctcctaacgatagtcggtcaactcagtggagaaagggttactattctttctgatgcacaactttttgacgacaagtatctcactatgacaaagagttcggtcaatgaaagacagttcggattcgatcgctcgagactatgtactataaataggaatctgatttcagggtggagtgtatcaatccaagaaattaattcaaagaaaaaagcggacccactaatgttaagctttaccaggattttcgacaattaaagccccgagcgtgtttttattacaacgatcatagttatttaattttccaaaacgaaaagacaaatgaaacttcgataacaagagggagtcaagaaatggttgtcaggaattttcccggtggggaccttagatttgatcatattgatggtcgacttttcgtaatcagtgacgatcgaatagatgaaattgacattagatcaatcgagaatttatggacccacaataatgaaaccgaaattattactaaaccgatcgggtctatgccatcatcatttaccgacttactaataattgagggacaaatttatctaattaaggagaagaaaatatacaaagatcgatttgactcaaacgagatacttcccaaatatgtgtcagacacagatagtgaattttttaattttgtcgtgttcaaagaatttgagaaaattaaagtttcaagttcaaatatttgggtatattttttgtcaattttagatttggtagtggtcgtcatctgtatttcagttctcagaattttaaaaataaagaaaaaaggcaaaaactcatcctacagtggtgaagtaatggtatataaggatttgcaacgaatatgaaaatgcctactcgtgctcaaaatgaattctctcgttgaaattctatgcgattttaacgaatgcgaaccacatgaactttctgaaattctaagactgcggaagaaagaaaatttgaaatttttgagaagacacgccctaataacgagacaccttaggcacaatcagtttatctcaccggatgacatcgcatttaacggttctaatcgactttttgcctaccgaggtttcctaggggttactgtcgaacagcacctctactctagacatcgggtcaaactacaattccctcaactaccgtgtgtaactatgtaccagaataatggtcataggtgctattttccccttgaacttttggattttttataaaaatattacggctaacaagagtgggccttcactttagaccgttccaccccagctagtcataatatcactttaatttttttttattcaactttatttaacaaaaaaaaaacaataaaatacaaattaacaaaatccaaatggtatcacattaagttcttcatcgattatccccttctggcagaccggcctgtacattttgtgcttctccctcgtcaccacttttgaatcccgcgttggcctaaatattgattttttaatgagtcaaatgtttgaaaaacgtacccaaaatcattcttgtacacgaagaacgccgggtcaacctcccctttcccgtaactaagaaccatctccctgaatgtatcgtaatgcaaagtcttcctgttgtccacgtcgaatgtaatccccctaattttcataacgtattccgtctcccccgtctgcttgtttttcatctttaatgcgtactgcttcgcccctccacaacaatattcttcaatctcatgcccaccgtattcctcactcatttctcccaaaaatttccccgtcgtaatcggctccacgtccctatcgtgcctaacaaaaatactgtccgtgtctgtgtacaaaatctccccgccatttccctcggcctccctcataaattccaataattttaaccgcgccatactcgtcgtcctggaaaattttaaatattaaaaattattgacatttatctcaccataaactgataacaatgttactggacttgtgctccatcacaaagtcctccttgtccctgtagatcactctaatcgcctcatccgaatattcaacaatatcacacatctcaactttatgatcacacgcaattttataaaattccgacgccctatcaatcaccgcattcttattcaaacaatttctcatcgaaaatttcccctaaagttaaaagttaaaattcttctacaattccttaaatgtttcttacccataaactattaagcatcaatttgctgatgtatcgtaatcccggattcttcttcacttttgccaattcaatatctattccatatttttctttatattcctctctccaaatattcttctgctcctccgtctcaacccccttcgggaaaccgctcgcctcctccttcagcttcaaaaataatcgcacgtatcctttaaataagtcatccgcctcttcttcgtaatgccacgctctataaaatctgtccacagaatatccgcactccaacgcctttgcctgaaaatggtcaaattatctaaanntttaattcttacccaatcacgctggtatatgtcgccacgtatctccgctgtgtctcatcatgggggcaat

SEQ ID NO: 7505 - DNA, 3015 bp, Heterodera glycines
ctcctcggtaaggggtcaaatcccttcgtaatatcgttaatcaatatcctcctaaactcaataatcgataacagcaatatctccgtgtcgtttctgcaataatttcgcaattcgtcattcaaataaaagggtgtcgtctccttgttttcgtggtacctgaaaacaaaattttatttattgttgttttttcatgttttcttaccatttttcgaattttgcatatttttccttattcatcgatcccggcgaatagtcctccatcggtggtagatgttccaatcgtattccataattttctttcttattgtagtagtaggggaaaaagggtttgtcctcacagtccaaattgaaggtcgccttcagcgactcgagtttcaccggcattaataagcatgagtctctccatatcagcattgaatgtttcctcgaattctgcactttaaattcataaattttcagtccgttgatgagcggtatcgggttcttcccggtacggcagagataattaaatacaaaatgtcctgaaattttaggattaaaaaaagtaaggattaaattttatcattaccatcaaatcgtccggcgttgtgtgcaaaaatgtacgtatcataactggtaaaagcagttaaaatccattccacaaagtccttcgtcggctcatgtcccaccgcctcgctccaatccttggtcctctcctccccacatattttgcaattcgtcctatttttgtcgtcacagcattccgtacacgtcactctcaccgaaatataattaatcacatgctccttctggtcccccttgtaaaccgtgtcctgcgaagtctccgaatcctgaaagttaggttttattttgttgattttattaaaacttacccaaacgacaattctgtacacgtccttgtcttctttttcttcgatcggcataatataacatccacgtttggggtcgtggctcacactacaaagctggcaataagtctctccacattcatggtccttcttcgggttaaatcgataagttttgtcacaaatcacacaacgtttccataatttgcaagtatgtccttgatgatagttgtagcattcccagttgtaaaagtaacgtcgacacttcgggcattcaatcttcactccactctccttttggcagggcacccctccaactctgttgcaataataacatctcgcccggcactccaacgtatgaaaaacatcccgcgaataaaaacattcgcaatcaatacagaattttctcccacgattaaaaaagcagacgtaattcttcagaccatcccagtgaccattctccaaaaatatcggcactacattttcacgtcccatagggcccttccacaaaacacggattgatttccgcggatccgcagatttctcaaatgcaacaacccggtactttccggggtatatctcatcctgaaaaatttattaattttgcattttttcatttaaacccacccaataattctgaacactcgataaatgctccactccataattcatttcatttccattaatctcacaattccgtaaaagttcatatgccgtctctttctgtcgcacaacattcttcataaaacgaataaacgaatatttatccataaccaaataattcatcgacgaagccagtgcgtagaacaaacaaaatttatccccattagaaatccttaataaatattattattataattattttaattatttcaattattaattttttttttgattaaaaaaaaaattttttttttttgcttattttaaataattatttaaatttattattatttttttctgtttttctattcaaatattatttttattttcttttttattattttttttttctgtttttctattcaaatattatttttattttcttttttttattatttatttattttttttcttcattaaatttaatttaaaaataattatttttaaatttattttattgttttttttttctattcaaatattatttttattccttttttttttttttaaattttttttttattatttatttattttatttgcttttgcttcattaaatttaatttaaaaataattattttaaatatatatattttttttttcgtttttctattcatttttcctacttcgttaaattatttaaaaaatacttaccttatccgctggtgttccttgaacccaaagtcaaatttatgaacattcctcggcccctctccactgggcattgtcacacacgttattttcatcgtgattggctcagacagcaacagcattttcttattctcctctccatccccgctctgtcccagcttattaatctcctgcataataacttccgcattgttctgcgggtacgccctgtacggcacccacaccgggaaagcaagcccggcgcccgtaatggccacaccaaacattcgtactttcctcatcatcctttcttccgtatttttaaaagccacctgtatcattgtgtcgaccgcatcctgcatcgcttcatcggggcgctccacatccgggttgatcacaaattccgcaatattcttcgtaaatccaaatttttcgcaaatcgtcgaacgataatccactaatttaaaagtttccatttcttcaataaaattgtttctgaaaaattatatgattaaaaatcgaattgcttatctctaatatattatttaataatttatttaaatgacttacccgattgatcggaaatcccattttttagtcgacggtccgctttgttgagaggttccattgcgttttgcagccatttttaataatatttaataatttctaaatatttacgcacaattttattttagcaaaaatccaacttttggttgaactgattgggagtgaatttgggcggcttttatacgagacgagtgatgtgcaaaattggacctgtcaatattttgattgacaggttacctaattttggtccagattgcgaaatattggaaagaaaaaaaacaaaaaagtcacgtgcatatgacgaaatgaa

SEQ ID NO: 7506 - DNA, 797 bp, Heterodera glycines
ggtagggaattcggcggtagggaattgggtcgatccctatttggtgttatgagcaattttgtctgacactggggcgtacccatagtgctgttataaatgacaggttttttccaccttattctttgcaactagcgccgaaaatttctagaaaacaaacaagtccgttaaattttaggaataaatttaattcggaccaaatctaattttcaaactttttacttttaaggctgttccttgtcaattatggatctcagcaagcttgaaccctgtctcaaagaatattacttgaactgttacccgtacgatctcattttcaaatggctttcatattcgaatagtgagtgaatttggcatttagggcacttttatggtaatgctttttgtaagtaatacccccaaaagtgccggcatttattttcatctttcgtattgagtaaattttcagagaaccgtgactatttgtcgaagagggaatttgctttcatcctcgagaaagatgaacatctccgttttctttcctttgtcgaacccaaagaatttattgtaaaattatatcaacttcggtaatcgaaaagaatgggggtcccaaatataaaattattattttttatttgagctcaaaatgagtaatttgggggttttcgagggtgctgatcacgaaactgaactcggatttgctcaattccgaatcccgggcccgaattcgaacaaaaaagttggatttttttttctaaaggtacatttttctgggtaaaagcttcgaattcatttaacaactatttattttgatcaaaata

SEQ ID NO: 7507 - DNA, 1308 bp, Heterodera glycines
tcagaacaaagatggctctgcgatcaacaaatatcgggtgcacccatttgttaccgaatcgtaccgaaaaatcatggaatccggcgattttgagcagttgatcatggaacagggatggttggactcgggcgaccaatggaactccacaatccttgcccattggactgaccaaagtttggctgaactgctcgacaaaagcttttcaaggtgtgcattttttgtttgggatttgttcgaaattattgggattttagttgagtctccgccaatttcctaccaagattttgggttttggttcacaattttcgtttttatgtcgaatttgcgctcattgtttaacaagaaatccaatttttgggctgtgtttcagctaatttcttaccaagatttgtattttgtttcaattttgttccgaattatctctaatttcttagccaaatctcgaactatgaggagttccggctccgtttttttttatactaaagcccaacaattaatttggttttccattgccaggcttcaaacgccaaaattgcgttgggaatcgatgaaactccgatttgatgatgcaacgcgaatcaatgcgcgagggatcaaattgccaccggttttcaataaaaattttgggtaaatatgtaaaaaaatgcaattttttagacaccttccgatgaagcgagacgttttttcatttcattggtcatgaaatttgcttatccgcaactcgacgcaaaagtcactgctgggtgagtcagttaaagacaaattaaaatggaaaaaatttaaaagcatcttcggagcattccgaatcccgaacctgaattcgaacaaagagttgaaattttcgatcttttctttaatgatggcggttgatgcaattctaatacatttagtttgaattcgaaagtaaatcttttctaacaataagcataaatttaaatttacaaatttgaattatccattgtatttagttcaaatccagtttaggggttcgtaattgcacgaaaagaatgcccattcgagatgagagacccttaaaaaaatttttcaaaaaaattccaggctcaaccatttgctgaaatcgcccttctctgttcatccagaaaatggaaatgttgccgttccgttgagtgccaaagaaatccgtgcctttgatccgaatgtggtgccacgaattgataaattgttggcacaacttgcctcattgcaatccagccaagaaaacaaggagaatcagcgttcaattggtaaaaagttttaccggcaaataaccagagattgcttttattagagagagaccgagattgtgtt

SEQ ID NO: 7508 - DNA, 3852 bp, Heterodera glycines
aaaagcaaatgaaaaggcaaatgcaaaaaaaggaaagaaaaaaggtcaatgccaattgactcaaaatattatttttcatttcggctgggaaatgatgaaaatcgcaaaaaaaaaatttaaaaaatttaaggtgcccacatagttctgcagcggaccgggtcgattgggccccgccgattgggccccatggggcagccacttttttcgtttcacatgttttaaaaaaattaaattattcataaatttattaagtatgaaattctatccattcttacaaaggcaataactcgtacaatagcagttcgtacaatacatttattttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccaaatagaaaagttattggacctcaaaaatcaaaattttgactgtgttttccccttcagggaaggtggtgaagtggggaaaattaaaaaaaacatcagtgggttaaattcttatttttcggaggtccaggttcgaacccaacatgaaaaaaatacattttaattaatgtgcaacaaagttaacgattaaaaaaccattttttatttaaaaatatacataggtaataatttttctttagtgaaagtaaaccaaaagtcgactaaaaaagtgactgccccatggggcccaatcgtactggggcccaatcggcggggcccaatcgtaccggggcccaaccggcggggcccaatcggcggggcccaatcggcggggcccaatcgacccccaccggagattttggggttaccgggccagagttcgagcttctaattagccaatttggccgatcccgggccgcctggttcaaaaaagccgtttaaccgctcgggcccgagttttttttttttttttaccgtgctagggcagcctgggctggttttttaaggttcatagagcccaggctaggggcggtctcaagaattagacaaaattaaaatttacatttattatatgagtgtcaaaatttttgaagcaaaaaagtcctcgtcgatactcttccaagttgaggtcctggttgtgggtttatggattcatttttctctcccattttcccctttaaaaacttttcaggtgtttttttggaaaattttttgacaaaaacttacaatagtattataattcaacataaattttcgaaaaaaaaaattttcttataaattgtctatttcttttatgttttagtctatcgtcaaacttcattggctccacacattgctgtgtttgaacaatggaccgcacaaattctccgttctgaagggcaaaaatgatgaacaacagcatcaacaactcatttctttcatcattgccatttttgaacactttaactgtttaatttaacatttgattttgccaattcttttttttaccaagatttgttctgtctgaaaatggaccaattacaaatttttctaatttatttgtgtgggatttgaaaatgttgtgtttaagagcaaatgtctgttccaaaaccgcgtcgattcacttattttgagcgtctcaagtccacctttaatgccgtccatgaccaggaaaccaaggtaatccaaattttctttttttaattactcatacaccggtcggtccattcgaattacgcccctttttttgatggacaattgcccgtctaaattcggagcttggtttacaaaaatgcatatttttacctgacaataagaaaaatacgataaatgcttattgtttgaaattatcgagacaaacacaattcttgtaattctgcaaaaacaatcacttgggttttcataagttttatttgataaaaaaagaactgcttacgaaaggaaaaccaatttttttttcaaattcgattcctcattttttgcacagtttctgtgcgacaaattgctctccttcttcgaaaactgttcctcaacaaatcccgccgcctcgtcggacattgtcgatttcactgacacatcgatggaaagtggcgttggcaaatttttgaaaaaccatgacgactttgtcaagcaaattttgggtcagtgatgaaatgtttttggggatttcaacttttttttgaaaatgggttaaattcaggcaaatatgtccatttctcggagagaggggagttcgacgtgttcggaattgaggagacaatgaaaaacaaaaatcgggtaagaaattacattaattcacacatttttggcccggttcaccgcccaaaactcgccaccaagacaaaacattggcaagcatatttctgctcctactgctgggtgttgttgattttgaaaattaattattcaaatttgttcaacattcgcaattttattaattttatatagtacaataaacattcctctccctccttacaattagcccaccggaatctcaaatttgtaaaaaattcaactaaatcgagtgcctcattcccctccaaaaacatatgggtaccacccacccatgcacccccacacccaaatttttgtaatttcccaattttgatttttgagatagtgttttatctttacattttcagcacaatgcaatggtgaaaacggttgaccaacactgttaccaagtgctgtgtttgtgcgcattgttctgtccggtggacatgcaaaagggcgtcatggacgcactgtttgcccatttgtgccgtatccaaccggacagagtgttccgccccgtggaccatgcactgtggacagcacttttgctgctgatcaacccggtgaagctgaagcagcaatgtaagcaattatggcgaaatatccatttttatggccaagacatgggtttagattcgaaaaaaaaattttaaatgaaatttggtaacaaattcaaaattttgggaaaacatattggcgggcgacggggagtgaacccgggtacattttattctctccgctcgacgtttaaaaaacgtttgaaattccaaaaaataaaacatttaaaatttttaaacaaatttcttgacttttaacaattccaaagaaagtttcttcgtttttggcttacaatattttatcatatttgtttatcggcatgaaattgggaccaaaaatttttaatttttccatttcggtgccctttgacctcttcccatggttagggactttgacagcacccaaaaattaaggcgacggttctgtcgaggtgttcaacaatttcatggcggtgttgcgccagccttccaaatgtgatgagccggacaatttttgtttgaagggcaccatttcacttgcgttgggtgtggcaataaaatatgcacgaaattcactcggtaaaaaaaaaaaatttttttttgcttttaaattttcctcaaatttttcaggccttggcatttcgcatgaacttgacgaaattgagttggtcaacgacggcatcaaaaacatggcatttgaatacatgcaggcgttcattgtgaaggcgccggcattttttgaattccctttttcaattgacgtggtcgactcgctgatcaaaaatttcatttgctatttccgcgacaaggtggacaatttgattgtacagtttaacaaatggtaccaaaatggggtcaatggcatttcgtagaatcgattttgtacattttttccaaaaattttgaaaataaactttaaaaaacaaaaatttacgaaaaaattatttttttagagaaaacttttattaatacaaaacattgccacaaatttaaaaaataatgcgctgttaatgcaaatgtcatattacttcatccaactacgaacccctaactcgaaattttagggt

SEQ ID NO: 7509 - DNA, 5861 bp, Heterodera glycines
cacagtttaacaatgttattttaattattaaagctatatttctgcagcacctttttctccgcgacattatttaattgcataatcctataaagagcccaggtcagaagtcaatataaacattaggaggtcgttttgtgataagtaatgcgatgaaacatatctgaacataatcattgcataattatagcagatttaaaaattggtgtggtggagccttagcagatcctggaattactccaccaatgaagacaacggaaagaagcataccttattgcgtaatctgacaaaaaaggagctttaaatcattagaaaatggcatcagaaacggcttacaagaaatgtttcccacaaattgtaaaatcttcgtcaaaattcatcattttttgattttcacagtttaacaatgttattttaattcttaaagctatatttctgcagcacctttttctccgcgacattatttaattgcataatcctataaagagcccaggtcagaagtcaatataaacattaggaggtcgttttgtgataagtaatgcgatgaaacatatctgaacataatcattgcataattatagcagatttaaaaattggtgtggtggagccttagcagatcctggaattactccaccaatgaagacaacggaaagaagcattccttattgcgtaatctgacaaaaaaggagctttaaatcattagaaaatggcatcagaaacggcttacaagaaatgtttcccaaaaatgtaaaatcttcgtcaaaattcatcattttttgattttcacagtttaaagcatatgcttggagaatttcgctgattgccaatcataagtatttgtcgttggatcggtacttccttccagtgccatggcgtgttgttggtttgccctcttttctttagttgttggcgacaaggcttttgtttggctgctgtgttcgaatgttcggcttattcctgcggaaggagctgcttttccttgtgttcgcttgcggaatgatactggtcgcgtggaatttgatgaactctgctttgttgctgttgatcttcgcagttctttcggcagtggagcagttgaatgtttgttcgatgagctgatttgttgatccgcaactgggtcttgtatgatctcgacatcggatgagtttccttcgctgtcggaagaaagatcaatcacgattggtgttgtgctgttgggaaccgattctcgcttgcgtcttggtcgtaacgttgcagcgctggacaagagcttgttgacttggtgccttctcaatgttttaccctctcgatgttgtttggctttctgcatgtgtgtcggtttactgcctgtcgattccttgttggtgaccaccatcacgaaagagacgttggatggttggctgagttcgattcgaccctttccgctgataatattgccaatttttgattgacaaattgtgaagccgcttggcaattgttcaattggttgaatctttagctcgtgccaaacatccattcaaagcaagatgtctggttgccgtggcgcatttggcaggttaagcttcttctgctgaagctcgtcgtgatccaccgcattcagttgtagtaccggcatttcgttcaacaggaacttcaacgcgttcaggttgaagatgaatctgtcgttgtcaggacaaagaatgccgattgcgacgcggtcgcttaagtatctctttggctctctttcgccaaagcttgtgaggaaacattcttccgttccaaggttggtcagctccaactgcttggctgcactgcttgagatgaacgatcggtggcttcccgggtcaatgaacactgttgccatcatgctgaggcctggttgtgccggattgaaaatcgtggcccttgctgtcattagcaatgctctggtgtccctgctttggacggcattgcacatctgctgttgttcgatcgctgttgatcgcctgccgttttggtcatttggcttcttttcactgtacgagttgcttggcatattgatgtcattctcagacctgcactgatctctgcagagtgctgtgggatgccgacgtttgcaatggtagcacttggacggtcgagcgcagttcgatgcttgatggtttgccttcaggcatttgaagcacaacttcttttctctgacgatgctgatccgttcgttgagtgtgctcacttttttgcactcgtcgtgccaatgattgccgttgcagaacgtgcaaggatagggcggaatcctgttgatgctttgtgcttggtctcgcgcttgtggatgccgactgtttgctagttgcatgtcctgttgcttcttataggcttgctgccttagactctcatccagtgttgaggcgatgaatgactcatgccgttgtgtgcttggttgattaggccttcgtgacctttggtttgctgttatgggcgattggacgtgtgctgctgaaacgacttctgcctttgattgaacgtagtgatgtccatattcgcccatcacttcttggatttggacttctttgcggactgcttcgttaagcacgtcccggaattttgttgttgtccaatttgccggatcctctccctttttgttgaggatgttgcgtaggaatgctggagtcagctttttctccaacatgaggaacacctgcggtccctcgatgtcctctccggcattgttcagctctcttgtcagtcgttcgagctgaagcaggaattcttttgtgtctcgaagacttcggcacggcttgagattggccagctcaaagtgtagcgctctgatgtgctcttcgggtgcgccgtaagtgtccttcagcaactgaaggaccgtctcgtagttttggtcctccaggcggaacccagcgatgagttcccgtgcttctccgcccagaagattgcggagcaagttcagcttctgtgctttgctgattgattggctgccgatggccgatttgaaggactcgtagaattcgggccattttcgcttttggccgaagaatttgtcaagctggattggctggaattggtagagcggtgccgtgaatgtcggtgctgccattggtggcattgctgtttgtggtggcggatttgcctgctgatccgcctttgcttctctttctgttctgcctcggtaaagtttggcatcggcactgagcgttgcttcgagatcccgcagatcccggagtttggttgtagctgcgtcatggcgttcggcaattttctcatgcgtgtcgaatttgacgtattctttctcgcctttgtctttttctgctccttctaggcggtttagcaggtcaatccaattgttggagaggtcgcgtagattgtccagttgtgcttcgattgtttggacttctctgttcacgcgagtgcattgagtctccaatttgactgcgttttcccagtttgagaggtcggcgtctggatgtagtgaaagtgccgtggtcgttctggcactatccagcgccttgagtgtgaatgtgatgcccttctggattaggctgaccattgtgggttgtttgccgtgggctttgcgctcttcagttgttctgctgctgctgttcagtttgcgttttgctgcgcttgttggttactgctttttgttcgagcagtttgtcgttgtcggccgtttgacttgtctgcgccgtcgaagtattgccgccacggagagcaagcagtactttgtcactggggacacggaggtcgcccagtaactgaacaactaccggcacgaagaccagacagttattcctagacctacgcttacaacccccaaagtcaaattacagttggcacggagaccgaactgtaattagtcgagtcactgttggcacggagaccgaacagtgcccaacaaagcccaaattttgcttccctccttcccttcctatgtgtttaagttcggccacgaagagcacgaacttatccactttccgaatgctttccctctcccctttgtcaccggttgctgttgctgttgttggcggacgaagaatccacccaggagcgccacttgtggaaacctccacaaaatttgcacaaggtagtgccacggggaccggttggggcagatgggctcggtcggtgggtcgggggcaattggtcgaacacacaattcacacaacaaaataatgctttattgttccctctcaaacttgggtaattaaaccgatatttaaatgtgaacaatataaaaaataaaaatgaaatgcgccatcaccggggggacaaatgatcacaatcacagaaagaggggccgtcggggggataatcacagaaatgcgggattcaccgggacaatccaagggggacaaatgttgggccaggagaagtgcaaaaaggtggaaagagagaaagggaccaggaaaagaaatggtcaaaagtggtccgaggatgggcaaagggagaaagagagagagagtgtgtgagagcgggcaaagggataggcattgattgcctgtaaaagcgaaatgaatgtgaattgggaatgatttgggagtgatttgatggccatttaaatatggaatagggaaagagataaaaatggggccaaaaagtgaaattgttaaatttacaattaaaatgggccgatcactacaaattgggggagcaaagtactttggagggggcaaaattggcgaacaaacgattttttttattgggggggaaatgggcggacaatttcgcacagttgcgattgcgggagaaaaaagtggggaaatttgcggcggagggaaatttggggaggaacaggatgtggaacgggcggggaagggattaaaaacaaacaaacacgggagggaaatcgatcagtcataccatccccttatcacccccttttacatcattttaatgctaaaattaaattttgattttacgaaaatttcgacacgagcataaaaataaataacaaattaacaaaaaaagtaatcagattcaaaaaaaacttatcttcaaatatatggcattaaattaatcatataaaaataaaaaatttcaaaatttattataaacttattaaataaaaatactaaaagtaaaaaaagtgctaaaataactatttttaaatttcgtaaaacaattaatattcgaaaattaattaaaattttctagcaaggtgacgagtccacaaagaaaatagagattaaagggaaggaagaaacgagtgagctatatatgctttagcattaaaatttatattaaaaaataatcaaaatatttgcataaataaaaaataaatatcgaaaaggcaaaataaaaaacacaagaaaaaattaatcaataaattaattattatggacagaatcaataataaatatttgaatagatacaatataatttattttagagaatttaaaaataaagcaatattaatttgttaaagcaatttaagcgacgagacatgactgacgaaagtacaaagactaaaatcataaaaagtgcaaaacaaacaatttggcaaaatatcggaatatttgtcaagtgtaaagcctgcgtataaaaaatgcaacttataaattaaaaaaataattcaattaataattcatatgggatttttatgtttttacatattttttctgcggcatagttatgacgagagaagcccaacaataacattttctccgaacaattttcgatttagagcgaattataaaaacataaaaacacatattttggcattttggcacataaaaacatatggcacatatttcggggttttggcacatattttggcattttgagaaaaattttcaataaaaatacaagaaaattgaaaaatacacccctaaaaatcaactttttcacaattcttatagaattttcaaatttttaaaattttttaagaatgtagaaagtaacaaaatcgaattcattaattc

SEQ ID NO: 7510 - DNA, 3007 bp, Heterodera glycines
  misc_feature (133)..(133): n is a, c, g, or t
aaaaacgtgccgcgaaaaaagcggtgtgaaagcaaaaaaggttattgatttacattaatttacatggccggagaccccttcgcaaaattggaaaattggccgctgatcccttgttttgcaataatctgaattntgaggtctatatctgaattttagtgttctttatcctgaatttgaaaaaaaaacttggtcaccctcaatatacatatacttctctgaacaattctaatgctaaaaaacaggcactcgcgcgaaaactgaataaaaattttgtatttgaaaaattgtgtccaaaatttttacgttggaaaattaccggtttttaccggtaccggtaccggtaccggtggaaaaagttggtaccggtaccggtaccggtttttgcattaccggtcagtaccggtaccggtttttttacaattaccgattaccgctcaactctatttaaaacacatattttgacagtttttgtccatattttggtccatatttggccatttttgagctttttagtccatatttcgggcttttttagtccatattttatgtccatatttgacgttttttagtctatataatttacaaccctaatcattaataaaattaatgtttattgacgaatcttaaaagaataaagcggagtacaattttaattatatgtatgggcaattaaaaatgattacgggaaatgaaaaggataatgacagcaaatttatgcgcgaaatgacaacaaaaaaatatggcagtttttgaatagacaaaaggtcaacaatatttcggcacagcgaaaattttttgacgaatttttttttgttgcaaaaaatactgatttgaatttatctgggatgtagcaacaacacatatacttaaattttgagtttgaatgtgtcgaccaactgtcaacacctttcgccgtttggaacaccgacaatggaaatgagactgtcagatattatgaggaattgaagaaaatgtcatgtgaacattaatgaggaaaatttatttcaagatgcattttacgttcaattatatgttaataaaaaaaaagtttgtcaatatttttgaagtttttccaaaaaatttgattctttttaaatttggcttcatgaaaaaatattcatgctacatataagaaattgtgagcatcgttgttgggaatgtatgccgacataatagctcggaaccattgccagaattcaggcattggtatcacggattttctcttggaatcagctcaatttttagattattttttgtgggccctttttcggtgtttgtcctttgtccctggactctttgtcggtgtgggccctttgtcggatttggccctttgctttgtccgtgggtcctttttttgtggatcctttgtcactgcaccattttaaaagtcactggttgagaacaaaaaaatattccatcctctttttcatttttataacattatcccgagactcgaaccgagacccaaaaaacagagacttttaaaaaaattaatttattcgattaaaaatcgtttaaaaattttgtttgattcttttcttaaacaattcttcattttttgatttgactcattaggaaccttacaatccaaaacaagactttaatcgagtcaagactcaagatcgatactctcgaacatccatagttttaacaaatgaatgttaattctagagaccggaaatttcaaatttgtggatcccgctgcgggattggaatccaaaattttttgcgggacgggatcccgcgggattaatcccgcaaatcccgcatttaaaatttgcgggatcccgcacaaggactcatttgaaaatttaaccattttcacacctaaagtaaacaaaaaatgaggctaaagcatatgctaattctaacaaaaattttttttattattatcaaaaaaacattggaacaaacagcgccgcatacactaaaattataaaaatatttttcaattattattttttaaatatgccattatgtggtgttgttcctaacaaaacctaagcggcgtttctgaaaataaataaatattgaatattttaatttttttcaacttttttgtacgaatatctgacatgaattcttcaaaactaatgccatatataattaaaaaaactgaataatattaaaattaaaaaacttacaaattagtgtccatttgtcaagttagtaatgcaaagaagaatggaatattgatcattcataacgtttttaaaggaccatcaataactttaattgcaatgtaaaaaattaaagtcaatataatgtttaattaattttattcggcgatcaatatttcatcaaaaatgttgattatcctattaaacaattaagttcatgcttttatttgttcgaaaaatctgtcatctttagcgttttgggagtccatgccggttttggcgtcctacggaattttgcttaatttttgatttgctatttaacaaaacccccacaatattggctattttaggtgtaactattgttaaaaaatttatacaaaattttaaaaatttcccgggtttcgaacttgtatccgagcttttgaattttatctattaaaatcctcattaatttattagtcatagtgctttttttgattatttttgtgggctctttgtcggtgctagtcctttgtctttgtgatatgatttaatttatttttaatttctatcaaaagttctaaaagtcaaaaatttcaagaaagccacaaggactgatttgaaaatttagccatattcacacctaaaaaggaacaaaatgagtctaaagcatatgctaacacctaacaaataatgccattaacctgtcgccaagctttttttgctcatcactcaatttttgttgtacaaatttttgctgcttcatctttgaggggccagcaaccaaaaagtgtatttcttcgccgtcgacttaaaattaaaaatgattttttgaattcatagcataattttttttttgcattaatataataaatattgaatatttcatcatttgtttctattcaatc

SEQ ID NO: 7511 - DNA, 4032 bp, Heterodera glycines
tcggtcgttcttcgctcaaatccgttgcaacacgtcatcagcaaaatgagcagcttggtattgcctttgcacggtctttcaaactcagtccaaaattttaaatttaacttagaaatcgaatcccattggagttgcaattgcattaaagcacaaaaaaaccagcataaaaagagcacaaatccaaattatgccaccatgcttaatcgaattattttaacttgagagaatatctttaagaaaatgcggagaaatttgacagggcttatttatacagaattttagaccccaaagaaagcgtcaaattatttatggaaaatttttttatttaatttaaattattctttctatacatcttttattttttgcaatgtttaatttcttttattcactttttatttttcctctccttgtcacacttttcttcgatagaattaatttttgctcttagttttttctcagtttctcttttatttttacatttttataattcccatttattttatggtgtttaatgattcttattcaccaaaattctggtaatgtccgtttatttcagggttttttatgttcttttttctaagaaatgttttatgacttagatttattcataattcgaatatataaaaattaaaatttttgggtttggaattcctaagaaaattaggattaaattttgcaaggcaatttcttcaaatagtcaaaatattctccaaattggtcccgattggcggcattgaatatcgcaaacactgttggcacgccaccaacgcagtcgtactgtaataaatagggaaaatatgaaagaagaattaataattgacaaaatttaatttaaattaaaaaaagcatcatgaaaaacgatttggcataattagttaatctatttgaaaatattatttaataagttttgcttttcgttccatccacataaagtgcttatgctggttagacattgtcacattggccaactcggccaaaatgcccgagtacagtacatcctccaggaaaaagccgttagttttcgggctgtgtgccaagacagctttgacagtgtcggtgttggtcaaataaatgttgccaagcgcaaatatggggaacaattcaccagggaaatcttccctcgagatgtacctgcaaataaatttggggctgaagaagccactcgacacttggccatttcgtcccgggcactggacgatttggccacggacaattggcaacagacaattggtcagtgcacaatttggtattttaaaaaattctacaatgttcaagtcaatgaaaaaatgaataaaaaagtgaattaactaccatttgatttccctgtcccgaaatggctttcgactggcgtccatatccccaaaaataatcagcggatggtcatcggcaatttggcgaaattttttgtttatccaatagtccatccggcgcagatggaccaccgtgtcgtcgtccaccttcgccacccattcggcaccggcacagtgccgttgttgccatgtcagagcaccgaaccactgcaaatataggcttatgtaaatccgacatattaaatttgtcaaagaattgccaaaataaatgcttttttttctccgtttttatcatttgaaagaaaattaattattaattaattaattgtcatttgctgatcactttgagatgtaaatgcttgtacttatccacaaagccgtgcaaaaacacaatgtcaccatgctttttctgctcctcttctaatttttgtttcacatctgccgcttctcctgccgatgggtcggcaacgaaaaaacggagaatttctccgggtgcctaattaaatccaaaattatatttatccaatcaataaaaaacaattaatgtccattttgttcaaattttaaaattcaaatgagtgcagccagtcctattatgatcaaatttagtttttaattgaatatttcaattatttttttctcactattaatttattcgacatttctcattaattgaattccttaaaattcaaaattgattaacccaattaaataatttacacaacgtgtttcatcaatacaatgatgaaaccaacttaattagtgctttaaattgtttcccccgttatttcgccaataaattattaaattaataataataaattcaattaaattgttccctaccgcttctttcatccatgtctctctcgcgcccgttcgcctctcaaatgaggttctgcccgacattgccaacatgatcagcttggtgccagccgcacattcgttgccaatttccatcgaacagttcatgcgaatgtttttgaagcgaattgcaaattcctaaaaatacgcaacagtatttctagaaaagactgtaaatggttcaactaaataataatttagaggtaataaatcagaaaagtgattatttataagctaaaatcgtaaaaatagcatttttggacaaaagttattaataaattttattattttttcgtttttatacaaaaaagtaaccacctcaattgaaacaaatgcagttttgttggcaatctgcttcagaagcgggtcagccagaagctgcattttgtttgtcactcgcaaaaaaagtaaaacaaaaagcagaattaatggtgccgcaattttaatttttttcattttttcaagaatagcttttattttttcaaaaattatccgcaaatgtcccaatacgctaaaaagtgcgatttaagtaatccattttaattcgatcaaagttcaaatctattctccggcctccgtcacaatttaataaacataattaaactggtaataagaaaatgcatgctttaatcttctaaactactaaaactgaattcattttattaaataaaaattttatattttgtaaataaaatgtacatttcagcagagaaaaattgctatgagttttgtttttagggtcaaaaataagaacattttgcgaaattgctttaaatcagttatttttaaaattatccgatcaaaaatgttatttaattattatatttttcgtctcccattatcgcttttaacaattttggggaggagataaacaaaccataaatatcagacattctggatccattaaatcagatttttaacattttttgcggcacagttttccaaaaaactcgggtgaatgtgcgtggaaaatttttaaaatttttaatggattttgttagaaattagccaaattcagaaatttcctcttttagatgaaaataagacactacccccaaatcataacatttcttagaaaaaagaacataaagaaaccctgaaaaaaacggatattaccagaattttagtgaataagaatcattaaacatcataaaataaaggggaattataaaaatgtaaaaataaaagagaaactgagaaaaaactaagagcaaaaattaattctaaggaagaaaagtgtgacaaggagaggaaaaataaaaagtgaataaaagaaattaaacattgcaaaaaataaaagatgtatagaaagaataatttaaattaaaaaaaaataaaattctcgataaatatatttgacgctttcattgggtctaaaattcttcaaattttaccgcattttttagagatattctctcaagtgagaataattcgattaagcattgtggtcataatttggatttgggcttttttatgctggttttattgcttgttaatcttagaataggaatgtacctcgtctcttccccacttccttaatatgaaaattctactgctgtcccgatcggctttggacgggacgaaactatgctgatcattttgcactcggttgatcagcttaaattcggctttacgcagacatgttcaacctgttcttcaatttcggctaaattcaaaaaaaccagaacattttagcctggtgaccggtaggcgaagccagggaaattttaatttttatacgattttcacagtttctcacttcaaaagctaaaattaacaaagaggggaaatatgtaattgcatttggtgaattccctccgggggagatgacgaacagaagacatttatgaaaataattaag

SEQ ID NO: 7512 - DNA, 1442 bp, Heterodera glycines
gccctattgatcagaaattccatttttatcagcattaaaaattatgcttaacagaggcagagaataaaatgaatatttattaaaacaattaaataattgtaaaatggtaatttaacaatagctcagcgaattggattaagtaggttcttgataattttaataataatttaatctaaagtcatctttccgttgaacaattgtatcggtacccattcagccaaaaagttttctcgattatgtggaaaacctaagtaaattagatgagtgcaaaaccgaaattcaattttcaaaaaaaaacaagccttacctttgccgaattttgaattgtaaaaaatggtggcattatccggcatcagataagcgacccaccaaccccatgttgaagtatttgctgttatcagcaacgaatcgcatgttatgatggaaaatgccaagtcattaattcgcggcattgcttttggcaaataaacgttgacaattaactataaaatttaaatttatcatattaataaacctacttttcgagttattagggcctattttctaggtttttaattttaaaccgaaaagcctaaaaaattttgaaaaaccatttttttttttgcctattttggcaatatgccaaaacttatttaaaaaaatgcaatgaaaaagaaaaacacattcttaagaagcgaccaaaggaccaaaattattatttattaaatttaaagctttttagaacctattccatttttaaagcttattttatgaattttttagagcctaaaaatataagccctatctatatattattacctgttgattgatttttaaatccttcaaaaattgtttgtcttctcccaacaagacgacagaaatgtttttaaaggatcccttaattttgaataaaaatattgaaaacgtaaattgatttaattaccattaaatatttaactccgaattcgatgccctgctcagtgaagtctttattggaagcccaagcaaaattaacaaaatcacctctacgagtatacacacaatatttatgtgattgatcatcactaaaattttttaattaaattcatattaaaattgatttaaaatacaaacccaaataattcttttttgtatttgtcaacagttctacagagtttttgttcaatccgaaaaatttgacggatttccgttcgtcgagtttcaaaatatttaaacgattggaatgcagttcccttcaaatctaataataaatttaaaaattattttaaaaaatgttacatcgatctttaagtatttttctttgatccttgaaatggcataccttaaaacaaaattcaccttttttttaatgtattcatgaaactgccaacttttgtgggttgtcataagaaaaaggcggagaaaatgccctcaagtaaaaggtttcgttttgcttttcagtcgaattctaaatgcattaaatt

SEQ ID NO: 7513 - DNA, 3101 bp, Heterodera glycines
  misc_feature (89)..(89): n is a, c, g, or t
  misc_feature (99)..(99): n is a, c, g, or t
  misc_feature (116)..(116): n is a, c, g, or t
  misc_feature (2947)..(2947): n is a, c, g, or t
  misc_feature (2980)..(2982): n is a, c, g, or t
cctaaactttatttattatgaaaaaagtatggacacaaaattttttttatattttggtcactttttcgtgtaacaaataaacttttctnaagtttgctngtagataaaaagctaanggtctatgaaaggtaccaagaatgttaattcggtcgatttgacagaagttatgacgatttttttgttttttaaagcagtgcgagttggttttttgccaattcttacccttccaatcagatccagaaattgtcaaacaaaagataggatttctgcaataggtacggtatcaaaaaacgtatttgcacagatgccgccatatggtccggctcacaaccaacagcaacaaatgatgccaccgtcggcgctggtcggcgttccaccgggcgcagctgcaacgaacacttggatggattggaattcgtcagcggcgatgccaccacgcggcacttacccgatggcgccgacgaacgccatgaaggcgggcacacagacgggcacgtacattccgccgcagagtggcggaatgatgccaccgcctgctgggcaggtgccgtactacgccgttgggatgcccacgtcgaccactgctgtgcacggtcaaccgatggaaccggctgcataccatcagcaacaacagcagcaacattaccaagccgttcagcagcagtacacaaattaccaccagcagcagcagccgaacatgatatacaactcacagcaacagcaacaaatgctcttccatcagcagcaacaacaacagctcaatcaacaaatgatgatgcagcagaggcagcaacagcagcatcgccaaatggtcgcgacggcaacggcaccaccggcggcagggacagcacagcagaaagcagaacttggcggagtccaggcaggacaaccggcggtgcaactgggaagctacgcgtcgtcagcagctggtggtggtggtggtggcatggcgccggcggcgggcggtccgtcggcagtgaattctgctgcacagcagcaacaccaatggcctggcagtgtgacgcctgttgaggacctttacgtacgttttcatcggcgggttggttttggaaagagcaaaaatgcttgggattttgttttaccattttttatgtccccatttctacgcattaacctaaccatcgccatgtatgatataattgactaaataacacatgtctaagtagttgtacaaaaatttaacgcatttaagagcacgttgggcgatttgctgcccgtgccaagtgaacagagggactctgctggccattttggtggtgccgtcacctcaaccgccatggcaccacaacagcagaacatggcgatgggcagtggaggcgacgtcggcaaagtgacggtgaactttttggacctgccggagatttgatagtggacccattttttatatacaccaatcgcaaaaaaaacatttacattcgcattactccaactttctccaggacaacaccattgagaagttctattctggccaaatttgatttggcagcgacttttaagaagaaaagaagcatcggttcgctcatctttacacactttctattccttaactttaccacacaaacacagatattatttttttcttgcgcattttttcttttatttgcttaagtattttcttgtaaaattagatatattcactgctacaaaatatgtatgtgtaaaatgaaaagtataaatggttttttgggtacgatctgttgctgaatttatggttaggaaattttggtcggattggactcgaagttagcctaaatgttggttaatttgtttgagccgcgcttcgtaaaaccgcagaactcttttcacgatctcacccaattcttccaaatggagaactcactccgaaccagcggttttttaagtgtccaatttcaaaaaatgttaatttatgcgcctccgggttatgtaaaagattatttgtttgtgtactctttttgcttgccgcctttgaactcacaaatatttttttctgattattttaaaacaaatttgttgaaaccacccggcgaataacaacatttctttatccattctgaccaacaaaaaaggggtaacaatgggttttttatctttgtgtgctcattcatcggcaatggccaccttctcggacacataaatgccgtccaggaatttccgaatgtccttgtttttcacagtcgtcgactgttggatgcgagcagctgaatttttgcctaattgcaatgcgaaacttcatggcaagagtccgatttgtaagtagcagttttcccgaaagggcattattccatgaaagccaaccccggtttttgactgccgaatagttaaaaaccaatctcagcactagagcccggtaaaaaaaattttttagaaaaaaatattgacttttctaaaatattgatttgcttattttttaagagaatagatggggatagagagagatagggagggcagagagagagagcgaagaataaagggaacgataaaaaaacctcggccgcgcattcaaattgccgcggccgcgaccgcgcaaaaaaaaaccgcggccgcgcatcgcgcattcaaattgccgcggccgcgaccgcgcaaaaaaaaaaccgcggccgcgcaccgcgcatcgcgcaaaaaaaaaaccgcggccgcgcaccgcgcattcaaattgccgcggccgcggaccgcgcatttaaaaacaaaattttcaaaaatttcaatttaactataaaattttcccaagtgaaaatttttttgaaaaaaaatttgaaaatttgactgcaatttgttacgaaaattgcctatattaaaatatgtatccgttaaatttttttattttcgtttggggagccattcgaagaatttttccattatatagaaatttttttttaaattttcatgcgggggggggggaatcttgaattttctgagtcccaaaattttggatttttttgaatanattaacaatctattaaagtgtggaatttgaccnnnagagcaacactgaaggtcagaaggtttagccactagcccaaatatttagtaaaatggctttaatgaaataaataataatttttttttctcaaaatttctcattcctcaccaattccctt

SEQ ID NO: 7514 - DNA, 1124 bp, Heterodera glycines
acccccattcttaccagtgcttaaaaatgggcgcggcgccccgcgcccacacaaaaaaatcccgcggccgcgcaccgcgcattcaaatttgccgcggagcgaccgcgcatcgcgcaaaaaaaaaatgccgcgaatcgcggtcgcgctccagccctgatactgaagtttatccccccccccatttttcgaaaaaaattaaaatttttaaaaaagccgtgtaaaacacttttctatggggttttcagggtcgctgaatacgaatacgacatttatattgccccttacctaaccctagacccatccgaataagaaaatctcaaaattcggttaaaatatatgctgttttttgtttcagattttgttattcattgattgaacaaatgattcgaataaacttgaaagtctgcaaaaaaaagtcggaagaagcgttatttgtcagacaagctacgactgtttcccactcgacttttggcagaagtgaggcgatcagcgactgatgaagcctttcaaacgtatcggtctcgtgcatttgtacggtgagaggacaaaattaggtgaggcagatcacaaaacattcaagtcaaaataaaagtaacataaatcctatttttcaaaagtgtaccatttcaaatccaactgacaaagagcacgatttgggagtggagtttgtcgaatcaaacgcagttacaaattttgacaaccatcaaacaaccgccgactttgaacggggctgaagtttcaacgtggcctttgtcattccaaagaggacatcgtctcgtatgacaatcgcaatgtcaggcaagatctattgtctttttaatgtatgagtaaaattgaaaaaaaaaattataaagatctctgttacgttgacgctacccgatctgtttattgttttattgtcagtaaagaaaaagagtccacaaaagggaaaatccgcttacattgaggacaaaacattaattaaaaatgtcctcaagagatcaccgccaaaataaaatataatatgaaatcaataccaataaataaatagcgaccaaatcacttttagtttgaatggattaaaaattcgactttaatttttccggtctattttacaggaatgaaatagttttagttttattttt

SEQ ID NO: 7515 - DNA, 2040 bp, Heterodera glycines
  misc_feature (14)..(14): n is a, c, g, or t
  misc_feature (23)..(23): n is a, c, g, or t
  misc_feature (74)..(75): n is a, c, g, or t
  misc_feature (100)..(101): n is a, c, g, or t
taaaaattcgactntaatttttnccggtctattttacaggaatgaaatagttttagttttatttttaaatgatnntaatgagttatttcaataaagcttnntatcgagttggttccaaattttagttactcgccctgcaacaggtataaattttttgcctagtttatatttcgaattaagtctataaaagggaatgttaaagcgttcagaaggtttgaatatttcaaagggattcagatctgttcggccataaattattttatgagccatgaacagatcagacagctttcgcctgctttcaagtgtcgcagttgaaggtattctaatctttgttggtatggaatgggtggaaggctgcatttgaaaagaactcttttggtgaaatatttttgacatttttcaatttttttaatattttttagaagagatggattccaaacctcaggagcatattccaataacggtctaacataagttttgtacaaaataatccaaatcctagaagattttgatttaataacccgaaataaagaacgcatacgtaaatatgcattctttattatttgtgcgacatgattggaaaattgcaatttattatcaatatttatgcctaaatccctaattgtatccacaacatttattatatttccatcaattttatatatttctttggggtttttgttccctaaatgaagtacaaaagtttttttaattgagattctgatttgccatttatttgcccattcggataaattatgcaatgctttatgcataatttctgtgtcagctctcgctttataacaaatatacaatttaacatcatcagcatataatttaattctcactcctgatggcaaagcatcaggaagatcgttaatatagatcaaaaataataaagggcccaggacagagccctgggggacgccagagcaaacttttttattcgaggataaagcctcctcaattttaacacgaaaagtcctattactcaaaaaatcctttatccaaattaaaagtttgccccttataccaattttttccaatttgtataaaagtaattcatggggcactgagtcaaatgctttttgaaagtcaatataaatacagtcaacattttttccatttataattgcctcataccaatcttccacaactgttattaattgactcgttgtagacctatttctaacaaaaccaaattggtattccgaaatttttttgttttttagtagaaaattgtaaaatgtctgcttaaaattctttccattaccctgcaaagtgagcaggttaatgaaattggcctatagttttcgggattatttttgtcaccctttttaaaaagcggaaaaacaattgattccttccagatgtctggaagtgaaccagtgtctaatgagatcctaaacaagtcagtaataacagttgacagagaagaatggcaaatttttaaaattttatagctaatattatctggagaagtgccatttttgttcggaagttttttcataagattttgggtctcgatgatgttaaaatttatatccgatataaagcattgatcattttctataatattacccaagtatgtattgcttgggtctgtttccttattattaaatgaattggcaaataagttggcaaatatttcacatttctcagcactgttatgatagcatttatcttcataaatcagattaggtatttcaaagggattgacattaaagttttgtatatatttataaatagaatttcttcccttttgaatagcctttttctcaatttggttatggtatttattttgtttgtatttttaattgaaaaagatatgctatccgaatagtgcttttttttagatgggggcaggttttaagcttgcctgaaaaaatttaagcttttcctttaatgggtgctaaataaaaggtttgggtattttaggagtcaaaatctttctttggtaaacgcctttattggaatacacctccatttaaaatttcttaacaacacattggtaaggggggaatatttttgatttatgctaaa

SEQ ID NO: 7516 - DNA, 2539 bp, Heterodera glycines
acttattattttaagtgaccgaaaatgattaaaccaataaatcctaggtccagtccaacctggaaattcagacccatgttttttcaaaatgttgctatctacttcccattaaaaaaagaaaaatgcaaaaacgaaaattaatttaatcaatgaatttcattattggctacatttcatcacacaacaatgccgaatcctccgatcagactgattgatcatgctttgccctccgtggccaccgccggcacggcgacggcggagtacgacttgacgaaggcgacgacgtcggcactgttgttcagattcagctccttcttcgtgttgtccgacattttggctgtcagctcttccgtccgcttcaccttctcgtccaaagtcgtctttttgtcttcaattatcaaagtcaactgaaaagggcaaaaaaataaaataaattgacatttaaaatcaaattactgacaattgctttttcaataaataatttcattgctttttcacctctgcgctggcctttttgctgtcctcagaaagtgttgccgttttcgttttcacttcgctttccaattccgcgtcgtttttcgcttttgcctccaaaattttgttgacagccgtcttaattggggtaattaataaataattaattgtttcgatgcttttgttttgtttgccttcagctgttcgttccctcctttttctgccacttctttcaatgctttttcctgctcttccggcgttttctctgccgttgcttcggccgcgtttttcaatgcttttgcctaatgagtgattattattttaagtaaacatttattataattaattgcttgactttttgtataattaattgacctgtttaacgcttaagtcatcgaccgctttgttcacattatcggcagcttcagttaagacggccggggcactgggctttgcttcttcctttttggcctcttccgttttcggctcctcctttttggcttcatctttcttagcttcttccgttttgccctctcctttctttgtttcttcctttttcggctcctccttcgtcgcttcttcctttttcgcttcggcttcttcctttttcggctcctcttttttgccttcgtccgctttggtttcggttgccgcagcttcttccggaattggctttgcttgtgtcagtgtgccaatggaaacggtgcaaatgaccagcagaaagatgcaaagcaattgggaattcattttctgacctaaaaatggaactgaaaattaactcaatgatttaaaaataattaaattaaacaattaattagaaaataattagtaaatgatgtgcaaaggaactgattctcgcacattttatatgttttaatggaccattgggcgggacgaaatttggggagggggggggggggggggctcggccaattaattgtcgaagttttggaggtcaatcggacggtcgggggacggacggaccagtttttgagcagttttcacgtcgcatcgcacggtttagcaaaaatatcattttttggcttaattagcgaatggaaacgaagtaaaaaaaaagggcacaaaatttgtgcagtaaagaaaatgaatttttgtaatgaatgacaaagaaagaaagaggcaatcatttaattgacactaattagaaaatggaaaaataattaattaattaattataaatttaattaatgaaaacagttaagaagaaaaagcaaattgggaaactgcagcagaatccgcccaattcaatgaatcattcaaacacagacaaacccttggaaaaatttagttcctccgaatttatgaaaatggcaaaaaaaaggaaaattaagaaattcaattcaaataaaacgaaatttgccaggtatgtactgtatgtgaaatgcaatggtaaagaaaaaccaggacttatgagaaaattgatgaaaaagccgcgattaaagcctcgagaaagtgaagaaaagggaaggattcttgagaaaaataaacaaaaacaaaattcatttaattaatttgaagaatcgtaatacaggctctccatttctatgaattaaatttttagccctgctggccagtcagcggactgaaaactctacgactttttcttttgttaaattcggactcaaaaataggcaattaccgtccgaaataaaacaaaataaaaaatcgaaaccgaaattcgtcatgaaaaactaaagtttgatgaagaaaatgaatgttttcgtgcttaaaaaagtaaaacgttgcaaaccgaaaaggaaaagacggatcagaaaggttccattgcttttgatccaaatgtttttttaaatttcgtttaaaaaccaatgttttcggggccgaattctctcagcgcattgtcagctgactggtcgaaaaactccaaaaaatataataaaaaaaggattggtaggaaccaaataaattgaaataattacaccggggacaaaactattttctcttacacatgttaaattagggttacacgggtccgggtatttgggctaggcaaaagccgcgtccgggtccaagttttcaaccggaa

SEQ ID NO: 7517 - DNA, 3320 bp, Heterodera glycines
  misc_feature (99)..(99): n is a, c, g, or t
tttctcatcattgccttcgcgaaggattcaaaacgcaaagcgttaccaactgagccatgaaaaggcagaaggaaaaataataaaaagaaagtaaatgtntattcttaatgttcaagtcccagaattcctgcgaattcgcacggggacagtttttttcccatccaattttagcgaatttttatactctttttgataagccgattcaaatagagagtccagtccatttgatccaacaaatataaaactgaatgaaaagaaagaatccgtggaaaatgtcagatcggtcaaaatttattttgcaaaacaaactgatggaaaaaaagtgtggacattattcacaaatctcaggcaaggattttcgttaaatgtcatattttggtgggggtcgaaaaagtcgggccgcaaatttccgtaattggcccttaagaaatgggccgcaaaacaaggcgcaaatgttgggccgaaaaagacggactgtaaatgtcgtttttggctgagtgtcgtaaaagtcgggacaggaccacagcaactaaatggatattaatttatttctctgtttttccttcccttccaattcttaccagtgaattttgtacgataagacccggacctaccgggtcggataccgaacatttggattcactgaaattcggatccgggtaccgggtcagtgtcttggaaaagccgcgtgtgtctgtactcggtggggtacccggacccgagaaagtttaattgaaaattctttattttataaaattaatagaatattttttaataatctattttcggccttcattttttactcgtacccaatacaaaaagtgcgcacttgaccttcgctgtcgtcaccgatggaatctctcgcttctccccattttttttattgtaataaattaaatccgatttttaaaattaattaccccaccgatttgtttgacatttttactattttgattgtttattgctgttctgtgctctgctcctcctccgcccgttttgtgtgtgtgtgattagatcaaagtcagaaaatcataattttgcgcggcgcccaccgcgcaatgccacccaccgctacccatccctttgattacccatccctctccggttttggtttgattacccatccctcttctccccgttttggtaattctcctcgattccatccgactcacttctttgtcttcgtctttgtccgcgtcgttgtcgtcgtcgttgttgttggtctccactccttccttctcctccgttgctgctgctgctgtgacactacacttccttgacctggataggtttcggtgggccgcgcgtccaccattatgaatttgccgtggggtgtgcctcattaattaattgactctcttttcatggtcactcttcgtttcgccttcggcgatgccacaccgtcgggcgggggaggcaatgaatgatttgggagtggcacggacagtcaccggcggcgcacgtgtggcgcgaccagcagcagaccaccaaacgatgcgccgggcgttggtcgtcgtcccccgcggcgtgggcgaccggcggcagcaaaaggcaaatcgaaagggtggggcgacccgtcgccgcccggtgggcacgcctttcggcgcgttgccttgctataaaagcggggcattcattaagcgaagccacacacagtgcacaccaccaaaacagccaaaacaacaaccgtgggtggttcaacagcagcagaggaaacccaatgaaagcgaaaacaaaaacgctctctctctcattaggaccaattagcaaaatttaattagagagggaaaggattttctgattaagcattttcaatttctaaatcccgctttgaaattataattttgctttttgttccttcagaaaatgctctttttcccaattgccactgttttgctcggtgtcttcgttggctcccttcaggggaaacccaccggtacagcaaaaagcgatccaatcaaaactaattatctgcgaatttcagaacaaaatgccgaaattaagccggcagcacccctcggtaaaaaagaaaaataaataaatatttttacatttttcatttttaaatttcctacagaggcaactcgcaacgaaatcaaagacacgccgcaacgcacagagaacaaagaaatttcgcgcagcgaaatcaacgaaatcaaagagattccgcgcaacgaattcaaaacggcgccaatcactggtgacagttttgaatatttaaaaaattaaataaaaattaattgttttaagagagccgtgaaagaccgttcattaaaagcgaaatcatccgcgacatcagctccgcaatgaacttcttgaacgagcaaatccgggagtactcggaacgaaccaaggacagagtgagtggagaggccaaggggaagcgaaacggaactcaaaatggacaattagcaggaggaattcaagggcatcattgaggccagaaacaaactcgagacggccatcaaaccattgcacggaggtgagcaaacaaattagggggcagcactaattgggctacatttggacaaattttcagtgatggagtccgacatggcttcttcgagcctggagacgtcgatgaccaactcggccaacatcgcccgacaagccctggaggagttgcccgtgaaacaggcatggcatttttgaagtaattagcactaattaaccctatttaatttcacaggtccgacaaatggaacaaattgcggaggagggaaagagcaaaacggtggaggagcaggagagggcactgcgcgagtacgcggagaagaacagcgaaagtgtgaaggtcggcggagcaacccccattcaacacaacaactcttcctctaaacggtcccataaaatttcagaaggctgttgaccaagtgttcgtcgccaaggaccgggcggacatcgctttggagacgtacttgaggagccacgctgacaccttctcccaggaggcgcgaaaggccaacgaccaggcaaaaagccaaattcaaaaggaaaagcatagctaaaatgccaaaacatcatttgcagatgctgttcgtgatgaaggacaagaagctcaactcggaggacaaagtgcgcaaattggaggagtgggccaacactttgccggagaatgtgcgcggagagctgcgcgtgcgcgacttgcgcgagctgaagcagctggtgcacctgtacaacggactgacgcccgtcctgcaccagggcatccaaggcggcatctgaacggaggaagagaaagggaggaaagggggcgatcggactgatcggacggaccgaaagtgatcggtgatctgttgtcattgtgaacgaaaatgccg

SEQ ID NO: 7518 - DNA, 2362 bp, Heterodera glycines
  misc_feature (35)..(35): n is a, c, g, or t
tgaaaaatgtgagtataatttccgcggatgatacnatattaatggaaatggtagtccgatctgatggcatcccatcccatttcaaagattgttttcctctttcccacctttggccataaaattcatcaatttgcgtgccaaacttgaaaaaatgccaccacttccttctgctgaagacaaaaatatttaatatttaaaaaaattataaaatgataatcaacttgcctttcggtggcatttgttgtggttgtccaaatgcgttttgcccaatgttcggttgttgttgttgttgttgttgtgccatcatttgctgatcattcaaattgaagccgttcgggccaaattggccttgaccatttggcggttgattaaacgcattttgttgcggcattgcttaaagcaaaataaataaattaaaaaattttaaaaatatacgcgcagaatttgcaccgccaccgcccgtgaatttatttttcaatccttcccaaaaattggtccaatcggcgccaacacttgcaaagaataaagttggcagaagaaaataaattgaaaaagatttaaaattcattttgatctattaattaataaaaaattaattttttgaataaaagttaattacatttggttacgaaataaaatggaaaattttaggattaaaactgacaaaaatgattaacacaatttaattattggcctaaatgaaagccgaaacgaataaatggaagcgcagttgtgtcaacaaatcgaaaaaattaaacaataatgactgacaaattgaaaaatttaaactggttaaacttaattaatttaaaaataaaaattatatttcttattgctagtcagatatgattttgtcggagagattaataattactacaaaaataacataaaaaagaaaaatgaaatatataaaaaaacgctttagtgaaacttttgaactcacttaagtcctccactcaaaagaaaaggtaattttaattgttgcaaagcacgaaaaaccaaaccaaggccaagctagtttaaaatgcacagcaattaacaaagttaaaaaacaaatgattcacaccaattaatttatatgcctttctcagtaaatcaattcattttttgcctctttcagaattacgaaaattatcaatatttaatcaaaactagaaaccgatacacttcccaatcgacttctcacaaattaatagaagcaattattgatattatcattttacaatttattttaggatatttccaaattttcaatgagatgattctttaaaaaatactaaaatagaattatcatttgccaaaaattatttattcatctgttttgtcatcattttctctattttcaattaatttgcaaattttttgattatttatttagcatttggttgcctaatatttaagcaaattggctacagtttatgatgacatttgtttccaaaatgttttcccatttctccacagtagtccttgtactcttttcatacggtagtgtcctcggtttcttcggtggcggtggcttagggatgggcggcggaggtaaaaaggcgaaaaagaatttggaaattaaattaaaaaaccattaaaacataaaacatttgcaattttaattagagcctggaaatttcaaatttgcggatcctgttgcaggattggaattcaaaaatttttgcaggaccggatccggccggatcctgcaaatcctgcattttaaatttgcaggatcccgcgcaggattgcggattcttagaaattttgaaaaaatttcaatgaaatttcaaaaaaaaatacctgacaagaaattttaggggctggcgggatgcattaaaagggcgactaagatttttcgaatgggccagacggtaaaaagagatcggaaatcaaatctgttaatggtcaataatttgactattttttgcttttcaaaaatgctttttttcggcgcaattgaccaaaaaatgaccaaatgtcacaccttttgactcaattctacaggattaatgtcgatccagtggtgccgataggcgccgccgggaaattttttttgcaaattctaggtgaaatttgagatgaaaattgaatttattttgattgattttattataaatttattcaaaaattttggcattctgttctttaaaatttcaaaaaatcaatgaaatcctgccggatcccgcacaaaaatcaaatttgcggatcctgttgcaggattggaattcaaaattttttgccggaccggatccggccggattaatcctgcaaatcctgcaatcctgcaaatcctgcattttccaaaaaaggcaggattgcggactgggatcctgcaaaatcctgcgcaaaagaccggtcctgctccggggctcta

SEQ ID NO: 7519 - DNA, 4379 bp, Heterodera glycines
tggccaatttgaaacccattaaaacaatgccaacaatcaccgcctccactcacttcccggcccggacgaacacgtcccgcttgtgcagtgcgtgtgccctccgtgccgggcaacgaatcggcagcagcacaccgtcgggcaggtaaacgtcgtggaacacgggacgaacgaccgtggagtggtcggaagggacggcattttttgtttctccgcctccgatcgcggtggtgttctgaagaatcagcagttcgccctccggtgaggtctcccaaattcggtgcaactgacgatgctgagcatcatcgatgttattgtaattgcattggtagttaagagcggtggttgagggaggcggaagggaagttgggtgaatttcggaattggacgaagaagggccgggctcactcgggtgcattgactggtgttataatacacaaacggcaaagaatacaaattgagttcaacttcacatgacataaaataatcaaagacaatttttcaatattgtttttggccaataaaaagcaattaattttaaatttggcacttttttcgtttaattgaccaaatggctttttttaaaaaaaatcaaaggcggcgtttctttgttttgtgcccagcgattcttttgcaattcaaaaggttcccttaatccactaaataagaaaagtgcctgaaatttgatgtattaattatgatatttatttagaaatattatgaaacgacacgaaaaaataacatacatagacacaacagatggtcaaataacattacaatattactttttggtcacaatttctcgtcccatttatttctctcatccgcgcttctcagtgccctcgcgataatccggcaatccaaattgcttcgggcaaaaattgtcaagcgaatcgagcaaggcggcaaaatttggacgcgaacggagttctttctcgggccaatcattcggcagaaactcacgctgaggcaccatcaccacctgaacaaggaaacaaatttgctgatgtaccgtattgtaacagttttaaactcgaaccgtgcatcccgcacccaacgcgctttccactccgttaattgagtcctcaaacaccagcacattcttcggcgaagtcggtttggcagcaaaacgtccaatggtcacttcgtatgcgtccggattcggtttgccaatgcgtacctctgaaacagttacaataaaacaaattgggtttgagcgttcattcgcctggatcactcccgcacagcacacgaagcggaatcttcttaagccattcgtcaaatttaagcattttgcttgcaaactcctcgttgtccgatcccgtacagatggccattggaatgttgtgggcgtacaaatggtcgatcaatttggtggcaccaggcaattcctaacaattgcatttacacttcattaaatgaaataaaaagaagcgaagcgtagcaaagcaaaaattttaaaaaagcgaaagcaaggcacaccaattgcacctccgtaagagcgcgcatgatttgaaggacgtgtttgtcgtactccgcaatgtattggtccatcgtaacgcgatccgctatccccgcatccttcagcaaaaccgtgaccgcctccgtctttttgcgtcccatcattttgagcttcctgtcgttgttttgctttattataacgtattaaacaaacaaaactcccacatttctcgagtgaattttgctccaaatttctccaacgtccgctcgttggccgttgtataatgacgttcagtgtcgatcagaacaccatcaaggtcgaagaccacgtgcgtaatagtagaagccatttattcggagcagaacttaatattcaaaggaaaaaaggcgctagttaaaggttgagctatttgaaattataatgatcagttttttaaatccttttgaatggcaaatttttaaattttcactaattatttacttttaaatagattcatttcattgtttcgattccctttgacgtattgtcctctttttcaaatttatttgttttgatcattttgattttttttggacaaatctgtttttctctccttccctcccatctcaccttctatctccctcccccctacgttttgtatgtttgtcatttccttttgccccaccatatacctatctcttcacattatcgtaaattgtggcggacgaccgtattcaaacgtctctttctttccatcgtttaaaaaaaatgtaaaagcatttagttgtatagtatgtatttgagcatatgagtggaatgaaagagagaggaaaaagggcatgggggagagcaagactttttttgttgatttttttatgaaattatcacagtactctccttttcgtcgacaaaatgcatacgatcgttttctgatttttgatttcgctcaaaatccaaattaaagttaaaattttggcgttctttctttaaaaaaataatattgtcgaacagacccaaattgagttgctttctgcaatagagaaagccctacattttgcaatttagttcaatattgcgagagttacaatttgactgccctattcaaaaataacaattttacttaaaatctgttaacaaatgtgactcgaatttgaaattccaggcgacgcctataaattaaataattctttgttttgtttcgttcttcagtttctatgtccaaacaaattcgaacttgttgggtgtggcgtaagaacaaccgttggtggcgttatttgccgcgacgtaacgactcccacaatatcatcgacatggacgagctgggcgaacaatgtgccaccttttccgacccaatgcccgccgatccgcccaaactttgggtggcgtggctttacaccgatttttacgggtcgggacgaaagatcaggtgaacggacacggaaaaattcatttaattatttagcttttgggttaatacttaagatggtgcgggttcccttttgaaaaaatccagttttgtgataaaacattcgttcccttttttgaaaaatatccagttttttttcgtgataagacattctaagttttcggggttgaataaccgaatccagcatctatttcgtatcgaaccctgattattcggataaaaaattgaattcaagtttttcgagtttcaatttaaatcatatttgactacacggaaacgaactgaaattcttcaaaaagataatttaaactttcaaaatagttgaattttcatgttttgttcgagtccgggtccggtgttcaatataggccgaaatagaacagatgtcgggttcggattatctgacccagaaaactcttattatgtttttatcactaaaaatcaaaaaagggatccccaccatctaaagttttaccattttttgttttagggaccaggtgacaaagcttttcggcaaagacgcgaaaccgggcgaaatgcaagtgttcaaaaacacactgtcgaccaacaaacagttatggaagataaagcatctgctcgaaatacggccggtaacatttccaaacggagagccggggcaggaagatgcgacacatttggaggtgaaaagcaaattggaaagcgaaattggcaaatgtcttttaagaaattttagcaacaaataatggcaactgtaaacaatgtaaatgtttagataatggcagatggacgctgtgtaatcagccggcaaagtttgcctaatgtcgacgactttcaactgattgactacagcaagcagttcaggttgaattacgacaactgattcgtacggcttttacgccaacccacaaatttagcccgcgttatttggcttctcgactgatgtcaaaggacgtgaccaagcaggacgtgtacgaggacaccgtctacaacccagaaaatatcagcattggatgaaagaagggcggcataattatgcaaaatttaagatgttctttttgatgtcatttgcacttcatttcggatttgtttaaaaattacactttgttgcaaataaacattttatatgcattagaccaaacaaatatctttcaaaatgtattaaactcaaaatattcaaacaatacaacaaaaaatggtgtttccgccgtatcactttccaatctgcacttttgtattcgttgccatgaccggtgctccttgtgcttccatatttagtaacttaaaaatttgttttaaatgacctaacattcgtcccacacttcgctcaacctgatgttcttgaaaacgcatggacaggcgttggccggccttaatgccataattcggtaatagtttagatggtcccccccccttttttggcagaaaattttttgttttaaacatccctgaaaacatgtttctaagggtttttggggttgctgatcacgaatatggcattcatttaggccaatttcgaaccccggacccgaattc

SEQ ID NO: 7520 - DNA, 2071 bp, Heterodera glycines
aaattcattttttgttcgaatctgtgcagaatgattgttttttggtgttgtaatgatccgtaattagtctttgctagttttaatctgttttagatcataaaagtgaattttgaaaaattcgactttttgttcgaattcgggtccggggtccgaaattggcttaaatgaatgcaatatttgtgattagcaacccaaaaccattagaaacacgttttcacgcttttaaaggaaaaaattttctgccaaaaggggggggggaccatctaaactattacccataattcattcgttatttcccttgggaaattcaccttcaaaaacttgtccatgcaattttttgagcaccgttcctccttctcgcttatgtctctgctggtgaaatcgcggatgcacgcgtcgaaacactgctcggtgactgcgttatattggaataaaaagtcgcggaactgaacggagtgatgtccaatttaaaaatgtgaaaaactaaacaaaccgttcgaaggtcagtgtctgttgcgccttgctgctgtgtcatcgtcaaaagtgcactttttatataattaataatttaagaaaaggtaaataataaggtgatttcgtttaaacattttgttggacaaatattgaaaaacaaaaacaatttatgcgagatcaatataacattcaacaaatggctgtccacaacaatttcttatttcttcagtttgtccggtctaaatttattcaatttgaaaaaacactaaaataaatagcatacttcgccaattgtcgggcgcatccggatcatcatgatcatcatcgtcatccgcgctacgcgctgaattgtgttaggcgatttagtttaaaaggcataaacttttaccttgccatggaataacctccggctcttcctcggcctccggctctgccggaggcagccgattagctgccatccgctcctggcggcccctccgcttctcctcttccttccgccggtgctcctccaaaccttccccctcttcgtcggtcgccaaattcgatctggcctcctaaagatattaggggtcaaattttaaggaaacaaatgcgaacaaaccagtattatcaaaacgataacagcagagacaaggagtacaactagaattgctgaaaatgatcaaatggaaattacactaggtcggtccctcccatgcctacccttcttccacttcggttcgaagacgttcaaaccatcagactttgaagaaaaaaagcgatgttgaacctatcaaaaaaggaatcatcaaaaatgaggcgcaaattttactcggccctttggctttaccaaatgatttgcaaaaccggctgaaaaattagaggggccaactccgcaaacagtcgaatgcaaaattgagttgagacgcccaacccccaatggcaaaaagcgatgattggtggtgttgcaaatgaagcgaaaatggtcggatgagcgaacggcggaagacggaaaagaaatggacggacggcgctggcgataacgacaatagtcgacggtcaactgaagaaagtgtaacccatcaaatgatcgaaggaaaaacatacactcaaagtgcgacgatggatcgccagtccacaccattgcaatttgtcatagcggcgaatgtgaaacattattcttagaaaaaaaagttgagggggaaatgtgaacgaaacacaaatacaaaatattcataaaagcaaaaactgtataatagtgaaactaaatgcaaaaaagcgtttattcagttcttctctcttagagggaaatagcaacaaataaatttgcaaaacaaaatatcaatcgaaattttcctgtccgtcattttgcgttttcgtccccccctctccgccggcgtatttcttctgttgattgtctcgcggctgttctctctgctggtcgctcgctgtggcggtgttggacaaaaaggccaaaattcccttcgtacaacgatttgcgtaatggcctttttcgccacatttataacaggtgatatccgcctaaattaaaggcagtgagacgaatgtttctacccaaagtggaaatttaaattaccacattccgtcgagattcatg

SEQ ID NO: 7521 - DNA, 6144 bp, Heterodera glycines
tgatgtgttaaattgaatattttgacctctctctgctctattttatttctataaattgtgttattttctcccttacctctgacctataattatgttttcctttctttttgttgttttctctaattatgttgttatttttaatcgatatttcctttgctaaatttccccgcatgtctccatcaattcattcttctttttcatggtacattttacttcggactgttctctctaaatatttggtgtgcatttaattattcgtcaatttcttcggattgaatttaaaataaacgtaattgaactgtccctgaccgaagtgcctgtcctaattaataaagcattggcccctttccccgcctgtgttaattaattaattggtctacagtccgttcgcttgtcttagcggagaactcgcgatcgccgtcaatcccaaaaagggatgatgaattatcaaatgaatgccaaatggcatcaaaataaacaaaaaccccgtaaaaagccattgccgtccaattgtgcgctgagaagaaaaaagtgtccgtttgtccgtctccgccggcctttcctttgtacgggtccacgagccgatattccaactcgaactgttgccgatcaccgccgtcgaaggcggggcgccatccgaccataagccaagtggtgccggactgaataagcctggcctgaagcggcgtttgaggacgaccgaaaaaggggaaaacaaataatggcatggattgatcaaaggcccttccgtttgtcaattttggcactttacttggtgcctgcaatcgaatgtccaccgccgccttcgccccgactccgttcctcgcctcacaagtgaacacgccaaagtgctgttcggagacctctctcagctccaaaaccgcctcaaactcgtctacggcatctaacggagagggaaaagtgaaggacagcccccctcccccctcccgcgtcactgacctttgacccgcgaaatgtgccgtttgtaatcgccccctccaaattccgtgccgatttctgttccgtctcggctccacgtaacttttggttcaggccgtgccgaaatccgacacacaatttgagccttaattcgaattaatttattgccatatgcaaattatgttcgaattttcctaccgatgcgccaatctctgccgctgtcagtgccaatccgtccacaaatcgttcattcaatgcaatcggctgatggatgacactgagcagcgattgactgctgacgggcggagaagtggccgaattgtgggccaagcacgagtaattgcccttgtcagcccaactgatcgaatgcgcaaatcggagaatggacagaatggaacggacgcaactctcatcggaaggacaactgaaaaagggaaaggcaacgactaatcaagtgagttaatgacactaattaagggaaaagagaaagggaagcggtaactaaaagggacaattaagaagaagacaatgactaaatgagggaacaaacaatgttaattaaaggaaataagcaatgaatgactaatgaattaattgggtataatagtgaatattaattactccggggatgcgtcccccatgcgttccgtcactgtccaatggacaaacaattcgatgggcaattgcactccgtcccgcagccaacgaatggacggccgaggaaagcctcgcgcttcacattcgatggtcacatcgttggccccattgttcagtattttgcttggcattggcattcgcgaaatccgcgcgggttcgacaaccttttcaatttaattttccgaccgttttgttttcgtttttccattaccgtaatccgaacggtcgcttcttcgccttggccgagttcgttgtgtgccacacatcggaagatgccgttgtgtgccaactgcgcgtccggcagtctcagctgcgctttgttccattcggtggctttccgttcgtacgcccctttcgttggcggccccgcccagcggaaatgcgccgacggactgcccgcgtcgccgtcagtgccgcagctgagcgtgatcgtctcgcccacgttaagcgttgtctgtttggcactgattgttgccgatccaggccgacgacggacatcgacgagcactcgggcggaaccggtacggatgacaacggccgaattgggggaagcgacggacgatgatggcgatttggacagagaagcggagacggaggacaaggcaagcgtattccatgcggtgcaggtgaaattgccggaatgtgcgctggaatgggatggaaaaacaaaatgagaaaataccaatcaaaaaaagaccaaccgattgaccgcttcgatcaccaaccgcgacccgttacgttggaagcccccaggtccgctccatgcgatagtgtccgcctttgggttggcgtccgcctcgcagtcgaccaccagccgatcgccctccgccgggctcaccaccgaaccgcccgatgcgcccccggcgactgttcgaatgcgtacggttggcccgtaaagaacattgagacggatgcgatcagaagccgagtctaacgaattgacggcagtgcaacggaattcgcccgcgtgtgcgcgtcgcacgtgtacgcgccactcgcggtcggcgtgcgtttcgcccgacggcaaatgcgtccaggcgaaatttgttgcgggtggattcgcatcagcggtgcactttagctcggccagctcgccctcctcgatgttcaattcgggcactgttgggacaaccttcacccgtggcgcgtacaaaacctgttcaacaaatgccgtactttctgttcgatccttttgtgttctgtcactcttttcttatttcgtctgtttctgtatttcgtttgtttcattgtcttctctcttcctggttacactattttgtttccctttcactctctcgctctcttctctcgccctttctcacgttaagtctgttcgtctccgcattgatcacttcgccctctcgcagtgctttgttccaagtttggcatgttaaataggcgccgttgtcgctgcgtgtcaaatgccattgtaacgtgcttatcgcgcgtggctttgttccgcttccaccgccaccttcgtgccgttcgtggaaccacgcgtccggcacccgcgtgcggttgtcgaaaagccattggaagcgcggcaaaggatttccgtcctgcgactcacagcgaacagtgacgaattcgccctcgcgcaccgcttccgtcggttgggcagtgatttggggcggcactaaagcagaaaaacattcgctgtttttaaatataaggcttttttgttattcgagctttggatcggatgaaaacccttcaacgaaaaaataattcttcgacaaacaatggcacttctttctgtgccattccctcccttctcatccaattcagtccgtcgcaattttttcctttttggcggcatattttgtggcaatttgatctgttcggcaaataatgacaattgtcggacaaaaatgggaatgagagagagagagagaaagggaaattagagatcgctaaaaatgcaatgaaatttaaaaattctaatgaaaaattacttataattccatgttcaaatgctttctcactttgattgtctctgcacaatttcctcccctaatacttaatttataattgtttaatgtttcctcgttcctctcacattttacaatttaccactttttcagattgttctttcaccattggcgaagtgccactaatccatctgtgccaaattaagggattaacgcattcaccggaggataaattcgccattttcactattggggggattttgatttggattatatacggaaaaaacaaattccaagtaaatccctctcattttttgtttctttttgggtattgaatttcaacattttcgtttatgtaaatttttcgttcctccgtaatttgcaaaaagaaatgcgatcttttgataatttattggatattatttttttgtctttgcgtttttccaattacaataagtctaaaagtggaaatgccatcgtcactaatctgataaaaatgccctccccccaaatccccccaaatcccatcatccatcattgttattgttcccttccacttttccccatttataatttacgtttttctccgattttatctacgccttgtttttttccaaattcattccttcgctctttcgttatgttttccctttgctcactgtccaatttcgtccccgggaggcaattatccgcaaaagaatcagtccatttgggtaactttgcccgggggaacctaaattttgattccaaggaaaatttttttgaaattccaatgttttattagctcgggatcacccccttttttgaagaaagtttttttaatgtcataaaaacatgcttccaagggttttcggtatccatttcgactaaattcgaaccacgaacccgtttcgaacaaaaatattttttaaattctcactttggttcctaaattgaccaaaataagccaaatttagtcaggaatcattgcaacaacagaactaaggtcaataagcacagttatgaatagggatgatatttatagtttcactatttttttcctgagctccccgtagcctgaaatgcagaaaacgacccccgcgcgaaaacgtcagcacgaaaacgacggcgcgaaaacggcggcgcgaaaacgaccccgaccgctttttttgtttttatgtcgaaacataatgccaaatatgcgtataatttgattttaaaaaatctgaatttccatgccctggctttattgatgtcggatgtcacttgatttttgcacacggcggcccaattttgggctccaagtacaattatgctggatttttcgtcttagtggtctgtgagttagtcaccaaaaagtgggtctccggttcaaatcttctttgtttgtgtataaatttcatttttaaagcaaataaataaaaaaaataataaaaacagaacgccaaaagaacaaatacaaacaataaaaggtaaacattttattttactcttgattttatgaatttttttagcttataactttttcaataatagaccaaataaaaccattttatgctcattttgaagggaaaattctgaagaatatttcttaattagtcaaaagttaaaaaaaattgtttattggcaaataaatgattcatgtgttattttatatgtcagagacatggaaatagtatgcccaaatgagagaaaaagaaaaaactttgtcctgggtcaaaaattttttcctagggtcagatttccttggaattttgcataggccaatattttgacctcctctagcgattccaagtttattttgtgaaagttaagtttttaactcgagatcggctcttctattttatcaatggaaaattccacaaaaattttaaattttgcaaagttttggcgttctgattactaaataaaaatccagaataattgtacttggagcccaaaattgggccgctgtgttgcataatacaaaatccaatccccagaagctaactcactttcattttaagataacatttactaattaaggattaacatgaagaaaaatgctaaactcattaaaaacaacaactccgttcgagttgctgtgaggtttgtacaaaagacatgtccataatttttttttaaattttaaaaattaggatcagaccgcaaagtggtaaagaaaaagaagagccaatttacctgagcgtaattcctggcgaaccacaacttacaattgggcgcgataaatcttttgcatacggttctaagcttaaaagttttatttgtaaaagttggctaatttttgagatttcgtcttcgaccaactgactccgcaaaagaccgtttacgacaaatgtgtgagggaactcgttgatggtgccttcgaaggatacaatacctcagtttttgcgtatggacaggtttttgtttaatttgaacaaagttcaaaaatgtttgtcggccgttcacagactggcagcggtaaaacatttaccatgggcactagcttggagggagacccggctaaaagaggcatcataccaaatgcggcacaacaaatcttcgatgaaattgagggaaggcgtgaacaggcccgcagatctggcaaagtgatcccctctttggaggtttccgctcagtttattgaggttcgttg

SEQ ID NO: 7522 - DNA, 1878 bp, Heterodera glycines
  misc_feature (14)..(15): n is a, c, g, or t
  misc_feature (1754)..(1754): n is a, c, g, or t
tctagagtcatttnntggcacaacttagaggcaaaaacaaaaaaacaaaacttattaagtgcccttaattgcgcctccgattcgtccgcccaatgcgcgaagattcggtccaagttcagcaacgccatggatttatctgcaaatggcagaccgtaatttttcaactaaaaaaaccagcataagggaattatatttggaatgtaaaaaaattttatcctgaaaaaaaggttttttttataggcatttttggtattttactttttgcgagttttcgccggaattaaaataataaagatatttttgtacggttgtgacgattagcgccgctgggaaattttgaatttttacgatctaatagatttgtattaatgaattgttgagaaaatttaaaatgagaaaaaaaacgaggatttcgaggtcaaaaaattgaacgaaacattccgaacaaaaaatttcaggtaaatcacacaatatcataagtttagactttcattattaaaatgcttaaatttgcaggcagttttcgacggacaacagttgcgcaactgcaagcaaatcaacaacacgaagatggacaacaaattgcagctgtttctgccaatagccacctgatgctggcgcccgaatttgccgcagtgaaatcggcactaattgtccaaaaggcattccatcgatttgcactaattgtccaaggcaaaccgacgaagtgatttataattaaccaattattgttaaggtttcattgccggactgacttttggccatgcattgttcgcttttttcgtcgccgatttggttttggaccatttttaaatttagtaatttttgggttaaaatatttacaatcatttgtagcattttctgcaaagcaatgtgtggatgactgctcctgtccatggctttttccacttttgtcttgcgattggagttgtcgatgcgctggacaggtgacaaaattgttaataatattttatttttaaaaattgtttaattttattaaaaattcaaataataagcaaattaatttcaaaaattgtaattctctttttgccaccactttaaatctttttattattaatttttttttaatccaatttcatattgttttaggtttaagtttgtgacagttttccaaattttttgctctcttccgtccgttggcattttggcctgcttttttgcttttttggcatccatttcgtctgcacaaattgagcaactgttggcccaacaaacagagaacgaagacccaattctttggtacaataaccaaattaatatatttttttacattttataattaattttcacccctaaagggatgttcaaattttgttcaccgtttggcaactgttaagcgccgtccgttccgtcagcgctctgttcggatggcttacaatggcatttcgcccaacggcaaatgccacgcgcgaaactctctccaaaatgctgccgtcaaattcaatgaaataaatcaaacgttttccgaagtcgttttaaattcatagaataaaatttatttttcatgtttttggacaacaaatatgttcaattgtgtaagcgggcataactcctccataaatactataagaaacatcaggaaaatcagaaagtatgaacaaaaaaaataatgcctttcccccgaaaatttccataaattttatttctcaaaaattcctgttttgaatcaatttttatatttgttaagcaggttcgtgtgccggtggtgttttgggcattccatatcaaattanaaaaaatatagaataaatcaccaaagacagtttgttactttccgacaaagctctcgcccagtcgaatatatttttatatttatttttttttcaaaatagacttcatgatttttcatttttaatt

SEQ ID NO: 7523 - DNA, 1863 bp, Heterodera glycines
taatcatgttcaaatgatcgcattaatcgaattttcgtaaaggtaaattttgttgaagatatattctgacgctataaaaaaggccaatttgtacaaaataaaaaaaatttattcgtatagtttaacgaaagcccaacgttttcttataaaaatgattgtttcaccaataagttaatccaattatagctcatttgagattataaattgcttatttggtatagggaaattgcgaaaactttccttaaaagaaacattatttatttacattctacaaagatttttttataatttttatttatttttaaataataatttatgttttatagtttaattgtttattttttcgaaaatttattcgtttgtttaaaagagattaaaaaataataatcttaaaacattatttcttataatggttaatttattactatttattataaaatttgaaataataaattttttttaggtatgaataaattatattttcccttattatttgttgccacaattttcatttatgccgtcgcattacctcgccttaatctgccgattaataagcacaaaaacaatactgaacatttaacaaaaacaggtattttgatctaaaaacataaaattttatgcttttttaaaattaatttagttcttattttttactttataaaatttatattttaatttggtaaatttaaaattatttattaaaatgttatatttataaactatttaaaaataatgtgttttataaataaattatatgatttttttttaatttaaatattcaaaaatggtaaaacatttcccatttagaatatcatcattctcagcatcaacaatcgtcaacacgttcatcatcaccaatcatcatcatcatcaaatttcccatttttggcacaaggcccaacgccagattatgtgcaggaagccagcgaaaaggcacgcattgaatactggaaaattttcactgatgacaaagggcaaatgccgaagggcgaattgaaagcgatacgattaaaatgggcggaatgccacggcatgagggtaagagaaataaaatgaaaaatttaattattaaacaaaatataatgtttaatgaaaatttggtggggggggggcgggtattaaaaaaactaataaattattgaaataatgacaataatttattttaaaatattttatttggtcggcttaaatttttttgcagaagcagaccgataatactttttttttgatagataggtaccaaataaaaaatttaagaatttgccgaaaatttttatttttagatcttgaagcataactttaaaaaaaactaaataaacatttcaaaattcaacaagaaattagaaacaataaataaatacatttcctgtaaaaattgtgttaaataatgtttcgaaaatttaggatgaatatgaaatgtatgaggaagagcatgagcagaaaacagatggcttttacaaattaatgacagcaaaccttggcggcgacgcgttaaaagcattcaaaaaaatttgggtgattttctttatttatatggttttacaatgtttttaatattagaaaatatttaaattaaattaaaaatttataaaaaataactaaaaggacatcactcacaacgatgaattatcgcgcaatgaggaatgcagaaaagcacaggttgattgatatatgtaacttttttgtcacgataaagtcaaggagaattccatggttgccgaaatggcgcgccgtcggaaaattttttttaaatattacaaaaatttttatgaaaatatttagggatgccaaaatggggaataccttttaaaaatagggctaatgaataatagcaaagaatttttcacttacgaaccaaagaaa

SEQ ID NO: 7524 - DNA, 1333 bp, Heterodera glycines
  misc_feature (40)..(40): n is a, c, g, or t
  misc_feature (1329)..(1329): n is a, c, g, or t
tattttttgctttagcatttaataaattttttaatgaganataaatttaaaaataggaaataaatatttggaataaaagaacgaaatccaaaaattaatataaaataaacgctatgaaattgaaaataggagaaagagcgcttacggattggaaaaaaatagaaaggaattggtgcaaaaatattccaaagtaagcgaatttaaattgtggaaataatctaaaaataaaaattaagaaagatgaagcattttcaaagttgatgaaacaaacagtttagcaagaaaataattgcaaagaaattagatgaaacctatgatgatggaagaaagaaatttgttcgttaaatagttttcgaaaatgccaaaatatgtgcaaacaaatgcatttttatcatattgtgtttttgttcttttaaaaaatccttcaagattttcaaaaaaaaaaaaaattattttcatataaattaaaaatcagattattttttaaatttattaacttgtcgcctttcattccagacactcccgggtgcattccatgccttctcggcttgccaggcacatgtgaaatgcctttctcgacccttgaatacaattcgggcgtcgccattggcatcagccaactctggataacctttttcacccatatttaagtaaaataatatttaggtattacaaaattaaatataatttaaattgtgtttttgatcaatatttacttttttattccaatcaaattttgtcattttttcctttattcttattaacgatttatacacacattaaaatcaaaattttataaaccaattcgcaaatttcgtgtttaaaaaataatggttcatctgttcaaatgcaaataattaaaattgggattttggggggggggggggaggattttttggaaaatttcattgttaatgaatgatgaattaacagatgagcaaatttggtgactgtggccgacctaaataaaattgaattttttatattttcattatttcgtaattttgtgaataatttctcttttatttaacaaaaaataataattattattttagcaatggaaaatatttttttcaattttattttatttaccatttttatcgtttttatgaaagaaaattgttttgcatgcggtaccgatgagtgtccaattgactgcgaagacaaatgtaaaaattaatttttaataattaattaattaattataattttaatatattgtttttaaaaaattagacaaatgcaaagacagaagtgaattatgtaagcagatggagcaccaatgtgagaactttttcttccgaaaatgtatgagatgcgcatgcccanaaaa

SEQ ID NO: 7525 - DNA, 3528 bp, Heterodera glycines
tagcgttttttggcactaatttggaatgtgcgcctttttgtaaattttaattttaaatgaattagacttttttttaaaataagccacgtctacacatttgccaacccaaattttcgttttcattttggcacccaaaaaaaatagtcatgcggcaaaatcgattaccaatcaagtcatctatatatttgatttattgtaaaacattttttgcatttattacttgtataatttatttgcctattaaagaaaagtctataaattgtatattttatttatttcataattttcgatttgaaatcaaattaggcaaattactcaaaaacaatcaaaataacagtttttgtttatacttttgctaaaaaaatcaaccaaaatatttaattcttgatataatttgatagccctaaaagtaaatacaaaaaaagcatatattgagactcaaaaaaaaaaattgaatgtaatacgaaattaaaaattttattaagtgtaaaatgctgtaaaattgacaaaaatttaaacattcaatatttaaattcctatcatttggccaatcttctgtgttaaaatatcggattcccaacttcatggcgccattattagggattcttttttcggcacaaaaaatcgcaaaataggctttaaataggcacaaaaataggtaataaaatttttttataccgatttttatgtagcaaaacacatagaaacttaatttaaaaaaaacttaatcttggttatatttcaattgtaaatgaaattataaatattttaatcttttttgtttcaaaatgaacaatttttaaaccaaaaatctttataaagcaaaaaagagattttatgggaataattttcgtaaaaattttttttcagttcttagaggtgcattttttattgcatttttgttaaggatttttccgaaaattctgaatattaaatattattttcttaaatattaatattgaccaatttaaaattaacaatttgcaattgggaaaaaacataaaaaaaaagaaaaagcttgaaattcctagatttcagatagtttcataagtcattcaaatttacggaaatgtttttagaaataaataaataaataccttaattgaataacttaattaatccattgcataaacaatattgaataaatatgtattatgtatataattttatttgatttcgtcaatgaatcttaaatcatcaatattctttcaccaatagcaatgctaaattctttcatttcatatgaacacataatatatttaatttaattttatataatgaatattcaatattttatttaataaaaaataaaaatttatatattttgaataaaaatatacaattttcaggtatttcttttgcattttcaaaatattaatgagtctttcggagcttttcctaaaggaactgataatggttcagaaaatacatcgtgatctgatcagtggtccaaatccggtgaatttggcacaactttacaacaattttgtagcgacaaattgtgctccattgaccagaacgaatggcaccgaaattggacaaattggacatgaacaacagagacaatcgccaattggcacaaatttggccagctcttcacgacaaactcaaacttggccaaatggtctgcatcggcagcaattccgtactgatgaaaaacgaatgcccaactcatcacaagtaggggaacctgacgaaaaatcccatttggccaaaatgccgtgccaaattaaatttcataaaaaagattggcttagggtcagtcacaaagtagggcgtgtaattatatgaaaatccatattttttttcctaaattgtggaaggccggaaacgcatgaaaacatgtttttatcttggtttgaagcttctaggatagagttctatactaaaattttccatatttcgcgatttatgtccatatttgtatattttgacattatgtccatattttcgcattttttataaaaaattctcattcgaattcttcctttattaaagcggccctttgtcccttaaagccggaaaaattttcaaaaaaaaatttaggattttttgagaatattaataaaaaatatctacaaaattggagatttatgcaaaatagtctaaaatggaatatttacgatttttaattaataaatttaagctttattattatttgattctaaaatgatttttaacactatatatagccattttttaaagttttactttacatttagcgaatttgaagaaatattgagaaatttattgctcaatctagaaaaaaattatgtccatattttatgatatatccataaataccagccctactgataagaaagatttgaaaaatttacacaatttttgaagaaaaaaagattttttgttcttttctctaacattaaatttcaatatttttgtgttttccattattaattttttttaatcatttacaaaaatatgttgtcaacaaatttggttgaataaaaatgttaaatgtttttcaggcttctcatgtgactgcttccggtgttttggcgccaataaattcattaagccatcatcataaaaatccaagtgtacaaacaaatttgcccgcaaataaaaaagatcaaaatgcagaagtgaaggaacaatttgaacaacaaagtacatcaaatgccactcaaatgccttttgaattggcacaaattgtggcaaaaagtgatcagcaggagaaaaatgggacaattttaaacagaaaaacatcaaattcaatgccacaaattgaggcgaagaaagtggaaaatttgaaccaaggcgcgggaaatgatcaggaaatagatgaaatcgatctgttcatcgatattgaaacgattgacccctttgatcagcctgaaccgtcaaaaagattatttgttgatcgaattcaaccaaattggaatgatcgacgtcagtgtttaaatgtgattaattcagaaagtgtcggaacatcatcaagttttgagcggtcaatttacgaaagtgctgacaatgagtcggcatcatcatcatcatttgatcattgtggtcagaatgcgaatggagaaacagaagaatcggcaataatggacaaaatatcaaccaaaattgatcatttggacaatgattgggaggattttgctaattggaagaaaagcgctgggataaaagttgaaatggtcgaaaacaagcaaatagaaaacaaaagttgtaaagaacaaatttggatcaaagaagaagtttcggagtttgatcaaatggtggaaaatgatcagaatgccaaggaaaatgaaaaaataaaaagtgccaacgatgaaaatgaaaacggtgccaaagaaaacaaaaaatttaacagaaacaaaaaaattgttgtacaaaatattataagaaagtgtgaatgggctgaatgtgaattgaaatttgaaaatgacaacaaattgtatgatcacctcaaaacagtttagttttttaaaaaggaaatttaattaaaaaaaaaaaaattaattttaaacaattaaaaattaagacacatattgacgaactaat

SEQ ID NO: 7526 - DNA, 4471 bp, Heterodera glycines
ttacagggtagctgagctcggtgtccaggaacaccttcgttgctgtacagctggtttgagtcgtacacctcccgctggttgatgtgcactttcaggttccggatgaacgttgcgccgggcatttggataaggccgaccgctgcgtttgccggcacatcaaccacaaccccatcatctgccacttttttgagcttgaactctgtgcacacaaacaccttgctaaggtctacatagctggtgattgggtggatctgaaccaacggatttgtctgctactgcatgtaaaaaccacctgccttaaaatgaaagggcctagagcttattgggttcatcgtcaggtactccctgtagctggagttggacacagcgcagctcgttgggggtatggtgaagaagtccagccccgcatttgccacctcagcacttgacgcatccacttttttatacaacattttgctaataataaccgagtgagtcaaatctttttttctttaacagagctttttgggaaacagtttgtccaacaacgtctgagggtttcaaaatgatttcagcttttttcccgcctcctcttctcttccttcttccgcgtcccttttgtagtgatgaagaggccttgtccagcaattttttcgctccctcttttccttccgacaccagcgcgtctttgatgttgccaccctttgacacctcgttgaggaatcgtgcacccgtctcgaggccctctttgccaatctcggcagcaatgtttgctgcatagggtcgtgccgctgtgaccattggacgaaggtagcgccacaggttgcgcagcacagagccaactcctgctcccttctgtcgggggacacccaagaaataaccgtatccccgctgaaacgttggtgccccctcaaagacgctgatcggtccaccgcctccactttgcggataaattttctcgagccgtaaatttgagccgtcaaaaatcacgcgaaccatctctctcagaacgttaacacctttttaaactgaagagtcaaaacaacttggccaaactcaaatggcacctcccttaaataagtgattagaaataattgccctgctgaagagcctaacctcccggtcagagtgcgaatctcaacgtcaagcacatccacctcccttgctatgattttgtgaaacaacggcgcctggaagtccttctctaccacactacccgactttccctcaacggcaatcacttggagcagattggcaaaggtgttgccgacaatcatgctctcaatgacgccactgttcaggtaaatgcacaggtggctcacaccaccacccaaatcaaccgcatattttgcaagctcttcatttctgatctgctgctcttgttcatagcccaacacgtaggccagctgatcagtcagcgtaatgtgcgaaattttcccgttgaaaactttgagctcaaatctgccaatttgctcggtgaagtaaaagcggaaccctttgaccagctcgatcagctcctccttttcctctcgcgttttcaccgcatagttttcatcgtacacctcttgctcaaacagctcacggaactccccaatattctgttggatgtgcgcggatgggttaaactcgggcgcctcccaggggagctctgagtgccggacacggtacttgtgtacagcattcacaaagtggtaatcatccgtttcgtgcagatagtgtacgtctggggttgggtctttgccgtgcaccagcctcatgtacccgcctcgccacggtctgaactctttgagcagctccaactctttttgctttcttatggcctgttgctgtcgtttaagctcttccaactgcttttcctcctcttgctttttcttggtctcgttttccgctctctccgcttccgcctttgccgctctttcctcttctgcctttgttaccattgccactctctccgcttccgcttttgccactctctcttcctctgcctttctttcttttgccactctctcatcctctgcctttctttcctttgctactctctcctcctcagcctttttatccttggtctctttctcgcctttcttttcctttgctattctctgctcttccttcttttcccgtgccagtttttcctcccttgccttcttttcacttgcctctttctcttcctttgccttcttttccttggctgctttctctgcagtcttccttctatcttcttctgtcttacgacgcctctcctcttcttctcgccgtctacgttcattttctcgctgctttctctgctcctcttcccttcgctttctctcttcttgtgctcatttttcatgccgcaacgtttcttgttgagccgctgattgcttggtcaaatatgaaagtgggtttaagggcgcttcgcccgtattgtcttcttcctcctcaacaaacgagacgtcaagaatctcgccctcctcctcatcgtcgtcgtcaatgttcccaaaacttgcatgcaccggtgcggacctttttcgtgtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgattttcgcccacctgtttgggtaaattatgccagacagtccaaccatccacccggccccatcaaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgccatcgtcgtcgtcgtcgtcgtcgttgccggttcatccttctttaggtgcttcatgatcagatcggtgcagtcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccatacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgttgtctccaattgtgatgacgtcatcatcattttgaggggaaaaattttcccgtttcgactcatccatttctttaaatttaaaattattataaaaaacccaaaaaaatgattacttttgttctcaaacaccaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctgtcccttttaatcgacaggccacgcccatccacaaacacatagacgagagtgtagtggttagagaaagatacaaaagggcgccaattcaaacacacagtgaaacccaagccaatttattgattttttacagattatggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattcagtttcggtctaacacacatgcgttcagaggttaaagtccaccagtatttctacataaagcaccggatccgcctactgtaccctcagctgaagtgcattgttgagtaccacaacaagggccactgcaaatactatcccttgggtataaaattttgtcaggaaaaaaatcaataatcattttcagagttgttggccgttgaggagggcggtgagagtgaacccgtcgaaagacctgccgctgaaaccgactacctggactacttgaactttcgcagtgggtggcaatcaacactctactgatcaatgaagcgtgtgcggccaatcggaaaagttgggcgaatt

SEQ ID NO: 7527 - DNA, 2430 bp, Heterodera glycines
  misc_feature (2333)..(2333): n is a, c, g, or t
  misc_feature (2353)..(2353): n is a, c, g, or t
  misc_feature (2389)..(2389): n is a, c, g, or t
  misc_feature (2405)..(2405): n is a, c, g, or t
tatttttctgtataggtttttgctggcaacactatgctaacgtttactgtatgtatttgccgatttaaagtctatgctataaggaatggatgtaccacaaataaacatttttaattttagccattatattcggctatcattaagactaattgtaagccattccattaatggtaaatttgttgactttttaacatcttgcttgaatgaactattttgctacgctgaattttataccgtattcaatggtctgtgactacggtgtattatcattagggatgtacacattaattttattgatttttttatataaaaagattttttaattcgcgttttttataaaagttgagcgtgaaatttcaattgtccttcaaaaaatttcaagtaattcagaaaatgatgacgaagttaaaaaattcaataacattttccatgactagttttatgtcctaaaaattgcatccctaatcatctcatttagcgtcactattgcttgaatttttctttgatatttatgattcaattatctatcatctcccgtacatatcccaaaggattgtttcgcccttttcttctcacaattagtcacacctcattagtgcgcaacgcatcagcggcgtttcgttgcgcttgtacaatgcgctcagcaccgccaccagtgggtccggctcgtccgcctccgtctccccattcccatcatttttgttgctgtttctgctgcaactcgctgccgccaccgcttcgccgattaaaaactcggccatttcgacgtgtccgctttcgcataccgcgtacagcggcgtgcgtccgtccgcgtccgccagtcgctggtccgcctcaaactctgtgaccaatttgcgcaccgcgagcagcctttgcccacgtacggccagcaatagtggggaagtgaattctgaaggtcggcaaatttataaactattataattaacaaaattaaattcaaattcactcgcccgtgtccaacgcgttgattttggctcccttggtgaacagcaactgaatgttgttcaccaggcactgctcgtcgtccgccttgaagttcgggttttggaacagcaaatggagcagagttcgaccacgctcatcaggtgcattcacctgtttagcattttgatttataataaacaaagtttccattttaacttacgagttgaggctccagccgttcttcaagccctaacagtccaatcggagaaaagagggccttttcacgaaggtgggccaacaactttcgtctttccatgtcttcgaccattcgaccgtgcgaatctgacaacaaatgaatgttatgcatgatagctaataatcaaaattaaatcgttttcaaaaagattttaccgatcggagaatgttccgtcgatgatccgccaatgcccgaggaggacgagcgtgagcaatacgtaccagcagcagcagcagcaggaggagcatgatgggggtggacacttgaaaaagggtataaattaaaaaataataaaaattattattacgaatttgagtgaattgtctgctgtttgttatgagagactaatgaatgatattgggcgggcccaaaatgctgctgcttccggtcagttagctgatgaaattgactgaaaatttttaaaattatatattctttattttatcccaagaggaaagttctcaaataattgagagtttaaataattaattaaaataaataataccaaaaataaatgtaattaatttaaattattttattttttcacccatgctcctgctgttgctggttgttgttgttgttgatggcattgtttgcgtgcacattgctcgtcaaactgttcagactgtccgcgtggcgaatcagcggaatggccgacgcggcggtagacgacgcgcaactgtccgtgctgatgctgccggcattgaacatcaaatattgctgttgctgctgcggctgatggaattggtaggcattttgctggtggtggttgtgttgcgtgtacgcgttgaacagatgctgttgtgtgttgccgtcaatcagcggcggctgatagtggccagggccgaccccaccgcacaaagttgccagcgaatttttggcgactaaaaatgggaaaattccattttaaaatatataagaaattaaattttgtaattcaaaattatggatcacttttcgactcttgtgctgggaattccggcttccacgtttttgcgtatcgccgttgtcggctgcgaatgcgaccgcttgcgaacactgtgccagcggcggccgacgcaatcgaaaccatcgcaaaggcgagcaaagcaaaccaaaagaacagtgaagaggcgcgcggcttaagcgcttncgactgcagaattgctatgngaatgtcgagattctgaagcagagaaaacgacactncattagtgctaattangcgtgggtaaatatttaattgattt

SEQ ID NO: 7528 - DNA, 1882 bp, Heterodera glycines
  misc_feature (22)..(22): n is a, c, g, or t
  misc_feature (28)..(28): n is a, c, g, or t
  misc_feature (1816)..(1816): n is a, c, g, or t
  misc_feature (1838)..(1838): n is a, c, g, or t
ttttccatgccttctttggcgnataggncaattgccagagccaacgacgccctgagatgggcactcaatgcgaccaaaaattggcgaaacagtgccgtatcgttgaaaagtgtggacggatggagtgcgaccgccaggaacagctcgccaagcagcaatttgggttggtcatccgccgtggggtcgggctcatgcgcgtcgtggacacagtcgccgccctgtgaattttcaaatttaaaaatcgtttaaatttttataaaattgggccggtcatatgaaaaggttcggcacatcccccgtcccctgggtcaattgtccattctatattagatttatattccaaatgtccacccacgtcccatccgcagttcgcctgattgcactgctcgtcacaatggccgtccgcgtacactttggcacagtcgaccatccacggacacgtcgcctggtgtcgctccaaacagtcaaagccgtcgaacaagcagcgttcgttgttgcaaatcttaattcagaaaatagacggatttaaaaattaatttgctaaataggtataggaaaaataaaacaaattaaaaataagctgagttgtggtgacataaaaccgactcacttcatcacatttgccatccgcaaacacatgtgaacaatagcttgcctgtgggcatttgccaaagggttgtgcctgttttgtggaacaatcgccgccgtcgaattggcacgcaaataaattgcactaaattaaatgaataaataaatttccaaatttgttttttagaattaagaacaatggttattgttttaataataatttttttaatttccagatttttcaacaaatcacctccgaatcacaccgatggtttccgtatttggcctcgcatcccgctttcttgcagttttccttgtccatcacatcggtccgattgaatttgtcaacgggcactgaggtctaaagaaattcaaattttttttatttcataaatatgttgcccagaaaatcacttcacaatggcgcccagtgaacccgcgcgaacattcgcattggaaatggttgactttgtcgtggcattttccgccgttggcacagacacttaaaaaaataaaattaaaaagggcatgcatataaatgttattattatttttgccacattttttcacagtcgttgcgattctcttcacaattcaggccaatccaacccggggcacaatcgcatcggtaccgatcgttaccaatgttcacacatttgcccttgtgtttgcacggagatgggcctgtaatttaataaataatatttttattattttcagattaatttttaattaatgcaattttatttttgttttaatttattggtatcgaaatgttattcaaaattaataaaattatttttctatgtgtactttttgagcacggatttcgctcaatttcgcactgttctccctcaaagccggtcaaacatttgcatccccacgagccatctgatgatgattttaaagtttaaataaattttggattttaattgccaacccttcgtcttcccgcattttccaccatttcggcatccgttttcgcaatgtctttcaattggcatattctcacacaatgtccccgaaaaattctttgggcaaatgcattcgaaatgaactgctaaatttgcaaaaacattaattaaaataaattactaaaaataaaattacccccattctgctgattgtccttcacacttacacattggccaccatttttgcagggatttttatgcaatggacagctttgatttctaaaaatgttttatttaattattattttttattntaaatttatttttacaatgctntctctgcattttcggccgactgatcacaaattgtgcccttccat

SEQ ID NO: 7529 - DNA, 2091 bp, Heterodera glycines
ttgaaacaacgcgtcatctcatccgaacattcgtccacgtcatccgtgcaattttggcccttaaaaattcatttgaaattgcaatttgaaatcataattttctgtttttccaccttccatccctcatcgcataagcatgtgtagcttccgttgaacggattcgtaaaacaatggccatgttcgcacagattttcgtggatattgcaaatgttttgaaattcgcacaaagcacctaattgtttggtagttaattgcttttgtaaatttctggcattttgtaccaattcggtccggcgcacaacggcaatcgtaccgagcaatgccatccacgcatgttgagccggcgtaacacaaattatccacacagtcgtcaatgttgatctcacaaaatttgcctgaaattaaattaaaaaaaacacaataaaatttaaaatcagtgcaaattcaccaacgaatccgccaacgcaaatgcacatgtaggagccgtgccgattcacacaagtgcccccgtttttgcacaaagtggcgccaaaccgttcacattcgttgatgtcctgctcacaaaaatcacctgcaataaaattcaatttctttaaattataattattttttataatataaattttgccctaattaccccccccccccaattttatctgtccccctcccccatgcccttcctcacccaccttcaaagccgtgcatgcatttgcactgcgacgcgtgccaattcctctccaccacaatgccattcccatcgcgcacgtcttcggcccacgcgtgtgcacatttgccgccgttcaaacatgtcatcatgcccatgtcgcactcgtcaacggcacgctcacaatgtttgcctgaatggcaatttaaaaggtgagaatccataatggcaaaatattaattttgaattaaatttttcaattttcaaagtaccctcaaagccgggcaaacattcgcattcccagcgccagtcaaaatgcgcgtccaatgcccaaactgcagttgtggccacaatgttctcgtggcattgggcaccatttaagcagggaaaatggttggccaggcatgggtcagtgggacggtgcggcacttcacagagatagccgacaaagtccgatggacactcgcagtaaaagccgccaatctgttgggtttaaaattataaaaacaaaataatgataatgggtgattacggtgttcacgcatttcccgccattttggcacaatttttcgctcagttggcactcgtcaatgtcctcttggcacctttgtcctttccaccccgtttggcattggcaatgactgccgttctggtcgttcatgcaaaacccattcagacaaacttccgtagagctttggcagaagtttatgtccgcacatattttaccttcaacaaaaattggcacaattattacaatatttattttattgatcaatgcttccaaaatacagtaactcgataaaaaaatggtataatgttttttccagaaaaaacatctaacctcaaatctactctaatattgactcattaatttgcgctttgctataataataataatccgttccatccgcgccgcgccgtcccccccccccccctagagatagcaattttctgaggcccgaaggaaaatttgagagggctaatttatatgtaatattcgaaagtgccaagctaattagcgattcaggcgcgcattggggcctgaattaagccattttccctttgatcggtactaaattggccgaaaaagagatagccattttctgaggcccgaaggaaaatttgagagggctaatttatatggaatattcgaaagtgccaagctaattagcgattcaggcgcacattggggcctgaattaagccattttccctttgatcggtacaaaattgggcgagaaagagatagccattttctgaggcccgaaggaaaatttgagaggggtaatttatatgtaatattcgaaagtgtcaagctaattagcgattcaggcgcacattggggcctgaattaagccattttccctttgatcggtacgaaattggacaaaaaagagatagccattttctgaggcccgaaggaaaatt

SEQ ID NO: 7530 - DNA, 2548 bp, Heterodera glycines
ttgtcggttggagtccaaggggcaagcggtgcctttatccgtgctttttgagccttttggcattcttcacattgacggacaatccgttcaatttccgagtccatgcccggccaatagacgtgttggcgggcgagtgccttcatgcgcacaattccggggtgtgccatgtgcagggacttcagcattcggttgcggagcgattggggaacaacaacgcgattttggtagagcaaacagccctcgatttccaaaatgttttcccttttcggaaaatacggtgcgatgtccgggtcgctgcttttctttggccaattcgatttgatgaatgccaaaattttctttaaaatctcatctttcggtgtcgcctctgcgatttcgtctgcagtgacgggaagttgatccgtcttggtttgcaggagtgtgctgatatagcactcggtttcggtgcagatattggcgatcaaaatatcctcctctggtcggggataatttgcgatgaggcgtgagagaacgtcagcctggccaaatgatgcggtgttgatgtaccgtatctcaaaatcgtaattggccatgattagggcccatctttggagtcggctggcggcataaatggggatgcctttcttggagccgaagatggccagcaatggcttgtggtccgtgagcagtgtgaatttccgtccgaaaagcatccggtggaatttttggactgcgaacacaagcgccagagcttctttctcaatttggctgtagttctgctgcgcgttggtcagaactgttgaggcgtgctcgatgactttttcctttttgtctggaaaaatgtggctgattgtggcgccgatgccatcttttgacgcgtctgccgctacgacgatcggaagtgtggggtcgtagtgggtcagcagaagttctgaaaccataattgccttcgctttctcgaacgcggactgttggtcatctccccaactccaggattcatcctttctgaggagttggtccaatggcgccctgatttctcgcattggtttaacaaaacgtccgtaataattgagcgctcccaaaaatgaacggagggtcgttttgtcgtgcggcgctggcattttctgaattgcctctgagcgcgctgggtcggggcgtatgccatttgaagatacgatgtggccgagaaaaagtaattctttttggaggaatttgcatttttcgagttgaattcgtaggccaaagtccttgatgcgttggaaaagcgtgtgaagcgcattgacgtggtcttccagggtctttgaggcgattaggcaatcatccaaataagagaagacccctggaattcctgcgcagatttggtccatcaagtgctggaaaatggatggtgccgatttaacgccaaatgggagacgttggcactgaaataagccgcggtgggtgtttattgtgcaaagatgtttcgatttttcatccaattccatttggaggtaggcgtctctcaggtcgaggtttgagaaaaatgcggctccatttaaagctgcatatatgacgtcgggtctcggaagaggatggcgattcagttcgatcgaatcgttcaatccggtcgaaaagtcgatgcacacccgggtctttccatttttctttttgacggccaaaatcggggcggcccaatggctgaattctaccggtttgattgcgccaatctgcaagaggcggtccagttcggtgtcgacagcttcgattgcaccatgggggactggtcgtgctttacagaagatgggtcgggcgtccggttttagaatcaggtgcgctttgattgcgcagtggccaagtccgctcttaaaaacttcctcaaaatcgttttgcaacacagcggtgagcgaggattcgtccgtgatgccaatcgccgggtttggtgcctttacgacattggcgttgattgacgcgtttggctttcctttgatgctctttggatacaaaatttctcttgggatgagctcgaattcctcaatccacggaaggccaaacaaatcatgctttaagtcactgctgacgtaagcgatcagtgttttggatggccgatcgaagcaactgacggtgcaatggaattttccttcggttgaaaatgcggtgtcattgcagttgcgggtttcgatgtccgttggagagagtttgggttgacccaatttgatccacgttttgaagctgatgactgttgcttgggctccactgtctccattcatcttgccattgattgtgaccgggatcttccaccatcggccttgggttgtgccaatcaccatacaatgtgacttgaccacgaccgtgtgaaatgatcggttctgagatttgtgtgccgtgttcgacgagcgctgacggcagacaatcgcaatgtggccttgccggttgcatttgttgcaaaatgcgttggcaaatttgcagtccgatcaccagtgatcgttgcttccgcatgatgcgcatggatgcgatggatggcctcggtttgctttgtcgtccgatttttgcttaggcgaaggcgcatgatgtggccatttaggtgccggtt

SEQ ID NO: 7531 - DNA, 3363 bp, Heterodera glycines
  misc_feature (3349)..(3350): n is a, c, g, or t
acggagggtcgttttgtcgtgcggcgctggcattttctgaattgcctctgagcgcgctgggtcggggcgtatgccatttgaagatacgatgtggccgagaaaaagtaattctttttggaggaatttgcatttttcgagttgaattcgtaggccaaagtccttgatgcgttggaaaagcgtgtgaatcgcattgacgtggtcttccagggtctttgaggcgattatgcaatcatccaaataagagaagacccctggaattcctgcgcagatttggtccatcaggtgctgaaaaatggacggtgccgatttaacgccaaatgggagacgttggcactgaaataggccgcggtgggtgttgattgtgcagagcggtttcgatttttcgtccaattccatttggaggtacgcatctctcaggtcgagattcgagaaaaatgctgctccattcaaagctgcataaatgacgtcgggcctcggaagaggatggcgattcaattcgatcgaatcgtttaatccggtcgaaaagtcgatgcacacccgggtctttccatttttctttttgacggccaaaatcggggcggcccaatggctgaattctaccggtttgatggcgccgatctgcaagaggcggtccagttcggtgtcgactgcttcgatagcaccatgggggactggtcgagctttacagaaaatgggtcgggcgtccggtttcagaatcagatgcgccttgattgcgcagtggccaagtccgctcttaaaaacttcctcaaaatcgttttgcaacacagcggtgagcgaggattcgtccgtgatgccaatcgccgggtttggtgcctttacgacattggcgttgattgacgcgttggtctttcctttggtgctctgtggatacaaaatttctttttggatgagctcaaattcctcaatccacggaaggccgaacaaatcatgctttaagtcactgctgacataagcgatcagtgtcttggatggccgatcgaagcaactgacggtgcaatgaaattttccttcggttgaaaatgcggtgtcattgcagttgcgggtctcgatgtccgttggagagagttcgggttggcccaatttgatccacgttttgaagctgatgactgttgcttgggctccactgtctccattcatcttcaaatttatgccattgatcattaccgggatcttccaccatcggccttgggttgtgccaatcaccatgcaatgtgacttggccacgaccgtgtggaaagatcgattttgaaatttgggtgctgtgttggacgagcgctgacggcagacaatcgcaatgtggccttgccggttgcatttgttgcaaaatgcgttggcaaatttgcagtccgatcgccaatgatcggtgctaccgcatgatgcacatgggtgcggtggacggcctctgtttgctttgtcgtccgatttttgcttaggcgaaggcgcatgatgtggcgatttgggtgccgattcatgttgtggccatttgggtcccggttttgccttatgtttgcctttgctggtctctcgccattgctgaggtcgcaattggatggcgctggttgagaccggttgagtaagcagagaaagggcactttctttaacgatttgaatcgccttcaactcctcttccactttttggagagtgatgtccgtgcctgtcttttctgcgtcctccagcattttgagacacttttgcctcaggtcgtggtgctcgtcgttgagtgcaatgaccaggattatgcactttagctgttctttggtcggactcaaattggcgttttcgcaggacgcattgatatgagcgaccagcgatgatatgtcctggctcggttgctgacgaattttgaaacattcgtagcgccggacaaatagtgaacgcgtttcgggatataatcctttcagcttggtgatcgagtccacccaagtgactttgtcgggctgggtcggactgatgctgtcgcggtatttgccgtactcctcgtcgccgagtttgccgagtagtagtctgacttttgtcgactcggggaggtccttaccatcttcctcaatcaaaactccaaaccgtttgaaccactgttcgaaagtgtttccggtttcggcgtcgtaattgaattttgaaatttggccgtcgatggaacttgacaaatttgcatggttcagactcgctgacgcggcgttttgcggtgcttggcccattagctgttggatggcatccgattgcactcgcatggcctcaaggagttgcttaatttggtccgcgctcatgccgaattgtttgccggtgccgaatttgagagtccaaagttgaaaaaccgcttattgcggaaccgcaacctttcttaggtctgttggtttttcggcaaattaactgcaatatatgcagacctcacccccctagggactattggttttgttgatggcgaaaaactgcagtatttgcagacctcacccgtctagggactattggtttttttgttggtgtgcagtccgggtgtcttcttgttggttgaagacgactgctgactgcgccaaatttgttgtgtctttgtccgagtgaataagaccaacaaatatttatttacgaagagacaataataataaataataaaaaatggcgaatggtcggtggagagaataatgaataaaaataataaattgaagataggagaagagtgaacatgggggaagagtccacgcctttaaatagacaatgtgagggggaaggaacggacgagagaatggacaaatgtaaagatcaataatcgataattgaacatgagcaaagtacatttgctttttctccaacaatacttttctcgagttaattgtgctgcagaaaaaattaaaagtgagtagaattagtgcgtgagttaatctccccgttattgcattaagaataattttaattcagccaacgcatttttgtcgtccagaaaatatagattttaattcaattaaagggcttttctgaaaagagtatttctccatcgcgtttggagttaatcgatttgaattgggaaataatttcagaattggaatcgaacaatattgtttaattccgttattccaaatctgatctctatttgtgcattcaaaatattgaactaaattgtatagaaaaattctgagaagaaaagactctatcaaatttcctttgacaaaaaaaagtgaacagatccactttcggttgaaaaatacttttctcgagttaattgtgctgcagaaaaaattaaaactgagtagaattagtgcgtgagttaatctccccgttattgcattaagaataattttaatatacagcacaacaccatttttgtcgtcaagaaannatatagattttaa

SEQ ID NO: 7532 - DNA, 6237 bp, Heterodera glycines
ttcattaatttttttgttaattaccccatcagatatcattaatgatcacagcttagctgagacatatgctaatattttgtcaagagacgaaacaacacggcataatgctgaacatttgttggccattcgaatttgttccgcacgaatttggcaaatttttcagcaaattcatttggtactcaaacagaagcataatgccagattgaaggatgtcaaaatgaaattttggcacaaattcaatcaaattggcgtcgcttttggaaaacacggcacgcaacttacaaatatatgccaaatgatttgtatgaacattgggcagcagtgcaaggtcaatggtaagatttgacatttttggcgcgccaattagtccaacaattagtgaccgataaagataatgttgctaaatattttcaacacataaagcaattgttgccagagcggaatctgttttatcagttggctgaggagcatgccaaaaacataaccaggtgaagggagaacctttgatcactgatcagatatcacttatctcaaatggaagtttttggccactactgtagtttgctgtatccctcttaaaacgaaaagggagacctttttgttttgaaaattttttttttatgacaacttgttattaacccgaacccgaacaaaaggataaaatgatttgcatgggaaggaattatataaaagatcaatttgatatacctatttgcaattatttttcaagaaatttggacgctaggcttaagaatttttttttatttctaggattttctcgggagcctatctcaataacccgcaaccgatttcaccatttcataaaaattataacaaactttccgcttttgtaggctaaaactggggtcacagtggtcccgtccacacatgtgtatggagtagctctattatgtcttgaatttcatagtaaattgcgaaaattcttattgaaaatacaggaaacaaacttagttttttattaaatttattaattctttttaaatgatatgtatttgaaataaataaaatgcaaataataataataaaaaaaagaaactttaagattggcagagacaaaaaatgcatttagtgaaagtcttaaaaattcactgctggaaggaaaagggaccaaatttcggctccaaaaatttttctcgcttagtctgggcgatattgcattatatgagcaaatggttagcaaatttcctcaattaaaaaatttgtctagatcaggtaggtgcatttaaaattttttttataaaataaatttaaatatttaattgattttattatataatagaattaacgaacgacgaaataacggaattacaaattcgaacttatatcaaatttcttgacaataaaaatgatgagcaaatttgtagacgcgcaaaatatttgctcgatattttagcattttatcaatggtattttaaaataatttttaataaaaaaaaaaaactttttaaggttaaaaaataaggacgacattttaatggacaaacaggccgaagtgttaaaacacttggagttgtacgaacttttgatggtcattaaaatttatattttttagttgcaaatttctttgttttttttcaatttgaaattaataaataattaaatatttttattttaggattcggtgccaaatttatctcaaaatgagatcaataatgatatgattatacagctgttgtacgaacagagaaaagaattatttccaaatttaaatattgtaaaattttcaaattttgacagcccccaaggcggtgaaacggatgctaaatcggcacaacaatttttgcacggcaaaatcctccaaaaattggttttaaacagcgaatttttgacgcagttaaaaggtctctgaaaaattctttaaaaattagcaaaataaaaaataaatattaatttaaattttagattagatacaatatttgtaaatttcggataaggaatttaaatttagataattataaataccgtatttcctaaaatagagtccccgggggttttattttcaacccccctcaaaagggaggctttatttcaggggcggttctaatttaggggggggggctgtattttaggaaataaggttgttttatttaaaaaattatttttatttttaaatttttgaaaataaaaaattggaattttttagaaatctgtgccgacattgaccggttgcatgagttatgcaacgaaccagtggttgaacaaattatcacgcaaaattgttgcaataaattggaaatgccaaaaacggatgccaaaaattcacatttggatgaaattgcttcatcatcatctccttctatgttcatgaaattgagtaagcaaaattaattaataaatttaaacaaaataattataaaattttttttaattcaaaaaatctctcaacaggcgattaataaaccttaataacactttaatgaatttgggttaattataatataaaataaaatgcactaatgaattaataatggatcgggggtcagttttcggtgccgaccgtttgggcgtcgccaaatttgaaatgctaaaactttttcctttatcagttaacatttagcaaaaatgccatcaattgaaaataaaaccatgaatccttttctaaacaatttgattaattttttttaaattgaaaaaaacttggaaaaattagcaaaaataattttaaagttttttcaggagaaaatatagttttatttgaaaaaaattctatgttaaaaaaaagttatggcatgcagcgacgaaaagccagaaaaagcccgaattaccgaattatacaaaagcatttaatttgggttgctatttagaagagttattaaggagcattaccaacggtgctgaaccggccggcgccgaactggctggcggcgtgctaaataatgcttttcgggtcgggtgaattgttcaatttaatgacaatgtacaaaaatgtgatgtttaaaggacgaaaaaataatgatgattcagatggtgtaattttggaaaagtcagaagaagacctcaattttgaggcaatttattttcaccacaaaacggtattaaaagaattggtcaaattgctttgggtctttcaacgatatttcagacatattaggtaattaatgtgaatatcatttaaaaaccaataaataatttcactaaaattcatcagcaattaatagagcccggaaatttcaaatttgcggatcccgctgcggggttggaactcaaaatttttttgggatacgggatcccgtgggattaatcccgaaaatcccgcaatttaaaaaaaaaattcgggattgcggattgggattccacaaaatcctgcacgggatcccgtctcgtaccgggcactagtaattaatccattcataattcgataattaatacaatttggaggtttgaaattttccataatttattctctataactaaatttcacaaattaaactgttctcaccttggctttattttaatgattttttttagaaaattatgaattagatttattgaaaattttgtttcatttaatttaaaattattaaaaaaaatttttttttaaagaattaatgatgaaaaagtgaagagactaatcattaaattgaatgtggacattgcaatggctgaccttttcgtggaagtgaatgatccggcaaaaaaacgtgccaatctttgcctaatggacagtttgttgactcatctggtggcaaatggcacattgtacacagaagtccaagaatggcaaacccacatgctttatgaacattttattaatcatgtaaaattacaaagataatttatttattttttaaattaaggttctttggttaatgtttaatcatgaaacttgttcccgaggggtttttgacgacctctgatcatgaaaatgacatctattttggccaatttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgtccatcggatgccgatttgcgctgggccaaaccggagtgccataaggcggaggtggcccaagcggcagtgagcaaattattgggccaaatgtatttggtggtacaatcgcacagttttgtgctgggccaagttgcaaaggattgtgccgaatttgttcaatttgtcaaccaaaatgggaaaggaattttgaaaaatttatattgcggtaaataaatatgccataggtcgtcgtatcgtaaaagtgccagttttgcagaattttcgagcaaaactcttcacactttttgtttgatatggttgtgtttataaaaattattacgagtttttctcgaaaaatctgtaaaattggctttttacgaaacgatccagccgcgtcaggatcaatcagccgaggacaactcagctttacgaggtgtcatgacaacttgtacacagacaactcgtacaatgacttatgctaggcctatgctttaggctaggcctaggttaagcttgcttgggcctaggcttaagcttagtctttattttgtaaaaatttttattgtacgactgagttgtctatcagccgaattgtcccatcagctgactagtccagaagccaatccagcacattaaataaaaatcaattttaattttgattagatttttttcacagaaaatattgcctttaatgagcgaatcacttattacaagacaattttgggctcacctaattcggaggaaagaaaagtggcagaagcattgcttgtcattaaaatgacttttagtgaaattttacaaattgaaaaagcaaatttcaagtattatttttatattttgtttaaaaagcattaatttaaataaagatataaataaaataagtttgcatatatttaatgatttatctaaaaaacaaattcataaatccttaacaaataaaatattaataaattgaaaaatattttataaaaatgctaaaatataaatattcaaatttttttttaaataaaattgattttaaagagcatcgaaatttgacgaccaaattggcatctttcgagccgaattaattgccttgatgaaaatgcttcaaattgtccttggcgagacaaaagcaatgttttggatgttttgtccaattttaacttattttcattttctgaaaacgaaacaaggacattcatcagaaaagttagactacaatcttttaaatatgtgcttcaaaaatacggtgagtgattagaacaaaatcaaaaaaaaatagaattttaatttttgtaaatttttgaaagaaggaaatttacaaatttatttaaaaaattatatttaagtgactaataaaaataaattaaaaattttaaattaatttcgaaagaattttaacaaaaaaatattataaatttttgaaattaatttttttaaagaatttttataaattttaaaaaataataaattaaaaattaaaatactgtaaattttaaaataatttcgaaagaatttttacaaatttatttaaaaaatattaattataataaattaaaaattaaaatattgtaaatttttgaaattaatttttgaaagaatttttataaatttattttaaaaattataattaagtgactaaaaatttttaataaattaaaaaaaacttttaggttgccgcacatttcaaaatgcaaagaaaaacatttaaagatattcatttacaattttttttgaattttttcacgaattacgccaataatgagttcgggttggtaatgattttgcgcgaaaaaccgggcgcaatttcacgccttcgccatttgttaggcgcagcaatagacaatttttggtggaaaaatgaatacatttttcgtcaacaattgataaattggaactgtaatttttattaaaaaaaatttaatttattaattagacatttatatatccataataatattaaaattaattaataatttcccttattttatttttccacgacaaaacacgtctattggaacattactacagtactctgatatcaaatgaccttcctggtgatcagata

SEQ ID NO: 7533 - DNA, 1140 bp, Heterodera glycines
taattaaaatttagaaataaaaaaattttttgaatttattcctattcataaatttttaaaaatagaaaattttttatttgcaattaaaaagtttgaaatttttgttacaaatgtcgaaaaaaaaactcttcctcaagtattttggtgaaatttttgaacaatttaacaaaaattaatcagacggtccatttttgaaaaattgaggaaaatttgaaaattcaaaaaatttttttgtattatttgcaatggaaaaaatttgaaatttttagataaaatgcctaaaataacatcatgcattttagtcatattttgggatataattttgattgatgcacccaaatttcaggtgtggatgtgccgttttgaacatctgttgagcctccaattgcccgcagttaggcaggaaatagagaaaatttggctgttcttccggtgttactatgacatcatcagcgattttgagccgccgattagcacggaaattgattggcctttagcggctgccacaaacgaattaattttgggtaattaattagtgaatttattactttataaattaatcaataaaaaatatcggaaaatgcgtcaagggaaatggagttgatagaaattttaatttagtatttattacatcatttttgggtaaaaaaagtgatttaaaccgcttaaaaaccctaaattttgaaaaatggcgccaagacaagaaacagtaagaaagctttaatgggattactgtaagaagcccctctattatttataggtttttaaatttaattattgtttttttttgcaaaaaatatgcagtaaatcaatttaatttccaaggcattatcatctattattttaaaaatgatttttaaatattttaatgatgtaatattccaatttaaattaaaaataaattcctcaaagaaattgaacattttatggaaatgcataaaaatgaaacggactcggacaaagtgctgaaacattggcagcaattaattaaatcaaattttgaagatggcattttaacagaattagcggataaaaataacaaaaatgaagatcaaatctgtgatgaacacattgaatacatacagaagctgcatttgctagaagttattaaattgattaattcaaaaaataatcacgaaa

SEQ ID NO: 7534 - DNA, 1688 bp, Heterodera glycines
  misc_feature (1419)..(1419): n is a, c, g, or t
ccccaaaattcccgttttacaagaaaacgaagacacggaacatgtgcaggaagacgatcaaaccggaaacacacacgttccgagtccaccgcgacaacaaatactgccagccgaaccgcgtcctcagcgaaaccgaaaaccgccaaaaaaattggtgatggatccaaaagctggtggacgatatgcacttcaagaataggagggcaacaaaacttgaagggggaaatgttgggaatgttcatttgctcatattttaaatttcccgcgcttttaatgctgaacatcactattattgatttcagccattttcccttttgacccgtccttaaatatcagtccttcctctcagttgtcgcctcctacacacatcattatattttgctccttgactccgccattttcattctgactttcattttcatatttgtttcttgtttgtcttttattttatttcttcaataaatttgcatttaaaacaacccaggacaaagtgacgaaagtgatcattttgctgggcagatacaattcaaaggatataataaagaagaccaggacaaagtgacgaaagtgatcattttgctgggaagatacaattcaatggacataataatagaaacccaggacaaagtgacgaaagtgatcattttgctgggaagatacaatttaaaggacataataaaagaaacccaggacaaagttggtcttccaacaaaaaatgatgtggaaagaaaaaattttctgatttgagggtagtcgaccaaatttcagtctgatttattaaacatactcataatttgaaatttatggcctaatctcatattttatctaaattttaaggtctaacgaaaaatttgtttatttttttggacaaaaatccgttaaaaaactagccaaattttttttaaatgtttcggcggcgccaatcggcaccgcaggaccctaatttttgattgaatagaatgtaaaaaaaactggtttgaagaaatttcgcaaaatgttctgattttcgaccccaaactctgatttttggagtccacggttctgattttgaaaaattttcgatagaaacccatatttttgagaaaacttcgcagtttttcaattaatgtcggagcaattggctgatcatttccgaccacagcaccgatcagcaacagttgggtgatcagaaacaaaaataaaggagttgcaagcatctttttttatattgaatttggggacaaaaaaaataaataaataattattttggtgcctgaaaaagttatgaaatttttacaagatttttaactgcttaaaaagaagaattttttaggatttagatctcataaaaagtataaattcattaataataattaacacatacaattttataaaattatatacaaaacactttatgacgaaacactgaattactatcgngaatgagtcataaaatatatttttaaaaatatatatgggatcataactgagaaaagtagaaattttattacatttataactaggggcttatatttttagatgctaaaaactggcgaaaaaattcaaaaaataaaaataaaaaaaaaaaaccaggttccgtttttagggttctaaaaacccaaaaatattttctaaaccgagaaataagggctaaaagttttcaaattttggggggggaaaaagaaaaaaaaattctttcaaaaaatcaa

SEQ ID NO: 7535 - DNA, 1968 bp, Heterodera glycines
tcaaaaaatcaacaaaattatgacaaataaatcttattgtattatttatatataatttaaaaaagaaaaaatccttgtcaagaaaataaataaataattatggatatttttgagagaatttttcatatgcatttaaggtacatgccataggaagctcaggaaaaaaactaggtgaaaatttaaaaacataagcactatttataactgcgaaaaataaacattttttttagggtttaaacaacaaataaaaaaacagaaatttattactaataattaacacattcaattttattgaattatatatatatatatatatatacaaatcgcttctgacgacagtgaattatgaccggaaatgcgtaatttataaacaaataacatttccggctaaaaaatcggtaacaattttttgtcaatctattcaacttattattaacgaattattttttaatgaatttagccaattaaatgtattgattaattcgatttatgatatttattcgctattacatacattcatttcaaacaaatacgagcattttatatatcccattcaatgtattagttattataatttttatattttgtattttatacaaatgattttaattttaaaaaatatattaagatgataatattatatttattccttttgttttcatcaattttatattattttggcacaaatggagcgcaaataaatgaacaccaaaatgttgtcgaggttcaattaagtgtaattaaatataatcataattagcataaggtatatatcactaatttgactgagacatgaagtgagagagggagagaaatgagagagagagagaagagggagagaagagcgaaatgagagagagagagaatggataggtcattaagccatttgataattgctggaaattaccctaagtaagcctttcattgatcaaattcggggtacaggtctggatccaggcctcgaggcgcctgtccctgtagctgttaacaaagcaaacacaaattttgaaaattttcccttgcggcgcctatcggcaccgccgtactcctccccccttgttccccaaaatgtggttgaaaaatgcgccgtaaagacccctaaagattgaccaaaatttcaattaagggaggttcaatcagaaatatcaaattgattatcatttgtcctccatttttgcttctttcacagtgaaatcgatggccaatttcacgttgtcctcgcctttgtcgtagaaaccgttgcttgggtccatcaattccttaattgtcataattggatcaattaaggaaaagtttaattgtcactcaccacaaaggaaatgaaattgcatccccagcctctgtttttattgtcaaaaacatcgtcatttaattctcttcagaaatccgccacatcgcacttttgtgagacaattcgaatgattgccgaacatttgcagctccaattttctgtgcaaaacaaaatttacttttccatttttggcaaggatttgagacgcaaagaatttcacagactaagcgcgaaaattattttctgggtataagtaacacaatttgagctttcttcaaattggccgtcgccaacaaatgtttttgcaattctgcgctccttttgatgcctttaaaaatatcaaatccatgccacaaaatgtacaaataacgcaaattaatatcgttgttaattcttatcaattagcatttaatttgcaccttcttgtggagcggcacacaaaagataaatgccattattaaagaatgaaatcatagcgtaattagtaatagtttttcaatttttaatttaataagcccaaacttcccggttcccaaatttctggtcccaaaaaattctgcttaaataaaaggacaaaatgatcagtcaattaggaatggttttcatttaaaaaaaaagttaaaaatgtttacgaaaatccaaacaaaattattgcataaatccaaagtccaaaaaaa

SEQ ID NO: 7536 - DNA, 5447 bp, Heterodera glycines
gtcataatggatccattaaggaaaagtttaattggcactcaccacaaaggaaatgaaattgcatccccagcctctgttttttattgtcaaaaacatcgcatttaattctcttctgaaatccgccacatcgcacttttgtgagacaattcgaatgattgccgaacatttgcagctccaattttctgtgcaaaacaaaatttacttttccatttttagcaaggatttgagacgcaaagaatttcacagactaagcgcgaaaattattttctgggtataagtaacacaatttgagctttcttcaaattggccgtggccaacaaatgtttttgcaattctgcgctccttttgatgcctttaaaaatatcaaatccatgccacaaaatgtacaaataacgcaaattaatatcgttgttaattcttatcaattagcatttaatttgcaccttcttgtggagcggcacacaaaagataaatgcccaaacatttctcaatattgtcagtgctttccgtcaactgacttatatcaatttcttaattaataataattatgccaattaaggaattatgtacaattgacactcaacaccacgtttaaacagctgtaagaattgactaaataataaaattgtcacttttccatattttaattttgtagtaaatataaatttttaagcgcagcttggattattaaagaatgaaatcatagcgtaattagtaatagtttttcaatttttaatttaataagcccaaacttcccggttcccaaatttctggtcccaaaaaattctgcttaaataaaaggaaaaaatgatcagtcaattaggaatggtttcaattttaaaaaaaaagtttaaaaaaatgtttacgtaaatcctaacaaaattaatgcaataaatccaagtccaaaaaaaatgagagtctactaaaacagctccgacaattaattaattcatatatcagcagttttgaaagtataatcaagaaaaattaataaataaaaaaacaggttcatcataggatggaggatattcaatgggcatttttccccaaatcatattgggcatttatgtttcgtcctccgttttgcttctttcactgtgacatcaatggccaatgtcactttgtcctcgctttggtcgtaaaagcctttgcttgggtccatcagttgcttaattaccccataattggtcaattaagggaatgtttaattgtcacttacagcaattgaaataaaattaaagtatcccctgttgttccatttattgtcaaaaacatcgtcatttaattctaatttaaaatccgacactccgctctttagagagacaattcgaaagtttgccgaacatttgcaactccaagtttctgctcaatataattaattaattgttgttaatatatatattaattattagtaattttgcacctccttttggagcatcgcaccaaaggaaaatggccaaccatttctcattgtcagtgcttccaattttcggatttatttgtgcccatattttccatggcaatcctttgatgtgaacagtttcacttttacgttcactccaaaagacttctcgcgcaaattccgacactttttcaatttccatcgaaattgtcccgtttgatttgctttgatccaaattgaatttgtccacttttggttcatcaacagttgtgagatcaataatcaatttcactttgtcttcttccctgtcgtaaaaaccattgttaaggtccatcaattccttaatttaaatcatctaatttaatttttgtttatgcgtggtcaattggttatgttttagaaattaatttattttgttatgatttctttacaccaggcaaataaataaatgaacttcaatattggctggtccacgaatgtcaaattaaaatatttgtttgagttggcacttaccgcaaacgaaacgaaattagggaatcccaaattatttgattttttgtcaaaaacataatcacaaaatgtcccaatggaattctccgtcacatttttttgcgatataattcgaaaagttgccgaacgaacgcagcagcgccaattcgaatcttaatgattattactcatcgttgttaattagcatttaataacagttaatttgcacctttttcagtagcatcacacaatagataaatgctcaaccatttctcactgtcaacgagttcatttagttctgcttcaattttccatggaagtccatttatgtatattttttcactcaatcgactgctctcaacctcctctcgtgcaaattccgacactttttcaatgtccatcaaaactgtgccctttttcgatcagaaatccgtccattagtcgaaaatggcattgggaaaattccgtcggaaatcccatgacaatttggaagggatttgaactgataaacggcgatcacttcatcttttgacaaaacaccgaagggaactgtaaatatgtattaacttattgaaaaataaattttaaaaaacatttttaaaaatcgccacaaaaactatgaattttttacggcatctcatcagaaaatgagtttgaaattttgacttatttttttaccaattttcttcgtaaattccacgtttgacaaaagcggaaagcgaattttgaacagtgccgggccaagcatttgacggcgattctctgctgaacaatcaatgccattttcacggcatttttcatcggcccaacggagtgcctttaaaaaatttaatggaaataattaaatgactaataaaatttacagtttttaaatttaattgttaaaattaccgcattccaaattgaaatttctccacggatttgcaattcgtcacactccaaaatttcgcacaacaatttttggtcaatttgcaaaaaagcatccgttttaagcaaagtgtccgcatttttgccaatgtaagccaaacaacaattggcaaaattctaaaatttaaaggaaaaataatctttaaaatgtagtctttctctgagagtgccaaagcgagaaaagaatcgagtttttctggtagaggttttcgagtttaggagaccgagatttctttaagccctctaatgattgtttggcttttgacaaacttaaaaaaacattcattttttgaggaacatattttacaaaaaaaaagtctaaagtcaagggtttttcgatctcacaatcagacagcagcaattaattggtcttaaaatccttaatttattatacattctaaataaacgaaaaaatttttgtaaaaattttagtgtaggaaaatatttgcaaagaaatgcaaataatagcgaaattcaagacggaaaaattcacgagattgagtttaatcattcaaaaaaaccactctaaacagtttattatgtattttatttaactggaaaatgtaaaccgacaaaatagttaaaaatagcaaatttttaattctttcgcatttttcaatttttcctacccactttcaagtcgagaagacgggcctgggcaaaagcgaagaaaacattgcgcaattcggaaattggaatttgcgaagatgagccgaccagagaggggatattgtactttttggctaatcaaataatttatttatttttgtcacataaaattaaatccaccggcgtaaagcacagccattgcattttctacgttcagttcgctcaaatcatctgtatagatgaagctcaacatcactttgaatgctgctgcttcaacgtcggggacctccacgggacaatcagcagaggctaattgaaaattattagtgtaattagcggaggactattgaaaattaattagggtaatttgcagagactaaattgtaaatgtcattaagtaatgtttttaccgaattccgctttttcctttttggcatcaaaacggaacatcgcctcaaaaacgtcggaagccaacttcaaaatgagcttatgggctggcacaagcttaagaggattaaattttaaaaaacacaacaaaatttaccattcactaaatttccaatttataattaataaattaaatttttaatttgaagactcgcctcttttgcgtctccgtcgcccaccaaaaaataaacatccgcgtcctcacccgtgctcaacaaatgcttcatccgatcaagcactgattgggacatgataagcaattccatcattcgtttaattatctatttaaatgcggtaaaattattggcaatttcaaaattggcaagaaataaaaaccacggcacaaaatcagcaaaactttatgttcagttgggctttgtgattattttgaggaaatttgtagcaaaaaaaacatgcaaatgtttcgttgtgctcctccccccctgtttttatgcattttttcatcgctttgccatcggtaaaaaaaaattgatccgactaaaatgcaaacgtaaacaaatatattttgaaaaatagatgcaatgtacgagaaattacctaaacgtattaatataaacaaagatatttttgtatttttggatagaaaaaaagtgggagaaaattgtgctctaatcgaaagcttaaaatttggggaagtttttgtatagcaaaattctggaataaaagcaaccgacaaaaaactatgcttgaatatatgcgaaaagttatgaatttcgggtttctcattgtaaattttttcttaatatatgtaagtatttgtttttttcttgtattaataaatacgctaaactttaagctttcgattaataccaagaattttggattaccaagtaataaaaaagttatgatttaaaaaagtgaggatggtcactcattggacgcgtaaatattgattggacgcgtaaactggaacagagccgaaaattgaatatattcaaataccattgggtaatgtgaaactataaaaagtttgcgccaaaaatagacacttttatcaatttgtttttcattgattgaccaatcattggcttaattaagcaattaaaggaccaggagaaaaactttaacgttaaaaatgaagacaaagtgatgacattgacattgaaatagtgaaagaagagcataaatggaggagatacatttaaattattggtaaaataaactcgaaaaataaaacactcatcagtaaagtacaggctttatcttttgtgcaccaaccgaagaggtgcaaattaaatgtttcaatttgacaaagcttagcaactccaattttctgctaatgcaaattaatttttgctaatgatttttgcgactggattttgtggatttccatattgttttatgctcatttattcggggctaaaagcaaggaaaaatgaacaaactgtatgattttgtatacctgaattgtactcttttttttttgcctcttcgttatcagaaaaatcttttagggtcagcattttgctgaagaattatttctccgttcttctcccctttaggtcagtattttgccgtaaatttaattgtacctttatgcccataatggaag

SEQ ID NO: 7537 - DNA, 2038 bp, Heterodera glycines
aggtccgaataaaacaaaacaaaaacaagcagttcaataatggttgtccacgttgaagcaataaaattctcatgaaatttgttgtgtctaaacgtcatctccatcatcgatgtcctccgcctcctcaatgtcatcttcccgctcttcctcctccgcctcctcctcctcctcttctggtggtgcccatttccatttcggtggcagctccacttggctttgtccttgtcgatgatcatcagcagctgcaccattgtcgtcgtcgtcatcatcgcaaaagacgttgctgtttgcaatggtggagccgttgcttccgttgttagcattattgttgcactgcttcaacttggacgccttccatgcagcaaaggcgtccaacgaccgacggcacatccaggagggcggctgccgcaactgttcctcccaataggcgccacatttgtccaaattgtccatgccgttctgccaagtgcaccactggatgaaggcctggaacaaaaataatatgttaatttaaaaaataaataaaatgacgaaaagagaaagagaaacaaattcatgggaccaaaactcaaaattggattaaaaaaagtaaactcataattttattggataataacgaacaatttggtcgaattggagaaaaaagctttcattttacctcgggtgccatttcctggacaacagccagcggaatttgctgtggcaatttgaagccgacaaatttgacaaaacactgacgcgtcccatccgcagcctttgcactgaccccaatgacactctccacctgggaagggggagggagggaattgattaaatttttgaatttgaatgtgtcatgcgtttgttacccggtgggggtcaaagggcgccaaaacaactttttgggtgttataatttgttcgacaaactacaaaaggtccaaaaaatcagccaacctcccatcccctggcgagcccgttgtcctcaacgtcctgcagttccttgacccaacagtcgacctcgcccggcttgtccgggttgagtggctaaaaatggagtaagtttgtgtgaaaatgcggaacatggcattataaatactttcattttttgttaaatttcaatttaatttttctaccatcatcggttcatattggggctggtccacttcctccaattggaggttgtccatgtccacccattcagtgcccaaatagtcacgccaaacatcttcgggtatgaaatatttcgaccctaaaaaacacttcctattatcgtcctttttcagtcttttccgaggggacggttcaatgggttttttcttgtgggacgggtgggtaaaagccaatgcctaaacagctttgtctacctttggtggtgccatcctttccgacactccggcacggaaccgcaccgcgtctgcccttcttttccaccgggccccgcttgacatcgatgtgctgccgcttcttgccctcctcctccttggtcatgctgctttccctctcttcttcctcctcctgctgctgctgttgttgcgcttccagttgttgttgttggaattggaatgtatctaaaaacagaataatttttattaacatttgtatatcaattattaattatgtaacaacaaatttatggtccccgaaaagtcattggttaattattttggattagaaataaatgcgacaaaaaaaacagaagcaaatactaaactaatttcattgagacaattaaaattatcagaccaaaacctcattaaccctccctcgccactcgctacaaaaaaaaataattaattattcatttattgaatgaatgtcagcaattctttgtcatttgcgactgaaattgcccattcgttcgatttttgtttgtatgggagaccgttcacagtgagtgaatttaaaaagagctaaaaaaattattgttatctattgggtggtaatctgcataatttcgttcgccttgaaaacaaaccgatggggcacaaaaattcaaaaacggactcttttatttgttgggattactttagagggggggggggggggggggagaatga

SEQ ID NO: 7538 - DNA, 4688 bp, Heterodera glycines
ggaattcttcttgttccagctgtttcgagacttgtttcctttgggttagcaagcccaaagcattcgtgtggcttcgcgattcttgttctcgaacgccctatgttgggaaatgctttttcaatgtcagcaaggatgtcttttttccatgcgtctgaaccgaaggagaatgccgatcaggtctttcaaaagtagcgggcctgtgtgcaggcattcgttgagtgtggggggggggggggagaaggaataaacaaaaggaccttggtttggagagagggaccacttacattgacaacaatgacactttttctcacaagcaatttaattttcttcctatttttttgaatgatccgacagtaggccgatatgccggatttttttttgaatatttaggtaaatagagttaatcctgaagtaaaacatgcatttggagttagatggtgcagaagaacaaacacgttacagtatattttcgtactcgttcaaatgctcaattttgtttctttctgtgctgcgttctttagacgcgcaacagaaaatgagaactgagggggggggggggaagagatgggaagagggcgatagaagaaagtgagtgaagcagtcaatgaaaatgagcaaagtaaattatttaaatggaatcaatcaaaatcttatgcattttagcgtggatttaccaaacaaacaaaaagagaggggaaaaggaggaaaaggggggaccacccacacaaaaaaacaagggaaaagtgaatgcatttgagggcgttaaatttgtgtgtgcaaagggtacggtcgaggcgagggagggaggcccgcccaaaaaacacgacggacgcttcattcatttgcaaagggtgccaacattcaaaatgcgattggttggcttattttcactcctactaaaacacattttccggaaattattgaattttgttgtgatttgttaaatatttcacaaatttttggttaagaaattggcaaattctttcgttcccccttccctcatttataatcgtctcttcttccttctccgctgttgatgatggcacgcaatgtttaaaagcagcagcaacagcagtgtgccaaaatgcggtcaacttttactcagatgacccgaaagcggcgatggcaatcgaaaaatggatgaaacatctgctgtcgttgctgctgcgccgttcgttgcattgaggggattgttaattgtaagtttacaaaaatattcttctcctcatcaacagatgcctccaggcccccggggattttaaaggaaaggaaagaatttttattaattttaaatgggtgacgattggatgactaacgatttaacttaaacaacgttgaataagggacataaggcgttaatataagcagccaccgtgacattagtgacaaacaaccaatcaatcgttaatacgaatgtgatgtggtgtggtggggttccttccattcggagcaagccaatgattccaacgcctccaacttttccaccacctctcgctttatcaataataaaaattaaattgtcctctgtgacattgttaatttcggattatccgtatataaattgtacgccatgaacaattggatgtcatagaattgctttagattggcaaaaatgagtctcaaaagcttggtgggataactcaaagcaccaaaccggccggaacaaaccgaagcaaaaacacttaagtgccaccctcactcattcagtttccaatacacaaaactccccccccccccaacacaaagccccttaatttggtaaaatggatagaagggggattgtccaaacaaacaaacaaaaattattccccttttcagttgacataagaaaatgcaaagacacctaccgtcatcctcatcagcatcctgctgcactaccacctgctgttgaacatcgacaacagcttcagcagcagcaacaacatcatccgaaccaccatcgccaccaccgttgtccatgtccaccatcggttgctgttgttggtcgcccatttccacctcctcttcctcctccaccgcttcgtccgcattgtccatgtgcggcggcgatgtgcgcggctcgtcacaaccgccggtggtgaccagttcgtccaagtcgcgctcatcaaaagcaagcggcgacacactctccgaacttttgacacgctccactgctgcgcgacgatcagcactcaatggcggcggcgtttgctggccatcggctgcagatgcaacgggagaagaagcggcacccggaacagcaacggtagcaacaccatcatcaccagaagtagagggatcttccggcggttgttgttgctcctcttcctcctgctccccaactccgtgcatttgaaccgtttccggtgtcagctgacggtgaccatgcgcaagtcgttgttgttgttgatgttccttcttcgtttccatggcacttaaaatggcaaaatttagttgtgagtggaaaaacgcgcacaaattgtgtgcctcaatgtatacagtaaaccccgggacagtagtaagtttgccatttgccaatgaaaaatatgttttctatgcggtgcgatgaatcacaccgaccgagaaagggaggataacaaaaaactttttgcttcactggacctaacgtgggaaaaacattaccattactatcacccaccacccatccgttccccctgccctcacgacgcatttatgtcatcatgccaactaaaggtggatgttcacaggtgagaaggaaatgacgctgaaacagtaactcagtcgatccctctagcagacatatttgcgtatgggagtggtcaagccgcccaccccccctcgaaccgcacatgcacagccgtattcttctgaacactccgtacggaggtcgacttgtgctggcgcttgaatgtagggctcacttctttttgtgcatctcaaagacaaacgtttgatccgacacaaaaagcgttggtcgcaagtgatgtacatgtactttttgctcgggcatcgaattatggactcacatttgagcgtataagacaaacaattgcaggtcttttgagcctaaattttgccctcgtggaatctgtgcaataattcaatgttcgcaccgatgcttaggctgacaacacatatattctcgccattgatggcgattccaaattcgaaccagcggcagtgattcgtcttttacatctgatgaacttgaaaagcgacgttggctgtgcgtgcggaagaatccatccgattggagaaggtgtgctatccttcccattaatggtgaatttcttaccattccccaggggtcatggtttggtaccaaaagttcgagtacgcaatcgcccattggttccaaaaggctgctgagcatgtgttcggctgtgttttgtgtgcccccggttgcttctctctgtttcgtgcttctgctctcatggatgacaatgtgatgcacaaatacaccaaaactgcctccgaaccacgacattttgttcaatacgaccaaggggaagaccgttggctttccactttgcttcttaagcaggtccaattgcctttcttttttcggaataataaccattttaagggttatcgggttgaatacgccgctgcttctgacgccgagacttatgcgcctgaagggtttgaggaatttttcaaccagagacggaggtggacgccttcttccatcgcaaatacgctcgatcttttagcggattacaaagttttggatgccattgactttttcatcattatttttagcttgcatcaagcaacaatgccagcatctctcggctgtacattctctatcaaatggtcgtcatcgttttctctttgcttggacctgccatcattttcactatgcttgtctatgcacaggttattatatgacaaattctatttaattgctacaaattaatgctcgagcgtatgaccggtggtttttcaggtggcggcctttgccgttgattcgacgagagtgctcttctacaatgcagttccggtgtgcggcttcatcttctgctgcttcaccatggattcgtccgtacagcttacctacgccaaaattgcttccgtcatttacgccttcataatgctggccgtccttatcgccaccacaaaccaaatcgtattggagacagtcttttcgcccacctccatgttcgtgttgggcatggtgctgatcttctcctttgcctcctgcatccacccgaaggaattcgccaacattatttatggttcgatcttcttcctgatgatcccttccacttatgtcttcctctcgctgtactcattgatcaatttgaacgtgattaattggggcactcgtgaagccgtagcaaaagcgacagggcaggcgacgttcagggagaatatagccgagagagtgctgcggcgagtggctaatctcaacgacgacaattccttcttgacgcgctttcttacgagagttcgcagtggtgaagaaccgagcgaaaaaatacggacacttgaaaggaaattcgaacgcactgaacgattgttgatgagcatgaaggcatttatggggtgatgggagttggatagtttaaacatttaggaaatgactgaaaaggcaagaggagaatccgatgccatgcaaatgggcggacagcatttttgcatgatggatgtggtgcttaatgaagagggtgaacaggaattgcctttacgatctggatacgaggtgactaatgtgttcatcatta

SEQ ID NO: 7539 - DNA, 1095 bp, Heterodera glycines
  misc_feature (1085)..(1085): n is a, c, g, or t
tggtcaattaaatgtttgcttgtactttaccttcatcgctcaggctgttgccattcgtcggctggacacttttgaacggcgtgccattgttactgacccatgcaaacgatccctttggatggactgtgaataccttcagtgttgcgatcgtgggaagttgagacttggggaagagactttttgggacgaattgatcgacaaatatttgaaggtgggcttttgggtcaaatgcaaattgtttcttttttgttcaatggcttttctttagccagtcgagaccaccacccgagaacaggcgcaagtcgcgaatggactcgtcgcattgcgaaaccgaattgcattttccatcattttgctcaattgtttgcttgtgctggcaattttccttctccaacgacacaaagatgttctgtccgtcaaattcactccttatggtgggcattgttagctctttttcacttcctttattttaaagatggatttaaatggacgaaaatgaatgaaacgaccgggaaatttgaagacacgactgaggccctgaaagttgacccgttgggtatcggaataatcttttttctgatgggaattctcattgtgagacctttttcaattgaattcactaattaattggaaaaggttcaaaccattggcatgctcatccatcgtctaaacactctcgtggaagcactgcacgaactgagtgagatgaaagacgtacaatacaacaccttcacatttactgaccacatcaaagtgctcaatgaaggtggcttttcatcatgtgccatttgcatttgtgtctacttttctaattgagctcgtcaaatgattgacaccgttaattacgaccgcgcccacggggctgatgggtacactcgccacggacttggggaccaaaaagtgcaaaagaatgtgctttacaaactccaaaagtgacaaaacaatcttttatatttaagtattttgccttgtttttcatcttttcatcagctaatcgatgtttgttatatattcatgacatttaattgacaattatttgcagtaataagaaaatttcttggttcatttgtgaaggaaagcggatncctaaccaat

SEQ ID NO: 7540 - DNA, 4973 bp, Heterodera glycines
aattccttcgtcgccacttgggcttcatcctgtatttcaaagattttttgacgcatcgtcaaaagtccattcaaggcattgcgcacttctttcgaatttttgttcacttcttcaatctcgcgcatcttctcatcccaacgattgttcgtgaacaattcgcctttgtttggcgatccctctctcaatcgtttacgaccattttgtctttcctttggcatgtccaacagtgccggcggctctaactcatttttggcctttatctttgcttcatttcgggactttgtcaattcctcaagttcccggcgtgaattcgctcgcacccccgcgctttcaaaaaaagacgtccccgtctcaaataccttcgctgcttcataaggagagtcttcttcttcatctcctaaggacaacacatcttccaccgtacttttctctttctccatttttgtttgcacaatgccatcctcatcagtttttcggtcttttgcttccggttcggctttttttgcctcaggttcttttttttcacataattctccacttttttcttctttttccgccgttcctttttggtctaccgtatcctttaccgtctgttgcttcagttgctcaatgcatttttcttctcttgccttcacatggcactcctccggttgttcttgggccaatgtttgcctcactttgttcagctgttcctgcagacgtctttccaatcgtctcagcgattcctcttcgtcatcagtcaaggattcgaagtgtaatggagccggtgatgtcattcggtccaattccttgaaaaacgaatggctcgcatattttttattttgtgttttattcgatttatttagccgccctttctcattcaactgttcgttttccattctccctaaaatttctagagaattattcatatttctctccctttctccggcattttccactaattcttcatttccttcatcttcatcaatttcgtttgaaaaatccaataaacttttaaacggttttacataatttatcacattaatgtctgttcttgaaaaatcatttacttcctctaaatcatcctgatcacttatcattccttctgaatctcgagagttacaaagtttggcccatacccaatttccaaattttccttttctgaaaaaaggatttcaggaattctgggaatttcaaattcgtgcccattttcatcgaagtagatttcccaatatgtctcaatttcattttcagtttttattcgccatctttcacccaacaacatttgcgcatcaattcccaacattatttgatcaaattcgttgacaatgaaaatttcgaaactttcgccaaaaatccatgccataacaaatcttgagccatttccattaacataaatttcccaattttcccttactaggttttcaggtatgcttgagattaatgagattgttacggggtctctccatccggtgtatacttcagtaaatgaaccctcaataaggacttcgagtattgtgaaaattggcattatttcgatttcggggtttctgtccattataacttccgggccttcatcatcctcagaattttggttttctcttacaaacgcaacaatattccaatcattctcatcgtcagaactctcaaagccatattttgaaacttttaatcccattttgttttttgactgcgcattttcattgtcttgcgtttcctcacagtcactttcgcaactttcaccttcaatttcttcctgttctaaattcggatcatctacgtacttttcccaatttaatggttcatctgactgccttagaggaagaattgccggtccattaaaatgtttcactttttcttggtgtacttttcttaatttggctcttccatcaattgactgtaaaatgacatttttcttttctttttcaacgcctacacaacgcattggtcccagccaacgctgatcaaatttatggcttaaaacttcttttttaaacaacactaaatcaccgatttcaaattctctttcattcgctttccttatgcgatcattctcttctttgttcctttcctgcgcttttaaaatttcatttcgcacaatttcccacgctttagctgctttttcagtctgaattcttgtatagaccgaaatatcggacacaagctcatcgggggatgggagtttaagtaaccgatcagttggcaattttggctgtcgtaaattaatgataaaaaatggcgaaaattttgtagctgaatgtattgaaacattgtatgaaaaaatagcgtgcggcagaatttcatcccaattattccctttttcattgaccatttgagaaataatattagccatgattcgcatagccccttcagccattccattagactgctgatgatatggtgttgtagtgacatgctcaaaaccgtatatttttgccaaatcattaaaaattcccgaagtgaactgtcttccctgatcagtcacaacaatctcaggagttgaatgttgatggaccaccatttcaacaaaattttctgatacagtattcgctttctgatccgggattgctttggccataacccattttgaaaaactatcaatcgccaagaaaatatacaagtttcctctttcagttttctttaaaggacccattaaatcgcaatgaattctttgaaatgggccatttgatggttcgattgggacactcggagccgatttggcctgccctggctgaattttcctcacttggcacttttcacacgcctcaattagcagtttaacatcgtctttcattccgatccaataaaatcgttctttaatttcgtgccaagttttttcgaatccaaaatggccctctgaatggaaaataagaaaaagtttttgtcttaaagaatgagggattattaatttaggtttctccatgttttctttgccttttacgaaataaatggctccatttatcaagctataatcagaaacaactcttttccatttcagaacatcacttggacactttccggtttttaaaatgtagaaaattttggccaattcctttacctttgtttgtgcctcaatcactgtttttaaggttattctcggattttcattcaaaatttcatcatttttggcaatcaaattttcattaatattatccgtgattacttttgtaaccccagacccaactatatatggcgagaattccttaaccgcatacactaatgccaatgcttccctttcaatttaagggtaatttgtttcgtgccgatttaatgctcttgaaatgtaagcaacgggcccattctcctggaggagaactgctccaatggccttttttgaagcatcacactcaattgtgaatgtcctcccgaatcttggggactgtagcactggtactgttgtgagcatttgttttagagtttgaaaagcatgttcctgctctgggcctaaatccttgctgtaaatccatgcacgtgtaaaatttctttgcccccatcagatctaacaactcttgaatgtttggcaagtgaaatactctcttttttgtcattttattcagtgttctgtagtcaatcgcaaaacgccacgactttttatcagccttagggaccatcactatagggctagcaaactcagattccgattcccttattatattctggtccagcatcattttgatttgcctttcgatttctttctgagtctccggtgggtaccgatatggccgacaatgaaatggtaacgaaccaggaattaggtcaattttatgcacaattggtccgttatatttgccaatttttccatcatcccctacaaaagcttctgaacactcatccacaattttctttaaatcatttttcgcattttcacttaattttgtaccctcaagattgattctttttgatggtggcctatttagtccgttttccggtaattttggtaaattttcgctccatcgtgtctcgggaggaatgtaatcttttgctgggatttcatctcctggtgatgcattaatttgaaccgattccaaatctgccaaatgtgactttccatataatttaaccgctgaatttcccgcatttaaaatttgtattgttacattcttactatttcctggtgaaaccaaagttcgtccaacaattattccgggatatttaagcttaattcctttcaccaaaaaattttgttccattggaaaacattcgtttacttttgccgaaagtatattttccgaccttggctctaaaacttccgtattttcaagtatcacagacggtggttttggcttttcagacccaattactgacacaatgtttgtccactcatcaccaagtctaactcttttctctcccagggaaattacaccttttaattccataagaagtggtaatccaataagcaaagggccgggacaatgttcgtccactgagacaagcaatacaacttcccattctccgacatttccagtcacattatcctcaattcgaagttttgccatagttttccccaaaatttctatgctcgaatcgtttgccgcagtcaaatttccttttccgtcattttgctccaaaattttaagtcctgcttttcttgctgttctttctctacagtaggatacactagcacatgaatcaaccaaggctgctgttaacaaatcattaagacggacactaatggatgggagtctcctcgggtcattcgtaatcgctgcaacccgtctcggaggaagataatccagaacataagcttcttcatcgatttaatccaattctggtgcggttggtaccgccaaaacccgagtacttcgtttttttgttcccatgattgctcttaacactcttgccaatactgacccagcacgaaccccggcaaatattatcagtctgtatttaattccaatgtaacccatcaatgccaaaagaattaataatggtatcgcaatcagtacatatgatatgcctttcaaataacttattgcttccttggttttctccgg

SEQ ID NO: 7541 - DNA, 688 bp, Heterodera glycines
atatatatacacttattttatttagcataagactcttattattataaaaaaatattaattttaatttcatttcttttgatattatattagccctttcgctaattcattcaaaaatattattaacgaaattgaagagattttaagaaagttttcccataaaaaatcccacggccttttctgctattggtttgtttgcctcttttcccactaattaacttgtggatattaaacctgggtgatagctcggctttttggggaataactccttttgtaattgtaattgctcttattggctattaaccaatattctctattaggctaggtccatttcaaaaaaatttccctaactttcaaaaacacgggcaaaaatttttttttaaatgtttcataaacattttgcaaatatttttgaattttcaaattttggaagcaaatagaggaaacttttggcgttcgaatgctatcaaatccgttcaattcaattcgtaccacactatgaaaggtgatttcccaaacaaaagccaggggctgtcgtcgcccagcagcagtttgttcatttccgcaaatggacacttcgtccgtctcatgacttttttcttcccccggctttcgtgcgatgtccacttaatccctctccccccccccccccccttttccccgtcaatttgtgtgaaaaagtattttccaa

SEQ ID NO: 7542 - DNA, 3480 bp, Heterodera glycines
  misc_feature (3444)..(3444): n is a, c, g, or t
tctctctctctctctttctctctctctctttccctcctctctctctctctctttctctctctttctctccctcctctctctctctctctctttctctctctctccctcctctctctctccctcctctctctctctctctctatctctctctctctctccctcctctctctctctctctctttctctctctctctctctttctctctctctctctttctctctctctccctcctctctctctctctctcttttctctctctctctctcttttctctctctctctctctacctctctctctctctttctctctctctccctcctctctctctctctctctctctttctctctctctctctctctttctctctctctctctcttttctctctctctctctctctacctctttctctctctttctctctctctccctcctctctctctctctctccctcctctctctctctctctctctctctttctctctctctctctcttttctctctctctctctcttttctctctctctctctccctcctctctctctctctcttttctctctctctctctctttgtcaataatttgtgtgtcaattgggctgtgtgctttgcgtgcggcggaaagaataaagggagaagaaaggggccgggagtttttcttagaaacaaccaaattcaacttgttcggcataatttgataaccctaattgccctctattagcatgcaaaatttcaaaaaattcattcagttttgaaaaagttattaaatagctgttttcctaaaatttttggccattagttttttgaacattaatgaagttttgcaggcgaactgaggacaacacctagggctattgaataatgatgccagaatgtttaatttggttgttgtaaagcgtaaaagtgccacgcactaaaattgtccggttcgaaaataaattgaatgaaataaatcaattttgaaaaaaatttatttgcggagtgaataggaaaagaataagaaaaacttcctctttgccttctaatgttctgctgactgccgttgtgtgaaatttgtgccaacggcacacggcacgggacgacggcatttgcgagccaaaattttatctttccacaacggcactcactcacaccatttacataatgcatgcatgtgtgcttagtagaaagggaatttgattaacgggtaaattggcatccctgtgcttgtgctcgagagtatcggtctcggttcttgagaaagtctcgagtttttttttgggttccccaatctctcgtcttgggttcatgagtcttggtgtttgttgtcgactctcgtgaaattttcgtttcacaaatatcacaaaatttatgtaaaatgtaattaaaaaattcaagaatttgttctttagagaaaaatagtatgtgtgctctaatgatataatgagatagtgacactttcttggagggcaattagcctaattatataattatttacctaattatgtaagatgatacaaatcgatttggcctataatgcttttgctgatgagtgatggatgggtgtgactttatgagaaaatgatgatgatgataatcggttttttgcgcttctgttgttgctactgtttttcccaccaccgagaacctcaaaaagcagccaaatgcacggcagcattagcatcaccatcatatcacatcataagcttcatcattagtcattcattagctttacataattcgattagtgttgcttgttaagtatttaaaaaaaacatttttaaaaaattctaaaaataaatatgggattccaggaaattttttattttttacagagttgtgaaggcaaataattacaggaattataaagcattttctggttttatggacgaagccaaacttcatctatctcacaaatcaggtccttgagttaataacctaaaaaaacatttttagacaaaaaaatcataatatttttttactgaaaataattaaaatcattcatttaaaatttggtaaagtctctcagaaattaaaaaaataaataaaacaaaaagcgcccttaggccaaaaatttcaattttcgagccctgtaactcccaagaaattgtgcccgtatattaaaaattcacaaaacgaatcgaccctgctctatccaatggcaaataacacatatgcatttccgagtagcgaggttcctttgttagtcccgggtgagtctcgactatttacagtgattctcgactatttacagtgattctcgactatttacagtgattctcgactatttacagtgattctcgactatttacagtgattctcgactatttaaactgagtaaaaaagtcgatggatttatggggaggagggaatggaatcggtcaatgtttaggaggggcgtaccccacggatttaaattttacaaaatgattgcttgcatattttgtagcgcaattatcatgaaattcatacactcccccccccccctcattattaaaatgaccaccgttccgttcagcatcattagcagtccgtcacaacaccaaaatttgttttgtgtgataaggaaaacgataagaaaatgtgaatgtaacagcggcagcagcgggggaattaattgtcaacgtaaaaataaaaataaacaataattattaattaactaataaagagagagagagcgagagagagggaaagaaaggagtagggaaagggagagagaaagaaagagaggaaaacagagagtgcgagaaagggtaattaggaaaagcaattttacagagttgcccaaacgcttgtcccgatttaaaaaaagatatacgtttgaatcagaaaaatgtttttgtcttaacgactgggaaaattaacaaaataaaaacatttactcaaaaatttcctcattttcgagtgaaattttatttaattaaaaagatttctatttaattaatttcaattaattaattaattcctcggttttattcgtgaaatacttaaataaaattttaaatatttgattaaaacatttattaaagtcgattggaatgaaaaagcaaaatgcaaagaatcctactacttttaaataggcaattaattaattactgcccattttatttgtggaaaagaggaaagctatttcaatggcaactgcttttgcttttctcattagcaaaagcagagaataaattattccgagctcagagaccggcggcgggcgggggcccattagtgtgagagtgaaaatggcgatttatccgcctatttccagcagccacgcacgacccgttactgcttaattgctttaattacgggtcgacagggacatttcaacgccgccattttggcaccgaacccatttaatacaccacaccctttttctaagtggcttaacctagacaattaatattagtttgaaaatcaaaatgtttagaattggcaattaaaatctagaagaatctatgaaattatgnacagggcggtgccacaggggccattgccgggcattt

SEQ ID NO: 7543 - DNA, 960 bp, Heterodera glycines
agcgaaaagagaaaacaaaatgcacagaaatccctttttcttactaacaacagaagcagcacaaattagtgttgacagctgaagttgttttggtgttcattagccagcaaatttgtgttacttgttcgagaaaagagtgccaaagtttttttttttgcattggccagacaaaatccccggcggggaaaggaacaaaaaaatgtgacggggacagggagaaagtgtcagtcgtccgccaacgtcggtgaattgtgctctaattgctgtcggacagcagcgccagtggaatttttgttgttcccccgccccccaccctccggcggtggcgttggattgattatgttttacatttttctggtggtgggctggtgcaatagagagaaattgtgagagaaattgtgtagtgaaagtacatagattatgtaggagaagataattgggcatttgcaaaaaatttaaaaaaatgtcggttgtatgtaagtttacggtcgtaaaaaatgttttttacttgaaaagaagtcaaaaagaattcaattcgacgctgatgcaaaaaatttaaaatgtttctaaatgctggttatacaaaagataattatgttttttaacttcctttaatagttttgacagtttttaaattttttagaccatttttattagaatattatttaattttctcttaaccaagggcttaaccctgctacgagttgtggttaaaattacaagggaaaaattaaaccgcggttaaccaagggaaaacgcgaataccaaaaaatgaaaatacgtggtttagaggcgttaaccgcggttaagcggccccttaaccgcggttaaataaaccgtggttaagcgttaaccatggttaaaaaagggaagacgagaatcgcggtttaatttcttaaccatggtttacttattttaaccgcggttaagaaattaaccgcagacggggataaggcccct

SEQ ID NO: 7544 - DNA, 1475 bp, Heterodera glycines
tcaaaaaagttttaaaaatggtcgggtgaatcgtaggatcaacgccgtcatcatcatgataatcttaaagtaagtataagcttaggccgaatctttaggctttggcttcacatttagctggggttgaagtggatgcattttcacatatcatttccattttttatctattttatttaatcaagaatctcaattaaatagtggcaaaaattccgaaatagtggcgaaaatggcaaaatagtcgcaaaacgccaaaagtgtgggtttctgaaaaaatgagagaaaaaacagctcatttttcattaaaaaatgaagatagttttaattgagatcctaataatgaatttatagagaagaattttaagtaaaaaaaataattttatttttatattaattttttaattatttcaatggcgaaaagtacaaaacagtgatccctattgacgattagtggcgctagaattaattgtgtttctaagataaaaatacgtgtttttttttgtgctttctgatcgaaaattaaattgtagatacaaatttattcatttttttgaacaaatgaatcctccgaatttacttttgttcgttttgttcattttttctttccaaattcattttgcccattcggatgacaatgtaatttgcggaattgcaagtaatcaagtgttaacatttaaataccaatcgaggaaagaaccaaaggaaatggaaatcaaaatttcattatatgcaaagaaatctggtgtaattttttctaaaacttaacttagaaaccaactaatttcaggaagggtcgggtcaattaagtaattggcagatgcatttaagtgattgatccttttcaattaaattacatttaattgaggaaaacaactcacaaatagtggaaaattctgcgaaatttatctttcaatttcttaagtaatcttttagaattaattatgcttttttaagactgtgatttttgatggttttatcaccgaaagtgataatttgagcaagaaacaatgtgttgtcatcaaaatgtatcgcaaatcagatgaaaagttttataaaaatagcgtaaatttgtggaaaaaattgaaaaaagttgatcagaaaaatgaatactttgtcaacataattgactagtaaattagaattagtttaaatcttaaaaaatattttaagaaaaaaaattataaatatatatatttaattttttgttgaaaaatgtaatggccaactttttttagtggcgaatttgacgaatcaagcaagcactaatgtgactttttttaaaaacatcatgcggtaaaaattaaaaaaaattataaattactcataggcttaaattatcacttatatatttttagcggattatttgatgaatccccccccctaaaaaggcgaatataaagcaaatccgccgtttgttgtgccgggaaaatgcacaaatcacaaatttgtaaaaaaaaatctgttggtaatttaggtta

SEQ ID NO: 7545 - DNA, 2507 bp, Heterodera glycines
  misc_feature (2441)..(2441): n is a, c, g, or t
cgaagccttaatttactcaattaaatgcgatcacaaatacacgaaaataaagaaggcggcttacgttggtaagatgacgaatgttgaatttctgaaaatgaatatttttaagaaattttttttactattaaatttttgttttaattaagtgcataattttattttaaaaataagagacggcacaattgacattttgtcaaaaaaaatcgatcgagtaatttccctttttcggttttttcgatatcgatcatttcaaaatttgtcgaatcatttggcaattgtttgataaataaagtgattgcccattgtccatgagataaaaacaaacaaaaatatttatacaataattcaatttatttatttaaaaccacacctcatttttactgaaaaatgaggagagaatgaaggcagtaattgtgcttccgatcagtgcggtgtaagtgttgacaatggcacggtttcgcgcatccacgccaaaggcatttgtggcattgaatgatggccaaaacacccacaaaaagccggttgctaaatcaaacaaccgataatgtgtgctaattcaactagtataagaggtcgagtctgacattcttggtactgaaaccggcttataataaaatgtgctaattgccccttaattaacttgttgattagctaactcaactcaccaataaatgtcaaaatgtcagagtggtaaacactgccaaaatgttcactttcacgccaattcttgttgtacagaatgcgtccagcaacaaggccgaaaacagcaccgaacacatgaatcaccattgagctttaataattaaaaatataaaagtaaattatttaaaaatacaatttcaaaaaagtgagatttttgaaattatttaaaattttccaacaaattaattttaaataccctccaatgtcctggactcccaacatcttcacaaggatgtactcgttgaaaatcttaattcgattttaatgatattttcaaattatcatttttattatttaaaattcaccgaaaatggcgcttcaatcagtgccatcaacaaatattgcattggcgacaatttgccgcacagggcaccgtatgaaatcagcacaaccgcagccgtataatcagcatttatcatactgtaaattgagtgtttttcaattaaaagcaattcaattatttggatgggaaataatattaattacttctgcaaattgacgtaaaatttgccattggtggcaaattcgtcggtgaggaagccgcggacaaggagctgtaaaaaggttttaattctagagaatttattaatttaaacttttttaaaattataaaatacacttattaaaatttttgatttgaaacaagttgtataataatctattttaattttaaatattttagtgaatgtgtttaataataaatattataataaattttaattaaaatgttttaattaaattttttagtttatatgtaaaaatcaaatttttaattaaaatattgtttttcttttaaaacaaaataataatttttttaatgtttatttattctaccgataattccaatgtgaacgaagtcagcatcattgagatggtgaacgatgcgaagccgtagcggcgcaaaaaagcgaccaaaaacccaaatccgatgatcaaagtgccgtgcacatcttggaaatctgaaaaactacgctttcaactctattttttaatttaaatattatttatttattatttttgcctgtgtattttcgctgtgcctccgctgcggccacattgccaaggggaattgcggacggcatggcattgggctcatgttgggagaacagcccgaacaagaccaggaagaacagttgagcaatgcccaacagcacacagaattggttgtgtggcaatttaacggttgcctgaaaaagttataaaaataaaatttccgtcgaaatagtttttttttcaataatattttttatttttcagggtaccataaggagaaggaccagcaaaaagatggccggagagacgagaatcaaagcctctgtcaaatattgtgaaaatgtagcattcattttctctttttttttgctaaaattagtttaaggaagaaaattgaatttttttttttttgaaaatccgatttttctaaaaaatgtttcatatacagtaataatggcactatttatgctaaataaacatcaattttcgtgctaactaataaccaaaaactgcaggcctttattacaatatataagatatttttgagaaaatcatttcaaaaaagaaattgatgcaaaaaatttttttgcacatgactgtaaaagacggacaaatttgggtggtctcggattttttgggattttaaattttccacaagcgtacatatcattaatatgcattatcaaatatgcattccacggggtgtgaaaggattattacagcccgcataaggacattaaaancaagtttgggttggaagtaggctcagaatatgtaaatttagtgacaattctggttttgcaacagct

SEQ ID NO: 7546 - DNA, 1558 bp, Heterodera glycines
  misc_feature (14)..(14): n is a, c, g, or t
  misc_feature (23)..(23): n is a, c, g, or t
agtaggctcagatngtgtaaatntagtgacaattctgggttttgcaacagctgccgattgtccgattacgcaaaatttgcattttcaattcgtataatatcagagataattaaaatagtttttaactatttaaaaaaagcggattaacaattttaaattatacaataaagttgttggaaatatgcttttttagaaaaagctcgacaaaattgagcaaaatcatagtcatagataaagaagaaatttaaaaatattttttagaccataaaaaacaaattaaatttccttaactctgcctcgacttagggataagaatgctcaagaaaaattaaacccaggttaaacgagcatcaaaaatggaattaaacacgggttaaaaaatccgctaacaatgattaaaccgggtttttaacccaaagacgagcaacacaagcaaaaatgttaacccgggtttggtctccgtaacccgccgggtttaaaacaggcccctgattaacgcctaaaattaggctaaaaaagtgctttcctttgaccggataaatgacatttttattagagttaggcacaacataaaagtccaaaaatgaaaagactcgtaaactgaactgatttgtgagcccttaatggagggttcaattagaattcagagagcacacaacagcagagtggtgcactgttacatgtttccatttggccccatttttatttttggaaaagcaaagaaaaatagcgaaacattttgcggagagggggggggggggggggtgttatgcttcgcacaataataacaaacaacacaataaacacagatagaaagaccatcgggaggtgtgggctttgctacgcggaggtgattgactacctcgaccaactccctgaaaaaaaggtagcaagggaacaatgtgccagacggcgaggggacacttcgcttgggactcagaggggaaaatgacagagtgttttcgttttgtacaaaaggggtggtctattgtgtgcactcatatgctcgtgtaactgacgagaatgcgaacggtatcgcctcctgtaaaggaaggaaactactaactttatctctctaaaaatgatataagactgcagctttgcactcccgggggctgcacgaaatattggccggcacaaacaacgctgtagtctatttgacaaaaaatcgaagaattttgcatgagcagcttacagaagatttcgcgagatatagaatagaattgactaatgcatcataacagatcagagaaagcccggtaccgattttagaacggtatgcagagaaaaagagcgaaaaaaatattcaaaatattcgtaaaaacattgtttactattctaaacagcagccgaacatttggtcacctttagaagaagaccgaaaattatcagcaatcgttttattcgtaattaaaagagaaaatttttttagaacaaaatttttttcaaaataaaaaattttttttcaaggggtgcctaaagaataggcaacaataaacaattttttggtatggatttgtttttcaattaaaaatttggaaattaccttcaatacggg

SEQ ID NO: 7547 - DNA, 1614 bp, Heterodera glycines
  misc_feature (1521)..(1521): n is a, c, g, or t
  misc_feature (1559)..(1559): n is a, c, g, or t
  misc_feature (1578)..(1578): n is a, c, g, or t
cccccccgataagacaaagtacggggaccaatgttctgctctgctgggtgttgttgtgctgtgtgaggaggagggaagaggttgatgtgtgctcatcggtggtgatggtggtggtggaaaatggtaaataaccctcgcgggcagttgggggggggggtttatgggacgcggcgggagggagaatgagtggccgaaaaagaacggccaactgagtcatttaggcgaccaactgagaaatcaaagtgctaaaagaacggccaactgagtcaccagaacggttttgtggtaaataaccctcgcgcgcagttgggtttatagtgcgtgggtgggccaaaaaagaacagacaatgagtcattttagaaaaaaagtatcgcgcgcagttggctttatgggacgcggcgggagaatgggccagaaaagaacgaataattgagtcatataacttttgtagtaaatatgtaacagacatcgttgaattgtcttttttggggggaagggttggccgagaacgagtggggccaaccgagagcgattttgatggtaaacaccagcgttggttgaatttatttatgcggaaaacatggtgggccacgaatggaacggccaactgagtcatatgtcagtttagcagccaaagtgagaaaaaggaaaatgggaggaggattcatttattctcaccaatgttgttgtaaacgggaaccggccacttcggcgcgggccatttcggcgccgattcaaataatttttttcattatcaaccaaattaaatatttttattatcattcgatagctcttaagattctctattagcctgcaaaatttcaaaaaatttcatctgtttacaaaaaaggtatggccaaaaaacctcaaaattgactttttcttggctttttcggcgccgcgtgccataacttttttattgttgaatcattaatttctattttggcatgtaaatatagagcacacatagagctttcaagtgatgccagaatggctaaagttgactgacaaataaaaaagttatagcatttcaaaatttgcggcgccgaaatggtccgcgccgaagtgaccccgacccgttgtaaacatattttttagcttctatttaattgataagaagaaattgtgaaaattttattgccgtttaaatgaatggatgggatggaaaacagcgattaaaacattaaaatgagtgtgcagtttagacataaaattaattaattttatttttttcatttatttttttagatatataattggacaaactgttttcaaatacaatacatgcatattgtcgttatagccagaattttgaatacatatacatatacctacaataatattaattttagaattattcaaatatttaatttatattacctttgatgtttatattatataaaaatttccacaaaatatatacaattaggcagacctaaaaatcaaccattcattcattgccaaaatgacctatgcattgtttcaaatacaagtgccacgctccttcacaaccaacacantttccttttgtttttgcattcaaattcagtccctttgngactcagttgttcactggngtctcggttgacccttccccctcccaccgctcaccc

SEQ ID NO: 7548 - DNA, 2059 bp, Heterodera glycines
  misc_feature (19)..(19): n is a, c, g, or t
  misc_feature (47)..(47): n is a, c, g, or t
  misc_feature (133)..(133): n is a, c, g, or t
atgcaattaattattggcncgcgcagtgttctttcgacgcaaaaganaagcttcaaaaaaaactacaaagtgatcgaatgaggaaatgccaagtcaaaaatattgggcgggtcgagaaaacactgcgccggcnggatggcatcgattccatggcacggattccgacattaaccgcccagcagatccacaatgttcgctgtggctccctgctgttgttgcgggtccgtctccatgctaatggtactcctctgctgttctatcggttgctgttccgtccgttggcattttcccgtcgtttcgattgcttcgcatccgttggcattttgctgtgccgtagtcgtcgtcgccgtctgaatgagtcccatggcactcagttggggtgcccaaatcagatcttcggcctccgatgtcaaatagcgatggccaagccgtttctccagacagatcaaatcccaatatgtctgtgcgtccttcaaccatcggtggccaatgcattcgtcgatggtcagccgttcttcgatctgatcgaaggacaattgaaaatttaataattttgaaaaggattggctttttgataaacccggggcttcactgattaaccgacttggactctgagcagtcgttggatcaaatccacagcatcggcactgatctgaaaccaaaaaatgagaaaattgttttttatgttttgtacattttgccaaggcgccgctgggaacatgaactcggcattttgaatttgttcagcaatttcttcgttcctttgacggaatgttttttttcaacttggcacatcgttgggccaaatggcacaactcactcattgaaaggaaatgtgccggaaagtgtcacataaatgatcacacccactgaccacatgtccaacgatttgttataccctgaatttaggtaatttcaaatcatcttttcgctctgatcagtgatcagacaatggcattgtgttttgtctcaccctttttcttgagcacttccggggccaaataggcgggagtgccgacaattgtctttcggaattgcgtctcgccaatgaaacgggcgtagccaaaatcgcacagtttcgtctggggaaagttggaatggaagtcggaaaggagcacattttctgttcaagttaaaggcattatgttttcgactttttaataaaaatttgcaattttcaaaaaaatattaattcgcattaaaacccaatttttgggatagaaaccctaattaaacctaatatcaaattaatcaatcgaaagaaacaattcgtctctattccgctcactctgtcgtccaattgtcctcagaattttatccgaattttacccggtttcaaatcgcagtgggcgattccgcgatagtgcaaatagtgaagggcgctcagaatttgcataatcaaaaatttggtgctccgttcgttcagccgtcccatggcctaagaatgaatttggaataggtaaaatatgccacaaaataaagatatttgtagaaatgtataaactaaattattatttttaaatgaatcggagcaaaaatcaaattaaaaatatattttaatgcccaatttcggatgcttttttttttgttttgctttacctggccaaggatcatctccaacatgttgccgtccatcttctccatgaccacaaatgtcttgtcgtcggtctcgaacatggagtccaacttgatgatgccctggtggtccaccgcctgcagaatggccatttcattatttgaaaagttacaaaactcaaaatcgcaaaacttggacaattttaggacaaaatctgtaaaagttctgggtttctcatcccaaaatctgattttctgagcccaatgttgtggttttggattatcggttacaatacgttcactcaccccgcaaaaaattttccaaacctattttcagtaatttctcaaaaaatttctagggttagaaaattaaaaaaaaattttccgggggaggatggtgaggtggggaagagttgctcattttttaccaaccttcaccgtcactgctctgcccgactgtcgctgcactccgccgtacaccgtc

SEQ ID NO: 7549 - DNA, 3473 bp, Heterodera glycines
  misc_feature (43)..(43): n is a, c, g, or t
gtatttgtgccgagagagccaaccaaagctcccaaattttctncaacacaaaaagtcaggcccgaggaggtgcgaatttcaaatgcatgaggagcaaatctatgcgatgggaaaagggatttaccaataatggcaaaattcggatagaaaaagcgaaaatggcattaccaaaaaattggcattaaaaatcgaaaatatttttattatttaaaattatggaataaaaaaggaatatatttaaatggaagaaatgctatgctgaccagcacagtttgtcgttgtgattgatgtaatgtttgacctacttcggatcaatcggaagtccttcatagggaatcaaagcgacgatttcagccaaatgaatgtgacggaacacgcgggaagtgttaacacctgaaaaagggggacacgcgtcgatcagtgagtgatcagcagtcaccgactgatcagtcaatttttttgttcggtgccgcccaattagaaaaaggataaatcaatatttggtaacaattgattcgtcgacaattctcccaggcgggtcggtcaaaactgcgatcagagttttgtgaaacacccaccgtcgttgtattcgttgtacaaactgatcactccgttggccaacacccaatagtgccggagacgccgtcgctccttttcttgcagcagaaaatggatcagccatccttcgcacaacggttggccagcagcggcgtgccgcaccgaacgtgaagacgcggaccctgaaagggggagggaggtacggtaggcattgcattggtaccgtaatttccacaaaacccagtaaatgccatccttccttttgctgcttattgttgcccctttctcacctggcaacctggccaatgggatcatcgcgtccaacgacgggttagccacttccattgcctgctgttggctgtgtcttttgtgttccgttgccccgccattgtcctgctggaagacgccaaatgacgcactctgatcagtgccgcccattggcaaattcggctgatcagtggaaaatgtcaatggattttcggcattcatttgacagtttggcggcaacaaatggacacactttttgtgcacattcacctgttaattgataatatggaaaattgtgacattctttgattgaaattgagaagggtttttttcaaattaaatcaagccgaaagcctcggattttcattgcaaatccaaaacttttcttatctgatttcattataatccacaaaattttaagcacatactcggcaatccttgcagcgtaagccttgcttgaacacgcccatcaacagtttgtcgcacactttgcacaccgttggcgttctgtaattgtgtggccacagagagtgcggcagttggaagtacggctgctgcttctgctgctgatgggaatggagctgttgtgactcagtcgtaccttaaaagggattccgatgatttgtttaaataaattgcatttcttaatgttcagtgagtcgtttttcgcttacttcccacaatgctcggcacgggaaactgtccggcaccggccaaaaaggtggtcggcacagtctctgacttggcacaattgttgcgcggggctaaggcgcactttttgtggaagttgcacctgtgaaaattcagcagctggtcaaaagtggtgaaaatctcaagcgcgattgaatattattgtaacctttattacgcgattaaatttttgctgaaaatgctaaaactgatcaggagataaatacgatcagttgaaagagatcggcactgttaaccccgacgcacttgcacagtcgacattgcactccctgcttgaccagcccgatcagcatctcgccgcaatagtcgcaaaaggtcggtgtcacgaaagtgttcacctgcagcaagtgcggtttggtcggcttttcgctccgatcaatccgaatgatttccaccacacttccattgtcctaaacaattaaatttctcaaattggtcataattgtgccgttctcggctatttaccgaccaattgtgccaacgatgttaggcaggtcagcatgttgaagcttttgtagtcgtgcagaaacagctgcacctcgctggctgtgacctgcgcggaagtgcccgtcggatggcctccgttagacgaaatagacgactcaagttgcaactgtttttcgaccatttgtcgcgctttctgtctgaaaagtgattttgtttaattaccccaattagtctcgttcgttcgacctgaacagctcaaaggcgcccatatcagctgtcctctcgacgattagcaactctttcattggtccatactgaagtgcgattgtgatcacttgctgttgctgctgctgttgttgttccttaatgaaaagaggatttggactgatcatttctgcgttagatatttttcagtcgatcatcgactgatataatatgacgttggacagagatattccccagtctaccattcatattgattgatcacagccattcctttatattgattgatcgggtctcattgcccattcaaataggcaatcactgtccctttcccctttatcgattgatcaattccccgcacccaaaatttgtcgggaaaatgctgctgctgaaaagcattactgctcgaattgttgttgatggtgctgttgctgcaattgttgtcattgctgttggctccgccattgttttcgttggggttctgttggagcggtgcaattatcaaattctgattggtgtggttgttggccaacgcagtgggccaaaactcggcactgtttagcagaaaactgccgcccccaccgtttttagccgccatttgcgcctgctggggattcggttgtgccgggaacatcgaattgggaagcatttggcaaaatgccaacaaagcgaccggacaaatcgccttcgcttacaaattaacttttggaaaaggggcaattaaaaatcaaattttaaaacattttaaacgaaaaaagcacccaaaatcaaaggataactgaaatgaataactgtgatcaacaacaaataatcggcgttaactttatgctcaaatcgattgagtctcacgcaaaagaaaagaatcattcattcttcggcgggtgcgcattgatttggtcaaattggtttgagtcgcacaaaacatttgtcgaagaaagtgctgcagggcacagccaaaacacacaatgccaacccaaaggcaattaatcaattaattaccgaaaaagacagggcaaatgcaaatcaatgggcgggggggagggggatcattgcgcagccgaagtgttgggatcggaggagagtgcgcaaaacctgttcatcctccagcagcaacacgacagcaccatcggtgagagagagtgggcgaaattgaaaattcggaggagcatataaaaagggagggggggggggggcggatgaatcagcccaattcgaaaggggcgggggagggatatgaacagcaaagcaaagcaaatgcatcacaaaat

SEQ ID NO: 7550 - DNA, 1221 bp, Heterodera glycines
  misc_feature (27)..(27): n is a, c, g, or t
atttaaaatgattttcatttaattttntggttcatcggtttattttgaaatttgtcatcctcaacccaattacacgttgagaccacgaaaatataccccctaatcggcaccgcatcgaaaatttcaaattttcgccgatttttcatattctttaaaaaggcatatttttcagaacgtttcccattttaggtttaaaaaatttttcattggggggaaggaatactcgagcccaattcatagccggaaaatgtcttataggttttgatttcgtgtcttttgtccatttttgctctgttttgtctctcttcgctgtccttactcgttcaggctgatgatctcgcgcaactgttgcggcggccgcagcatcaaatccacgttcagttttgtgtgcaaaaagctttggcgtggagtttctgcactttcttcaacagcgccgctcgctttgtcccaattattttccgaacccaccaatagaaaacgaatggtgttgtcaaagtccatgcgtaccaatgccaacgcagtctctgagcacatacaaaattttggagtcaatttcaaaaaaaaatttactgtgagcaaatgtaacgcagcgattttagcagcgccaagtaggtgttcgagctgatgtttgacggctggaaaacagtaacaagtttcaatttaaatatttattaattttttaactaaagcagcgatttgatctgaacattttcaatatcaggacatcaggcccaaaaaaatcaaattttggcatactttttgctctgttttgtctctcttctctgtccttactcgtccaggctgatgatatcgcgcaactgttgcggcggcgcagcatcaaatccacgttcagttttgtgtgcaaaaagctttggcgtgcttgaagttatttttacaatttactggatcaaaaatatatttatatataattttttcaccacactttatcgattataacaattttggggagaaattagcaaatcataaattttaatgcatttgggatcaaaaaaccagatttttaaatgaccaaattttgcctcaaatcttatattttcttgagaaaacattaacattctgccataaaattttaaaattattaatttatttaagaaaccagaacaatttttggtcgctacctccaactcaggacaaatgtgacaaattaggacaaatctcatccctaactaatttttcatattttttaaatcttgacatttt

SEQ ID NO: 7551 - DNA, 2854 bp, Heterodera glycines
tttccatttacatattttcccactttaaattttcaggttttttccatcattgttacttaattgccttaaaatttggtgccgcagccaaatcggtagcgccggcgccctttgacaaaaggcggtaccgctttcgacccatctattgctgctgttggattgcgtttgatgtgcatgcaagctgtgtaaattatgcgcccatttttgagaaagacatcatgtgcgcaaaagctgtggagcccaatgtggagcaattaattaattaattacagattatgtttatattgtatatattttaataataaatattccattttttataaaatgaatattatggattgtgcagtacatttccctccgtcatccccaatatcgttcactccccccgaaagaaagtttttaattttataaacctaaactttttcaagaaatttttaagaatttttgcagctaatttttgaaaaataatataaactaaaaatacattgataaaattttttcataaaattttttaaggcactcccggccgattaattcaaatcctctcaagtaatcagtaatgaccaaatttttggttgctacctccaactcaggacaaatgtgacaaattaggacaaatctaatccctaactaatttttcatattttttaaatcttgacattttagaacacaaaattgaatagaaggacccattcccccctccaataatgcctgcgctcaccgaaggtttgtgaagaaaacattttttataaaaataaaaaaccaaaaaacaattattctaaatagctgttttacattttttaaacgactttcacataaaaacttttttagtctataactgtgcgctttctttacggaacaagggcgcggcatgcaaagacatcaagtggcttatcgctacttataagatcaaagccacagaagaagacgacataatcgatgttgttgattgtcctggaaatgtcttcatggggtgccagacattctcttgtttggctggttgtttcatttttcaatttaaatatttattaatttgatatattttttcaattcatgccaacttcagaacaaaataatgatatatttgtcttgaatggatgcgccgaaacaaaaagttgttcatccaaattggagaaaatctgtaaaaaatatgatggatttgcgtcatgtgttatttgcaaaggaccattgccagtgtgcaacaaagaaaaaattgagttaaaggagccctttccgcccttcaatgatggccatgcccatcgatggttgtgtagtaaaaaagttttatttgcacagttgacgaaaacgctaccggacaaattgtgagcaaaattgctgccgtttcgtgtgctaattgtttaattgaaaaggcaaacaatgagaaaatgcaggtgagtattttgcagcaaattttgaaggatcaacatcaattaattaaatttttattttattttcaaataaattttcagtaatttaaatggtaattaataacgggaaattcaggaacagctttttcagcggcaagagcaaatgttggccaaaattgacgagttacaaaagtccgtttttgcattaaaagaaggacagagctcaattggtgggttaattaaattaaacagatcataattaaattaatttttggaattattttaaataattaaattcatcattttcaatttatcttaacttttttaaaaaaatcattgacacaataaagaaaagtttaaacgagaatttggtcttaagggaaaaaaacaacatttttgaggattttacatatctagggatgattttaaaaaataaggacgatattagtgccccgtcatcatggcttatgaaattttgaaaaatgtttttttaacaaaatatttaaaaattcaaaattatgccaaacatttgtgtggaatttatgccaaattaaaatgtttttactttagtttctgtttttgaaaagcaattttcttcgctgggaacaaaattggacgataaaattaatgagttgatgaactcaaaaacaggatcgattggcgtacaaatggtgaagtttaaaatttaatttacaatagaattctttttttaattatttctttttcattgctttgttttatagtggacttggaaatttcagttttttgacgccgaaattcgcattccgataatttatcggcggatttagaatctaaattattgtaataattaacttaaaaaaatttctcaaaccctaaaaatcccacgaaataaaaaaaggaatcttccaaaataataaaccatagaaaaaaaacgcattccagcgatttgtgaagccggattttcagagtcgtgcactttttggcgccgaatactcacattcctgcactttttagcacccgattttcgcattccgggcacttttttagcgccgtatattctacattccggcactttttagcgacagattttcgcgtttcggtgtccgttccagcccgatgcccctcttttctttaaattgttaattgtttttgtgttcccttcctcctccccgcgcacaatttaaccgctaattcatcaaatcgcaacttttctcccccaatttcattacgatttttgccccgttcctcccgcccaaccgccgtaaaattgtttgtcactaattgcctcctccgtttatttgtgcggtaaaaacccaaaaattggtgtgatcaaagtactccattccctccctcccaatttgtgatcgaaatgccccattttttcaccatttctccaactgttgcccgtctctcatcatcccatttttcgcccaatttctgtccacttttgcaattttttatgtaattttgttaatatttaaatggccccaaatgaacccaaattcgca

SEQ ID NO: 7552 - DNA, 1342 bp, Heterodera glycines
aatggtgaagtttaaaatttaatttacaatagaattcttttttttaattatttctttttcattgctttgttttatagtggacttggaaatttcagttttttgacgccgaaattcgcattccgataatttatcggcggatttagaatctaaattattgtaataattaacttaaaaaaatttctcaaaccctaaaaatcccacgaaataaaaaaaggaatcttccaaaataataaaccatagaaaaaaaacgcattccagcgatttgtgaagccggattttcagagtcgtgcactttttggcgccgaatactcacattcctgcactttttagcacccgattttcgcattccgggcacttttttagcgccgtatattctacattccggcactttttagcgacagattttcgcgtttcgggcacttattggcaccggaaattttcttgcaatttttttttttttgcttgcttgtgggaaagcttacacaacaaaaaatattacaatacccgttttacagttgaaaaatgcgtacagtaattgttgggatgtcgccgcttgtcaccccaatttgctcatctccaactcggcatcaattaatgccccactgaacaaagcccagcagctactgaagagcagcaatatctttacaacagctggcggtgcgattttggcaactttgcccggatatgtgcgcaaaagtgtggtggtcaagcataacgggaagaacagcggtaaatgatggtgacgaatttcgagagtcaatcccgggttttctcaactcgagaatttttcggcatttttatctgctgttataagcttgacagcccaagatcgacttttgttggtcagaagcattccttacatatccatgttgtttaattaagtattgtatcgtttaaattgctaaaaaaatgaaaatggaaaaaagtttttcgtcaaccaatgctaatgataatcaaatagttatttagttaacgattttaaagtgttcaagctctcgtctttttggatatcaaatcacacgtgaaaaaggggggaatgggtaaatagttaaatttagaacagattttgtaagaaattcgttatattagcaattttcactcgtgatttatattggttcgtcagtctataaagttgttattttcataaaacaaaccctacgtgtatttcattatccgattgattgattgtgaacctttcggcggacgattttatgttcccaaaaggttttttaaaaagtgctcgcaaaatatgttggccaaaagagcgtaattgaagaattccgtctgtcattcctttggtgttgagtctagaagaaagcgaagttgacgtcggaggcgcttt

SEQ ID NO: 7553 - DNA, 4700 bp, Heterodera glycines
gggggttcgggttccaaaatcctgatttctgctcagattttgcattgagagttttgggtaccagtacttggggagaaagagattgctgggggatttgtcaacagtttcctgagactgctgagattgggggatgggaaatggggcatgagaaacattatattttgggctagggatgcggagaatcagatatggtgttggaagcttccataacttcatcccaatttaagggattaacattttcaaatttgactttggcaaggggagcattttcttggattttgggggggtgagattacttccaaaaagattatatccgggtccgaggaagaagtcatgggttgattttcagttcgtggtggggaaggagccggactattgttggacaaattctgattttcagaaggagaagagaccgagataagggccaacagagtctccatagaggatagaggagatgaagggacaacagaatgtgagagaggatcaaaagagtcagcaggttcagtagaatatgctgccggagtgatggtcgaatcagcattagttgtcagagcttggagcgattcttcaagaggagttgtcggaaggagtctggggcatttcatctttggaatccagggtttcgattgtcgtttcggcatacttaatgtggcagtgaagagatattcgaggagaggacaaaacgagattagaaagcaacacagcaatgtggaaacgtggtaaagcattgttagtaaaacaaacaaaacaaagcatttaaggagaacttggagtgcacaggaggggtcgataattttggaagggaaagaggaagatggggggggggaataaaggtgtgagacttatgatgtttatttgagaagggacgctggggaatgaggaatcctaaaaccttttaatttttcacgaagttccattagcagttggcccatggtgtttcgcccagtaaagttccattgacgaatgtcgtcaatggtggcaccagcgccccagaatcggtcagtgtgactcgcttcaaccaaaaatttctccccagttgaaatgaggcactctgccagggcggggttctggtcgaacttgtggaagagaatctcttccatctttgactgcttcgtgctgtgccacacttttactgctgcggggtcagcttcattttgggcacaagccccgagtcgttttgctacgactggggaggtggttttcaggatttcggtgtctatgtcgtatctttggaagaatgttgcttttgtggattggtaacattgttctgacgaaaggaagtgacaggaggagggagggtagaagaagggggcggggtagaagttggagaggtatttgtgttcggggatgttggacaggaaggggatcattctgttggggaagggagggaaacgcgaattaatcataaaaattttgggtgcaaggcggtgtgaaggaatgaaaacaaaaaggggaaagatgttgtaaaaaagtggtgtgagaagttaaaaattaattgtgagtatgaaaatgggtaaggagaaaagtgcatttgttattgtttaaaactgttagaccttgggcgagagcggagattgtatttacttttatgcaagagatcccgctgagggaaaaccgcttgttctttgtcaatagaagtaggtaaaatttggggtacattggatttttgggtatcagaagggagggtttttggtgaaatatcaggggtatgattgaagcctatcgtgtttggtatctcggtggcttcagctgcttctaaagcagctttttcagcagaagagaggacgggggaggtgctgggaggaccggaaatctcaaaaagtttcttcagttgattaatatggactttaaatgggttggattgtggggaggaacaacttacgatggtgacatggagttcttctatgttaataactctgaaaacgcccttccatggattgtgaaatttttgggaagtgcccggttttccagtataattccgtaacagaacacggtccccaatggaaatgtcgggattcctaaatttcttatcatattgtacttttgatttattctgagcctctttaattgagtcagctgcagaattccaggcttttcttagggaaaggacaaggagggttttgaactcagctaagtcattgtgagggagtggtagatggacggagggatcaagaatttgatcaatactaaagattgggtctctgccaaacacgagaaagaaggggctttcgccagttgattcatgaatggaagtattgtaacagaaggtagctgcgtctagaaattcatcgaaattgggctctttgggattgatatatttagacagaatattatgaaaagttctaaatgtcctttctgttgcaccattgccctgggaccagtaaggggtggagaatgatttattaatatagagaagggaacaaaatgatttaaagaagtctgaggtgaatgtggtggcattgtcacttattaattcagtgcaaccaccgaattttaagtaaacatgtcgaaggagagcctttgcagtagtgagagatttggtgtcagggacagggactgagatgacatatttggagaaccaacaaacgaaatttaggatgtaacgatttcccatttctgtgatggggaggggccagctaaatctaaaccaattttggcaaagagagtgttggaagggaccgatttcatttcagctcggaacatggggatgggattatgccggagctggcagacaagacattgtttgatccagcgaaaaatatctgagtgcaatttgggccaataatatttttttgaacatttttgtagagtctttttgagactcatatgacctcctcccatgattggaatgtgaaaggagtcaaaaatcagggatctgagcgagacagggatgaaaacgcgggggtaactgttgggaggatgaaagtatagtatgtcagaagagataactaaatgttctgattctgaaagaaatttttgtaattcagcttcagagagatctggatgagagccatcttctaaaaatttaatgtgagaaagaacttgggggtcatttctttgttcttgaaaaaggtctactttatgaggaataccatccttggtacgaatagtaagggaagagagaattgggtcaaagttatggacaatgcgatcaaaagggacaagagagagacatacaggaaattcaatgatgtcttgtaactcttgagagtcacttggaatttgaggaggatcagattcggaaagtctggaaagagcatcagcaagtgcgtttttcttaccggaaatatgaacaattttaatgttaaaattttggagttctattagccaacgggccaggtgggcatgctgttgtgcctttgcttggaggtatgccaaaggacggtggtcagtgtggagctcaatttcagacatataaatatatggtttgaaggttctgagggcatagacaatggctccgagttcgatttggacagggggccaacgacgttcgggggctgatagagtgcgagaggcatatgctacagcggaaaatagatcatttttcttttgcatgagagcagcgccttgaccaacgactgatgcgtcagtgaaaatgtgaaaaggttgagaataatccggaaaagtgagaatgggattttgagagagaagttccttaattctggtcaaagcatcttcttgtgccttgtcccaaataaatttcttttcttttttggtgagagaagttaaaggctcaacaattgttgaaaaattgggaatgtgacgacgataaaagctggccatgccaacaattcgttttacttgttttagattttggggagtgggaatatttttgatcacttcgatgcgtgagagagatggggagtaaccttttgatgagacagtgtgaccaagaaagttcatggaagaggcagcaaaagtacattttttgggagagagttttagattgaatcgtcgaaatctttcaaaaatagtttgaagggcggagagatggtcagaaaatgaggggggtttggtgaaaacaagaatgtcatccacgtaggcaacaacaaacccatcaagtccggagaggacatgggccatggttctggcaaaagcagaagtggcatttctaagaccaaaagggagatgtgtcatttggaaaacaccttcttctatgattagtccacattttcgtgaggcttcttttgtgagggggatttggaaataaccggaagataggtcaagagaagagtaaaaatggcagtggccaattttctccataattgtttcgagacggggaaggggataatggtcagggatagttatttcattgagcttccggaaatcaatgcatggacggagtccaccatctttcttctggacaagaacgatgttagacacccacggagtgtcagattggaccatgacaccagacttaaggagttgttctatgtgctttttgagctcatcccgatatttgaaaggggttctatgtggcttacaggtaataggttcctgcgttgaggtgacaatttcatgggctccagcagtgctggacccctagatcatattgagatttgctgaaaatgtcagagacctcttctcataaattttagagatatgaacgatcaggcacactgtcggaagatatagaaaactcaatttagaaggaggggttcagggagttataccattcatgcccatttggggggaaagac

SEQ ID NO: 7554 - DNA, 1614 bp, Heterodera glycines
aaaaagaaaaaagaaagttgcccttttttggcaggtgaattcatttgcactgattgatttgttttgtggtaattagagaaaggaaataaaagaaaatgttaatggaattcattttgcgtgaaaaatcatttctttggcgcttaaaatccaatctgaaattttaaatcgcataatggtaataattaggtaattgaatcactaatgaggttgattgattgatgcaaattaattaaatgaattggtccccttatttggaattgttcgttttgtctgtcccctttgcttctcaattcactcactcatctgctgaccacaatgctcacttgctccggtgtcaaattgccccctgctgagatggcattcacttgtgacagtaattcgggcgacggagcgtacggtgactcgtcctcttggcccactttgccctccagccaatgggtgaagcattcgcccttgccctacggtatgcctttccttcggtcgctcctccacccaattaccgtaccttaatatcgattttcccacgtggtaccgttctgaactcggggtaatgcttgtgcagcgcctccatgtaatattcgctgcactgaatcttctccggaagcccagtggactccatccgcgaggccatattcacctttaagtccattgtttttatgctttatcaccgaaaaagaatacggtcttacagtgtctccgaacagacagtaccgcggggtggacagtccgacaacgccggcggcgacctttcaaaagtgcgtttctttttgattttgccttcccttggcattctcactggtccggtgtgcagtccaattcggattttgattttttgtggctttcgatgcgggatttcaaagcttttgaggtacttaacattgaaaatacgcaaatgaaacgccaaaataaaattacgtgtaaaaattccaaagcgatgtcactgagatgcatcaaatggcgcactccgatctcctgcggaatgccgctcaccaccatgtaagcatcgccttaagcctccttcacagttacaaaaatgccctttcgtaatgccatccctccaattgccacccccgtccccattctccccctcctccgcccttttttcccaccgatcgtctccactttgtaagcttcatgtttgttgatcaaatcgtcgaatccggtgtaaacagtgttaagcattgtaacaacttcaagaggagtggaagatgaacagagtgtggtgaagccgacaatgtcactgaaatggaaagggtttgtgccgagtgaaaaaggggcaaaggtcaacggcaaacctgaacatgaccgaggccgttttgaacgtcttcggcggcactgaccggcccaatttcagttcattggccacatagcttaacaaaagtgattgatcccatccttcgtttgggagggcacctcggcagaagttggttcagcaatttgtccgcgcgtttattcgcgtcctccaaaaggccggtcctctcttgcacgagcttctccaaattgttggcgtactgttccatcatgcgcatcatttggtccacaagagagcccttcctgcgatcggtcggtccgatcagtcaatgccctccccccccccccccccctcttacactt

SEQ ID NO: 7555 - DNA, 5902 bp, Heterodera glycines
  misc_feature (5890)..(5890): n is a, c, g, or t
tgacccgtcgctgtgactttcgtttccgtttgatgggccttcacctgtggcactctcctcagccgacttacccgccaaatcggtcccatccggaaatggcaggccgcggaaaaggatttcatacatgacaattccgaacgcgtaaatgtcgcccgcctgccgccgcgaggcgctttgcttcatccacatctgttccagaggtgaacgcaaatgcgtaatgcgttttgcgtgttttttcactatttgcgtgcgcatatttttaaatttgcaaaaataaatcatttctgaacgaacagtgcgttcgttatgcgcggattttgttatgcgcacacccctgacctgctccatgccacggcgacggttctgctctctgttcttcagcagttccggagcacagtacaaaacatctttgggcaatgatacgatatgggacagggaaagcgactcattccaccgtaacccctgtgtctttccaccgtactctcctcaaagatcgtccgcccccgtatccccccccccccttcagcagcccctctcgtccaacaataccgtaccccttgtcccgtcctcccaatttgaccgtcctccttctcaccccctctaatactcacttgtcagttgagttgctccgcttctgtcctccccgtctttcagtgtctccttggagatgtatcccgacttctcccatcgctcttcaattgtttttccataattacccccgcgggggttcgcccctttgactcaccgatacaattagcaatggcaaagtctgtcagtttgaccatcctatttacaaaaagttttccgtcgttttgtttgcgcctcgtctactcaccaattgcggtcgatcagacatgaccacggggtgagtgagccgtggtacccaatcggactcatgtgcaaatactccaagccctgcaatatttcattttaccaatggccaatttgtggtctttgttctgaccaaagttatgtctcgcacaaatgcggcgtggaatttcgcgtcaagcgtcacattttcgttgtaaatgatgtccttaactttgcaactccgtgctgattggcctcggtttgctgaacctgaattgtgccgcgggagcagaatttccacagcaccagcagttcgtccttctcattgaatgcgattcccatgaacgggttcaaattgtcatggaccaattgcttcatcagcgacaacagttggaggtcggcgcgggcgaaagagatgggcctccgctgggggtacagatggaaagaggcatgggtgttggtgccgatcaccgcgtggtgtttggcaaagcgcgccatgttggacattttggttttggaggagccaatggaaagctaaaaatggggggaggggggaaaaatggccaaagggatggacaatcggacgaaccattgacttcatctcctcaatgctgactatacgcatatcatcgcggaaaatgcgccaagcagttttggaaagagcacgattctccctaaaaagtgggaaaccagtgaaagtcgggggggggggagaattggccaacagaattcggaagaagatgaagccggcaccggcgccgagcagtgcaatcagcgcgagaatgccgacgataatcatcagagtataatcgcatcgctcgttgcggaagccacagacgggctaattgggggggggaagggcttttcggtcggtatgaaaagggttttgaacttcgtcgggcggcagtcggccgtctgtggaaggccaaaagccggtcaaaaggtcggccagtttgagctcaaaacagccgcttttgttgataattccatcgcaatttgtggacgggaaaggcgacatttccacctgacaaatgaatgccaatgaatgcttttgcctttctttgcttttgcctttgccattctttgccttcgcttaccattttcattacgtcgtcgcgatttggagcgacataaaaagctgaacaacacacgatttggcttcacatttcttcacttacctgcgtaaacagccgcacgttctgccaaatcgtccattatcacctaaagcattcatttgttggcactttcccctccaattgtcagctacagtaagcttttccttctcattcgtttgtccgatggtaacatcgtcctactgtacctctttgtcagtgtctcggttatcccctgctgtcctacggtgtctcccttgtctcttatttgcttatcacctctttcttctccccctgccccaccacctgtcccgaagaaacgccctcggcactgacaaggcctgaatggtttgttcgattggcactacactaattaaggtcattagacagaccagggaattgcattcgacgcattttgttccacaggtagcgcccgtcgatggtcacgttcggattgccgcccgtttcgttcagtgccattcgcgcggcaatcgaataaagtttaagcgcatcgtacagatggacgtatccgtagatgttttgctgaatggatcaacagatggcatttggtgcgtcgttctgttgctcaccaagttcaagtcgtccacagaaagtccgttggattcaacgcgttctttgaacggtgccagaatggaattgtcgaacccattcacatcatcaatctatgccagatcggcaaacgatcaaaggctagcacagaaaactgacaatgattgttccggcgaagtaatcgcgcacattttggatcatttgcccgtccgtgccaatccatggcgacgcgtcttttgcttcggcctggagccacgggaggatgtagacgaactcgtgggtcttcaggttggccaaactgacggcttgcatgaactcctttgtcatgtcacgagtggaagagaacacacaaatgatcactgatcgcatggataaaaatgaccaaaggcaaaacgatcaaaagcaatgaccgatgggatggccaatggaaattggcaatgaaatgagcaaataaccaatggtactggccaatggcaattacgaatggaaatagccaattaaatggccaaataaccaatggtactggccaatggtaattaatggccctgataatggcaaatggcaattaacaatggtaatggacaatggcaattaacaatggcaattaccaagggaaattgccaatggaatggccaatgaatgccctctgttccctgccactgacccctcgctgaatttttcagatcctccaaatatccgctggcttgtatcattttggcatctgcgttctcttcgaacagtattttcttgacgacggtcacgtgtctctggtggaagacttcttcaaatgcctgcgtccgctcaaatgccattggacctgcgattgttttcttattcccttccaaacgatgccttcatttcatacccgtgttggtcacaatggcaacctaagaaaagggcaatcattttggcattttatttaaaaaataattaggagtcgctgataacgaaaaaggggggtgattgactgataaggatgaacttactcgattccaattgtaatggcggactaaataatacaccgcaatggccaaagagtttgtcttaatggccaagggatcagaaagtcaattaggcggacatacggtgcggagagaaacgcgggcaagtgttttgtaaatgtttttgtcggagaagatgttgctggcagccatgtagccgatgattggcacattccttcgagagaaagcgtttagacaaaagagtcgggactcaattagcccccccccccctgaaaaaagttccaaaacaaaaaaacgaacgtaccaaaaagccgccattttgctcaccttaacatttgtttttctttagttaccataactcatccctaattaccgcatccatttccgcgttacagtatggccctatgaatgccttcacattttgctgatggaacatgtccgctccgactgccactccttcgaaactttcaccacagcccatttgggagatgatcctgaaggtggctgtgtccccatggcccctggtttaactctttcctttcccgtgccaaagtccgttccctgcccatgcccaagtccactcttctcaacccccccccccccccccgcgggcaattgcactgactccacgtcaaagtcttcgttgagcactccctccttccacaactctttgcggcatatctccaggatttgttctgccttcggcatcacatttattgctccgatgtgtccaatgcgcacttttatcccacttaattgagaaggggccaaagaatgccgtacaaagagagtgactaattgttcacttgaacttggggttgttcatcagctccaatgaacgggcggtggtcgtttcgacggatgcctaaagaacaaagaatttcgttggattggcgagcaaaaaacaaatcggataattttgggtacgttgttcagttgatttactgctgaagaattggagggccgagaagaagccgttaccaatttggaggaagaagaagcattttgctggagacgaacacatggcaaaaaagaggagaaaaggaggaggggaaaaagcgaggacattgggggaaagggaaggacaaatggacgcgaaactttggaaggaagtgccacggaaaggaaaagccggccaaaaaggacggggcaaagccaatcaaagcaattgccactaacaacactaagcgcggataagggaaatccgtcagaccaattaactaatgggggggggggatcaaaggaaagccgaccgtattggccaacgcgcggggcaggcgggaaaattggtggcaacaaatccctagggaaggaaaaaaaggataagggatgatccaaatccaacgggaaaataaaataaattgaaaaagggcgtcgggtgttatcataaaaggtagcagcaaccaggcgggaagattgtgaaagaaactatgccaaaattcgacaaacacttttatatcattaggcaaatgaccgaacgaatattcggcagaaaaatcgcaatgaaaccgaatcaaatcgaatacattcgaattttatgccttcttatgaagttttactatctttctttttttaatattcttttatataattgtatcaattttcattgtaatgacttttctcttccactaaaactttttaattaatcttatttattttttaaaaaattaattcaaatattttgatcattttgatcacattagattagtcataaatcacagatcagatccaagacaatcactgattgattggtgcttatttgtcagtcaatccgtcggcattcccttttccacttttgctcctctttctttcatcttcttcctcttccttctcacttttcccattcgttctttcttccgtttgtccgtctttaattcgtcttcggcctttcttccatctccatgctttccctcctttccgagtgccattttcgcttcacttcgcccgttttgtcctccgccgttttcggtacaattttcaccgatgacattttcgtcttcttctgctgttgttcgttttgggctttgttgtgcgccatttcttttcgtctcgccccattcctttcaatcgctgcgccgcaattttcagttggcatcgaatcggaagagagaacccccgaatttgtggtagttgacagttttggcactgaattttgagtcggtttcgaaacggaacgaaaacgtaacaattggaacacttctcttctgagctgaaaatgagaaggaggatgacggcacttctgctattttaagacgaattgttgtgccatccaaaaatacctctttgtccataaagccaacaaaaacatccaaaataatgcgaatcaaaacgaacagacggattaagccgagcgaaatttgcatcaaattgtaatggagaatgaagtaacagttgctggaaaacatactgacaaaagggggggaatgattgaggggngggggggggggg

SEQ ID NO: 7556 - DNA, 974 bp, Heterodera glycines
atttgtcatgtcattttcggcattttgtccatatttcccgtcccttttgtcactcatctgaaatgccattttcggcactttgtccgcctcttcttcgcctccaattgtcgcatatccgtccccgtgttcctccgttgtcgcccttttttcctctccaattattccctttgtttttcgcgtccttttttctcgatttttctttcgtcgattttcataataatagatttgttccgatgtcacaaaatcgtaaggaatttgccggaccgattttggcacaattcggcccaacgaagtcatccgaacgcggaagtcgcgcacaaagtcaactgtggtggtccaggggagaaagggagggtacagtactaaaagtgtgtttgcctaccgtacaccgtttcgccaacgtaacgcctcaaatgaccgaattggacgatgttgggctgtaaaagcaatttttaatttcattaatcgtttttttatttcgctttcttcttcaccttaatcactgtcacttctctgatcagtgaaacttcgctgaatcgaaatttcttttcacactttcttttgttctcttctccgtctttccttttgccaattgttttttctccgtttttggcacttttctgccaattgtgccgttctaattgtgcttcgaaagtgcgtctccattcctttttaatgttttaattaaatttattttaatttattttatctttttttcgttttctcatttttccaccttaaaaaaggctttttcttcttcattttggtccttcgcaattctgtccattaagccggtgaattggttaaacaaagttttgacaacggtcggctctaaatgttttaaatgtttaaatcagggatggtatcgtccgaagtcggtttccaaggacggggatgccgatttgcagggacatagtggtgaaaattcatgaaatttcaggacattaaaatttttattatatgcaatgcaaaat

SEQ ID NO: 7557 - DNA, 2109 bp, Heterodera glycines
  misc_feature (71)..(71): n is a, c, g, or t
ttttaatcgctttctctccaaaaagctatggcacttctgtgcccaccgctaatggccatcgcatcggtcanaatggtgaaaaaaatccaaggcaaaggaatttaaaaaaataataaataatcatcattcactccgactattaaatttttgaagttaatcatttgtacttttattttcttaaaatgtgccatcgctttttttctttcctttcgctttttcttttacactctctccggcggtgtcttctcatattattaattaatatgcacagtcatccaaaaagtggcatttgcccattggcaccttatgaatttaccaaataatttcaaaaaagtcgcggacgaatttttagagagtgtaaagccaaaacattggacgaggcgtgaattttgagtaattgtgccgaaagagataaaaggagaccgacaaagaaaggaactcaaaaaaacacggcatccctcgggggaaaaggcggagaaagtgacggaattggtaaagcatcgcatcagaggaagaagccaaaaggggccccagggggccgaagggtccgccgaatttgccaataaatcggaagtatttgaagcggcaaaaggcaccgattgggcgacgcttctcaaattcaattgcaatcaaattattgtttaaaactaagcttcttctttttattattctcgaaaattatttatgtgtttcgctttcattttttgtttaattattttaattttgtttttttcagtttacataaattattttgaaaaaggaattgccccgaggcgaatttttaaattatgcaaatgaaactccaatgaggggagaaagtgagaagctcaaatgaaaagcccatttcaatcggcacaattttcaaagcgggaaacatttgaacagaaatatgccattttatgcttttgagcattttttgactcgaaaatgtaaaaaaaaaaacaattaaataaaccctttttaatggacaacagaagcaaatgccaaaaataaaatgcatttgaaagcattgggtgaatatttagaggctatcattaagcaaatgctaagcgatcaaaaagcataaaaaacgaaaaaactttttcgagtattcggctataaattctctttattttttaaaaattaccaattttttccggcggcgcttttcgccatcgtccgactccaattctttcataattatttattctcccacaaaagtccttttgacaaccattataagctgtggcaatttctaattttaattttgacctctcttttcttacatttttttgggttttttcggtgccatccgtcgcttttttttttggtaaattccaacgctttgtaattacttaatttaaataattaaaaatccgccagtgttcgtcgtattattattattaacattttctctcaaaatgaaatgtttgcgtcggtcgtcgcaattattttcgcattgtctacagaaatttgacactttgtccccttttggcaaatgaattggcaaaatgtgttgacaaatgtccgtccgtttgatgggaaaatgcggtgcccttttcattttctgctttttctgtgtgaactttttcccttaaattttgttttttcatcatttttatgtttattttcccttttaaatacgatttgctcccttttaaatttcattttttaaattttgacattggcattttaccctccccctttttctctgatggcactatcctcccctatttctcaatgttcttctgctgctgctgtttttgtcgaccaacacaaactccaactgctccggcaaccacggcactcttccctttcttcttctccctcttcctacagtaacccttccccgtacagtacgccttcttctgatgacagtataacatcatcgttgaaaatgcaatacaacggaagagatgagaataacgacgagggcgggcgatgggttgcgatggcacgggcagcggcggacgacgggggcggcaacggcggaggcgtttttgtcatgctgcaaaaaaggtggggaaggggggaagacaggtcgagactctcaactgatttaattgtaaaacaaaagaatggccgaaactgatcagtcagtcagtggattggctgattcggggagctttt

SEQ ID NO: 7558 - DNA, 2664 bp, Heterodera glycines
tcgccaattcgtcccccactcctttcccaatgttcgacttcccagctttgcctagcagtgcttcgtttgcactcagttcgccagttgcccaattgtcccattcgaacgccgtcctcgtccaggacaatgaacgactgaacgacagagtcggggtaatacgataagacagggtgtatctgataggtgatggtattgtgccgctgttccaggagttggaactgatgttgcgtgaccatgtggcccacatcaactccatttaccactctctgcactctttgcacggtttccatgcgcttcaattgcccgacggtcaaaaaaaaaaagaaaaataatatttaaacccaaagatcaattcattttaatttcagggggaattggtccatctgtcccaattccacggctttcctttgcgtttcatttgcaccaaaacgaccgaaagtgaagcgattgtggccgatgaggagcagcaccgtattctcgaacaggcgacggacaaccggcatacggtgggccaagcacggcgctttatgctgcagcagcgacaaaggcatcgtcagcagcaggggagcgtgaatgaggtggtacggtactcccccatggtgtcactgtatgggaatgttaccgttacagtatgattgggtgggcattactgtttttccgcttttcgcccttcctccaattttactttcctattgtcagtcgttgtcctccggctcctcctcctccttcgcctcctcctcgtccaccttcgactcttcgtttgctgctgatccgactgacttttccctggcgatgatgcgacgtttgtgcattcgcccggtggcacgggacgacagtgaggaaatgcaggtgaagagaaggagattcgcagtgtccaaattcgaatggccaaattaggcttttatggagtggctgaagagcggcgactccgccggcaacgaaagcattgccaacggcgacttttccgccgccctttcgccgctcgcagaggcgacaaaaagctgcgcatggctcaaagcggaaatggacgcggaagggacgagcggcaccgagtcaaagtgataatgggggggggggaggaattagcagcataagcgtgagagaatttcagacaatccgccgagcatgaggccgcgagcgcaaatggcgcctccgttgcgtcatccgtcgcgcagcgttcccaacgccaaccgccggtgtattcggtgatgagcaaaagccaacggatgaggtggccacggcatttggccctttccaaatgcatcttcccccaggactcagtgtccgtctctcagctcgcgccgccgatcgccgctgctctcccccacctcgtcctcctcttccgcctcgttcctcgccgccccctcctccccctcttccgccacattcactcaccacggcggatttggcggcggcggcggaagcgcgtcgggcgccgatgaaacggcggcggcgcggtcgccgcgtcggagcggcatcggaatcacaaatatgaaaagaatgggcagcagaccatcggacgcacaaaagtcggcaaaaaggcatctgatctgatcagacaaacattggaaaccgacgaagagaaatgccaaagtaaaaaagacgaaagaaattgtatgtaaattatttttatggcaccaaattaaaaatttcgaacatttcatgtccaatttccttcccttctctctgtctctctttgcttttttcatttgcccttcggcgtgctctttcctttttgtatttctttgctcatttggacaggttttatctgcatttagctgcttcaccttttgtggtggatgaatcatcgtccattgcattttaatgctcagagaaagagagaggaaaaaagagagagagagagagacattttgggaagagtgagagagtctttccttggaggaggggggggggcactttcctttaggggtgactaattgttgtaggccgcctaatgaatgcatttctgtgcgcaaaagccactcatccgcggtcctttgaaagcaacaaccggtcgtttgatcgttctttcgatttgcttctcccattgatcgtcgcaaaagtccgtttccctccaaaagctttgtataagccaaaaatataaaagacgagcgatcaaagccaaatcatttgtttaacaaattcaaaattgacttttgaactgccaatctccaaaatggtgcttctttgctgttcccaacataaaatggaccgctcattgcccaattgcctcagggggtgccgttgtggcattttggtcggcagaaaagggaagaaaaatgtgccgaaaagcagcggagaggagggaaaagcggagcaatcgcagcagaggaacgaacggaaacagaacaacgaaaattattattgttcagtggaagagatggcttacgatgcgatgtacgacgaaaaaatgccggcggatgaacggtgaaacagacaataattagttgctaattaggcaattaaattaattgttcttttgtagggacaaaacgggcacagtgcttcaacgagttgcgatggcacttcagggaaaggccggccccgaacaataccaacagttcaaatgaaaagcggtggaagagaagaggaaaagccgttttgggtggaaaatacaccaaaaaaacgaacaaattggaatttttttcaattttttgttccaga

SEQ ID NO: 7559 - DNA, 5595 bp, Heterodera glycines
atgtctaagttagtaaatttttcggcgctttttgtccggacgacgttttgacccgacgacgtttcggccgacgacgtttcggcgacgacgttttgtcctgctccgtaatgcatcaattaggcaaaaaatatttttatgcatttctatcgaaacaataattaaactcaaaatccgattccctgatgaggttgtcccgattgtcagtattcctttttcagctaatcttttgtccaatgccttaaaagattgaaaatgcatgcaaacttcaaattttcatttccccctttaagtccgcaaattctcaacggactgttgagctgagcaccaacacaagggaagtccaagcagtccctgaagaccagcagcaccaccagcaacagtcgttggacatggatgccaagcagcaggagatggaccagcagcaggaactcactgttgtttagcctctaatcaaatagaaaaaagcacagtacacacaaaacaacggtacctcaaatgtcgtactgtactgtcgtcctctcaagtcgtttcttttccctttttttggttgaatgtttgtacaatttttgatgttaacaacggacctctatcatcacattcatttttatcattttttatttcacgattttagacattttaccatatacaattcttttttgtcacatttttacgagattggactgagaattttgcgaattgattgcttagcttatttacgaaaacacctccaatgccatggttgggacattttttgtagcagtttcacccgtctacagtacccattctgttgtaccatgtaccataccccgtcacccttcgcctctaccgtaccccatgactatgcgcgtacatttgttgatcattgacgggatttattgattctttttaataaatttatttaatttcccccttcgaccggtgttcgttcaaatggcattccatccatacacaatgttaaatgttaattagtgctgatgtcggctagtttttttaatttggggaggggggcaaagttttttcgaaataaattttaaaaaattttgaagcacagccccctcaccctcatagttaattaccattttaaatattatttaaaaaatagaaaaacgagtacattttggtcattgaaatgctctcattattcatattgtatttacgaaagttcatattttattctatgttttcttctgcagacctcgtaatattattctgtttcattttgtttttttttaattaattttcgaattttgggggagaagttttcccatttttatttcttttaattagccacactcatcacatataatgtttgtgttattcattaattaattatactctattattatcattatttcctcaacaacaaaatattctgtggaataaattcgttgtgaaaaattttcaattaatgaaaattaatcacaaaacatttaattaaacgaaacttttattatttaattaaaataaaaggtattattggcaatttcatcattaaataaaagggacatttactttgtttttgagcaaattggccgtttattttacaattgagcggataattatttattttcatgcaattaaaggggtttatttaaactcgaacttaagcgaaccccaaaaacgggtttttgttcgtcgacgaaagaaagaattgagcactaaattatttgttggcccatcaaaaggtcctttttctccccaatgaatacatttttattattgcaccattgaattatttatttttaattattattttgggatcagttcttaaaattttgtctgtttattcaacaaaaaatgactgcaattccggtgaaacgcgacctttgtaagaaaaataattaacaaaccaattaattgttttgactgaccagcaccaaaattaattgattgtcgaaactttgatgggatgccaattcaatagttctttatgacctctctattttgtcaatgtttggcatttcggaaatgtttgaattggcatagtgaaaataaacatttcgcttcagtcgccggcccttcgttgttctcctcgcccagcaacaaggccgacttcgaggtggagttggacgtgcaccaattcgcgcccaacgaaattgacgtgaaagtgtccggtgatgacgtggtcgtccattgtgcgcacgagtcaaagggtactgtaaccatatgcctgggcattacagtcaacacaaatggcattgcaattgctaataattcttccactttttcgtttttatattttccaacaaacagttggccaacacacggacaagcgcgagttgcaccgtcagtaccgcctgccgctgggcgtcgacccgggcacggtgaaggcccatttgaccgcgaccggaagtcgtctgacggtcaccgcggccggcaacaaagcgacgggccaaccgccgcctcccccggcggtgttggccactcacggcaccacttttggacaaagcatcatcccggtcaaacacgtgcccgcttcgtcatgtgagttttggcacggccaataattggcttttctaaattcattttgattaatcatttggcttatttcactttgctttgtcagttccgatcactcaaaaaaagcaaaagttccaagtggaattggacgtgcaacaattcggaccgcaagagattgatgtaaggctctgcatgtttaattttataaaaaaacgcaggtgaaagtgagtgggttcgatgtgatcattcattgtctgcatgagaaaggtgaattgggacagaaagcgatggcaacacaatgccaaacattcaaaatgctttatttttgtggaccagaaaatggtctatattttttcgttttgtcattttatgctacaaaatccatttaagggggggggggagggaattgaaaggtgctgggtcgttacttaaaaaccatcataatgggcgttacttaaaaaaccatcattatgaaaatttttgtcgaaaaattatttataactttgctcgaaagcaaccaaatttttaattcttgatatcatttgatagccctaagtgttctctatcagtctgcaaaatttcaaaaaatttcgttaagtttcaaaaaagttatagctcgaggaactcaaaaaactttgattttcgaacatttttggccataactttttttaaacttaataacattttttgaaattttacaggctcataaagaacatttagatctatcgaatgatagcaaggattaaaaatttggtctttttagagcaaagttataagcaaaaatgttcattatggtggttttttaagtaacgcccattatgatggtttttaagtaatgacatagcaccattctctgtccatttccccgtgatcagtgctcagccgaagtgcgcagagttagttgtatgcaattaccaccaacaaatacataaatggaggagtagcaacacaaccagtagtcactcattcattcttcttctgtcagttgtcgtacgtccatttgaatttgaatcgccctaagtgggcagcattaaattaaattgaattgtactgcccccgaggtgcttctctttttactgacttttttgcttcgctaattaaattaggtatttgcttcattaatttttgttgaaaatcacatcaaaataacattgatcaatttttctgttcttaattcacttttcaaataaattcgtttactgtttgtttattcccttctcaattaatcctcccccccccccatcagcaacaaatttcgcttcatttttacttgtacttatgtcattacaattaggtaatcatatcaatttaattgactattccattaagaaaacaaaagtttttttgaggggtggagaaattttcgttttataaagaatttcatatttaaatttaagcatatataatttttggctttctgccaataaatattttggtaaaaaagtttaattttttttttcttccgtagttaaaaaccgcacattttttgagtcgcctatttttgtgctttcctaatttggggcattgaattttctgggccataggctagcagcttctgtgctgctgctgctgtgctcttccccacattttgtggtggaatttggcgctggagggggcggagggagtggtgaaatagtgttggttttaaagagtaggggaagaagggggaggatggaaatagtgttggttttaaagagtaggggaagaagggggaggatggaaatagtgttggttttaaagagtaggggaagaagggggaggatggaaatagtgttggttttaatggagtgtaaagagggggagggaggggaagagagaggttaaatggttttccctttccctcctttttgctctcttttgtgtgtttgcctttctctctatcattctcttcgtatatgtctcttcttcctctctgcttctctactctctctctcactcctttctctctctcgtatgtgtcttcccttcttcttcttctctctctctctctctctctgtgtttatgtctttcacttcctcttcctctctctctatccctttccttctttctttctctctttctccatcttttcctccatttcttttcatttcacttcaatcatttaatttctctcttttattccccccgggttctcttctctcttattttagtgccatttctttcttcttttcttttttgtttttcaataaaaacaatgcctttcttcttctccttctttctctctttctgtccccacatttcttcggcaatttcaacgcacaaacacttcctaatttgttgtttatttgtttttcccattttttccattttttttttttgcttcatcaatcccttcccatttccatacataacacatgttttaacccctggcttccacataacacttaatccattcaatttcaattcaacaacttttcccattattttttatttttcaaaaaatttatggacccaataaatctcacatttattcattttccgaggcccggtcctcgccgataatctttgcctggctggcgctgtcgtcaccaacagcaaatgtggctgacctcacccaacatcattttgtcggaccgattttgttcttcctccccttttcccccatatttactcgcattttcacatttcctcgcccccgcccgccacttcgctcaaaaaccaaatcgttaaatcgtcttctaacagaaattgggaaaaaatggggggcggggtggggaaggggtggacgcggcgcgcggctcggggctcatcatcgtttgcgcaagggctgaatttgtgagcccagcagcagcacagcatggcgaagagcgacttgacggggatggacggacggttgactctgctggggcggtggtggcgacgcattttgcgagagattattgcctttttgtaaatgctggtggctgttttccttccttgatttgcttttcctcatgctgtttgttgctgctggaggtgtccacggctcgactgttttgttaagacggagcccccctccccccccccccccaaaaaaaaaatccaggaacttctttacaaattttgccaccattgttgttgtgtggtttgttatgtgtgtgcgtcggagcggcgccattgctggtggctgcttcatctcctcctccttttattcg

SEQ ID NO: 7560 - DNA, 1599 bp, Heterodera glycines
tttaaatttttcaaaaaaaaaagtatttttacaacatgcgttttaattttgattgaattttcctcttttatctttttttcaaacaaattaaattaacaatttttgtatttatttattatttgtctataattttcaggcagaatatggctttgtgatggccgacaaaattggcacttcactgttggaacaaaacagggaattgcaggaaaagtcagtcggtggcagttttttttaaattttttactttcaatcctcaaaattttaattttcaatcattttttctgatttttcccatggtttcaggaacgaatttctggaggcatcgttggccaccagccgtgacaatgtggcacagctgaagcgccagttggagcagcgctgtgacctgttcaagaagttgcaactccaactcgagggcatggaggaggaggagccgaacgggacagacaaataccatcagacggggtgagcagaaaactgaaaattcttaggacgaatttaacacagattttttgtaaaaatttcagccattcaaaattttttgagtttgtcaaaaaaaattttttccaaaaattgctgaaaattttttcttgaaattttcattggaattttgatagtcagacgctccgcttcgggcgggggtcgaattcaaaaattcgttaacgccattgaactcttacctcaaattttctatgtcaaaatgcaaaaataaacaacaaaaaaaaagggggtgggcgccacagcaccactttattcctccttcaagtggtttgtacgggtttctgcctgccctttctgggcatgggggggggatgacatggattggatgagaacaaaggacagacagaccgaacactgatggaggatggagatgcccttgaaaatcgcagcaacaaaaaaaaacccatgaaaattacccattgttttcgcgcatgagcaaaaaaaaaaatatcgtatattgtgtagtaactctacggtagcaaatcattgtgcaaaaacaaaaattaatgacagccaattttgcttcagaatgtgcagctcaacggcggcgcaattggagagcaaaattaaacgattggagggggaaaataaggaattgcgaacaaaggtggggggaaatgagggagggagagggggtgggggacaattcaattaattgagagagagattttgaaaattcccagatcggaatcaaagactcgaaaatgcatccggaccggaatttcgggactaaaattcagttttttccgggttcccttctccggttgcaaaaaagatataacctggttcgagtttctacccggattccggatcgggagcccgggaaatccgtaccggaccatcccaatccaccaatggtatcgaacaattaatgtgggggagaggagaggacggcggtctcatttttcatcattttatttgcagacaaaggactcggatgaattgagagtgattgcggagaagcgcgaggagcagcggatcaacgagtactgctcacgcttgaggggagcaaacctgaaggtgtgggggaggggcgatgacggacaaaataacgcacaaatcgtaccccgggacaaagtgatataaccggagatttgg

SEQ ID NO: 7561 - DNA, 3916 bp, Heterodera glycines
ctttataatatatatttattatacataattaaattttttaatttattttaaacttagagttcacgtttctatactttattcactttgacaattttaaaaatcactaaattaaaatttgcagcaatttttaaattgattatgagttttacattttttcatccaaggcaataaatttacattgtcatctccttaggtgaaagcgaatttagcagaatttatgattataggtacgaaattttcttttttacgtttctttttttacttgtttgaaaattattttacatttgcactttttataatcgcagaatcagcaaaatacattcattactttgtagataattaagtaaacacttggaatttcgaggatttatagacgttcataccttttacatatttttactgtctaatatcgttcatgcattttttttgaataagttgtttaagaataccatttttttgcctttgtaaaaagatatgtatttttatatattttaattgcagataatttaaaaagaaattttatttgaaattgaaatttattctttatatataataattattattaatggatttttgtttaattcttttttatttcatgtttaagaatgatttccaaattgttatcattttatttagaaattgttatttttttctaatttattgtgtttgttttttggttattttttgatgacttactttaatttttttataatttatttcaattatttgtattgtattgtgtatagggttatttcgatttatttgttgaattcaaaataggagcttatatttaaagcaaaatttaaataatttattataggatatttttaaataaaatattttaaaataatttcatattgagttttttgttatgtacttctaaataatatgaattatattttcttaatttttaaaaagaagcaaaaaaataaatagcatttcaatgaaattagcttatcaattattatttttatataaccatttgagtaatgttttacattaattattcattgtttttttgttttattccttcatttaaataattaatttatatgatatgttatttttcggttttataataactaatattcatattgtactaattataaatttatttaattagaattgttaaaaaattaatgcgtcatatattttattccagtcttaaaaaagaattccttttatttgtaatttctaataaaatttttatttcattattgtatacacatttacagatgattttgaattttaacaattattattatgacaatgctgaattttcgaataaaaatttttaataatagaagagtattacttttaaagaattaaaatttaattttatttattttctttccaatatttgataaaaaaaatttttctttaattcttttttaaatattcttgaccagtctcttttattcatgttgattcttatagacgaattattaaattagtaaaagttaaaataaattttttaaaaaacattcccgactctctgtcttttttaatcaccgtctcgattccttcaaatggctttattaagttttatattaaaaaataatggatagtattttcaaagcaacacttggtaatactgccgatggtctcccccctcctttttggaaaaatttttttctgttctaaaaattcgtgaacacacgttttatgggcttttagggtctctgaccacgattctgacatcaattttgaccaatttcgaagctcagacgcgaatcagaacaaaaggtcgaaaattcaaaattttcgaaattcttacttttgttcttaaattgatcaaaatgagctaaatttagtcaaaaatcattgcaacaccaaattcgaacataaaagtgaatttcgaaaattttgaattttcgactttttgttcgaattcgtgtccgggaacgtaattggtaaaataaatgtcagattcgtgatcgggcaacttttatttttcgttcaaataaattttgagtgacgaacacaaccgcaaattggtggtagtgggattttttggtaaataactccgacaaataacgttcgtaaatggacagcattaggtcgtcgagaatgagtaggagaggtttgcaatgttgtttaatcaattcttcagaagggacgccaagtacactgcaacaccagcccgttgaagtgccggaactgcaaattcatttccccaaaacaatacagtatagagacaggctgtggaataattagtaactcgtcaataaatttcaataaaaactgtgttccggaaataataattccacaaggcagtttaaagcaaatatctttatcaacaaatgattttgtattaagcattttagtttatgttgtaatgatgacgtgaatgatttaaatatgcattttacataccggtggtcgctgcttttatgctagcaaaaaattcatcaagagttttatcaatgtcacctacgtcttcttcttcattattgctttttggttttttatccgccttaggcacgctgacgtcatcaatttgcgtggaagcagagtctagatggctttttgttgggtctttcttttcttcgctagcttctcgttttttggtggtttctttttgaggcgcggcctttggctgtgcaatattttgagcaacaggtgaatccggagagtttttgttttcttttttgacggtagctagagactcggccaaaagaacatttccgagcacgttcattgctgtctttgctttcttccagctctcactgtcctgtaaggcatatgccactagtccgatctccaacaaatcgagcgcaacctttgcttttcgtttcaattctcgttgatcactttgaatattttggcttttgcacgtcattggtggaggctctccatacggaattcattcatacatcatcgttcaatcgctcattaaacctatcgaaaaagcaaaatgttttacaaatttaacaatggaatgtcttaccgatcgcgcacgcatgtgtgcggaaatggtcaacgggagttcgggtgggtcacgaaagttggccactaaatggaaacgggagtttttaatatttttaaattaattattttaattgaataaatttattatttaccacgacggcgggtaaaaccctgccggcgaagcgctgtcatttcaaccggccgcgcatcacatatttgcggcaacggtacccgctttacatcgccgaaaaaacagaccaagcatgaaaatagataattaaatagcgtgaaaaacattgagattaaaaatacaaaataattaaatgtttgaaaattaaattttaaacttacaatgagcagcacaacaagtagctgcagaaccacgatcagccaccactgagtggcacacgaaccaccaccatcagtggcatgggcattcgcgaacactaaattaattaaaaattagaaaaaataaataggtaaatgattgtgagtacccgggtgttcttcccctggggaagcaacaaaatccaacaagtttttgatgctcttgtgagcacagataacgggttttgtgtaattgagtggacgaatgcactcattgtccaaaataggacattggcaattctccacgggaagccaagggagtccagagggagagggcatttttattctataaagcaaataatttgtacaggaaaaaaagtacaaatgatttatttggcaaaaacgatatggccaatccgaatggtcatccccaatcaaacttttgatcaattcattcacttaccctttggacaatgcgctgaaggaaacgccacaatagccgcccatccgcttaagaaaaccacccctctctttcaatcaaatgcgagatggttggtccctttctccgtccatccccttggcgcaccaaacaacgggccccgataaacccccccccccccccctccaaacgtgttcgtgaatttaactgaccacctgt

SEQ ID NO: 7562 - DNA, 1329 bp, Heterodera glycines
aattattattttttaatttttaaaaatattttttaattcatcaaactcaccgtctaaaaagacgatgtcctcctcctgatcgctcacatctccagcttcgcgcatcaactgcacccaccgctctgttggacgacaattctccgtaattgtctcggcgcggcaggtggggcatttgccaccacgcttgatgaggtgcttggcgatgcaccccaagtggtaggcccccgtgcagcggcagtttagctgaaccaccattctcgacccgtcgggggcctcaccaggcttggggtacagagcgccagtgcaaaagcacgtttcatcatccatttttataatattaactttaaattaaaaaaaaaagtatacaaataataaaacaaaaaaaaatgattcagatgggggggggggtcataatgaccttcggcatcacaagcgaaggaggggaggcattgcgagtggaggtcataacagtagtggaagaggagagaaaaacggagggggtggtcagcaatcaattggcgtcgtttttccccgaccacgctccccatccgcccccaccaacacaaacatgtccgcgaatttaactgaccacctgttcaccccccccagtgtgcgcgaaatccgcgcacataacaccggtacagacccccatgtgcgcgaaaatttcgcgcactacgacggtcccgaccaatcccccaaaccctttgaccccccgccgacaccctcccgaactcttagtgcgcgaaaatttcgcgcactacgacggtcccgaccaacccccctagaccccaccgacttccctcccacactcatagtgcgcgaaaatttcgcgcactacgacggtcccgaccaacccccaaaccccctttgatcccgccgacacccaccccaaaccttacgcccagcgcgcgaaaccctttgatccgcgccgcaaaaaacgcccaaaaccctgtcgctagtgcgcgaaaatctcccgcgctacgacggtgtggcaggactaactacttttgatatgtcaattgtaattcaataacaaaaatctttgtttaatcttttttaattaaattaatttttttttctttcattcgatatcaccagttccttcatctatgattatgataaaatcatcagtgtttttcttttcatcaaactattccaatgttaattttttgatttaattaattattaaaatcatttaaatttaattttgaaaaaatatttcatttcatctgattcattttctatccgttgaatatttaaacaatttattttagcgattccaatttttgtttagcattgttcaacattaaaattattttatgtatttta

SEQ ID NO: 7563 - DNA, 4207 bp, Heterodera glycines
ccccccccccgtcccccccgcccccgccgggggcgggacaggttttttgggctcacccccgtcaccgcccccgtgactcagacccccgcaacccccgcccccgcgaccttcacccccgcgggggcgcgggggtgaaaatacacccctaagaatggcatattcgttgaattaaaggcaaaaatttatacaattttgaattttttaatcatcttttacaaatttttatgaaataaagtaaattttgcttatattttttaaaatatttgtggtttagtggttagtgcttcagcactaatagaaatctttgttatgagttcaacaccgggtgacgttttccttaaataaatttttttttcctttaattaattttttttctgattaatacagggtttctttatgttcttgtttctaagtgttctgatttgggagtaaatccttattttcatctaaaaagaggaaaacttctgaaaaattttgctaagttctaacaaaattcatataatttcttaaaattttcccctggaggcgcctataggcaccgccgtcccccaaaattcctctttttttcttaaaaattagccaaagatcgaaaaatttgcttattttttgtacaaaatttgttaacaaattgcattcaaattttcaaaaaatttccccggcggcgcctgtcggcaccgccggacctctcccctcgcacattcagcaaattttttggaaaaatgtaccgcaagaaaaatttaaaaaatctgagttccaattttccttgagtaaatcatgattagggctgctaattttatgtaaatacatattttttcctggcttctccatagcctaatcagtaggaaaaacactttcttttttgtgtttgcaaacaaaagtttggacttttatttacatattttagtagatattttgcaaatttgaatatctgttagaaataaatttaaaattcgctcctatcggcacgccggcccccccccccaaaaaaaaacctttttttcttaaaaaattacccaaaaatcgctaaatttgattatttttagtcaaaatctgtgcaatttatgtcaaaataaatattatcaaggcgatcaacgaataaaagaatgtggagccaaagaaattattcataaaaaatattttttttgtgggatttttggagctaattcaaagcaaacccccgcccccgcccccgcgggggcggaattatcgtgcccccgccaccgcccccgcgactctgacccccgccaacccccgcccccgcgaaaagccacccccgcccacggggctcgaaccctaattaggaggaagagggacatcgttgaaataaggtaaataattttagtccgtcagtgtttggacttttttgatcagcacaaaaaattgggatagattggaatttataaaattttaggtggaatttgctatcattttatgtttgacaaacactttttccatcacatattttgtcgactcttaattaactcttcgctttcctcacgaacaattgcaaaaatttattgaagaaaatttgtttttaaagtaaaaagtgtgttttgccaaaggtcagtcggttcattcaacagaatattgaaaaagaactgaccaattttggtgcttattcagcagaagacttttgtccaccagcgtaaaaatgcgaagtaaatttatggtaagggaatactgtaaggaaagaagggaagagacgtggtaacatcacaagttttaaatttacagactgatttaggacaaagtacagtattatattccgcggggcagaattacagtaattcctttgccatcggcagcattttaagaaagaaatttgcaatttggaagtggaaaaccagttcaatccacaacaatgcactcactcattcacatcactttcattaccaattttccaatttcaattcccctcaaatcgctgctcaagtggtcggtcgttctgttgtcctttttgttcgcctccttctgaaaaggttttgccaattccttttcaaaattcgcttttcaattcgaatttattttgtataaaatgcgaatgaatcggccaaaaagtccgtccgtccattcatttcatatatttctccgacatttaaattttcttcctaattcctttttttgtaagcaaaaatattcgtggccctttgaaaaataattccgtgggaacagaaactcaacaaaaagagcaagttcagaattgagaatgttttcaaagttggcaattgccttatttttcctttcttttgcaacgaattgccaaattatttggcctttgtttcatttgggaagaactcagtccgtcggggtacgcttttgccgtcgaaaatgcttttctttttatgctttgttttaaattcacttttgggtcactggcaaattgctctgtaacagcgccccggccgcgggaattctcgtcaaattgtacgacgacgacggttcatttttggctattgtttgcttttgccttggcatttcgttcgttttcccaaggtctgtttggcttcgacgatctgttggccaaaggatacaccgaccaaaacggacatttcgccatttacggctcaaccaacgaaattagcaaaattgagccgaaagtgaacatttaccacgactgcaacgacattttgccatgccaacgaaaaatatcagtcggtgccaagaaacagaggaccaaaaaacaattggacaacacaatgttcgttcagataagtgtaccggacggagtcgtctacgaaggccatcgcccgtcggggcttttctcggtcggagtgttggaacttgggaatgactacggaggagaaagtcgagactgttttcatcgctgacattgtcaaaatatccaaataattacaaaaaaaataaataaaattaaattgaaaaaaacaattaaaaatggattaaattaaattaacttttgttttcatatttagaactgcttctgatttaaataaaacatgtaattaattactggtagaaattcaaattcttttcttttcctctgctgccttagattttgcgaaattaaaattaattaattaaattaattaaataatatttttacttttaattcgacagaaattatttttgtattcccaaaagattctctttccctttggctgctgccgctgtgttattttccgctttttgtttaccatttcgcgacgtaaacaccacactccccagtgaatatttttattatttgttatttttgcttttgcttttgcccctttttcccccggcttaaaattcgttcgtttcgctttaattttttgattttgatttttcaatttttcgtcataattcggcaatttgtcacttttggttagcttttaatattcaattttccgatggataagcaaacttttggtggagattcttctgccaattcggcagcggaagacaaaatgagcggttgctgttcagaacacattgtggaaattgaggttcaaaaatagagagtggtatttaaaattgagtgatttaaaacgaataaaaattgaatgaattggcctttcagtggaaacatttcgactatctctccgccctcagtggcctttacacggcatcggtcgaacgtcgaaaatgcaatttgcttgtgctcgtgcagggcaatttggacaatttggaagggaaaatggtcgaaatgaattaacaattatctttttgaacgattaacaccactagagcccggcgcgggatttgcgggatcaatcccgctgggtcccgtccagcaaaaaaaaaaaaaaattgagttccaatctcgcagcgggatccgaaaatcggttttctgtgcgggatcccgcggatccgtattgtattttttggaaatttaattgaaatttaaaacattttttatcgcaaatttcacccataatttatgaaaaaattcccgacggtgcctatcggcccacgggatcagcctacaccttaataactctttaaaagattgactcaaaaagcgacatttgctgttaataaatcgatttaaattttcaaaaaattttcccggctgctccctacgccggaccttcctgttccccaataagttttttgaaaagcgcgcgcgcagaagtgaaaagcaccataaaatagtctaaatttcttttagaagttccaaaattccgcactccgcacgggatcccgcaaattttaaatacgggatttgcgggattaatccctcaggatcccgtccagcaaaaatttt

SEQ ID NO: 7564 - DNA, 1521 bp, Heterodera glycines
  misc_feature (30)..(30): n is a, c, g, or t
cagcagtttcccgtcgatggatcagctcgnccatgccatggtgcaagtgctgcgccatttcaaaatctctcattgttttgcaatgggcgaaggcgccggcgcggacatttgttgtcgattcgctgtaacaaagctttttagtcaaattggtggtccatcatctcgagtagtgcaaattttatgaaattgtttcgctacattcattgacttttgcatatcccgagaaaggaaattcgaacaatgccaccaaatacattatttgatcagtgtgtttcagttggattttccgtcgatggtccgggggttggtgttgatccattgcacttcgacaacccacggaattgtcgaaaacatcaaagagattgtgagcattttcaccaaatacttaatatataaacctgccctttacaaaactaagttcgccgggttgcgtctcgaagacggcgaaatgactcattcggcgtggaattatttgctgactcaccgttttggaaatgcacgtcattcccatgcttattaaactaagtgaaaagcatatccattgtagcacaatttggaccaaacccaaaagcattacgtggacttgctgaagtcggtgatgaaccaacgcaatttgagccgttatttgtacagtttcggacaccgaagcgatttcactgaccgactcaaagaaaatttggcgaagtcatttggattttacgtgattttaaccgaaaacattgccattttcagcgtggatgttcttttggtgagcggagcgaaggcaccgcacaacgaagtgaatcttttaaattttcgaagtttcggaaatgcatttaaaatgcctctaaggcaggggtgccagcagaaaaaacttcaatcagaatgattgtcaaaacatcaaagttttaggggcattttgaggccaaaatcagaataaggggattttttaagaaactttgcctaaaaatgatcaaattacggttacggttcagtaccctcgaaatcaaatcattttatccaaattttgtgggataattctttctttttctctcagaatatgatgcacatgttcaaaaacatggccaacgaccgtaccggtctgctgatggcggaggactgcgtggacgtactgtcggaggcggtcagtgaaaaataattaatcggataaataattaccaaattaatgaacgatgggtataaatgaccctaatattgaatgaatgagtttgggaagcctttattgaaaaactgtggggcgggcaggctttgaatcgcgtaaaaatgtttatcagtttaattaccggcactgtgtcaattgtcgctcaattaatccattatcttcctctcggagaagcttctctatctcatgtccatttaagcccgacaatgtctcttcggccataattttgctcggccaacgccatggactgctcaatgatttgaccattccgataattaaaaaggccggcggaacggaacaaaacagagggttatagcaaagttggaaacatttgaatgttttaatttcagttttcctcc

SEQ ID NO: 7565 - DNA, 6617 bp, Heterodera glycines
  misc_feature (6457)..(6457): n is a, c, g, or t
cgtgtcccgacatttgcgcttttgttcaaagcgggttcaaaattaagaattttttcaatctctgattgcataaacagttttaaataagcgattgaaagtgattgtatgcgatcagttgatcttcaaaaaattttttgaaaaaataaaaaaattttcaaacaacaaattattgattataatgaaccacaagaccgaattttcttaattttaatgcttattaggctatcagggcttaaaaaattcaactttgcgtccaattttggacataggcacaaatgtcggggcgctccgtacaaaatacgaattttttgagtggagtaaaatgcaacttttcaggagattgaaattttctggtgaaggattttgctggatgtgagaggcgccattaaaaaaaaaattccaaggacttagtaaaacgccatgaacttgataaactggtttttgtttcgtccagtttttatattttttaaattattttggcaaaaaaaaccccaaatccaagtggaaacagtcagacaagtttaaatccttttttccgccaatattcacctcaatgacaatgtccgcattttcgatggtccgtcgaacttcggccgcaaatgaacgcaccgatttggcattggcacgggccccggcttttgtgtcactgttttccgtcgtcgcgcccggcacttccggaagcgaatccaccaaaaattggttggcattgtaattgtcctgtaaaaaaaaataaatgaaatggctgacccctgaaaaattgtaaagaaaatcgggtgaatttttgaaaaatttaactcatttttttaaggaatttgatgcaaaagttttttaaatttttcacggcagacgcctaaagacatggctgggtcccatttttccaaaataggtcccaaaatgaccaaaattggcgaaaattccttttttttctccctcggcgccgaaaatttagaaaaatacattgaataaaaaaatttttgggactcttcgggtgcccctccaagaatttctatttttttttgttgacagcgcctgcacaaattgccattgtaagttaattcattaaattaaaatagtagtaaaaatataaccccctaattattagttagttaaaagcaaacaaaactgccgaaaatgccattttttcatgatattttctcaacaaaaattaaatttccaaattaaaaacaaaacaatcaattccggtggattttatacttcgtctttggccactcgcttcgccagcgcctcaatggacgacaacggattggtcgtcgccaattttttggactgttttttgacgacgccgccgccggcctttttggccgctttctgtcgtgccttgcgctcctgttccatctcctaaaaattagaaaattttcatgtggaagttaaaataatcaaaaaattttgcgtttatgggtcggtcggataaggaaaattaattagcgaccccgaaaaacccctaagaaaggcgttttaacaattaaaaaaaatattttattaaaaaaatgttcgaattcgtgttccggattcgaaataggtcaaaattgatatcatattcgtgatcagcgaccccgaaaacccccgggtactactccgaattgcataaagaaccctttttaatctctttttttatgggaccaataaaatacaggattacccaatttttttggagaaaattgggaagaaaaagaagaatgaactcaaaaaaagagaaataattgcaaaattttataaaataaaagagaaaatcaagcaaaaaggaagaaaatattcagcaaaagaatggagtaaaattaattcgaaaattgcattaatttttctaaaatctctttacattgtgaatttattttatttttattgaaaatatgtttattattttcgaatgagctccagaagaaagtaataaaattttatttaatcattaatttaacaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattactctaattgatcaaattggtggaacggaaaataaaaaattacaacaaaaaacatttgaggaaatatttggagaaaaatgggaggaaaaagaagaagaaaaacgaaatgaactcaaaaaaagagaaataattgaaaaaattatagaataaaagaaaaaaaaagcaaaaaggaagaaaatatccaaaaaaagaatggagtaaaattgaaacaaaaacaaacatttgaggccaaactttttgcagaccctccgtcactatccccccaattaactccaaaaaacagcgaattgtgcaccaattggacaatgccgcctcagcaattgaacaattccacatggagcatcttaccgatgcgcctccatgggcttccgcaatgttgggactggtgaaccaaatggttggaatgtgccgcgagctgatctccatggtacgcgagcaggacggaggaagcaacccgaacagtgtttttgacgaagaacgacgactgcacagcgttgtcatcgcgcaattgcaggaaagcaacagccaaacgccaactcaacgtgcaaccgatgacttggcgaatgtcaaagaactgatggaccattgtgacatcgaatgcctgccgacccaagtgtacagaatgggcaaaaaacaagccgacggacgtccaaggttgctcaaagttgaactcccgaccaaattccataccaatttatttttgcgcaacaaaaacaaaatcaaaaattttaacaaattttccaaagttttgttgcgcccctccctatctaaaagtgatctcattgaccgtgcccgactcattacactgtgtaaatctcaacgtgaaaatgacccatcctgtgattatattgtctatgcggggcatgtgcttgcccgcgacgacattcccgcctttaaatctgacctcaattttaaatgtatttgtcataacaaatcttaatgtgttttgggtgaccactcacgaggcaataaccttaatttagctcttttacaaactaaatatagaaaatttgaacaccccatagaaaattcgaaaactttactaaataaaaaacaaaattttttatattcaacatttatcaatatgcgatccctaaataataagcttaacgaatttactgcgattatagccctaaaagattttgaattagtttttgtaactgaaacgtgggcaaaagaaaaaatacctttccaaccatatatcactaacaattacaaaatatatgaagctagcagaagcggaaaaaatggtggtggagtaatgattttgacaaaaacgagcgtaaattctttttctgtcttatctgctctaaattcaattgtaaaatccaaattattcagataaatggagcaaaaaaattaagaatagcattactttacagaccaccgaacacttctgctaatttcacaaaaaagattctgaacctcaattttatcattatgggagattttaacctaaatgcaaaggacataacttggaccagtggaacgccttatgctaagtcggaaaaaggaaatattttttgtgaattttttaataagtatggcttattccttatgacgaacggcccaactcgtggtagtgcttggcttgatctgattctctcttctaaacctgattttgttaataatgttttaattgaggatatttttagttctgatcatcttaccactaacttttcactatcttttcccagtaatagaactaaaacaaacacatttacagtacgcaattataattctactaaacttaatctactaaatttaaacttatcttcaattttaccctacaaattactacaaaaatttaccattgaagataagtttaatcatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttacaaaaaatgaaaataattttttgaataaaggaaaaaatgctatctacaaatatattaataaatttacaaaaaattttgaacaaattcactctattaattatgagaaccaaactatttttgatgattacttaaaagcagaaatttttgcaaacactgcccaagtgtgcaaatggcctaatggctagtctccttgactttcccttcttctttcccctggttcaatccctctacagaaattagattattttcaatttttttttttgtatactcgtgggtttcctataaagaaaatatgattcctcatagtttttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaagtgatgtgaaaatcaaatctgaatttctattaatattcgatgatttggtccaaaaatgattaattgtttgaaataattgaagaaaatttgtttaaaaattttcattaatttaatttattaaataaaaaaccaaataattttgtattattttcacttgatataaattaaaatttgaattttttttttaatttttaaaatttttttgaatttttaaaatttcccggttggtcccggtttttcttgcggtcccggtcccgaaaaaaatcgaggtcccggtcccggcttctcaggtcccggcaagtcccggtcccggttttggcaaaaattcccggtcccgtggcactctagaaaaaattattgcaaaaagcatttataacttccttcatcagaataatttaatatccgaacatcagttcggttttgttaaacaccgatctactaatactcaactaattacagtattagaagattggtacgacagcatatacggtaagaaaaatatcgactgtatttatgtggactttcggaaagcttttgattcccttcctataaacattttaataaataaacttcataacattggcattaagggaaaactgctaagttggttatctgaatttttaagggataggtcttacagagttaaaattaacaataaatcttctaatttacatccgattcagtccggtgttccacagggttctgttcttggcccactgttatttttaatatacattaatgacctcccgcaggtaatcccttcggtagttagcatcaagctttttgctgatgatgtcaaaatttatgtctcttacaaaactcgtgatgaaagaagcaaattaaatattgcattggaaaatattggaaaatgggctaatgcatttggtttaaacatctcccaaaataaaacatttattcaaaacaacaatataaattatttaacaatattattaatgaggttgaatctattagtgatttgggcattttgattgataataaattaagattttctaatcattatactaaaattactaaagctgcttatttaaggattcgcaatattgccaaaattttaaaatcccgctctatacgtatttggaccaaagtttataagacatatattcgccctcttttagaatatgcgcctgaaatttggaatccgacatacaaaaaagatataaataaattagaaagatgccaaaaatattttacaaaaattgcattatttaaatgcagacttccttacataccttacaaacaaagacttgatttattcaaacttcaaactttagaagaaaggagaaaaacaattgatttagttcaggcattcaaaatcattaatggtctcactcatcttaaaaaagacatattcccacaattttctggtcacatcccttataatcttagacgtaaagttgtgttaaaatcacaatccagtaaaacttcaaattcttttatcaacagaacagccttaatatggtctaaactcaacaaagatataacagatgctccatctgttgacagtttcaaaaaacgtataaataaatggattgagttaaacaaaaatttagtctgtaaaagagctccttggacttgatattaatttactaaaatctaacgtgtaagtggtcaccccttcgttggatattttatttcttctgaataaaaaaaagggggcttaccaaaagtcatttctagggtaattttgggcgctgatcacgaatatgaaatttaatttttcnaaataccgaatcccgaattcgaacaaaaactagaaattcataaattacaaggaaaacatatttctaggggtattcgaggtagctgaaaacgtttatgacatccattttgacaaatttccaacctgaaccctgactcgaacaaaaaacgagatttaattta

SEQ ID NO: 7566 - DNA, 4332 bp, Heterodera glycines
tttcgtggcttggacattttgtgggggcgccccataaccattcacttcatctgcaccatgttcttgaagctctttgtaaaatttcaatgaaatgctcagctgtaaaataatttgagaaatttacgtcttaatgtataattaatttaccataagctttgatttgtcgcctccatccggatttgatgcatggtataaaatgccatcaaaatcggcgaacacaacatcgacggtatcaaatttactgctggaatttatctattatttttgaaccacagattagcaactttactttgttcgggcattggtaaatttcatttccaaaagttccgcaattaccctattgttttgctcaagaataatcattactttcagtttatattagaataaatatcttaaagcatgttagtaaatttatctcattagttcagtggttaaaaaataattgtagctgcagctgtagggaattaaaaaatgtcttgtcaaagttcccctcccccatttttaaaaatatttttgttcataaaagtcaagtcgctggtctattatatgcacggtacccattttggtaaattccgaacgccggactcgaactcgaacaaaaacccgttcatataaactgtgctcgaacgctccaccatacataccggctcacaatgtatatgctttttcgcgaccgatgagcccaactgcagttgcagcaagtttcgttttatggtactgaaatgtcgttccttttacatattcaccacgactatgcatatatacaaaacattaagatcgtttaactgtatgttgaatgatgaacaacgttgttgaaaaattattgttgggattaccgtagttggttcttactatacttggggcctactgtggtccttttaaaattaaaattatgaaacactagatttctttttattcttttctgctaatcattgctagtccacctgatgcagccaaccgttcgctcatttttttttctttttgcggctgaacaaaaacaagtcagtcgagacgaattgacgaaaacagaaaaacaagggccgccactgaggaaggaggggggggggggggggggaattgaaggcgcaaccagtgctatactacatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcggttcaatcatttgaaaatataaattaatatattaggcaaacatttattttccttcccctttagaaattgtcgataaatttttgtcgtaaatattcacaaaacaatattttattttactgtaatcttgttccaaggtaagtgaaatgcaataaataacgcttggagataaaagaaactggcgaaaataattgactcaattaactgtcgtgaaacagttcgggaaaaaacttgccaagaaaaggcgaaaatatttccaacggctcatgtgcggttcaacaagtgagcaacaaaacatgaaataaaagcttctaaaaattacttgactttctttttcgaaattgtcattaattttttgatgtaaatattcattaaacaaactttgtttttattgacaatttttttcgataaggccttgagcttaaacaaataatgcatatgcgtagagataaagaaatcagtgaaaaaaattatcacaaaaatctgccgtgaaacattacaagaattctggagcagtgcttcgtgattatgcgtcacactctgctttgattggccatatctcgcctgagagtggcgataggcccttagttgatacgtctgaatatgaagagcgcgccgagctctttcgaacctgcaaaactccatattttatggccagcatagtaaaataagcactgaatgaaacgggcaatataaattgagatgaatggagttttcaaatttaaaaaccttctgcattttttgggaaaatagttgagaattttttattcgagatttatcacaatactaaggggtgggtgaagcgaattcatttgttgagaaagtattattttttgctgaggaaccttctattaaggggcagaattgaaggcgcaaccagtgctatactacatgtatagtgcaaagaaaaatattgttaaatcagctgcaaaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcggttcaatcatttgaaaatataaattaatatattaggcaaacatttattttccttcccctttagaaattgtggataaatttttgtcgtaaatattcacaaaacaatattttattttactgtaatcttgttccaaggtaagtgaaatgcaataaataacgcttggagataaaagaaactggcgaaaataattgactcaattaactgtcgtgaaacagttcgggaaaaaacttgccaagaaaaggcgaaaatatttccaacggctcatgtgcggttcaacaagtgagcaacaaaacatgaaataaaagcttctaaaaattacttgactttctttttcgaaattgtcattaattttttgatgtaaatattcattaaacaaactttgtttttattgacaattttttcgataaggccttgagcttaaacaaataatgcatatgcgtagagataaaagaaatcagtgaaaaaaattatcacaaaaatctgccgtgaaacattacaagaattctggagcagtgcttcgtgattatgcgtcacactctgctttgattggccatatctcgcctgagagtggcgataggcccttagttgatacgtctgaatatgaagagcgcgccgagctctttcgaacctgcaaaactccatatttttatggccagcatagtaaaataagcactgaatgaaacgggcaatataaattgagatgaatggagttttcaaatttaaaaaccttctgcattttttgggaaaatagttgagaattttttattcgagatttatcacaatactaaggggtgggcgaagcgaattcatttgttgagaaagtattattttttgctgaggaaccttctattaaggggcagaattgaaggcgcaaccagtgctatactacatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcggttcaatcatttgaaaatataaattaatatattaggcaaacatttattttccttcccctttagaaatggtcgataaatttttgtcgtaaattttcacaaaacaatattttattttactgtaatctttttccaaggtaagtgaaatgcaataactaacgcttggagataaaagaaactggcgaaaataattgactcaattaactgtcgtgaaacagttcgggaaaaaacttgccaagaaaaggcgaaaatatttccaacggctcatgtgcggttcaacaagtgagcaacaaaacatgaaataaaagcttctaaaaattacttgactttctttttcgaaattgtcattaatttgttgatgtaaatattcattaaacaaactttgtttttattgacaattttttcgataaggccttgagcttaaacaaataatgcatatgcgtagagataaaagaaatcagtgaaaaaaattatcacaaaaatctgccgtgaaacattacaagaattctggagcagtgcttcgtgattatgcgtcacactctgctttgattggccatatctcgcctgagagtggcgataggcccttagttgatacgtctgaatatgaagagcgcgccgagctctttcgaacctgcaaaactccatattttatggccagcatagtaaaataagcactgaatgaaacgggcaatataaattgagatgaatggagttttcaatttaaaaaccttctgcatttttgggaaaatagtgagattttttta

SEQ ID NO: 7567 - DNA, 4733 bp, Heterodera glycines
cagatttaagctgcggcatggcaattattcaggtgccaatttgaacaatatccggtttgagccgtggtataaggattgcattgggtgagcagcaaaagcaatttttgattgtcgtaaaaaacaaaaattatttaggcctttgtcgccaccagcggaagaaaaagacgacgaagcggatcaaagcaacggaaattaattatatttgagaaatgatcgatctcgccattttgtttgtatgtatttgacctttgcttgctcacaaattcgtatattgttgaacaatgtcttttttgatttgtgtgccttccaaaattgcattgggtaagtgtaataagtcccagtgaatcaatggcatttgccattgctaaattttccttttcaccgaattaaattgcatttaatttaggccattgtatttgagcaaagtgttctcgagtcccgcggggccaagcagtgatgagcagaaagaatgaacgaattatttcagaaatgatcacaatccttttttgaattcttaattgaaattgaatttatttttctttatattaaataaaaaatttggattatattgatgttaacaagagccgactcttgaaaattccggataagtaaggataagagaactttgatccggaccggtttcgggattaaaaaattcacaattaaaacaaaggagagctttcaggtggtgtggcgatgttttttggcacacaaggtttttaggatataaaactggacactgctgttgatcaatgatcaccaataaatctttttcaaaagaaatcttttgccaactttggagccggatcaaatcgttcgttccaaaggaattttgccgttttttccacctttcccgtgacccctcccccttaatctccgcctttccccatttatcccataaaaaaagtattctccaattttgctccattgatctcttggttgttcttctgtcttctgccgctcatccgtgccaggaacgcctccgccccgttggaagagcctataaaagaaccatttgaagagccattcaaagccattctctctctctctcttaaagcctcccaccctcccctgaaattaataaaaaatatatttattcataatcttattaagagacgggcatgggatttgccaagatctcagcattccgcaatttcttttgctttatgtgttctgaataatttcacttattctgtttttcaatttgcttagctaatttaaatccgtcaaatctgtcttaataatttgacccaataaaagtatctgatgccatctgatcaccgagacaactgagtcccagtgaaaatagatttttcagtaccgaagaaataagttaatttttattcttttatgcacaaaattgttattttttaactttgagactttattcattggttttaaatgtaactcatcaagagctgccgattgataccaaatttgcccggctttgacccttttaaatggttaggagagcccaatttgtacatttctccgtagtttgaactctttcaaaaaccggtttaaagttaaatagtgcttaaaaactttggattgcttaatcgttttcagcgcataagaaaacctaaaagtgtttttgtgtgtttttgagtttgggccctatgattaatattttccttctttccaagagctttcaaatgatacaccaaggttattcaattggttggaaaagcatcaaaattattttcaaaaatcatcatttttttaacttaacgtgtctaatacagtggcacatctcgagggtggcgattttgtgtcagtacagttgtgccatccaagacaaaaaaaaattaaatttttttttatgatttaagttaatttgttcgggacaagcattttgctcacctatattttttaaatttctcaagccatactgacaaatcttgtcaggaaatttgttacctctgttccccgacttttcttttacaggtcaaggaaaaatcatagattaaattttgatctgctggtgttcagctgtagggataatagcatcatttcgaggcccaaaaaatttgcgggtatttaagtcggaaattttgaacaaatataaaatataataataataataacattcaaataacagaaacattttttgaattatttctcttttccaatgttttttattatcgtctttatttgagcataattcggacacaaaaaattaaaaaataaataaaagttaataatttaaaatttagtttgtttccctctttgtttattattactagagtttgtaaattatatggaaatccatatttttttcctggactgtgggaggcctgaaacgcaagaaaaacatgtttttagcctgttttgaagcttctaggatgactttccatatccatattttccatatttttaacctctattagaacggccctcatcagctaattggcctttttgacccctaaagaccgaaaaaatttctgaaaaagtcatttttttagcagaatttgtcgaaaaaattgatgaaatttaatttttcttaaaaaattggtatgtcaaaaataagcaaaaaaatggaaaatttcgatttttggtcgattttctcaagaaattgcttttttttcttctaaaacgagttttttaccatatttatccaattgtttcgggacgagaaaaatatcgggtcgggtttcaggtttcgggacggaaaaatgtcgggggattcgggtcacccggaacagccctgacacatatagtacaacataataatccaatgaaaaacaaatacttatgtactcataatttagtcatttactttttatttacatctaggtatatgctccgttccaaaattataaactcaagaaattttttgccacttcatctatttcccgtggacgaattgagcttgcgggattgcggaatgggatccgcaaaatcccgcaccgggctctatgttcgactctcctcccatccgatcactttgctcatcctctcatattactctaagcacaaacatttcctgatcgctttatattgcttaacacctgtagagactgatcagtcatccttaattgactgatttttttgcaccttttctggaggaaatattttccaatgaaaaaaatatttttgtcagtcaaagataatagaacatggaattttaaattccaaaatcgaatccattttctttaaacccttatctaattttttgtttgaaaataccgttttttccttttgtcgccaaattctcgatcagcgcctaaaattaccatagaaacatttttcatttgtcaaatttggtggggtacaagaagcctctgcaataacgtccactgtacaattttgtccacttctgtccaatatttattacaaaaaatcctcaaaaatagccatttttatgtaaaacggctaccaaaaactcccaatttgaacgggcacagattgcaataattcaatcatttcatttatccattttatcccccagctttgggaccacaaatgaccaaaacaaataacatatatccattgcatttaggccttttgtcccattggcctttggtccattacatttcggccttttgtttttcagccttttgtcacattggcctttgctacgccatctttcggccatttaacaaacataacttttcatgctgatcaaaaaagtcctttgctccaccgtgatcagaccactccttcgggctgatctgaaaacctcaaaatggcttgaaagcggggtaaatttgggaaaaaattcctagggggctggaaaaaaattttcgtggaagatgaatatggcggacagaaagagcacaaaatttgctataaggtgcaaaaaaccgcatgtcgctacgacttctgaactctgagaatttacatgtttaatttcgaacagcaaaaaagtattgtataattcttaagaaacagtgcattttacagtagttttgatcacttcgatattaatcgtccggagtctcagcgtacagaagtcgtagagacatgcggttttttgcatattgtagccaatgacatcattaatttagtcacttactttttattttacatctacataagtaagtatatatatatatacataatcaacaatgcgtaatatttaaaattaattaaaatattcgattttttaaaatttgcttcccccgtgcccaaacttttccccctgcgttttatataaggcccatttttgatgggcggcaccttttcatctctggcactttcccaggtcaacatcgattttcctgtcaattctttcgctaaatatgatgccgattgcaaacagttggaaaaattcaattgattttttggctaagaattttgcaaaaattttggaaattcgaaaaacaaacattttattagagtagagcggcaccgggaccaaaacacggacaactgagtacaactgagtaccgaggtcccgaatatgaccgggaccgggaccggttcctggcgttttccagttattccacattcattaaataatgattctgctcatcattattgtcttgtctgatatgatgagttcttgcaatattgttcttcttcaaatccatcaggaccaattttaaataatttttcgtcaataaaattttcttaatttgaaattttaattgtttccagtttttttagaaattttttttgtcctcaatactttttattttcttttaattttggcttaatttcgtataaatttattttcttcactctgtccatttgcaattttaaataaatgtccgattgggttaagaaaa

SEQ ID NO: 7568 - DNA, 2651 bp, Heterodera glycines
tcccggttttgaccgggaccgggaccagtcccggcccccccacgggttttcccagccaaaaattcccggtttttcaacttgaaaaggtcccggtcccggttaagcccaaaattcccggtcccgctctactctaatttatatgtataaaaagcttaaattaggtttatttttactttatttttttctttttctttccctattttatacgccacatttcacagttaattaagacaacaatttttattgttaaaattcttctgatttgcaatttttttttatcgttgagaaattcgatggatcggatgaaacatttgttgagcagcacgggtgagcattcggatgtgcactttttggtgggggacggagacgaaaaagaggcgagttaaattcttttttttttttaattttttttttaattttcaatttaaattttaaatttttaaattaccctttttatatttaatttcaattatgtaattttccacatttttaaagattttaccagcacataaacacattttgatgaacacttccgatgtttttgaggcaatgttccgttttgactcccaaaatggaaaagcggaaaatggtattaatattaatgatgtaaaattgggaaatccaattagtctgctaatttccctaattaatttaattagcctcagctaattgtcctgttgtggaggtccccgacattgaaccaacaacgttcaaacttatgttgaagtacatatacgtggctgattttagcgaattaaacggagaaaatgcaatggcagtgctttatgccggtggatttatttttaaattaaattaaataaataaaaaataataatttttaattagcaaaaaagtacaacatccccgccctggtcgaccgatctttgcaaattcccatctccgaattgcgcaatgttttcatggcttatgcctatgcttgccttttcgaattgaaggttggaaggacagatttaaattcatattttaatatatatccccctaatttaaaaggatcatcagtgtttttttgtataatttttgataatttaattatattttttaaggattttgccaacaaatgtctgtcttatatttgtcaaaatgcagcccatttgttcaagtcagatgactttttggaaattgatcagaaaatcttttgtgtgcttctcgatcttgatcgtttgttgctaagcaatgaatttgaaatttggaaaactgtaatttcgactttttctttttttcatttgcattataattttcgttttttttcaaatttaggcactccgttgggccgatgaaaaatgtcgtcagaatggcattgaatgctcctcggataatcgtcgttctgtacttggtccggcattgttcaaaattcgttttccaaatatccctgaggaggatttttcaaaattcgttggtaatcggacaataaaaatttgaattttcttttggggcatataaatttttacattttttttttaaatttttcagttccatccggtctgttaacagtggaagaagtgtttggcgtttatcagttcaattcccatccgaatctttatcttcgtggagtgcccgagctgtactcgttgaaattcccaagccatggacgaatttctgattggaacacagccaagcgcaacggaagagggacactggcgttggaaattgaaaaagtgtcggaatttgcgggagagtctgtcgggggttaccgatgcagtgataccgtatacatcaacggattggcatggaatattcaagcagaaatcagggaaggcactgctgctgatgatgagaagaaatatttgggatttttcttatggtatgagcgaacaaaacacggtacaacaattttaattaataattaaaaattaaagaaaaattaatatttgttttttacaaataatagaaaaacctttgaactgccttttttcggcaacatttcgaattgtgtcggaaaagagcgaaacggagaattccattgggacactttgtgattataacaatcaaatgaacagcagttggggatttggaaatttcattagctttgaggtgagtgccaaattgtttccttaattaatattaattaataattatggctaattaaggaagtggtcaacccgatcaatggttattataacagagaagaggacaaagtgacactgaccattgatgtcatgactgttgatgaaccaaaaatggacaaattcattttgggtcaaaacaaatcgacagggacactttttatggaaattgaaaaagcgtcggaatttgggcgagaagtctttggaagtgatcgaaaaagtgaaactgtgcacatcaacggattgccatggaaaatattggcaaaaattcaaacgaaaaatggaagcgttgacaatgagaaatggttgggcatttacctttcgtgcggtgctccagaaaaaggtgtaaatgaactaccaattattgcctaattcattagcgataattaattgccattaagatttccattggcgctgcttcgttcgatcagcaatttttcgaattattaatcgaaaaaatggtgctgagaattccactgttgggacactttgtgaccgtgttaggacaacaattcaaccaaccggggatttcctaatccttagaagattgtggtgagtgacaattaa

SEQ ID NO: 7569 - DNA, 1583 bp, Heterodera glycines
caacgaatgaaatgccatcagcaggaaatattcgcttatttttgtcccccaactgataataatccaacggatttatttgtgtaaattaaatttcaaaaaaaatatacaatatttacaataaatgaattaatgaatggctaatggaattaattgattagagaaggaaagggaaaatgaaagggacgaagagagagattaattacataattagggattgattgcacagaagaaagagaacaacacgagctgagaatgagaacagagagagaggagcgatgagaaggacggacggagtgacacaatcgaagacaatccgtcgcggataattagcacaaatcacccaattggcaataattagcactaatcacccaattggcaaagtgaacaagcccactctgatggtgcatcaccacactgaacaccttttggagcccaaattcattgcacttccaaccggacaattgaaatgtttggcaaattggggcaaattgccgagtacgacgttaaccctaaggcagcgaatgaatgaacgagtgctttggcattcttttgaccttaattcccatttatgactcacctcgattctggcggagaatgagaatcgaaaagggcagcaaataccgcggcctaaaaaggaaaatgaattatttgccatgggaatgtcaatgttcggcacttcgtggcgttggttggtgcaccaactctgaacaaaattagtgagaaaagtttcgactgtcctttccccgatcgcttacaaatgcataatttatgaagaacagttgctccgggccgaactgctccaacccgcgcactctctgcgccccattggcacgacccttcgccaaattggcactcattgcagcgaaagcggccctttcacggggggggggggtgtatttaaaggggaggaggcatattttgctgcatttgagagagccataggccaaatccgtaaaaaatgtgtcctcacataaaaaggcgtgcagttaaatggcggtcatagagcactaaacagtttcaattcgaagcggagagcagagaagcgagaaaagctgacatagagaaagagagaagccgagatgagagagagagcagagaaattgaaaaaaaaacatatgacctaagtaaaagaaaaaagaaacgagaaacttatgaccaggtcaagaaatgaagaattagagaaacgagaaaagccatcatagagagtgtgagggacagttgagcaaaaaaagggttagagaaacgagaaaagccacgagagataagggccaagtcgagaaaagggagcagagaaattataaatgccacaaaaaagagagagagcgaaagcggccatccaaaagaggaggagataaatgtaaaaagccacgagagataacgaccaagtcgagaaaagaagggataggtgagaaagggagagagagagagaaaaaagagagaggagaaagagagaggagagcgagagagagatgggaatgagagagagagagagagagagatgggaatgagtgagagcgcgaaaagagagagagaagatagtgggcgggatatcaaaagaaaaagcatgtgatgggacttgctgc

SEQ ID NO: 7570 - DNA, 3760 bp, Heterodera glycines
cattccgccattgtccgcgatgttctcgccctgggtcaagttgccgttgacctaaaattccaagcataattatggagggctgaacttttattttgtttgttttttcttttggtccgttccgcccaaagtcggccgaatttcccctcataccttccccccccccctcccccccccccccattttgtcaatttttacatgaagtccttcaatccccggcacttggattgcgttgtattggtcaataaagcatttcttctgcccaataaatgccgttactgttccattttgccaccaattccgaacatttccaaattggtcatgaagccgacctaatgagaaatgttttggaaaatttctggcacaaattattgaccattattgtcaaagccatgagtaatttcatgggccaaaacgacgccaattgagccgtaattcataggtctaaacaattaaaacaaaatcctaattaacgattttattttatgggttttacatcggtcgggaggaattgaaaaaaacgcccttaaattgtcaaataataaaaaaaaaaaattaaaatggtgctggaattggttgtaacctgaaggattcctccggtaagaactgaaatgagtaaattaactcagcaaataaaagggatggaaagactgaccaattgaatttttaattgggtaataaaacccattgatcaccaaactgctgaattccacttcaacgggctcgagcagttgcaggaaacttttgcggttcatcagtttggacaaagaaaaggccatttcggggaaagtctgtcctttcgtgcacgtcgtactcgagaggaaacgcattttttgggggggggggattggcaattgtaaagaacgaccgacctctttgaaatgattttttagtttcgtttcattaaaaatggcgtccatgtattcgatcaaaacattgagtctctcaagctgaagttgaacaaaccattggcattttgattgaattggcaaataatggcatgccaaagtgccaatgctcagtctcccctcccctccatggcacccttttgaccttttcgaatgcctccgacttcgttttgggctccatccacaaattaaggtcgagcatttggtggaaggacgtcttcacatcttcgaacatttccttcaactgcgttttggttgcattcacttccaaatgccggtgaatataaactgaaagtgaagtgaccataaaagggaaagaaatgccaaaaaaagattgtcaaatcgcctctttcgatcagagcggggaagaagccgagcacaacgtttttgcattctttccattgggcgggacgtgccaaagatccttgcaaaacgcggtccaattccttaaatggtttaaaaaacaattgtacaaatgggaagaagccatgcgcacaaattgagcctccaaaaagcggttgtccaagtggccaattccgctgaggatcactttccaatccatgtaatcactgagtatttgtcccgacagactccgtgccaatttttcgaatttctgaaaacatttcattttgtgcgagttgagttgccaagttggctccaactttaatcagttgaacttccgcaattcgcactttgactgttccaattgcttcggaataccttcggctaatcacttcgtttggcaaaatatttttcagatatcttggccaattaatctgaaaagactcaaagagaataggccatttggacaatttgctcactgttccagccaaagtgtcttgcaattcctaaaatggaccattaaaaacggaaacactcagttaacggtaatgatcagttctaattatgtcagtcagttagctcattagcataattaggcaccactaagtggcctgctttgcccacatggccctgcttctgatgcccacctgcagagtgatataactgtcctctctgtacgcgttgtcgtagtgtttgtcggtgccgttgatgagtagtgccattcgcacttccacctccacaaatgcgttcactctccgttcgatgtccgccgctttgtttgcccttctgaacaccgtttgccgttggtcgtcttcgtacaacaattccaacactttgcgcaaaaattgcttcagtgccgcgaggtattttggtgccaaattctcctcaatgtacaatttctcactgagcagaaacaaattattgggcgatatctgaacactttgctgaaatgggttggtgaaatgggcccaccgtcagaatggtggcggaagtgttgcgcatgtcggggccaacgctgaccgcgtagaaaaggttgacaggccaaactttgagcagccaatcggtgacgtaacgcatgccacgcgactgcttcaaagacctgagcaaacccaacaatcaccacaaaattggcatttcaatcctccgactttaatgttttcagcagaatgttgctgcccgccacacggcgactgacattgtcctgaaggaaaagcgaaagggtcaacaaaagggggagacaattgtgaccatgcaagcatcgaacatggcgaacatcatccgatcgtaggggggaagagcatggaaatgagcacggtcgtccaaaatcgctgaacaatacacaataatcgaagaaaagtcgaattgttggcaatgagctgaccgacccttcactctgtcctcgatcaaattgttgatcagttggaattggttggcactcgtcttgtcctcgtcgatcggattcgacttcatccatccatcgcaaacgaattcatagaaattatcgcacgggtttaaactcagatttagcgatgcaacgagttcggggtattcgaacagattcgaaccgaacgaagaactcggtgacgagaagggttcatttgcaaaaggcagaagcggcggtgtcttcggcgaagagtcggctcgttgctgatcaccacctacggaggatgggtgaaaatacaaacgacggtaattgggagggacagaccaagcagagagtttaaacatagcatccgtaattttgtatttattaagcaatgttttaatcgactcatttaaagcgattaaaattcggaaaatgccccaattccgctgcgccttgtctgacttatgcccaccttctgctgagttcacttccaggaagtcggcagtgatgttgaagctgctcatttcaatgactccgttttgggaagagaagtgaagttccgggatgaaaatggtcacatttttggcctccaatctgtccaaattggccatttcttcccattttgcccgtccgtcccaacttgaactgctctttgcctccatttgtcttccgtcctgtagttggctgaaatggactctcatttacactgatgattgaatttccgcccgaaaatgtttcatttgaggacaatgaaaagggtttcgtttctccgtccggcaaccattcgccaaaagcgccaaaaaatgggcacaaagcgaataaaaatggaaatgatcgaaaggagaagggatgacggacactcattctatgttgaactttccttgatcagttgatttgctaaagctgacaaaggaaacgatttcatccgacaataaaatggggcgctgacaaatgagcggagcctttcgcattaattgttcggctgagattgccttaggccatgaaaaagtgagcatcacattggggtatgagggcaatctgccggatgaatgaaatgggatatggccggtgggcgggcggagacgaatgatggatgggaaggagggcccggcgggggaaagagggcaattcgcgagggggggggggg

SEQ ID NO: 7571 - DNA, 2124 bp, Heterodera glycines
  misc_feature (60)..(60): n is a, c, g, or t
  misc_feature (1376)..(1376): n is a, c, g, or t
cttctctacaagttctacacattcaaacggttgctgctttcttacagaacttcgccaggncggtcatattctccatgaattgtttatcgacaactcttcccccgtggaattccacgccgttctctttgaggagatgatacgcattttgtgctctttccaacaaccactggtcggtctggacgtattaaaccccgaagaaatggtcagttttcatccctttcttttgtattattacgctgtttttctattatttcagatcactcctggccttgaccgcgaattggtgcaggacatgttccgttcattgagcatgttgcacctgcaacagcagttattggcaacgaagagcaaaagcggaggaagtaggtcagtggaacgaccgacaaaggcactgttccctccgaacgattcgatggcgcagagtgacgaactcagcgaaagagttactaatctgatggaaaccctacggccaatgctcacccaagcattggcaaattgttttttggattaatatcgttgtatcatgttcgtttgaaataacttttttgaagtttttcaaattaccgcttggaattgtcatgcaaagacaaggcttacaatgagaaaataactttaatcaaacagaggacataccgagttttttcaaaaagacaatccaagtcaaacccaatctttaagaaaaataaaagaggaatcgaattttgatatctcatcagcaatcactttccattctgagtttgcgaactgctgctgctactgctggtgttgctgctactgaacgagatggaaatgttgaggctggcagtgactgcggtgcgcacttttgtgcaagtgatgcagcatttggacatggacagggcgttgtaattctgcgatggaaacttatgattgctaatgagttagtgtactgcttgctgaccgggtcaagacacgttttcatgtagctgggatcggtacagtttccgttcatcagattgtccgaacatgctgaaaatggcaatcagtacaccaaaagaaaaaggcatggatacgtgtcgggaagttcggcttcggcaccactacttgtccgtcttcctttttggtgcactgcgattgcatctgttcgtagtccgattgcaattggctatagcttttctccgtttccgctttgatctgttccgtctctgacatgcttttttccatctctatttgtttctgttccatttgctttttttcttccttcatttgactattttgttcattcatttgcttgttcgactcttccaattgttcgttctgtttcttcacttcgttgtattcatttgtcttcgtttcatacatttgcatagttgttattgtttttgtcaccagcttttggtaactttctactaatttanagtattcttgtatcatataatggctttgatcgtgttgcgccattgaagaagttgaagcagtacttggtgttgaatagctactgcttgaaactgtgcttgattctgtaatcggtgatgatgcacgtgtagttgaactctctgctgacgtgaatattgtacttgttgattcgatgcatgtcggtgaacttgatgtcaccgaacttgtgcttgattctgtactgggagttgaacttgaacttggtgtcgaggtactggtcgaaattgtgcttgattcggtactgggagaggaagcacttatagtcgaactagagctaggtgtcgaacccgttgaacttgcgcttgactcagtattagtagttgaagcacttgtggtcgaactaaagctaagtgtcgaagtactggtcgaacttgaacttggtgttgaactactggtcgaactcgttatagttgaacttgaacttggtgttgaaatactggtcgaacttgtgcttgattcagtactagtagaaatagttgagcttggtgttgaagtactgctcgaactcgtgcttgattcagtaccagttgaacttgagcttggtgttgaaatactggttgaacttgaacttggtgttgaagtactggtcgaacttgtgcttgattcagtactagtagaaatagttgagcttgagcttggtgttgaagtactggtcgaacttgtgcttgattcagtactagtagaaatgcttgagcttgttgttgaagtact

SEQ ID NO: 7572 - DNA, 1520 bp, Heterodera glycines
  misc_feature (1430)..(1430): n is a, c, g, or t
ctagttgagcgtactgttgatatttgatcatttaatttttattctatatttaaatgggcgtacttgtcgataaagtgctctcaatttgaccatcctccacctgacccttgtccatttccagatcctcctccaaatcctccccctgatcccgctcctccgccattccctcctccatttcctgctcctccaccatttgctgctcctcctccgtttcctactcctcccccaccaccaccgccacctccagctcctcctcctccacctccgcctgctgccactcctccattcatgccttggccccacccttggccactgccttgtcctcctccccctccccctccttggccaaaaccttggctattactcgctgcgttgctcaagcttccacaagaaacatgatggaaaaatacattttcaagaacattaattataacaataatatggacatattgtataagcttcatattcctatatttttggtaaaacttttaattaacaaaagaatggcagaaaattattttctttttttagtgcgtccataaactgtttgagcgttaagcagaacaaatatatactatttataaagattaaaaccatttcgagcaagcaattggattggcctatttatgtgtgtctcacagtgaacccaggttaagctgaccaaacaaaaagtttctttttttatcctcattcaatgatttagcaaaattttattatacccaaacaaaaaatatttttaattattttctttgacagaagatcagtcactttctttatttagtcgaaagttttatgtttccaagtatttcttataaatagaatctaagcaagaatagtttttacaaataagtaaaaaattattaatttatgagcttaactgggaaaataattattatgtaattttaaaagaaatattaattaatggatttcttcaataaaaaataattatgcctccttggagttttaatcatgaaaaattcaaaaaaatcaactaaatatgatacctgactcaaaaaaatgccagacatatgtttttataaaaaatatatatatatatatcgaactgcgtttataagataacatacttctgtcaaaaaatataatgacacacatcaatactgttgaaacaaattaaatataggaataaaagtcaaattgtttaaatttttcaacccataaaaagaggaagcgaattttaatatctcatcggcaatcactttccattctgagtttgcaagctgctactgctgctgctactgaacgaaatggaaatgttgaggctggcagtgactgcggtgcgcacttttgtgcaagtgatgcagcatttggacatggacagagtgttgtaattctgtaatggaaacttatgattgctaatgagttagtgtactgcttgctgaccgggtcaagacacgtcttcatgtagctgngatcggtacagtttccgttcatcagattgtccgaacatgctgaaaatggcaatcagtacaccaaagaaaaaggcatggatacgtgtcggg

SEQ ID NO: 7573 - DNA, 446 bp, Heterodera glycines
  misc_feature (12)..(12): n is a, c, g, or t
ttcctcctccgnctcctcgtccgtttttttttcctcctcctcctccgtcaccacttccagttccttttcctgcaccaccactttctcctcctccccctccgtttccgcttcctcctccgtttcctattcctcctccgtctcctcctccgtttccttttcctcctccgtttcctattcctcctccgtctcctcctccgtttcctattcctcctccgtttccttttcctcctccgtttcctcctccgtctcctcctcctcctccgtcaccacttccagttcctcttcctgcaccaccaccttctcctcctccccctccgtttccgcttcctcctccatttcctattcctcctccttcgtttcctcctccccctccgtttccgcgtcctcctccgtctccacctccgtttccttttccacctccgtttccttttcctcctccgtttcct

SEQ ID NO: 7574 - DNA, 2580 bp, Heterodera glycines
  misc_feature (196)..(196): n is a, c, g, or t
cctcctccccctccgtttcagcttcctcctccatttcctattcctcctccttcgtttcctcctccgcctcgtattccgcgtcctcctcagtctccacctcgtttccttttccacctcagttcctgttcctcctccgtttcctattcctcctccgtttcctcctccgcttccttctgctcctcctccttcgtccatntcatcgcattcatcacacacaattgtttcttttacaagaaatattaataaaatgctgaatagcgttaaacgcggccacattatctgagatcgctacacaaagattatttagaaagaaatgtgctgctcatcagtcagagagactaccaatttgataaatttaatttgagctgttataattatatcttttggagctttaataggagggcttaagtttcattaaagctaaacaaacagccaaaaatggcaattttttgcgacccgtttgttttattatttcagagattggaacttctgctgaattagcttaaactggtgacgacttgaagaataaggagcactcaaacaaattgtcattttctgcaaaacaaaattaaaaatttggttcacatttttcgtgaactttataaaaaattgtttcaaaaaagaaagcagcgtcaataataattattaattaatatttgtcatttctgatgagatcgctctcttcctcttccaatttttgttcctccctcaaattccttccgctttttcttctccctacctcctctgttgctgtttgtcccgcttctgtcagtgccattcgcagcgcatccatcgttttggccgactgttttttttgtttgattggcattctgcttaaatgcccaaaaattgactgaccattgcaatgaccccactgctccaatgtctctgtgctttgtcaatggcccgaatggcctcagggaatgcaagttgattgtccttgagaaatgtcaacattttcgggctcttccagagaaggagtgctctttctgccagctgaaacattattatccattttaaatgccaagtcgacaatttccatactcgtgcattttgactggtcgtacatcgaaccaatcggccaactaatggcttcataattgctcggaattggtcctcaccaacttggctcaaaatttcatccaactcggtgatgaacagaatctgaaagtgtaactattttcgccggtgtcactttcattttgcccacttctctgatgccactttttgatggccaattccgtagcagtgattttatcgcgggtttagccaatgaggcgtccttttcaacgaaaagcatcacacaatatgccaacttggagaaaaacattggcagcgcgggtgatttgtgtaatggaagcagaactcgaaacagaaactgtcgatgctcctccttcagcggcacattgaatccgttgatgatgtcgccaaggatttggagcagttcgtccaccccattgaagggcatggactcgaaagtgtgggacagcaaaatgttcgccatttgtttccgaatgccggtcctccgctccgttagttttgtgtaaatgccgtgtacaatttgccaggctttttcccgctcccgagagtccgccgagcggagcagctccagtgcatttaagcagaagcaatcggagatgaaagggtcgagctgttcggcggacaaacggtcgatcagctggcggagaaggcggtagaccaactgaaggtgaggccaggccggctccaagaaaaggctggacgagggcgaagaaccgagcaaatcctccgagttggactcgctccactgcggtgaaataggcactcggcgacaacacccttcagggcaaatcaagagtaattagcagttcgggttgaaggttgaagccagtcttcagtcaaacctgaacaggttgcactccatcgttttgaacagttcagtgccaatctcctcatttgccaacagtgcgctgtttctgccaatggcaacgaactcgttaagctcctttagggcatctgccttcacttctttctcctgtttttgcttcatcgggtcgccaaagtcaagcattttttgacattggcgcaacttttgaacaaataatttgcgttgcctaattgggtcgcaaattgcttcgcggagtgtcggaagagggaccttaggagggggagggcacattcgctgctgattatgcaagacgaatcggggcactgaccagtgctccgtcctcctcaatgctcgtcatgtcgctgttctccagctcggtgccgctctcctgctggccctgctccggccacttttgctgccattgctgggtctcaaggaactgctcgaccgagtcggccctcgtccgcacttcccactcccatccgccggcggaggataacattgtcgtcatttgctctctttttttccaacacactttcaattctctttcctcctccaattctccccacgtgtgcaatttgttcgtttgcttcgcttgtgactgtccgtgttgggctgacaatgaatgaatggcgcgaggaaggcgaatgatcacttagggggggggggtgaaattttgcttaaatttaaagagaaaaaacaaaaacaacgaa

SEQ ID NO: 7575 - DNA, 3455 bp, Heterodera glycines
  misc_feature (305)..(305): n is a, c, g, or t
cgggcaaaatgcaaacattcattcacaatgcacaggtcacattacacacccaaccaaactcattttaattttatttctaaaattttttccatgaattttcgagttttgagtaaaaaataatttttctatcggataaaaaacgatgaaacgccgcacggtttttgacataataattcttttgttttctgtttcagattgccaacaaagctcgtgtcgatgcgctggtgcaactcaatttcagagacaccaaagggaacaaatgcaccgaaacgaatgaatgcgagcgcaactcacagcgtacgggngagggggggggggggaactcgtgaaaattgaaaccgaaaataaattattttttagggcaaattgtcaacaaaatcggacgaatttacgctgagaattgaggacaatttggcaatttgaacagtatctcctccaaaatctcggacttcaacaaggaggtcagtagtgattctgctcacactttgcacgaagtttcttttcccaaatttagatgctcaatttgttgggcgtcccaaaggccgtgttggagcatgttttgttctgtcaccaggaggaggccaatggtgggccgaagacgaaaaactcaaaagtttaaactcactgaagtcgggggggggggggaaatgacgccatggaaaaccataaataaaaacaaaattagtggaacggtgtcaaattttagcaattttccaattaaggtccgaagtggggctcttgaattttctgcattttgcttgtttttttggcattccgtcgtcccttcgtttttaggcctttgtccgagccgaaagaattgaaattgcgattcgatgcaatttttgagctgacaaacgacgtcaaagcattgaatcatattaagaaaaacaccaaagaattggtgagttggctttttttaaattggaaatgttgaaaaataaatattttcagcgcatgcaaattcaactgatcgacaagaaattgcctcattttgagaacaacatgagggcacggccgatgttcgttcattttgagggcggagagatgtcaatggcatttaactcttaaattttttctctttttggaaactataccttttgtcaaaaccccaaatttttcctcaattcgttgtgctttttcagctccgtctccgcattgatgagactctcatcacactgaagcacaatctgaagagcattgagcaccaattgaagacagaaagagaggcggtggacggcgaactgcgcaacattcgcaaacagttggaaatggcgaccaaatgcaaccaggagttcggtcagttgaccatccctggagggtccactgcgtttcggcgccgaccgtttcggcgccagctcagttttttgactaaaacttttctttgtcaaccaaatctaatattgttggtatcactcgaaagccctaagtgttctctattagcctgtcgaattccgaaaaatttcgttaaggttcaaaaaaggtaggaccagaagaattaaaaaaacgaaattttcccatcttttttggctcgaacattttttaaacttaacgaaattttttgaaaatttgcatgctaatagagcacgtgaatagctttcgaatgataccaagcttaataaatatggttgagaaagaaaaaagttatagtccaaaaatcccgaaaaactgatgtggaagaatcaaaaatggggaaattaagggcggggcaaaaagcgtgggtctgtgacccatttgtttgaaaagcaactaatcaaataccaacagatgattgaaagccgtgaagccgaatacacaaggcattgcttgaacagtgcggtcgcaaatacgaaatttcgggtgagcaccaaaaacattcaacttcatttatgccatccgacccactaaacgcctccccccccccccccccccgaatttcagtcgatgccaattttgctgagcaattacgcgaaaaagttcgaagcattgaagcgaaaaaagcggaatttacggtggctttttgtgctttggaacattttctttaattatttatttttttacaggaacagaaaaacaaatggccgaggccattgagaagctccgcctcagtgtcgtacagctgaaaaacaacggcacacagaagcgacaggagtgtgccaaactgtcccaggccatcgcgtcggtcggcggagagggaactgcgaacgctgggacaaaccacgcaaatgtggggggtgggggttacggaaaaaataaaggttttttggaattggattttttgggctgtccctcccccgttttctgtcccattctatcggcctaatttagcattgacaagctgactgcggatattgtgaagtgtgagtcgcagttgaagcagctcagcgacttctctctgtaggacgacgtgtggaaaatgctgcagggcattcatgtaattaattgaccaacgacaattgattacaggaaaccccagttttactgactctgcctaactctgattacctttttcaagacggacctgaacacattgcgcatggacatggtggagttggccagcagtgccggggacgagggcaccgtcggcaaagccaacgcactgttggaacgtgcgggcgacaaattggacctgtccatggagcacattggaacattaaagcgtcgggtacagctcagcaaccaggtggaaaatggcattactgactgacattaaattggctttttggcactttcagttggccgagttcaaagactgtcgggcgaacgccagcgaaaaagtaattcaaatggagacaattcgggagagcatcggtgacaaggcggagcaggtcaaacagttggagcagctgatcgccgccaccggtcgcgaattgcctgagacggaacgccaattgcgcgccatggaacgctcgaagaaggcaaaatgcgaaagtgctaaagcaatttggccgtttcttttcaaggagttggaaatgacggtgcagcaaaacttacgcaaaatgacgctcgacgtggacagcatcaacgcgacgctagacaaaatcaccgagatgggcgagtccaacgagcgcgaccgtttgagcatgttcgccacaccgacggactttcgtgaaatggtcacacacccttttggggataaaattaattaactgattgtttagtcttttcccttcagttggatgagcaaagactgcgtttggtgaatttggcaacgcgaaaagtcaattggagaagcaattggagggggacgaagggaaaaagcaccaattgaagacagtggaggaccaacagagacggatgaacattgataaacaagtgggaggaggggagggggaataccaaggcaaattgggcatgttgttcagctggaaaagttacgtccaacagttggaggaggccaaagagaacgcggcagtgaaaggcgtcgaaaatttgatggaaggaattgcgaaagaaagtacaaaaatagcaagaaagga

SEQ ID NO: 7576 - DNA, 3447 bp, Heterodera glycines
  misc_feature (3440)..(3440): n is a, c, g, or t
tgacgaatccatttccttttttttatccattattttcagatgaacccacaacaaatttggacgaggataaggtgggtaggcgcaatgggcactgattgggagagggaatcactttcattcattcataggcactttttgattttggtccaaaaatttcccatttttatggtttctcccctttttcggctaatctgtcctctgttctgtcgcgtttgtcaaacacattccgtttcatatggaaaacattggcgaaacgtggaaaagttgggtccaaatttgaaaaccgacgccgtcggcgggcggcggagcaatcggagcacaacgcatttactaggcggacgacttggactttgaggaggacgaaaatgcgaatgtaaaaagacgagaatttgcggcttttaaatggaacattttgtttgacagcaaaatgattgagggggaacagaacaatcgccgctccggcaacagagaagaggacgaaatggagctgaaccgctcgctgcaactgattgtcatcacttacgtccgtcggctcgtcgagcatttgcacttggcatgccgtcccgagtacatctacagcatggccaaggacgagaacggcgtgtcgcacatcaaagcgcaccgacaaatttcggccgccggcgacggggacgacgaattggaaatgtgtctacttgagccaaaaaattttgaaaaacactcaatctcatcacattgatataggtacgtgtattcgcaggcgcatatttatttttgccttttttattttcatactgaatcattcatgatttttgtcaattctttttggttttgaatataaatatttttttaattataaatttttattcggatcagtgcttttttattgtaaaattcgcagagaaaacaaaaaattcgttcgtacgaatacaatagacaaattgaagcgaacgttgtcgcctcctctctgccaaaatgtgatagtcattcgaagggtccgcttgactatgccacgcatttggcaactgaacgaataattaattggtcaatcacttttgttcgaattccttcccaatgctgtccaaatatttggactctttctttgtcatttttggtgtccaaaataggacaagccgcgtcttcatccaacgcgagaaaagggacgggtcgacggccatcgccggcgcgtagtcccgaaacccgtcgttgctcatcagcagatgggcgtcggggcccaacagaagcgcagcgttcagagtgaaaaggtcgtcgtggattctgagaaaagggaataagttgggaaatcccatccgaatttcccgcccctccgatttaaaatgccaatttctttaaattttaatttgctttctctcattttgttcattttgctgcgcaagtcgaaaatgtgtcccttttcgcgaaaacagtgaatgaattcggacggaaaggtgcagcgagtgaccaccaaaatgggcgaaaaaccgttgcgttccaaggaattgaagaaggaacggacgtagccaagctgatgctgctccggcttgccgtccaccaaattgagcgcgtccaccaccaacggacgacgacttgacaaaatggaaaacattgggggacaaaaagcgagaaacaaatgaaagtgtactacaaaatggggcacccaaataatcgcccgccatcgttttttgtccttttcacctcgtcgattactgctgttgctcgctgatttgccgtttcatctctttgatcgttttcatcagcgcaagaacctctgaaagaaacgacgaatcagttgcggcacattcgtcgaaacaacccaattatttattttttcattttggtcgtttggcaaaaacaactaatttctcctcattaatttgtgacatttggacaaggcccactcctctgattatgggttatccaaaaggactatcataaatagggatggtaaaaatatggatataaaatcgcgaaatatggccataaaatatggactaaaaatcgcgaaatatggacataaaatggtacagtcaggtgcaaatgtttaacaccactagccattcgaaggagaaaaaaggaaaatccacaaaaaatttgtctaaaggcgagaaaaagaggaaaatccacaaaagaaatttgtctaaaggcgcctatcgcggcctattcgccaccgtcggacaccccccccccattccaaatctttttttttttttgaaaaaacgtcgcaaaaaaagctgtttgaaaaggaaaaaaatgttggcatgaccccctgcgtaaattttgatgtcgtcgacctcccccctccctttcgaaatcttggacgctctggatgtggaaatgtgccctcaaatggtctaccggatggtacgccggaacgatgacaaaaggaaaggtccgcgactggtcaaagttgtgctcccggcgagcacttttcagcactttgccttggcgcaatggggacgacgtcgcaatgttcttcgcgcaaaaaacgaatgggatcggctgcttgttcgaccatcgttgataaaagaggaacaaatggcggaacgtgaggcacgtgcaaagaaaaaggaggagtacgaacagaagcgcgagggaatcacaattcgcggacaaaaaaacttttgaggtcacgaaattttatcgaatttttgtatttcaactcaagaagttgtagtaaataagttagatgatttaaaaaacttacttttagaaaacaaatataaaattattgctatctcggagacttggttgagcaataagttagataattcgcttatagtccaaaattttccttacataattgtacgaaatgatagaaaaaacaaaaaaggtggtgacgtagccttcatcgtctcaaatcagataccttttgaagttatcaaaataccgaaaatcaaaaattctgaaataagttgtatagatattctctctccatttccgaccaaaaaattcgcttaattttggtttataggccagtaacacaagaaaaatacgaagactttatagaacttttagaagtattatcacttttagttgaacaatcaaacaattgtcttttttttggtgattttaactttcctagcctaaaatggcattctgatgtctcccaaaatctgactgaaaaatctttagaaaaactttttttatcattccttcatggctttagccatgtttagtgcttcaaaaaagaatggtcgacgcgcctttgcccttgcccatggtcaaacaagactttgatcaaaattgaatttgatcaaaattgaacttaacaaaatcaaaaaaacaacgacccagcatgtcattacagctcaagtaaaattcctgtgtcgcggcgcaccgatgtttatcacttatgaactaagtgcggctgaaaacgaaaaagcaagttttcttttgataatttcaaactaagaaatggggtttcagtaaaaatgggtaggattcactttgatttaaaaganaagtact

SEQ ID NO: 7577 - DNA, 5078 bp, Heterodera glycines
agttcatgattagcatgaataaattgttattctatatatttaaaaaaaaaaaattaattttatccctacggatggtccgatacacaaatttcaccaattcattctttttgcaaatataaccatcatctttagccgcttataaaacattaatccattaaatctattctaaaattataagaaggtaagaaaatgataagtaattaaaaaacgttaatttaatggaataagtggagaattggactgggttttgggcgtggcgacaggcccataattagggtacaccaaaatgggaatgagttcgtttttcaaaatgttatcaaatttcgctaaatatgtattgacgacccagagccaaaactcacaaaaccatttctatagcttttattagctttttataacgatagaaaattctaaaaatgattgcggtgatgcgtttaaaccgtttttttaaacggtaaaaatgcgataaaatgaacaaaatgtggacctcataattagggctgagaatttaagtcaaatgatttttttgctgcctctaatggtctttaaatgacttaaaaagtgttctaaacattgtctgaagcctctaacacggatttttctgtgactttttttgaattttacattttttgggatttttatgacttttttgagttttttgcgacttttttcgtgatttttttgactttttgaggcaaaatttgaattttagcgaggaaaatgccgaaaaaacaaagaaaattccaaataaaatctcgatcgataaaaagtatagttgagcgggaccgggaccgtgccggtaattcccggtcatcctcccggtcccggttccggattttgaaaagctcaggtcccggtcccggtagggaaaccgggaatcgggaaaaacaagcactggtatgaatggggttctgagtggaaaattagtgatgaaaatttgagtcaaaggaaaaaattttaaaaaataattaaaaatattctttaagagtgtcgcaaccaaatgtgcaaattgcctagtggctagtccccttgacttttgtcttcttctttcccctggttcaatctttttaaatgaaaatacgtacaaattgagcctacctaataaatccaaaaaacatgcctttctgttgataatctgttaacaaattgcactcaaattttaaaaattttccccggcggcgcctaccggcaccgccggtctcccctttcttccacaaaagttttttggaaaaagcgcgccgaaaaaatgatgagaaaagtaatatacatttctaataattgatcatttagtccaaaaatgattatttttttaaataattgaaataaatttagtttgaaaattttcattaatttaattatgttttaacttttggattttattaaataaaaaacaaaataataatattgtattagtttcacttgaaataaatttaaatttgaattttttttaatttttaaaattttttaaaatttttttgaatttctaaaatttcccggttggtcccggttcccggttccgaagaaaaatcgttgtcccggtcccggcttctcaggtcccggcaagtcccggtcccggttttgcccaaaattcccggtcccgctcaactctaatattttctctgaaatttgaaaggaattttaacactgtcacttgcaagcatttcgtggaagctatattattttggcacagtgatgttggacaaaaatagattttcacagattaatccctgtaaccggtttttcaaaaatatctctattaattagctaacaattaaattagttaatcatttattaatattatctctggaataaaaaactaatttatgatatggctttattaaaaccgaatttaaaggcatttcgctgctatatttgttttgtcaaaatgatgttgacaacagtgcagaatgcggcgaaaatggcggatttaaaattgcgacgccctttttaaccattcgagtgacgctcagtgttatgccccgtacttttagcaccgttttctcctccccgctttgtcggtgccgcatccgcagggcgtactgtttgcacccaccggaaacaaattacacgagttcatggaccggccattcatccgaaaggtcgcctagatggggccccgtctccagagggcacccgtccgcctcacgatgggcgaaacacacactgtccgtgtcggtgtagatgagcaccgagtttggcgcgcgaacaaccgtctgcattagccgcaacaagtggaggcgcgcgactgatgttgtccaaagagagagcacaatgtttgagcactcgtgttcctccacccattcgtttccggccgcataggtgaccaatacgcattagtcggtcagctggtcaatggagctgacctccaccgctgggttgttaagcagagcgcgcagttccgcgggcgagtcggtcacaatcgttttggacaacccgttgcgtaatgagaatcgcccccaaagtgagttgttgcacagttttgcgatggtccgcttggccttgttgtgcaccatcttttccctctcaatacggattccgaatttttcctcacattcctctacgaattgctgctgatcttcctcggttgtgccaatttcgtccgggaagcctcaattgacgtcacagtggacacccacccccgctcatcatcttcacgatgtgtgcactcgtagtctttattgacggctccatgcggatgtttcagagcgcacgtacggcacagcgggaacagaagtcgctgatcaaatttcacgggcagtacaggcatgtcaacgtgatggggcggcacaacgaagactttgagaatgcctcagaccggcacttggtcgtcgcgtcgccagtcaaccgcctgctcagcttcaccgatgatgttcactcgtgttgggtggcccgcaggatatgctgtcacagcattcgtgtgggtagagcgaacgaacgtcgtaatatttcatccgccacccctttggcacctcataatgcagtcgttgtggacccacacgtcctccatggtagcagtccttcaaccgaattggaccactgtccttatactgtgcaaaggcgcgcttcatttcgtcgttgttgcgcttctccgcgttgatttcacactcccaaaatacgagcacttgttgcaccttagatgtgatgaaggccatccgtcgcgcatcgtcctaccgtatccgctgcgccattttgccgttcgccatcactgtttggggctgaaaacggtgacggggatggtcgtgcgcgttccagtggcagccgttgacttcgatcacggtgtcggtcgccgcgatgtatccgtccacagtgtattggccaattttttctctccgtcgggcgagtgtgccgtctgaatgctcaccccgttctttttggcgtaccagtcaatgaatttgagcgctataaggctctgggtgtttgtcgtgtagtagccgtactcgggcacgatcgcgagctgatctcgcttcagatgattgaggcgaaagtgtctcatcgaggcactggcgatgttcatcggctcccaggttatgtcgatgccaccgacaatcacatcgaatgcattatcgttgtcttcttcctcctcctcctcctcttcgtcgtcctcgtcatccaagcatccatgccactccaacgggtctctgatcgccaaaaactgtgccaaaagcaaccaacgcctcaattagttgtgcgtgtcgttggtgcagtaggctgcgagctgttcacataggtcgaactgctgatggtggtgttctgcgtaccactggtcgaatctgcgctgtcggtcgggcgtcattccgccgtataagtagtcagcttttggcggtagcgactgcagaatgtgcccataactcgcctcaacattcgccaaatgagggaagaactccttatcctgcacattgagtccgaacgccccgggcagagcgccgagcggcaccggcataaggttccagctgtctcttacgatgatctctgggtttttttcgccccgcgcaattttcatttcatataatttgttaccacgacggatcatttgtggacaaaacccgttgaggaagaactgtcgaaacagcataatgttgtcaaagcgacccccgaaatgggcgaagaacgaattgtggcaagtattagcactgattctggaagtgccgtgcataatgcaattgaaaaaggacttccgattgtcaatgacgatctttttaaatgaaaatacgtacaaattgagcctacctaataaatccaaaaaacatgcctttctgttgataatctgttaacaaattgcactcaaattttaaaaattttccccggcggcgcctaccggcaccgccggtctcccctttcttccacaaaagttttttggaaaaagcgcgccgaaaaaatgatgagaaaagtaatatacatttctaataattgatcatttagtccaaaaatgattatttttttaaataattgaaataaatttagtttgaaaattttcattaatttaattatgttttaacttttggattttattaaataaaaaacaaaataataatattgtattagtttcacttgaaataaatttaaatttgaatttttttttaatttttaaaattttttaaaatttttttgaatttctaaaatttcccggttggtcccggttcccggttccgaagaaaaatcgttgtcccggtcccggcttctcaggtcccggcaagtcccggtcccggttttgcccaaaattcccggtcccgctcaactctaatattttctctgaaatttgaaaggaattttaacactgtcacttgcaagcatttcgtggaagctatattattttggcacagtgatgttggacaaaaatagattttcacagattaatccctgtaaccggtttttcaaaaatatctctattaattagctaacaattaaattagttaatcatttattaatattatctctggaataaaaaactaatttatgatatggctttattaaaaccgaatttaaaggcatttcgctgctagatttgttttgtcaaaatgatgttgacaacagtgcagaagggagggaaaatggcggatttaaaattgcgacgccctttt

SEQ ID NO: 7578 - DNA, 1768 bp, Heterodera glycines
tagtcagcttttggcggtagcgactgcagaatgtgcccataactcgcctcaacattcgccaaatgaggaagaactccttatcccgcacatgagtccgaacgccccgggcagagcgcgagcgggcaccggcataaggttccagctgtctcttacgatgatctctgggtttttttcgccccgcgcaattttcatttcatataatttgttaccacgacggatcatttgtggacaaaacccgtggaggaagaactgtcgaaacagcataatgttgtcaaagcgacccccgaaatgggcgaagaacgaattgtggcaagtattagcactgattctggaagtgccgtgcataatgcaattgaaaaaggacttccgattgtcaatgacgatctgatcagagccgctgaacaggatcagacaatcctgaaggtcaaaaagttcgtcaaaactcaatggccaaacaaaaaggcaatttcggacgaacttatgcaattccaccgcaggcgagaggcattgacaatcgaaaataattgtttgttatattccgaacgagtcgtggtccctgcctctctacaaaatgaggtactgcaacttttgcacaaagggcaccccggaattaaacggattaaaagcctcgcgcgccaatacgtttattggcctggaatggacgagcacatcgaaaacatgataaaatcttgccaaccgtgtgctgcagaagcaaaagcaccagtgaagactgaacttcactcttggccgaaaacggatggtccatggaaacgaatccatatggactacgctggaccgttcttcggaaagatgtttctcatcatcgtggactctttttcgaagtggcacgaagttttcgagatgcgttcatccggaacaaccgcaacaattgaaaaattgcgcggcatttactcgacttttggcttgccggagactttcgtcaccgacaacggcatccaatttacgtccaacgaattcaagcagttcgtcactcgaaacggcattacccacctattttcggcgccttataaccttatgtcgaatgggcaggctgaacgctttgtcgacacgttcaaacgaacgtccagaaaattaaaaggggagggaattgccaacgcattggagacgtttttggtcacgtataggacgacgccaagcgagtcgctgaatggcaaaagtccggccgaaatgttccttcagcgcaaagttcggacaacattggacctgctgatgccaaaacaaagacagccgatcatccgtgacgaagcaatggaaaagaacttcaaccgacgcttcggagcaactccgagattttttttagttggagataaggtttatgctcgtcaccggctgtcgcaacaatggaatgctggacacgtcacgtcttgcaaaggagtgatgtacgacgtggagttcgtgctcggatcaacatcacgttttcacgcgaaccagctgatcaagagtgacaccgatcaattggacgtggacccactgaacgtgtttaatgaagattttggtttgccaaaaatggcacatcaaccaaatcagcgcccaaatgaggccgtggttgaaccaaatattgtggacaatgctgagccagcaaatgatccaccacctgtcgaacaacagccaatttcaccgattcgtcctcgacgacagtacccgaaacggaaccgtcgtccgcccgatcgctactcgccgaagtgatctgaggacctgtgctcgctgaacagaaggatggaagacttttaaaaggggaggtgttcgg

SEQ ID NO: 7579 - DNA, 2039 bp, Heterodera glycines
  misc_feature (1500)..(1500): n is a, c, g, or t
  misc_feature (1773)..(1773): n is a, c, g, or t
  misc_feature (1780)..(1780): n is a, c, g, or t
gcgcccacacaatggcctcgtcggtgttcaactgtctgcttatctctttgcttgaaacaaaaaacagaattaccgtcatcatcattttgcaattctccaaatttgatattttttaaattaaatatcggatttaggaaatttaagcaaattttaataattcaacttcaaacttccaaaaaaaaaaaattttatttttcatgggtgcacttgacgacaccgcgaaacccccattttaccatatttgtgaagatttgacccaaaatggcaaaaattggcatgttttggcgaaaaacggctacaaattcctgctttttcctcccggcgctgataattttaaatgacacaggagaaaattttttttaaaatttttggcccgaaaagaataaaaaaaaattgttttatttcgctctcccaaatttttttcctattgtttgtaaactttttgttcatttctgaccaaaaactgtttcgcttttttttaatccggtcccattttcgacaggctttgaattttgggtcaaaatgaatgggtcaatgggcccaaaaaagctgccgatgtcgccaaactcttgcaatcgttaaatagtgccaaccaacccctggagaaatgtgccgaggacggtctgtaggcgtggcatccgtgtgccggcacccatcaacacaacacggtccaatttgtccagcgtaagttgggccatccgcaacgcgtcggtgatgggctccatgtggaattgctcaaagtcttggaacatcgcctccaactcgtcccgggtgactttgacgcggaagtcgcggtcctcaaacacactctccacatgggcgtaatggtccgtgtttgccgacaaaatctatgggttttaaaagagcgtatttatgaaatcaccaaaaatatcataagaataattaccaggaattgcgatacttactcctattgtaagatgccatgttcaagtcgtaaccaaaaaccaaaaattcggagggggaacccgaagattttttttttttgaaattcgggccaaaaaagcttttctttaatgtgagcaaccgagagaaaaaaacagaaattttgtagctgttttccgccaaaaaaaaaagtactcatttttgcattttgtcgttaaaattcaaattttctgaccggcggtgccgataggcgccaccgagaaggcattcccactggctatgtttcccaaaaaaaaaaaaaaatcgctaaaagacaaaaaaaaaatttttttttcttttcgtcaaattttctaatatttttttctgaaaattcaacctgtttgacgcgttcggcctccttcatcagtttggccattgccctcaaattctgttcaacggtattgctcgtggacgggtgctgttgcttgaacgcgcggacaaggtggtcgcggagtcgaagtgtcaactgacgaccgcccaatgtgcggttgtagccgacgccgagcgtttccaccttaagcaacaatgcaggagcggaaaatgatagaattctcagtnttttcaccgtccacccttctcccccccccctctcccagaaattttttaaatcaaaaagaaaaccttaactcttttaatttaagtaaaaaaaatttaaaagaaaatgtgattttttcaaattacgaagtttttcaaaggtttcctgaaatgcattagaaaacttcgaaatttttacctaatttttttacaaaatgattttttaaagatttttcgggggttggggataccataaaagaactgcctccctcgatttttttttgttgaaatctatangcctgcncaaccacacgcgacgcacttgtggataaattgtgggtgcttttcgcttcgctgtggccgttgtgctggttggtgctgttgcttggaagcggtgttgctgccttcgtgtcattggtgacaagccaaattgacaaaaagggcccggcggttttgatgatccacaatcttaaagaacacccctgttaagaaaaaaaaaaaggggggggggggggggggggaaaaaaaaaaaaaaaaaaaaaaaaaaaatttttttttttttt

SEQ ID NO: 7580 - DNA, 2846 bp, Heterodera glycines
tactatttctttatctctgttaatagagaaaaaccgcatttacttctctctaagaaacttttttcccgttaacagattttcttcaaattttgcatatcaatagagaaaaaaattcttcatttttctatgctgatttattaattgtctatgctcaagttcaaaacttgcaagtttagaacacccatatattttttctaactcaccaaactgttcaacatttgcttagaaaaagcttctcctcatcaagagcttttgaatgataccaagatctttcaatttactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaacgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatccattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatccttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttatggccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtatttgatagccccaagagccctctataaatctacgaggttgaaaaaattcacccaatattagaaaatttatggtcaaaatgttcagaaaattattatttgaagttttttggatgcttctagaaaatgcattaaagttgtcaacttattttatgatttggtgaactgcaatagagtcaactattttaccaataagaaaaaagttatggtccactaattatgagaattttattgtagggtatcagaataatcgacaatgatttgccggagggaccgggcagaaggcttcgcaaaatgtggccaatgttcggaaacacatagactacatcgcaaacgcactcaatcacatggaggtaagcaaattcatcagtaaaatgtgctttttattaaattcccgcggttagattatgtgaaagttcataaaaaaaaaagatggaattccacctctcaaagagaaaaatcttattttataagtcatttgggaaaattgttgtctcctgtctctcccaattcattttctatcatttgatttgggtaggggatggttcgactttcccccgattcgttcgtatggacgagagtcgccggagtccaacacgttcattcgcttttgcctttctttttgccttcttcaataggcacgcctttggcagtctccgcaccgtcgccaattgcggtgggaacgtccggtcattcagccggacattctctaccagtcgtatgtgttaatgccgaaacttacgccagaagtgccggtggattgcgttttgagtaaatttgtgcgtgccgcgatgaacaaagtgaagtgtccgatttactcactttgcgttcgtttgttttcttccgcttttttccttccaaaaagtgttttcagtggaccccggagggcaaacgactgattaccggcgcatcatccggtgaatttacgctttggaacggaaccgcgtttaatttcgaaacgattctacaggtaattgggttctaattggattggcactttctgtctgaaatggggaggggtggtttggagtttttgtgaatgaggtcagacagtgcatttaatttaacgattttttttttttgttcttttgtgatacgcataaaaaaactcaattcatattttaggaaatttttaggtctcccattttggggtctgcctccgttagcatgtttattttttttgttttacgtgagccgctctttgcatttgcaggcgcacgacgtggccattcgggcgatgaaatggtcccacaatgaccaatggttggcgtcggctgaccaaggcggctttgtgaagtattggcagccgaacttcaacaatg

SEQ ID NO: 7581 - DNA, 2390 bp, Heterodera glycines
  misc_feature (138)..(138): n is a, c, g, or t
  misc_feature (291)..(292): n is a, c, g, or t
gctcacatcattacgggtaaatttggtaaatgaattcgtcgtcaaattcgggtcattaccatttgtcaatgaaataaattactgcgattttgagaggaggagggcaatctttttgtttgttttattcatttgcgtctntaacaaaagtttaaattatgtgttaacttcggcatttaaatgatggatttttgtcatttatcaatattcaatttgtctagtgaaaacgttaaaattaattggcaaagggtgaaaatacgaaattcgataaaatttgactcggatcacccaacnncaagaaacaaagcaacgcatttagccagattaaaaaatgaatttgaacaaactgacgtaaaccggcttaaatattcaaatatactgaacaaacgtcttcgccaagtggcactccgaccgacgaataaatttgctcttattttgtaaagggcgcgttataatctttgggttgggcaccgataaataattagcgaatttaattttatctttttccattgaattattatcggcgtgataaagggaatggctgcccaatgactgttttcatttgtttcttcaattctttctccgtaaccaaagtcacttcttcgcttgcctttggttttgttcgcttttcgaccgccatttcgttcatttccattgtttttttctttcctctgattgttccctttttcatcccttccgccctttttcagctggtgcccaaccgatgtcaaattggccactgcttccgacgatgcgaccgcgcgcgtttgggacttcgcgcggtgtgcggaagagcgcgtcatgcggggccacggagcagacgtccgatcggtggattggcacccgacaaaaggtgaagacgagggagcgacggaaccgatgccgttgaagggattcccacatttggccaatttctcgaattcgtttattgcaaatgtttaggacttttggccacaggttctcgcgactcgcagcaaccggtcaaactttgggacgtgaaaacgggccaatgcttggccactctgtgcgtttgttgactgtgtcctttattccgccttctctcccccctcagtcatgaccacaaaaattcggtgatggctgtccaatggaatcggaatggcaattggctgctcaccgggtctcgcgaccacgtgatcaaaatgtacgatgttcggatgatgcgcgaaattcggtcattccgtgcacacaaaaaggaagtgacatgtacgaagttgcactttctgtcactgcttccccatctccaattgtttctgcttttagccctcgcttggcaccccgtccacgagggactttttgtcagcggaggcggcgacggatccatcggttattggctggtcaattcggagaaagagttgactctgctcgagcaggcccatgacatggtcagtgggcattgccattgtttttttcgggccattgccttttgctgtttaggccatttgggctttggaatggcacccgctcggacacattttggccaccggttccaacgacaacaacaccaaattttgggcacggaatcgacccggggacacgcaggaggatgtgttcggcatgacaagcgtgggaggggtgctaacatcgaccgcggcatcggtaggacggcccatttaatagacatttataaaatggggacgcaatcgaaggcactcgacgacgaccatcaccacggcagaagagaaacgcacgcgatcagtgaggaatcggcacaagcgcaagtggccatcccaggtgaaagggaacggacaacgaacggggggagggagaatggcactgtgcctggggcaatttggcatcccccgtccgaaagaattatctggacaatgttaatgattttatttttcatatcatttcttgctttattcggatcctcatcattcccttcccctttttgcggatacgttttgtcctgctccgttaatcgtttgcccttctaagggatgggaatcgacgattcattgcgttcgatgatgaacagagatgtatttgtgcagcacttccaaacgacccaactgatgtctttgccggggctgggcagtggccaaatgccaccgccgtcggccaccggggccaacactcaaccaatttttgttggcggtgggaggccaccgatgggcggagacaaattgggcaagtttaattctttgtgtaatgggctaatagatgggggcaaaatttttgccaaaggatccaaccattaaaccgattaccttttttgctttttacatcgcttttgcggtgcgtttttttaaatacttataataaaaacccgtttatttttagcaatggaaacgggaagacggcctcacaatcagttccacgagccgtatcaacaggggacgaggaggggacagcagcaacagccattcctc

SEQ ID NO: 7582 - DNA, 2014 bp, Heterodera glycines
aaaaaaaaaaaaaaaaaaaaaaaggggggggggggggaaaaaaaaaaaaaaaaaaaaaatttttttttttttttttttttttccccccccccccccccccaaaaataattttgtttttaaaaaaaaaaaaaaatatttttttttttgggaaaaaaaaaaaaatttttctttttattatataaaaaaaaaaaaaaaatgtttgttttttttaaaatttttttttttttttttttttttgccccttttccccggggttccctttttttttttttccccctttttttttttttagaagagaaaaaggagagaaaaataaaacccccctttttttttacctttttaaaaaaagcccccaaaatgggtgggttttttttgggtttccttttggggggccaaaaagatcccccggggggatgggctttaaaagggggggggaagggggaaaaccgggaggagcccaagaaaagggtcggtccaaccacaaatgaccatccccaaattggtgtcggaggcagttggagctattcggtaaaaaaggaacacacgcgggaaaagaaaaaaaattaaaattgatttcttttttggtcatttttctttgagaaggtctcgattaaaagaaacacaaaataataatttaaccattcttttcaaggtacctaacaatataagtaaaaattattataaatgatttattaattaatgctttagtgcttgctttttggctgtgattttgcatcaaaattccgagttccttgtcacatgtcccaaaataaaggcccaaatcagtggcggaaagacggcgtgaccaaatgtcattggcaaagtgacgtttagactgaacaaaaaacatttttattattattttcaatttttaattgccattaactgtttcatcgttatggtgtttgggcaaaagcgcccgaaagtgatggatttcaaggctatggtcctgctcataaactgtgtccaaaacggacacattattgccccgactcgccagcctaaacaaaacacacatccaatttaaattcaattaatattaattaattagctagttaattgattctatcttataaatcccctccaattttgtaaaatatttgtacttttgcatcaatggaaacaccgattggaaatggcttcccgtgtcatggaaaaaggtgaacagaatgtttgtacatcggcacttgtcaattgaaacaaaaagcacaacagaaatggcaaaaactgatgttttaagttttgccaatgccattttattggccacttaaataaaataaaattaatttaattaatattttttatcttttggccattcacttcgaatgcgaatgaatgaaagtgagtaacaaacaaaataaagcggcaaatcagcgacagcttatcggaaataattgggaagaaaaagataaaacaaatgaatgaattggtcattgtgaacaaataaaattaataataattatcattttagagaaaaaaagcaattattttgtcaaaaaggaaaatgaatgagcaaattttgtcgcgttatcgtacaataattcgtttaccgtatatttaaataaaatgaatttgaacgaggttttatagctgccaaggtttacaattgtgaataaaaaagcattgttggatttgcttgcccttggctcttaattatgacagtttgcaattaatttgataaaataattagcccgcgtgagtttcgcttttaaaattttccgctggtgctgctgcgttctgttctgcttcagttcgttctgctgctgctcctcaatctgttccatgtactgtctgagtgccaatccgcccacaatttccgttgtccgcgacggcgccgctccgccgccgcgtgccatcgtccgcactgccgccgcgcctcgtccggtgcctttcacgcgccgtccgccccatccgttgccctcgcgaccgaccgcgcaatggtcgcagcccttcagaaactcgcgcacaatttctttgctgacattggcgaagcgtttgcgcgcctccacataca

SEQ ID NO: 7583 - DNA, 1075 bp, Heterodera glycines
ttgctttaaatgccccctcctacgatgccacctccccccctcccctccgttggcactgtctttgccacgaatggcaaaattacgattgacagtagaacgaaaatattccaagcgatggagcagtgaaatggattaaaaacagatgaatggatgaagtcattaacattggcaaaaaattgaaagcaaattttgccatcatttgccaactgtccaataaatcattctcccctcgattcgtttttctgcacatttgtatattttctgtgttggaaataagcacatgcccttttctgttaatgccattttctctgtttttttctgtaaaagtgcatttttttattacgttttattatttcaatttttctaattaaaattctcaaattgtcattatttatatgaaacaccgaaaatggcaaaagaagtgaacggaaatgattggtttcggaatttcggtcattccttcggcataatgcaaaacctaattaaaattatatgttaatcaaaatttagtttaattaattatattttactctatgccatataagttggttattatatgataacagggctgccattcgttcttgaatgggaaggacgtccttaaaattgggtcctctcacttgaaaatttgaaaatatccttgaattcaagatgtccttgaaaatgaacactcgaaaaacattcaaaattttgtttttttttaattttataccaagccttttatatttaatgcaaaatttgttctaaatcgcaccaaaaaagacctgtagtttttattcgtctttggatttcacaaatttctcccgtcaaatccttcgaaatcagtacactcgtccctggaaagcgagttttaccaatgccaccagccctgtttaatctgttatagatgccaaaacattttatttaatagcaattaattaaaaagcaatttctgaactttggcagattattcccaatctgttctcgagtttttttatattaccagtttgttcacttaagtttaactatttgggagacattaattaataaacccaaatattcttatttgcttaaatgaatgctttggtctcatttt

SEQ ID NO: 7584 - DNA, 4580 bp, Heterodera glycines
taattttaaaaaatatggaaaaacattaatgttaaaaataaaaagaaaaatttaccataaaaatataaaattaattatttgcgaatgttatacatacataggattaaattaagtgtgtatataccaaataaatggttatgtaataatattacacaattggcagttggacatacacaaagaaaagggaaaaaatgagatttgtaaaaataaaaatgttaaaatttatttccaaagattgggcaattaattaatttgttttttaaagttattgaattgcgcaaatatcaaattgttcgtaaaaatattgcgccaatttttgaaaatttcaaatttttcaaattaattttgttagtgttttgtgcatgtgttgtttaattgatccaattgtgccttctttcgctctgccttttggtgccaaagttcgtttattcgctaattgctccccggtgagttcgcccttaaggtggacgacgccgtttcgttggtgtgccgactgcgtgcgtccgctttcgcactgcccggcgcgacgacgtcgtcactttcgggttgagcctaagcacacgcattaaaattaatttaaattcaatatttaaatataattgtaaataattctgactgacgaggggcgcctgcggcaacagaacgtaaccgccggtgggcgccgaagaagcggcggaaaagcgggacgaacgggggaggccgtggtgagaggtgacgcggtggtgcaccccgccactgctcactgagcccttcatcagttcgtagcgcatcggagaacggaaagccaaacagaagcgctgaaaaacgaaattcaaaaaataataattgaaaatgggaaacacccggcaaagcgaacgcggaccgccgcgggcgcaggcgcggaaaatggccaaaagggcgcagaagggaatgggaagaagcggaaaaagtgcaacggcgacgccgcaccattcggaccattcccaagagcgcaattggggcgaatatttggcgaaggaatagccgagaacgttgaggacggaaattgccttgggggaaaatttaaaattgggaaaaatggtgagaaatgtgtacaattggggcgaagcaaaggcagtaggagagagagagcagcaaatagccgacacaccaccagaagacggagctgagcatcgtccgcaaatccatggccaacgaatgggcgcagtacacccaaccgacggcgaacagttcaaatgccaaaatggccaacacagtgacgtaattgaggaagccgctggccaattcgtagccgaaggcaccggcctaaaaaacacttaaaaaatcaaaattaaaaactggggaaaaaggacctgagtagcgaaaaagagggaggaagaagcgcagaaaaggcacacgaaaagtgcgagggaaaagcgaggacaacactaattggggacagcaacaaatgagaggcatttgggaataaatccatttaaaaccaacccgagaccatttctcgccgaacgcatcttccaaagtggcgagaatggaaagtgcgagaagatactgtaaggggggggggggggtgaaacggtaatactgtaagacaaaagcgggaaaaagataaaaagacgaacaaaaacattgagaagaacgaaggcgcagagaaacaaaaagaggccggagagaatcttggcatgaggcagaaagccaaggaagacgagcaactggtaaaactgattctcacctgaacgaaaaataattgccaattttaaaatgccaaacaccgtaaccgaaagagaggaaaaggggtactgtaacagaaaaaatcacagaccctggtcaatcagttggtcgggactgagtccgcttttggcactgacatggccgacgagcgcaacaacagtggccacttggaggacactgatcagcgcgtgggtaaacaccaaaatgaatgagtctctgcacattttaagggttattctcgagatttagatgcatttttaagtgagggcactcacttcaccaaattgttggaccgtttgttgtacgatccgacggtgatcaaagcgccgaagccgacaccactggccaaaatggcctgctcaacggccgttttccaaaccttagcacagcgaaagtaatgcatttgcctcgacaattattgcttatttcgccctttgccctcccaccaaataatccttcaatttgtgccaatccaacgaatccacaaaaaattcttggaacatttcaacggcgcccgaggcgaacatcgcgcgaccgcaaagggccaaaagcaaagcgagcggaaccatgaaagagaactgccaaattggccaataaattaaagcgaaaagaagcgaaaagagagaaaggacggaccacaatcactttgccaagccaacggacgccgaaacaaatggcacaaaaaaccaaaatccaaataaggcattgggcgacgagaaaatgccaattaaaattgccaacgtcgacgacactgtcacttttgtgatccaaaaggctaaaatgaatgtaaaaaaattttcttcagtatttttgtatgttcacaaaaaataattcgaatttgtccgatttccctttacttttgaaatttgctcatcgccgactcctcgtgaaaggtggccaatctttggacagtgccaacgatggccgaggtgccgttctgactgatcaccgacatcgattctctgcagggcccaaattgaatctcgggaaagtttttgcaatggagccaaggcaggcctaaaattttagtaaggccgggactggaatgattaaaacggtgggactgaatcagtccggccacactttaccgggtctgtcgtcggttaatgtccaaaagagagcataaatgaaaatgataagtcgggccaaaaagtgagtcatcgtcgccttagacagtccaaattgatgaaaaatgtgaaaaatgggcactgaccaaaacgaaaagggaaaacaaaatttgggagattccgacacctaaattaaataaaataaatttaaaaatattttaaatgaatgcctttgaagacggggcaaatgttgtaaaatgcctggacaggcccccgcccggtcagttgaccaaggcaaatttcgagtgcaacaattggcaaaacgaccaaaacgagtgcggcgccataagcgaccaaaaaggcggctaaattaaaaacgaatttcatttttttgtaatttttctttttttacgtccgccgttgtcgaggataagcctgggaaggttcagaaaattggtggtggcgaagagataggcaaaagcggcaaacataaactcggatttggcggaccaaatgtcccgccattcctcgacgatcagagaagaaacctatgaaaaataagaggaggaattgatcggaagaaatggacaaaacaaaaaacaaaggaaaaactgatcaaacaatgccaaagtgaatggagagaatgccaaaacaaacagaaagtgccatcgaattaattaatcatttaattgaccctttgctaattaattattgcattaattttacgaattcgtccaattaaatcaccttcatgttggacaaacttctgtcctcaaaccacatcttttcagcagatatgtctcattagcagcagcagaagcagtgttgaaggttttgcacattaatttgaggaggaaatgaaaagcggcgaatggccgttcggttgggattacagtaatgaaactgcagcgaagtgagtacggtaatgttactgtaaaagcaaaaatttcacaataattcttcgtttgtgttcaatacatattaatgttttgttgcacacttccctttggcatttgctcattcactccctttttttcgtttgttttatttcggttttaatttaaaatgtgcgaaaaatgggcgaaggaatggcaaagtgtcggggcaattgcaacaacacattttacaacaatattattgcatttttacaaacattttgatggaaattggcaatattttctttcgttttgaaagggacaaacaaaaaaagggacgaccgaccgactcattatttggggaccaattcaatgaatgggtaaatggggggggtgaatcgaattaagattaacatgtcccccgagggcagcgcgggaaggcgggggaaattggcagggaaaggaaagaaattgcgacggaaaatgaaaaaagaaaaggagcagacgcaccaggcggaggaagaaaaaggttttgttattttggatgacggagaagggcattattcattcattcattggcacggcattttagtgacataagaaacaaaaaaaggaagtgagtgacaatgccaactttgaagaagatgagtccaaatttaattaatgagtggtcagtgacgagagtaaatggcaaaaagtgaggatgagagagataaagggggtggggaaatagtgcggagaaatggaggacagacagaggagagaatgggaaagaaaaggtcgaagagggggagaaatagtatggggatatgagagacgaaagggggacagagaaaagaagaaaagccaaccaatcacatcattgacattgttttgctaatttgtaaggtaaagtgaaaagaaggcgcaaattaacgccgaaagaacaaaa

SEQ ID NO: 7585 - DNA, 1163 bp, Heterodera glycines
gatcttaatagaaaatggataaagaaaagggtggtttattgaaaaaaatggtgttaattcgagtgcaggatctataaataaattaatattattttaatcattaaaaatattttagttatataaatgataaatcgaaatttattaatgctctgataaaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattttttaaatcttttataagatttacgcgatacaaattaaggaaatagtgaagttcatgtgatcttaatagaaaatggataaagaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatcttaatcttttataagattacgcgatacaattaaggaaatagtaaagttcatgtgatcttgatagaaaatggaaatgaaaatgtggtttattgaaaaaaaatggtgtaattcgcgtgcaggatctataaataaattaatattattttaatcattaaaatatttttagttatataaatgataaatcgaaaatttattattgctctgaataaaaaagcattttgataat

SEQ ID NO: 7586 - DNA, 1665 bp, Heterodera glycines
  misc_feature (13)..(13): n is a, c, g, or t
  misc_feature (23)..(23): n is a, c, g, or t
  misc_feature (35)..(35): n is a, c, g, or t
attatttaatctnttataagatntacgcgatacanaattaagaaaatagtaaagttcctgtgatcttaatagaaaatggataatgaaacgtggtttattgaaaaaaatggtgttaattcgagtgcaggaatctataaataaattaatattattttaatccattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtgaagttcatgtgatcttaatagaaaatggataaagaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataatgaaaaggtggtttattgaaaaaaatggtgttaattcgagtgcaagatctataaataaattaatattattttaatcattaaaaacattttagttatataaatgataaatcgaaatgtattaatgctctgataaaaaaatcatttggtaatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataatgaaaaggtggtttattgaaaaaaaaaaaattattataggtttttagtcaacatcgaggctcaagacgggcgcttcgcgcccgtttttaaatttgttggccttggacgggcgcttcgcgcccgttattcaaattttgttggccttacagagattagaagagatacaacagtgattaaaagaggtaaaaagtgattaaaagaagtacaacagtgattaaatgaggtcaaaagtgattaaaagaggtacaacagtgattaga

SEQ ID NO: 7587 - DNA, 2806 bp, Heterodera glycines
  misc_feature (2764)..(2764): n is a, c, g, or t
  misc_feature (2785)..(2785): n is a, c, g, or t
aatttttgaaaatttccgaaaacgaagtacaccgtctctctagagcttaaaatgctctacaaaaatgtcctaagtcaacttttcgctaaaatcaacccctgacgagttataggcccgggactcaaatgtcccgctcaggccaaaatttttttctatttccgggaaaaaatcgaaaattttccaaaaaaattaccaatcgatagagctcgaaaaactatgttttggaagtggtcttcgtttctctgggaaaattcgttaaaaattcctaaaattcaaaaacccgaaaaccgttttttaggcctagctcgaaaaattttgaaaattttcgaaattttaaaaactggaaaaatccagctcattgaactctacaataagtctgctggtaactccccgcccagatcaaaccctaatgagttattcaaccgggactgaactggacaaagttggtactgaaaaagtccacgaacctacagcctttcctattgcagatagaggcttggaattttttttgttttttagaaaacacttcaacttagccccctcacagcagacattttttgatttgggttttagaaaaaaagttacgggcccccaaatgcacgaaaaaatgagaaatccgtccctgggactcagtcgtccgcgctaaatttttctctatagttttcccagatgcgcctcaaaaagttgtaagacccttccactactttcagggcgctcccggccttcggccgggagaaaatggttttagcaacgaaactccttgtcaatataacgtatatagtaactagcgggtgcgtgaaccgtcggctatttagctgggaaaaagcgcttcgcgctttgggagcttcgctacctagattagctctggttgtggagatttggattttttaaaaaaatgttaggggtttttaggccgcttccagtgattagaagaggttcaacagtgattaaaagaggtaaaaagtgattaaaagaagtacaacagtgattaaaagaggtaaaaagtgattaaaagaagtacaacagtgattaaaagacgtcaaaagtgattaaaagaggtacaacagtgattagaagttagctcttgttgtggagatttggaatttttttaaaattatctgggacttttaggccgcttcgcggcctcgaacgggcgcttcgcgcccgttttttaaattttgttgggcttatacgggcgcttcgcgcccgtttctaaatttgttgggctattaaggcattcgaggcctcagacgggcgcttcgcgcccgtttctaaatttgttgggctattaaggctgcttcgcggcctcagacgggcgcttcgcgcccgtttttcaatttttgttgaccttgaacgggcgcttcgcgcccattttttaaatccgttgaactcatacgggcgctttgcgcatgttttttagcttgttaggccgctttgcagcctcagtcgggcgcttcgccggtttttcaatttttgttggccttggacgggcgcttagcgcccgttatttaaattttgaggtacaaaagtgatgagaagaggtacaaaagtgatgagaagaggtataaaagtgattagaagaggtacaactgtgattataagtggtacaacattgttaggagaggtacaatattgtttaaaattaaataaataaggaaacgtttttattaaaggttaaaaatcgagtgcattttaatttaaaaattttttaataataaaatactcttttattaattaaaacaaccttggaaattattaattgaatatttatttaatttgaaattaaatgaatttttttacaaattcaaaaataaataatgaaattctttaatttaaaaaaaataaatttaaataatttaaaagaaatcttcaaattaattaaaaacattgtaaaataagccaaaaatacaaagaaaaataatgttacaccgtccggattcgaacctgctgcccccccccccccctcagaacatgtcccagaatccccaatcacacagggattctgaggtcttgacgatgtcaaaagtaaaatctgatcacgtattcgtgatcagcggcccaaataacgcctaaagacatgtttttggaagatttttggtgaaaattttttttcacttaaaaaccatgtgctcccccctttggtcccgaagcccaaaatcacttttatttttgtatcttttttttaaaatgtgatagaaatgccaaataaaatttatataatagagcaaaaaattgcggatttttgtagtattttacttttacagtatgacttttcagaaccgagttatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattctaaaaaatctgaaacttaaaataaacatcatatttgtgctcaggaccctaatttaccccagaaaaatttttttcaccctctttttcacccaaaaaaaatttttgaaaatttctagggggcctagctcgaaaatttttgaaaattttcgaaaatgaagtacaccgttcgatagagcttaaaagctctacaattttgctctaaggccatttttggctaaaccaccccctgacgagttatgggcccnggactcaaatgtcccgctcangccaaaaattttttctatttc

SEQ ID NO: 7588 - DNA, 4480 bp, Heterodera glycines
  misc_feature (5)..(5): n is a, c, g, or t
ggggncaactccgtctgagccaaccccgtctagccaactccgtctagccaattttcgtctggcaaactccgtctggcaaactccgtctcgccaactccgtcttggggccaactccgtctgagccaactccgtctagccaactccgtctagccaatttcgtctggcaaactccgtctggcaaactccgtctcgccaactccgtcttggggccaactccgtctgagccaagtccgtctagccaatttcgtctggcaaactccgtctcgccaactccgtcttggggccaactccgtctgagccaactccgtctagccaactccgtctagccaactccgtctggcaaactccgtctggcaaactccgtctggcaaactccgtctcgccaactccgtcttggggccaactccgtctgagccaactccgtctagccaatttcgtctggcaaactccgtctcgccaactccgtcttggggccaactccgtctgaaccatctccgtcttgccaactccgtctggccaactccgtcttggggccaactccgtctgagctaactccgtctggccaactccgtctggccaactccgtctggccaactccgtctggccaactccgtcttagtgtataaggggccaactccgtctcgacaaaaaaaaagaatttttttcaacgaatttttttaaaaatacacccctaagaaattaaaaatttcttaaaaattcatccactaaatccatttatttagtttcatgttctgatttttaaaattattcatcaaaatattgtttgacctaacagtttaaagtgccattaatattttagcactacgaaaatggaaaatgctgaaattaaatctcaacgaaaaatttaaaaactcgaacatgaaggctgcctgtatgtcttccatttgttgaacgctgatggtgacgtaaaattttggcgatgtgaacatcagcacagcgaattcaaatgccgagggcgccttcacacaacgctcaatgacgtcgttctgaagataattggtatacacacgtgcaaccacagcgcggcaaatgtcatcgcacaaaaaatcaccacccgcattaaacgacgtgctgctgaaacgatggaaacgccagcggcaatcagggcacacacacttcagcaaatcccaacgccagtaatggcgaacattccgacaaaaaacgcgaccaaaaaagtgaaaaatctttttattttttacttttttacatttttgggtttaagctggtgaagcgagtccgccatgaaattgaagtgccgccgccagtgccagtaacgcttcaagaattggaacttccagagcagtacagaatttacaaacgcaccgaagaagcgcaggagcttttccttctcgccgattctggaacgtacaccgagcagaaccgagaacaacagcggtgtgtttaagtgaaattttcagccatattttaattttagaattcacatttttggctggctttcattcggaaattgggctttcgaaatgaagtatatttagctgacggaaccttcgcaagtgcaccggagctcttttcgcaactttacgtcattttggggcggtacttttttggcaattttgatttcaatagttttctcctaatttcagtcgtggaaaatgggtgtttccggttcttcattgtctgcttacgtgcaagtcgcagtccacgtacgaaaagatgtttgacatgatcagaaaccgctggccgacattttcaccaacaaatgcgtccatggacttcccctccgcgcaaaacatccacaatgctcaatcaacatttgcctattccatttggtgcgcaacatgaaagcacgtcttaccgacgagcaaactcacgtaagaatttttttttattaattttgaaattctcaaatttagcgtttcaaaacagacgcagcctttgcacgatcagccaaaatggtcacttcgctggcgttcatgccgctggctgaccttacacccgcgtgggcagcactagaagaccatctaccaaatgagcttgagagcgttctcgattggttggttgaatttatttttttcaattttattagtaattttaaaggtttataatcaactacgttggacgtcttctcaacaatgacacacgcactcgtccattgtttcgtccagaagaatggagtgtgtatgagcgcacaatgaacagcaccgaccgcacaaacaacttcgctgaagcgtaccatcgcacgttgcaacttgccatcggacaaggacatcccccaatatggaaatttataaacattttgcgcgagcaccagaaaataattgacgtggacttcgaacatttccttgccggaaatgctcctgccgatgaaatctaagcgttaccgtgaagtggacagacgaattttgagcatattacagcgctacaatgaggaaaaacagcagccacaaatcaacgatgatcaccaatacggcaaaaatcaaaataacccgaatttgttcattgaaatgcttgggggaatttcgagcaattatcaaatggattgttaattttttgttaatttatttgctattacattttgaataaaactgagatttaaaaaaattaagcccaatctatattttgataaatatttttaaatttttgaaaaaaaaaactttcaactattttggcgttttgccgaaaatttgttaacaaatatgcaataaatggaaaaatacacccctaagaatcgacccaagcactcttctgttgactgattgggccaagtgaaacagacaatgtctgatcattgtgttcggccaaacatcaagaaatgccgatctcgcagctaaatgagcaaatatttaaaataaaatcgattaaatatcaatataaccaggttcaaaatccagcataaaactgcttggtattacaccttcaacacgctgctgtataacagagaaggctcgacgatatgtttgttgcatccggtttgccattattatatatgcgcatggtatgcttgagtgttgtgcaataatgtttagggtatataattgcatgaaattcgatggccgagctacaaaactttagaaaatggtcacacccctgtcatatatcacttttgaaagtgccgtcgcccgcccaattttggtatgtccgtagccattcaatgcctttgtcacttgcaaagataaaaaaaatggctcctcaatatcgtgctcacgtgagtcccaaatcaaaaattggttccctcttttatccgtcgcgaaggcacccttgaaaaatgagttggaaaatgtcagagacagcgaggatatgagtaagcgtccaagtagggttgcgcgcggtcggttaaccgaaccgaaaccgaaaaccgggggtgggaaaacgggcctaaccgaaaaccgggggtaccggttaataaccggtcgtgcgcaacactacgttcaaggaaaaccattgtttaatttttggcacgatttttagctgttcctgacgctgccttttctataatttaataaaattaaataggaaatattccaattttaacaacagatttcaccacgttagactctgggtccggcaaatggttatgatttgttcttccaattaagtttgtgctgtcgataggtgaatgggccctgcctgggcatgatttcttgacacatctccatacctatttaagataaaatatttaatatatacaaatactgaaaaatagcctgggtttggcctgctgctattattctatcagtacgcatttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgtccgcctctcttgttattgccagccgtccgcctctcttgttattgccagccgtccgcctctcttgttattgccagccgtccgcctctcttgttattgccagccgtccgcctctcttgttattgccagccgcccatttctcttgttattgccgtccgcccgcactttataactatttcttttatgaaacgtgaaaatattattgaactctaaatgaaaactttatttatattttctctgttatttttctcttcatatgaaaacccaattcgcaaacaacgagctgttcgcaatgaacgggcaatagctgggttagcacaattggcagcatcacttgtggccgtgaaagcatttattgccgcaaa

SEQ ID NO: 7589 - DNA, 2420 bp, Heterodera glycines
  misc_feature (7)..(8): n is a, c, g, or t
  misc_feature (2281)..(2282): n is a, c, g, or t
  misc_feature (2346)..(2346): n is a, c, g, or t
agtccanntttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgcccatttctcttgttattgccgtccgcccgcactttataactatttcttttatgaaacgtgaaaatattattgaactctaaatgaaaactttatttctattttctctgttatttttctcttcatatgaaaacccaattcgcaaacaacgagctgttcgcaatgaacgggcaatagctgggttagcacaattggcagcatcacttgtggccgtgaaagcatttattgccgcaaatgcagctttaacggcttctacagccgtagctttggcagcacttggaaccgatatctaccttgctattgagctcgtgagatgtaagtttatgataattgaaaaggcggttgtgactctaataactcatgttaagcctctgatcactatgaggaattgctcaaagacttcttcccgttaacatttgttttggacgattatgaattcactgtctcggccaaagattataccccggattatatttttagaaaaatatcacaacattttggccataagacagaggaaatatgcataaacagtatgttttaataaacaaaaatgttttttaataaattaaaatgtaaattttactcctctactaaagcaaagacaatggcgagacgaaaagtgaaaaattcaagggccgatcttggtgaattaaattaaaattaacataagcactattatttgagtatttaaatatattaatatttaagaaaaaacattgaataaaaatccgtcattgtcaagatgtctgaaaattgcatctacttaattattaataatgaatttattctattgagctcatcaaagttttgtgccatgttcagcatgcacttcaacgaacatataattaaatcaaaaaaaatagaatcaataaaatttcgtttatatattatattattaaaaatactatttaaaacattgtaaaaaaaagaaagaattgctatttaaaaggagatattttttaatcattcatacctgtatgtgctaagataaaaaagaacttattaattatttttataagtaaatatgacgcagtgatgcaaaatggatattataatatttccacagccatacaataattaatatttataaatcatttatgaaaaaaaaattacatataatctaacaaagattgttacctaaataagataaacattataaaccttatttttaaaaaattaaaaagttttttcaatcgtttgattgaaaaatataaacaccaaaaatggaatctgtaaaacagaaacatgtgaattaaatattataacaattatagaaaaatgtatcgaaatttttcaaaaattgtattcaaagcattttattcaaaaatttgacaaaaattcatttaaataataaaaaaaacaattgattctttaatacaagagacagaatacaacctgtgttcattcaattgcaagaattgggacaagaattttaacgacagaaaaaataattattaaattaaagctgaagtaaatattaaaattagttatttaatttaataaacgaatatttaaagattgaaaagggtattgaaatttagcgcagtagaataataaagaattcggatatttaaaaagaaattattttatttcaaaattaattaaatttaaaaatcataaataaattgagcatttttacctaactttttgaattcaactttaaaaaaatatattaaaaagataaataaattattaatagaaagttaattaaatttaatttatatcgcattatcatcactataaaaagttctaattataagaataaaaataacattttacaagtcaacttttaaaaaattcatattatacttcaatgaaagttagttttagtataaaaaatattaacgtaaaaatgattttgactatccacgtgttatattannagcagaatctgacgcaaaatacgtatttcgatggagctgctacatttgcgcccctacatttgcngcccgcacatttgcgcccctacatttgcgcccctacatttgcgcccctacatttgcgcccctacatttgcgccc

SEQ ID NO: 7590 - DNA, 1015 bp, Heterodera glycines
  misc_feature (981)..(981): n is a, c, g, or t
aaaaagaagcaattcttcccctcactttttcctttttcaaatttgtttgcttatgtacagtgtgattcattcactaattcagttatggaccattaaattaattcagcaccgttatggtagggttatttagcgtgtgttgatatttacctatttattaatgggatacactcccacggtggaaggggccatgggaaagtgcactttttcatccgccgatcgtccatcttattatatacaccaccactctttgtggagaacggcagttgtggtgggaatgatgagaagtagctaaattcttaagaaaatggtgccgttcattgggcgaattgccattttatgataaaggaaaggattacactaaaaataaatgcttaaaattggtatttttactttaaaaatgaattcagggatgaaattttttgcattggcggtcttccgattttttaaatgagataggggtggggggtgagattcattataaaatttactaatcattttgtccaattagtgctaattagcgtgagaacatttaaaagttggtgccattgggttggtatgataatgaagggtttttgatgacctttctgccatcatccaattttcccattcgcacctcccccccccctccccctctattagtgatggctcaccaattggtgacactaatcaaattaagcggaaaatcgtccataattatcatcatcatcaaatccttatgtcagattggtgagaaaaatcttatcatcgtcgaaaaggcgacacaaaaatagcctttttaacatttttggaagccgagaaattcacaaattcccgccgagtttttagagttttatctgctaaaacagcgtaaactaatctaggtctcattaatcccaacttaattataaaattagaaactctgacgatgtctgatttcacgaatggcaattatttgaaaaagaaaaattatttttttaccctttcccctcgctgaaggcaaancatgccaattttggtgccatttctgtccttaatg

SEQ ID NO: 7591 - DNA, 3724 bp, Heterodera glycines
tggcaagtcaagtcacgaatgtgcaatattgtgccgttagctgacggaaaaggtcattcattttatccgctataacttataaatgactaattaattgactttcttttcgcttatgtcaattatcattcattaacttttgttaattattcttttttctgtttttaatccaattattttttaaattaacactaattaattaatgatgccaatttaagttgttccccttctccaaattggtttggtgcccagtgcaaattgagaaggtgcagtcatcggcacaatccgtgtattaacggggccgaatgtgagaagaccaaggagtcgtttaagtgccattgtgccgttggttcgttttaaaaaaaattttaatttaataaatttttaataaattagcttttcattgcctttttgtagaaattatgatggaactttttataatcaatttttatgaaagttttatttgtttttgtgtattaattttataaattttttaaggctttactggcacatattgtgagaatgcggtgccgacaatttgtgacagggacggaggaagggacgacccatgtatgcacggcacttgccgagttggcacgacggtggacgactttgtgtgcgattgtcagtacggatacacaggtggggaggcgaaatgaaattcaaaaatatttttgaaaattgtgcaaaatgccacaatttgcattttcaaaatgtctgtccgttctctctgccccaccattcattcacgaaatggcgaatgttatttatggggggggggggggggggagaaaaaaatgaaaatggaaaaattaaatgagagagcgatgagaggagaaagccgtggccaatgggcgatagatgttttttctggacaaaattaactttaccgggttactgtattttggaagcaatgatttggaagcattcaatattttaacaattgtgccaattttttgaagggaaaatatgcgcggatataaacttctgccaaagctctacggaagtttgtctgaatgggttttgcatgaacgaccagaacggcagtcactgccaatgccagacggggtggactggacaaaggtgccaagaggacattgacgaatgccaactgagggacaaattgtgccaaaatggggggaaatgcgtgaacactgtaaccaatcattaccattttataatttaaatgtcaacccaacagattggcggcttttactgcgagtgtccatcggactttgtcggctatctctgtgaagtgccgcaccgtcccactgatccatgcctggccaaccattttccgtgcctaaacggtgcacaatgccacgagaacattgtggccacaaccgcagttttggcattggacgcgcattttgactggcactgggaatgcgaatgtttgcccggctttgatggtattttgggattagttttattttttaattcaaaattgcaacccaggcaaacattgtgagcgtgccattgacgagtgcgacatgggcatgatgacatgtttgaacggcggcaaatgtgcacacgcgtgggccgaagacgcgcgtgatgggaatggcattgtggtggagaggaattggcacgcatcgcagtgcaaatgcctgcgcggctttgaaggtggggggggggaaggggagggggacagataaaattaggtgggagggcagtgattaacggacaaaagcaaaatgaatttatataaaaataaaataataaataaattgaaaatccattgcaggtgatttttgtgagcaggacatcaacgaatgtgagcggttcggtgccactttgtgcaaaaacggaggcacttgtgtgaatcggcacggctcttacatgtgcatttgcgttggcggattcgctggtgcatttgtactaatttaaattttgttgtttttttttttaatttttaggcaaattttgcgagaccaacattgacgattgtgtggacaatttgtgttacgccggctcaacatgcgtggatggcattgctcggtacgattgccgttgtgcgccagaccgaattggtacaaaatgccagaaatttagaaaaaaaaaaaaatttaaaacaaaattttaaggtgcgctgtgcgaatttcaaaacatttgcaacatccacgaaaatctgtgcgaacatggccattgttttacaaatccgttcaacggaagctacacatgcttatgtgatgagggatggaaggtggaaaaacagaaaattatgatttaaaatttagatttaaatgaatttttaagagccaaaattgcacggaagacgtggacgaatgttcggatgagatgacccgttgtttcaacggcaaatgcgtcaatttggtcggcagttacaaatgcgaatgcgaggtcagtgttagcgtttattttcaataaattatgcatttcttttaaatattttatatatttttaggaaaaataaattaaaaatttatttttgcattttttactcttttttagtttggttacaccggcgacatatgcgcgtcatggatcagttattgtgatgatgaacaaccatgtcaaaacggaggcatttgccacgaccaattgagccactacgaatgccgatgcaaatttggtaaaatttttgaaaaaataatttttaatattgttttaaatatttgtttttaaggattttctggcaaaaattgcgagtttcaaaatgaagaaggcgcgaacaaatgcgaattggactgtcagaatgggccacctgccaaaatgcgtcgtcagaacagtgcgaatgtctgccaaaatttggcggcattttgtgcgaaatgtaagtaaaagagaaataattaaattaatattttaaaatatattttatatattttgaattatcttaaatcaaaaatcttaaatcaaaaagttttattcaattttattttatttgtatgagtttcttgtacttatttattgcagtgaaaaacccgacccatgcgaattcaaaccgtgccccgagaggacaatttgcacaccgacaaatgactataagtaatttttggggataattaagcacaataaagcaaaaatatattttaccttttcagctcattgacctgtgagtgtgctcctggccaacagtgttcccatctttcgtccccctgcgagcgtggccataatccatgtgtgcatggccaatgccgaattaaagttggccattaattacagtcaaataattttttaatttctatcggacaaacaaaaagtgtactgtgaatgccaacacggatggaagggcacattttgtgatcagtcggccgaaaatggggagaaagcattgtaaaaataaatttaaaataaaaaataataattaaaatggaaatattttttagcaatcaaagctgtctattggaaaaaaatcgttgcaaaaatggtggccaatgtgtaagtgtgaaggacaatcagcagaatgggggtaatttgatttttataaattatttttttaaatttttgcaaatttagcaattcatttcgagtgcatttgcccaaagaatttttcgggaacattgtgtgagaatatgctaattgaaagacactgcgaaaacggatgtcgaaatggtggaaaatgtggaaagacgaagggttggcaattaaaatttgaaaatttatttaaacattaaaaacttagatggctcatggggatgcaaatgtttgatgggctttgagggagaacagtgcgaaatttttcgaaatccgtgctcaaaaagta

SEQ ID NO: 7592 - DNA, 3814 bp, Heterodera glycines
acaaagtcaaccatttccaatgcgaatgttcgcgcggcttctctgggcgccattgcgaagtgatctggcaaaaatttttctatcaaataaaaaaaaattaaattctttagaccgcagtacctgtcgacaaattcaatcgaacagatttgatggacaaggaaaactgcaagaaggcgggatgcgaggccaaatacggaaaccatcgatgtgattcggaggtgatttgttgaaaaaagtcgaaaataaataataataaattttaaaacaataattattatttgaaatcccaaaaaaaaacaaattaaaaaaataaatttaattttagtgcaatttatttgcgtgccaattcgacggcggcgattgttccacaaaacaggcacaaccctttggcaaatgcccacaggcaagctattgtgcccatgtgtttgcggatggcaaatgtgacgaagtgtgtgggctttatgtcactatagcaatttatttttaaatttgttcgttttccatgtcactatttgcaaattaatttttaaataattgtaattatttttttcaattttctccatccatccctttgaattaagatttgcaacaacgagcgctgcttgttcgacggctttgactgtttggagcggcaccaggcgacgtgtccatggatggtcgactgtgccaaagtgtacgcggacggccattgtgacgagcagtgcaatcaggcgaactgcggatgggacgtgggtggcacatttggaatatcaaaataattatagaacggacaattgatccaaaggacgagggaagtgctggggccgattttcatatgaccggctcaattttatcagatttaaacgatttttaaatttgaaaattcacagggcggcgactgtgcccacgacgcgcatgagcccgaccccacggcggatgaccaacccaaattgctgctgggcgagctgttcctggcggtcgcactacatccgtctacactgttcaacgatacggcactgtttcgccaatttttggtcgcattgagtgcccatctccgtgcgtcgttggcactgtcaattgaccgatacgacaaaaaggcatggaaaatttaattttaaattaatttaaaaattttattgtattcagcccaaactttttgaatggcgatcagacaaaggcattggcaaacgcattgaattgtcaccggaagtgaacgcaacggcactgttcaatgtccgctacgatgagaaggaggaggaagcgggcaaacgaagcaaaagaaaggcggaggaaaagggtaattaaccaaatatattattatttgagttaattgaacaattactgagtaaaaataataaattcaaaaattctttaatatttatttcataataattatattattttcatttttattttcagatgttgtcgaaggcattgctttgtttttgcaagttgatgtcaccatgtgcaatatgtaagagagaaaaaaaacacttacttaaaatatttttctattaaaattcttggctttttttaaggatcactcccggcagtttggcacagtccacccaattggtcggcgttcacaaactgtgcttttcggacctggaaaatgttgctgcttatctgggagccgcaaatgccaaacaggtgattggattattcgaattctattaatttacagttttaatattctccggtttgaccccgcttgatttgaaagacagtgtctgggaatggcaccaatttgccgatttcccaccttgtttttgcacattgttttcgacttgaaggataaatgtaatccgccatttttgacagggattaaattttcattacaattaaatgcacatagtaaaatgacaattaacaaagtgggagataatctccacgtaaaggctcggaattgacgtgaaaatcaaaaaagaagtgctgtggcatatttttattgggtggggcaaaaggcaatttggggagggacacataaattttggggtggacatttcccatggagacactacataattggttataaagaagaattaaattcatttttatgaatggaccccaattaaataattttacatgcctaattagcactaattaattcagttcccgtttctttgcttaagaatctcgacattcccatcacaattctgcagtccgaagcgcttaaaccgcgcgcctcttcgctgttcttttggtttgctttgctcgcctttgcgatagtttcgattgcgtcggccgctgcgggcacagtgttcgcaagcggtcgcattcgcagccgacagcggcgatatgcaaaaacgtggaagccggaattcccggcacaagagtcgaaaggtgatccataatgttgatttacaaattcaattttatttcatttctatattttaaaatgggatttccccatttttagtcgccaaaaatttgctggcaactttgtgcggtggggtcggccctggccactatcagccgccgttgattgacggcaacacgcagcaacacctgtttaacgcgtacacgcaacacaaccaccaccagcaaaatgcctaccaattccatcagccgcagcaacagcatttgatgttcaacgccggcagcatcagcacggacagttgcgcttcatccaccgccgcgtcggccattccgctgattcgccacgcggacagcctgaacagtttgacgagcaatgtgctcgcaaacaatgccatcaacaaaaatcagcaacagcatgggtgaaaaaataaaatatctaaataatttagaaaaaaataataataattttcatttttgcattgatttattttaatataaatatttcaaatcttaattatttgacaatttttataaaatagaatatatatattttttaattttcagacaatttcatcagctaattgacttgcagcaacagtattttgggcccgcccaataccattcattagtccctcataacaaacagcagacaattcactcaaatgcgtaataataatttttattatttttcaaaatatttaatttatacccttcttcaagtgtccacccccatcatgctcctcctgctgttgctgctggtccgtattgctcacgctcgtcctcctcgggcattggcgggtcatcgacggaacattccccgattggtaaaatcattttgaaaacgatttagttttgattattagcacccatacaataacatgcattttgttatcagattcgcacggtcagatggtcgaagacatggaaagacgaaagttgttggcccaccttcgtgaaaatgccctcttttctccgaatggactgttagggcatgaagaacggctggagcctcaactcgtaagtaaaatggaatttgtttaaaataaatcaaatgctaaacaggtgaatgcacctgatgagcgtggtcgaactctgctccatttgctgttccaaaacccgaacttcaaggcggacgacgagcagtgcctggtgaacaacattcagttgctgtttaccaagggagccaaaatcaacgcgttggacaagggtgactgaatttaatttaattacggtaattaatttttaatatattgccgagttcagaattcacctccccactgttgctggccgtacgggacaaaggctgcttgcggtgcgcaaattggtcacagagtttgaggcggaccaacgactggcggacgcggacgggcgcacgccgctgtacgcggtgtgcgaaagcggaaacgtagaaatggccgagtttttaatcggcgaagcggtcgcggcggcgagttgcggcagaaacagcaccaaaaacaaggggaatggggagacggaggcggacgagccggaccca

SEQ ID NO: 7593 - DNA, 1810 bp, Heterodera glycines
cagtgcccgtcactgatggtactgctgtcccattcttttccggcatcggcttcatcgtcgactcgtcctccacggcgaacgcgttgccaacgccgcaggcgacgagcgtcgtctcatccccaccgccgcgcagagtgttcaggtcgaagtgtcctgtttgtatgtacattcgtgaaggattcagactttatcgaactttaaaattaaatttttacggccagagaatgggaggaggggtaacgccgttttggactaaaatttgttctcaaccaaacattattctttattgttcgaaaatatttgacaaattctattaatctataaaatgaaaaaaatttttgttcatgtacaaaaaatcagtgccaaagttggaaaacccgattttttatgttatacccttattttttttaaattaacgaaattttttgaattggctgaataaaaaaaaaacaattacaaggaagcataccgaactgtcagtgtccaaatctgatcacttttggcaccggagtcaaaaattcggagattcatttcaattccctgtcccctttcgctgcatttaactgacccataattgaggccacgttgtccgcttcgttgttgtttccgccgcttccgatgctcaatgtgcgtgcttttttctgcaacggcgctggtgactcgtcgccgccgctttcgctgcactccgacggacagcgcgagccgcacacgctcgaggtgggcgtctcgcccgcccactcgtaaatggccaacttccacagacggacctgtgggaaacgtcaaaaaaggcacagttcaacatttaaaaaatgcgggatccaaaacaatcccataaatattcataaagaactaactcggtccccctccctgggaaaagatgggcaacagcacccgttcccctctcgcccacctgtttgtcccacgaacgacgcgtgtggttgatgtatttgttgggtgtgcgcgggtgagggccttttttgcgcgcaaatttgggaatttgggacaagtaacgcttgtaggtcggcttctccttcatcttctgcagttccttgtcccgccgttccaacgtcgcttcgtccgtgcaccaaccctggaaaagtgccgaaaatttgattttgtttctctttcggggtttgtctatggtaaaagaagcgccaaactgaccttgttcggctccgcccatcctttttgtggagttggcaaaatatgacggcgtttgttgggcgcggacgatgagacaacggacggagtggtggacagtgccgtgctcttgctccgctccctctcctcctcgtcaatgatgtcgacccacgaacggttggcaaagtcggagtcgtcgaagagggaaaagtcgaactgaaagggaacaaaattgagggaatgaagtgattgtgcctttaaacggtcttaactgtaaacactgtatttcggggtgcaagaaactgagtcattttgcagaaaaacaaggcacaggaacaccaataaccaattaattcaaagttcggaatagccgacggacgaattttagctttcaaaaaattagatatgagttagaatgggcagtcaatcaaagataaataaacatttagtttttttatgaaaaataattatgaaattgaatatgcaacgcaaaagccccaccttaaaacgagctgtcaaattcaaactttaggaaaataataaataaatattatgccataaggggagagggggataagcaaaacacaattaagagaaagcatttgggagaagggaaaatgggcagagcaatcgaacagaacacagactaatgagacataaataaaccaaa

SEQ ID NO: 7594 - DNA, 2951 bp, Heterodera glycines
  misc_feature (15)..(15): n is a, c, g, or t
  misc_feature (2946)..(2946): n is a, c, g, or t
gcaaaagcagtagancggcgggacatcgggcatcacaaaacagcccaagtgaatgaatgcttcgacattggcatttgcgcgcgcaattttaggcgccaaacacacatttatgacgccaatctttgttaggaattaggcaaaaaaaattatcgaaaaatttcatgttttttcaccacgttattaatgactttttttgtgttctttaccgtcaataattttccaaaaagtcatatcaggagaaaaaaaagatattttaaccgttttgcacttaaaatttcgggtgtgggaattgctggctttccctgcacaaatgaccagtaattaatgctaaaatacataatgaaaattgacaatagaccgataaacaattggatccgaattattaaagaatgctttggaaaatgttaattaatgggagtctctcgctgtgaagaaaaaaaaatgaggggcagaaatgcttgggtgcattttccaaatgagtatcttttttcaaatttcgtggtttaggtcaattaattggtacagcggtgtcgacaaatgtgcaggagatattttattttaatgagatttttaagaaaaaaatttttttttcaatcccaaatagaaacagcataagaaaatagtcttatggggaccgctattgggggttgaatttttttttaaataatagtttttttggcacaaaatgtctggggcgcatatcatttggaaattttgggacaaagaccaaaaaaataaataaaggatttcccatcagaattctttctggttgcccaactgacaaatgccttggccaaatacaaattgttttctaattgacaccaaagcgcaaaggaacattcccaaatgtgactgactacccaagtcattcttttaaaatttattttggtttttttgatcactggtactttaaaggttggccatcaatttcgtgataaattgactattctttaaaatttggctgtgaagttcccccgtgggtgcgttttcggtaggcaaattcccccctcccctccattttgccgaccttttgcgccttcggcacattctctcccttttccgctctttcgctgttgcatcgcttattgctgggggaagcggaagacgaagcgaccgcagcaacagaagcaattggaggggcagcggacgcggcggtcgtttcagcggtcgccgcttttgctttgtgcgtcttccgcgccgccgcctcctcctcttcaatgagttcgacccatgaacgattcgcgaattcggagtcgtcgaagagggaaaaatctaactgaaaggggcaggggaaaacgcttagcttaccaaaagtgggaacttagaacacattttttaccattataaaaattataaaaaggtctgaattaattttctaaaaaactgatttcttaatttagtataattgcgaagcaaaatataaaaatttaaaccgattttggacataagcacaaatgcccggactgattttttatttgggtcggaaaatggcattcatccatttcatttctttcacttccttaatacaaataaacccccaaaatgccaactttttgtggtggttcctctttctgctgctccttttcttcttcttttgttcgtctgctgttctgtaactcggccaatttgacacgtaaagcattttgcattttggttttaaaacacctttaaaaaagatcagttaaataaaaataagtctatttcaagaaaattgtcaaagttctacttgaaagtgctgagaaaaggccaaaggtaactaaatttctgaacgtttcttcgtttagatttccaagtctggtaattcttgagttaaattaatttaaatatttttattaccggtaaaacattcgcgctaataatttaaaaattggcggccatttaagcgaatgatttttatttatgcatcaaaatataaaatctttaagtgaataatctgagggacctgagaactcgtgctgaagaagtcatatcttttggtattctcgatttatggatttttagcctcggaaatcaaatttaaatcggaaggtgattaattcatttcactttcttcttaatgtctaattctaagcttaagaaaactttccctaattgctgggcaccaaaataagagatccaattgcgtaagaaaaagaagaaaaggctgtgtaattagtgttaatttgattgtttccacaaaacacacaaaaaaatgatggggaaaacattcgctcggcccgctttgttcttgtgacgttgcgatcgatcaccgatctcccgtaaattgcgcaacaccaaaacccattaaattgagctgaattcacccgtcttgtatattctgctgattgttttgcgatcagttttgacttgcccattagcaaactcaaaaaagacaaaattaaattcattagaaagggccggtttttatggatttccatgtttttccccacttattcggcttaaaatcgagtaaaaaaatatttttgcctagtttgaagcttttaggatgcttttttccaaatttaactttttaattaaaaatttatattcttcgaattaataattgagaatcaaatattttaaaattattttttgacaatttatgaatttttatttttgttttaaattgatttaaagaatttttttgattagttctttgattccaccattttgttactctcccagcaaagggaatgaattttttgcccattttatattttgtgttaagcctataaaaagggaatgttaaggcttgttgatggatttatttattttaaatttataataataatttttcatccaattgtgttgtaatattgcctttaaattcctttttacattcctttgggtgcccacactcattaacgggttttttgattatgcggttaacccaaaatataattacctaaaagtgtaccggaaattaaactaagcacttggaaaatttggtgggtcttttgccaaatntctct

SEQ ID NO: 7595 - DNA, 2170 bp, Heterodera glycines
tttaatttcctatttatttgtggaagaagtgtccaaaaactttggaattcccgaacccaaagagccgaggtttttgcgatccgtgaagaaccaaaaacagaatttcttctctgaaattccttgatattgccgcccttaattaattaattagtatacctattaatttaaattgtgactctttgcttagaattatgtgaataaatacattttggtgctgttggcctccgattcgctggtccttctcagcatgttcgtgcgaatgtttgtcaattttgacaccgtcagtttcgccctttgcttctccgtccgtttcacttggaacacggcaatttacgtgagcaatttcgccatcatttcgctgaccattgagcggttcttcgccatcgtttaccctctccaacatttgagggtaatttttatttaaatggaaataatttagtcgaatatttctatttcattttacatcataaaaatgtttcggcattttatctgtgcccttttccttttccgctacagtattcggggctcaaccgatggaaagtgatctgtgcctggctgttccttttgcttctgatcagttcccatcacttttttgcactgcgaaaaactgcgcatgattctgtgacagttcaattttcatccaccgcctctttcaagtgcagctatgagacggaacggaaatttgtcgatgtaaaatttaaataaattaatttaatttaattttcaaatttcatattaaggtgattttccattttccaaggtttttgctccaatttattctcactttcgtcgtagtaattgtcgttaacattttcataattatcaaactccgctcgcgttatgtgataatcggtgggcagaagcaaattttgaaaaataaacagacaaaaaataaaaatgcaaatttgtaagtgtaaatggacttgaaaacttatcttaaacacattttattattgtaagttaccggaaaaataagtcaataatacagtatttctaaattaaagtactgtagcatttataaaaggtcgaaattgtttaaaaacttcgttctgaattttttcaaagtttctttaaagtctaaagaaatttgaaatttacccaatccctaaaaaaattatactgtaaataggttgttgtaagcttgtttagataccaatcaagatataagtattatactaccgggtctcgttttttccaagatattctgattcactgacccattttcaagtcacgcactgtgaaaacgctaattgatacatttagtaaacaaattaactaaaaattccaattttcaaattttaattacaacaaaactttaaggcgagacgggccccggcgaaatgcgtgccaccaatgttttgttggccgtcgtccctttcgtttacgtccttttcaatttcatgtacaacctcaaaaactttctcaaattcttccaaacgaacaaaagtcagaatatttttctcgagcattactattgaagcccggtgtttcggaaagaattttgtcgcaaatggcttcgaaaacgggcaacaataaggccaaggtccaccacaatgacgacaaaagatgtgcagacggaaaatgccaaaaagagtctccaaatgaaaccaatcgaaacgaaaacagcggcagagacaataatttaaggacgctgaaaataattaaatgaaaaaattgtgcaattttaaagaaattgtaaatttaccaaaagggaaagtgtctaataaataaattttctggagagaatattgtgccaaaaaatgaattcatttgccatcactgcttattaggctgtagaggaccaaaggcacatcaaaacggcacaataaacgccgtttcctattaaggaaatgccaacaaacagcaaaacaaaatccgaatctttagtaagccatccatcactttgccaacaatagttcatgcaaaacaaagaagcacacattcttggacaacttttatttttataggggtgccgtttaagttttttaaaaatatggacaaaactgtttggaacctctaaagggagtgcccattgctcagttgcttagagcattccacggttggaaatgccgtgagttcaagtcccaatgggctagtgtaatcttttatgttctacaaagcaaaattaaaggttaactcttacataattacgttttgttgcattgcggcg

SEQ ID NO: 7596 - DNA, 2214 bp, Heterodera glycines
tactgtagttaaaaaatgtattgtggtttgtctattgtgttgtggttagtatgggctcaaaattctgcgcctcctcgcggtgagtccggaaacagagttaatttttaaaatattaattaattttttttgcaatggaattaactctggctaaagcagacgtaattttgtctaattttgtggcttagaattaaattttttaatttttttttgttttattgaaatccccaaatgtcgggtccccaaatgtcgggtccccaagttgcaaatccccaaaagtcgggtagccgtttttatgttctacaaacatctgctggatatacgtttttacgcccgactaatttcttaaaatttgtctagaaaaaataccttcaacatttttaacttttttttcgcctggacaccaattcttgaccattgccgatttattcaattgactgtcaactcctcttcgacacccggaaccattcgaaaaactttgactgaccgactccccttttgtccatgtatgccgtaagctcccaaaattccttattttttaaattcacttttaaatctaaaaaaagaaaaataattgatttaaaaaatttatacaaatttgaatttttttttatccattctgccaaatttttattaaataaagtaatttgcttttgtttactcatatgtagtagtggtgtagaggttagtgttttgacactaaaactatttttgtcatgagttctatcctggttgactgtttttttttaaatttttttgtctttaatagggtttttaaacaaaaatacccataaaaattgaccatcattggcataatttattgacaaattaaattcaatttttctttcgttgaaattaaaaaaattaattttccttgactaaattgaaaaattaatattttcaaagtatttttgacaaaatataaagaagaataagtaaaaatttcatgaaattcataaatttcttagtgaaaatctgttagaaaataaagctcaaatttttaaaatttcccccggcggcgcctatcggcaccgccggaccccttctccctaaaattcttcggaaaaagcgcgcgcgaaaaatttttgaaattagaaaattagaatgcaattttttaactgattttcaccagaataaccaattttttcgactttgagccaaatgttttttaagaaaaaaaaaagttttgggggtccggcgccggaggaaaaatttgaaattttaccattttttacagattttcactgaaaattggccatttcaaaaataccttatcgtttttaattaattctatacaaaaatatttatgataaaaagaaataaaaaaagtacataaaattattattatgaataataaaatttttaaactaaagtaataaaaaaaatttgactatatagtataaggcaaaaattgaaaaatcccgaccccgaccccgaccttgctgaccccgacgaccccgaaccccgacttttccaaccccgacggtcggggacgcaactctagataaaacggaacggacaaagtctgaattctagcccaaacttagctacctaatttgaaatattatttatttttggcattttgcctaaaattcacgattaaaaaactgttccttctcgtgcctttggcgaaattgaagcccgtttatctcgtcaaaatgaacagggctttgacggaattggccggcaccagggcttccttcgggacaactatgtcttggtggttttccaaaaaaaaacgggaccgggcggccccgtaaaaccctcaggctcgtcaggtcaataccaaaaactgctcttccctctggctatgtttatgcagtggcttattaaacaaaataatttttaaagaaacgctataaatccgagtgcagaagaaattgtttttcgttcattaataattgtgagtcacagacacccaaaatttcaaaaaaaaaacattttttttcttttttactaaattttactaatttttatttcttttttttttgttagatacataaatcaaaaattagcatttgccatttctgccgagcgaaatgggcgcctataaatacatgcaggaattgtggcgcaagaagcagtcggaggtgatgcgctatttgctgcgcatccgctgctggcaatacgccaaatggaggccatccatcgctgcacgcggcccacgcggccggagaaggcgcgccgcttgggctacaaggcgaagcaaggtttgtg

SEQ ID NO: 7597 - DNA, 3340 bp, Heterodera glycines
cggaatgtgccgtcgaggctccaccgacgattctgtttgagcactgacaccagctgaaattaaactaatttaaaaaaggacataagtataggtagacttgccttgctatgactgaaaatcaggacaacatcagattgtccagtcctcacttcacggctgtcataaatgaggacggactcatcattctttatcaaaagaccaggcggaatttgtatgttcagtgggtcggcacagttgacaccaccaacgaatttgttctttgttctaaatattgcatcattattttctctgaattttgtctacctgttcgccatttggtcgagcgcttcattggtgccgagcaattcgaagacttcatcgtcgatgtcagtccgaatttgagcgcggatttgacatggtttcgtttttggctcctccttgatcaggcgcttcatctgatttcgtttcgtctctgcatcataacgcgatggtgcgcaaccatggtgatgtccttttgcgcccaaaatgcctgtcatcaaatcgttgtcgtccaatttggctgtcgctggacaattgcgctgttcgcacctgaaccagctaccatcttttctgtttttgataaatcgaaagcctgaaaataaagaaataaaaatcaaaaaaaactagtaacaccttgataccaaagacaaagagctccccggattgtttctccacgtttgaattgaacgggctcacaattttcttcgtcatcactcgaagcgacgtccaaattgttcctggttgaagtgccttcaatttgttgttctgcgtctgtcctctcaacattcagtacgctgtcttcatttgtagcaatgcgaggcttttttactcgcttttgcagactctcaagtatttcgcgaacagttggcatttcttattagaatctgaaatttctttgtttttgaagaaaatttgaaatgacataaaaatgaaatgaatgatttatttgatgcaaaaacattatatattgtatattctctctttttattttctctttggcattatgtatttccaataggcgaaatgaatgtttctggcttagtaggcgaaatgaatagtaggcgaaatgaatagtaggcgaaatgtccggttttgggttagtaggcgaaatgaatgtttttggcttagtaggcgaaatgtcgagtaggcgaaatgtcatgtagcctaactggacttgatttgatgctattttctctttgaatgtgcttattttttcttggcggttttttttcttttgatttgatggattttcattcaaaaattgcaataaatttcaaaaatttgatttttttttttattgcggcgtcatttgaagaaaattcgtgttccgcgactctgaaaaccttcatatttttctcactaatttgtttcaattgcttttattttaagacgagattaatttttaatggcaccgcctgccgagaaaaagcaaaaacttttgtccgccgttgaaaatcagcagcaatcgtcgtcgtcggcttcttttgtgaaaccatttggaggacggaagaaaatgcgagtgctcagatttttgcattaaaaataataatttaatggtaaataaatgtagtagtactagaaatcgacattttggaaaaagcctggacctggattccattttggacctggatttcctggacaaaaatccaggtccaggaaaaatccagttgccaaaaaatgacctggacctggatccaggaaaaatccaggtcgatctttaagtagtactgatggtgccccctccattttttttgaaaaaaaaattctcaaaatcaagtcattttagaggttttcagggtagaagcatctgattataatacaaccatttgactcccaaaccatcgaaaataattggacaatatgtgtatatgaattttggtgaaaattatttttcgcttttgttcgatttcgggtccgggatttgaaatgggtggaaaaatgaatgtcatattcgtgatcagcgcccatgaaaaccccagaaaaaaacaaaaaaaattattatttttttatgtggcgtaaagtgaaaaagtacctagttttgcgtgaaaaatggcgacatggaaattttatgaaaattgagtgaatttatttccaaaaatgtaactgcatttgagcttcccgtcctaaaataaaaccctttgggctctcctctttatttttatagaacaaaccagtcatttaaactataagcatggctggacagtattttttttaaagtcaattttggtagtgactgaatgtttcggaaaaaggggggaaccgccaattcgtcgcggccaactcgccgcaaccattgcggcgagaaactcacgccgagatgacggcgttgaattggccgctacgaaatggtcctttttcttcgaaaaatcgtggcgcaaagtttcgatttttttttacaatttgccatttttaaggctttctcatttaccgcgtgcgcattcgccgcgggggtcgaaagcgccaagtgaccaaagggcaaacgtacggaaagccgaaaacgcacggcgtcaaccagctgaagaacacgcgcagtttgcaagccgttgcggaagtttgtttttaatttgatgggcctaaggaaatggtgtgtgttttacatttaaaaagttgggaattttaggcgaaatgcgctgagaaccaatcaaaatttatatagattcttcgaatttaggatttgttaggacgaagcgcaattcattaaccgaaaatagtatgaaaggatgccactttccagcccgcaccattaaatttgtttataaatttcagtttcttttttttccaattttatcccgccgggtcggttattatgagcccattaattttttaaaatattttagactaaagactaaaataaatcttgagtttttttttggtaatatgccgatgttccccccctccccccctttgtcgaaaattcaaaattcttacttctgttcctaattttgaattttcgactttttgtcgagttcgggtccgggattccaatttgaccaaaatgaatcttagattcgtgatcagcgacctcgaaaacccatgaaacttgtttttatgacattaaaattttagatttttttccaaaacggggggggcatcggcagtatgacctttttatttatgtttaaaattattgttgttcttttttattacaaaattttacgagttttccaactcattttcccttttcccataggcccgtgccggccgccgtttgggcgaacttcgtgtgctcaattcgtactgggtgggccaggactcgacctacaaattctttgaggtcatcctcgtcgacccgtcgcacaaagtgcgttttgtttcttgtttg

SEQ ID NO: 7598 - DNA, 997 bp, Heterodera glycines
aacccgaaatgaaaattttgagaagcttcaaaatttccaaggaaccaaaaatttgtttagaaggaattttctttgaaagaaaattaattgatgtggaaggagcgcctcaccttttggtaatacattggtttgtctacaacccccatttttcaaaaaaaaaaaagttttgttttaatctgtgtaaaacgccttttcctggggtttcgaggtcgctgataataagcttgacaaatagcgaatcctgaattcgaacaaacatagaacattcaaattttcgaaaaccccgggaagatgttttacatgacttttttcgaaaaattgggagaccacaatattatttattaccaatttttccattgcagatcggtggaaaagataagcagtttccgtgccacgagatgcccaacaaaattcgcttctgtttcctccaaattgagtaattcaataataaattttctgtggccaatggcggagaaaattcattggtcccgaattttttgttaattttaagaaaacggcaatcatcaagaatgggggtcccatattttcattttttgttttgggataagaacatgaactttgtttgagttagttagctaaattttccaaaaaaaaagttttttttgagtgtagggttaggccatcggaaaaagtttggaatctttggccgatttttgaacagattttgagataaattatcacccccccccccccaaaaaaagaagaggtctcagtgcatcagattacatacttctagaaatgacttagaaaattaaaaaaaaatttcttggtcgatgttctccacctttgccttttctgtgcgtgcgcgcttgcaagggctcatttttcgtctaaatctgttcaaaattgacaaaaaaaattccaaacttggcctaatctaccctcaaaaaaaaaaaattttttttttgaaaatttcgctacttaaataagaggccgaagagcaaacaaaggtcatcgctcgtgggcgggggggggg

SEQ ID NO: 7599 - DNA, 4413 bp, Heterodera glycines
ttgcacattcattcaaattccatttaactaattacttcctcccctgtgacttattaaatcttcatgatttttcttttcattggcacaaatttgcctttgctgctgatgcacgtattgacaaaaaacaaaaaaaaattatggtgtctatcgttatttagttgttttttttgcatatcttttaattgctttttttgttattgcacgttgaaaattggtaaaatatcttaaaatatgtttttgcttggcggcgcaagtgtcgaggcgcagatttcgcaacacggtttcccccagctcagatcactaattcatcataaaattaaaaaaaggcttaaaaatttactaatttttttttcttgaaaagttttaggttttgaaaattgaaaaacccctttaatttgggcattttgtcgatggaattcggtgccattctttctgttcattttctctccttttgcagtgcctgcggttccaatgcgatgttttccatcggtgagctcgactcctcgttgacttcctcctcctctgcctcctctccgttcgttttccctacaatccgtcggcacaattcgacctttgtcggcgccaacggtgagtcgcttgaacgccacagcgattttgtgatggcgccggaagaaagtcgggcgaagcggacgacgaatggcaccgccgaagggaaccaaagcgaaagggaagcggcacggggcgaaacgatcagtaagcagacgcagcaacggttcacggtgatggccagcgaaatctgacggatcaaccgaatgagcaggcgactggctaacgaagaacggacaacggaggagtgatcggttggcatgtgaccgatcgatctatggatggatgaacggattgcgcgagacattctcgcattttcaatttggcaattgcgggattatgacacaaatcattagatgaattttggggttttcgactaatggagtccaaaaaggttaaattcgattgttagccgatcacacaagtgcactcactccttttacacttcgaaaacttcaatttctcgtattttttgtcgcatacttatagacaattaactaattattacggtccctcctcttttttcatcactttccttaaattattaaattttagtaaaattccaccaaatggctgaatgcggtattaaaaatcatttcagaagaaaaaatatataaaaataaaaatttattaattagcgaaaaacggctcttttcgcgtttttttagttattttgacacaaatttaccaatttttaagttaaatgtttagcaaaatgcttaagaaaatttactaataaatgatttcggaattccgttctttgagggtaaaaaaggctaattttgttgatgagggccgttctaatagaggtttttggaaaataaaaacacggacgtctcaaaaattagcctcccaccgggaagctactcaccagacggaattccgcgttgcgtccgacattttttggctcggaatttcaacttcatttttgggcctcggggctccatccgtccatccccggtactcaaatcaccaacaaatctctcaaacattgctttaaggctacatatttatatgtgtatgtttttgttttgtatgaataatctatggtatgttttgtagttcgtttcgatcacttttcaattcgtcgtccgatttgccctttttcctccgtcgtctctccgctgccccttcgctccgttctcaactcagtcactctttggccatacccttcgatcattgcttctacgatgaatctgatcagtcgtccaaatgcgttaatcgtttctgctctttcgttgtcgtcggcaaattccattttggaaataagtgctgaaaaataaaattatgtacctttaaaatcggcaaaataatttcctcccccgtggcatttccttttgaatgccctcaccgattagactctgctggtaaatgtccaaaaagtgcggcttcagtccgaactgcgcgtactccgcgtgcgttttgcccagccgcgtgcattggtcggccatccgccgctcgtccatgttcagctcgtagatgagccgttcgtaaaatttgaactgcgcctggctaaataaatgaatatttttttattcatggtggaaaccggcactttttctgtggacattttgaccgaataaaatttaatatttaatttaataaatatttttttattatttttaatccccgccccaaaactaaccaaattctgttcagttttggccattttgtcaagtcacggtaacagtatcttccgcatgcgatgatttcattcagttttgggctcgcctcaatgcatcggagcatcgttttgtggaaaaggtcgcaccgatcggtcgcaattcgtttccgccaacagcgggcgattcttaagcaaacaatggaaaaatcatttaaatctttcctcacttaaaaaaactgacgtaaaatttgggtaagaaattaaatttaaataaataatatatttttggaataaaaataaactctttttcgttttgagtccgatgaattcgaatttcgcttctctgcttgcgcttttcccaagtcctcgtcccactcaactctttggccccttggccatggcttttgtagtgccctccctattaatccccccttggcacttacatttccttatctctcatgctcaattctcccccaattgtgccttctccgtctttggcatttcctttggcgttttgtcccgcgtcgttttgctttgcccaattttccgctgcttctccccctttctgatgcttctgttcgctttgcttttgctgctgttccttcgtcggtgtcatcaaagtgttcactttcactgtcctcctttgcaattcgtccattgtttttgccatttccctttaataaattaaattaaaaataaataattgcagggaacaagctgctgggcggttacaacgcggaagcgaggaatgattaagactcataaaaagaaagggcggacggaatgtgccgcggtagcttaatggtaaatggtaaagccacccatggattggtcggacgagtggttcgattccaatccgaggccaacatttgcccatttctttattagtgaatatgttaattgtgttttttaggatttaattatttactgtaataatttatcagtgtacagtaatagttacagtacaatttgttggtgagcagcagctgctgttgcgagcacaacgactgactgagacacgcgttgcccatttttgtgtgccttttgtcaaattataaattcaaaataattgtaaaaatctaaaaaaaaatagaagaattggttggaaagtgtcaaacattaaggatgaataaagcttaattggatgtttagaacaataatttaaaatattatcatttgaaaagcataacaaataaattattaattaggaatgaattgcttttttccaatgatttcaaatggccaaaatatggtagaacatttctatgggaatatttatttacgtaatgatagcacctgctatttggtgaatgttctcaccacaaattacattttaaattagttacgcttttccgtttctccgattttcccatgggagtgaattttgggtaaaaaatttgcacttttccaaatataattaattacatggcaaaattcgttcatagtaggctaaatttgaaaagatcatttcctaattgattttaaaatgtactcaatgttagtctttgatttgccgtgagttcggctaagtctccgctggggcggcgcattggcaataaaaagtgggcaatttgaagaagcaggcgctaattgccgctgttaatgattctcatctttcattttttttacatttagcggagtccaaggaacagagcttaaaaaatagggatacgaactgctaaatttggaagtaattttacaatgtttcgttagcagaatgaactaaaaaatctaatttttatttaaaatattaacattatgaattaaaatgggacgaaaatgctaaagatgagatttttatgtaaataagtaacatgaaaatttggaaaagctgatattcttattcagtttttttaatcaacatttttgcaatataacttaaaaagcataaaaatttttatgtaaaatttacaaattttagaaatttgcggatttttgtaaattttaagtgtgtaaaatgttctggtttttgcagactttaagctttaattagaaaatatttgtctacaaaattcaagtcattctgacaattacgaactgaataaggaaatcagttttttcgaacttcgtgaaattttatttacataaaatctcaccttcaccaattaggaccgaatttaaatggacaaaaaaaaggatgaagtatggacaaaacgcttgaatatggataaaaatttcaaaatattgaaatagaaaatcttaaaaataagttaattaagaaa

SEQ ID NO: 7600 - DNA, 651 bp, Heterodera glycines
ggaggtcatagacaaaatcaaaggattttgcaaaatctgagatcggattcgtgtggtccccgcccttccggtggcaatttttctttatcgataaataaaaaactttcaatttataaaactatcactggggactcaacccaccagcattccaattcgtctattagcagatacaaaataagtaattgcataaactaaaacttttccctttttaatttcatcattacattttcattttgaatgactaagcgacctcgctctcaaagtgaatacagtcatggtcataagtgttgtcccatcatgctttgaaaaaaataattgcgtataaaattgtgattttccaatttcaacagataagtagcataccattggataggattttttatgggctttccaatgataccatatttgcatttgtgacgtagacatttatttgatttattttaccatattcacaatttgatcagaatataggtggtcaaaagtgttgtcccatttcatttttaaaatattgcttctctggatcgggattaaaaagatctaaaaaaattcaggtgatgataactttggatggtgataaggaaaggtagcaacaccatgtggagcagataactccttgatggagatctgatcagattattttgtgtgggaaag

SEQ ID NO: 7601 - DNA, 4690 bp, Heterodera glycines
  misc_feature (121)..(121): n is a, c, g, or t
taagcggggggagatggaccggtacaaaatccattgtctattcgattcgctgggggtcgaatgcggcaccatatcgtaccgaatgggccgtccttacaaccagcacaaaaaagtgcccgcncactcaaagtgatcatgccttcccgtgcttttcaaagacaggttcttgtggaatggcggaacaaatcgaacacaattcgcggcaaagtgaccaaagcacagctagatgaacggcgtcgttttcatgcacagtgtgtcgaaaatcgtcagagagacggtcaggattggattgtctatgcaggaagcgttatcttacgggaggaaattcacatttttcggcgccaaatgatagataccgattctcgtaaaaattgactcgagacaaaatcacctaagcatttctcaaaaaattttcaaaatttaaattgctgcctaattaatattaggtcaataatgaacaaaatggaagagatttcactaattttagaagccaaaaaatacaaatcttaacattaactgaaacttggacaacagaaaaccaggacatacctttttgtccttggattaaagaaaattttaattatatctttgcttcaagaaaatctaaaaatctcttacgtagcggtggctatggtattcttcttagaaaagaaattaaattttttgttaaattttctgatactaaatttaatagttaaattttggttctacaattacaaaatactaaatcaattaggcttatattaatatatcgtccgccaaggactacttttaagcaaacaaaaaatctttttagtttttaaaacctttttctgtgtaaattctataattttagacgatttaaatttttctaaaaaagacctagtatggaaggaaggcaaaccattttccttgagtaattttggtgaaatattttgtgacttctttaataggttttcttatgttaatgccactcatggaccctcaaggagaaattcttggctagacagttttaccagcaaatgataaaattgtaacacaatgttctatcgaaggaggcattttttcgtcagatcatttagcccaattttttatattaactgttccggaattaattcctaaatcaaaaacataaatattaggcgatttactccatcaaatgtgtcacttttcaatgtagttattgcctcaaggcttagagctttatcatgtggaataatcagagtaaatgaaaaatatgtatcttataacaatgcatagatatattgttatgagcagtgtattggaaaaattcagcaataattttattatttactgtatttaccgtaattattttgacaattatttcaattttatatttaaagttttcaccaatcggaagaggatacaaattaataagccgaaatttaattacaattattatttcttttttattaattaatgacaaaattttctcggcgagagggtcacataaatgtgacaaaaattcatatgaaatttctgatcagcaaacgccaaaatttaatgaatcacaaaatattattgttcataaaatcacaaataaaatgactaagatttttgcaaggaacattttgcaaataaaaattaaagatcagaatttaaaaaattattcaaggcttattagggcacattttaaatcatatgaactgactaaattatgtcgacatttgaacaagaaatgcttacggcacaagaaatgtgttcaaataaacaaaatgagaaataaattaaagaatatgaaacaaagatcaagaatatttatgtataaaagcaaaaataaaataaaatttaaacacattaaaaacaaaataattttaaaattaattttaaattcactattttcaattaagcttttcaaaatgatcgaaccacgaaccagcctgatcaaattcgcagccgagttgttcaacaccaaggctgaatttgtgcagtgcattgtgctgacccgggccgacaaacgagagaaattgatcatggaactgagaaaggccgacttcaacggggtcaaaatttggagcaaaatggacacaaagccaaaagtaaatttaaacgaaaattggtgggaattcgttttagacatgccatttgaagccgaatttggaggcaccaattcggtggtcgaattaaacaaacaaataaatgatgattttcgaccaaatttgtcaaaattcggaccaggtttagtcttaaaccgaaaattttacccgatttcgggaataatgctcgaaggagtactcgatatttatgataaatatcgagaattctggtggaaaattgaaaaggaaaacacccaaattcaaaattctaaaagttgccaaaagggtgcaacaaaaataatgaatgcaaatgaagaaaaagaaaaaactatcgaattttttatggaaactgatgaggattcggttgattttgaagccgaatcggaattttttcaggaagagaaggagcaaaattcggccaagagggctgatgggcgtctaaaactgacggtaaaggcgaattccaatcaaaaccgtgttttgacaattaagggagttaatgctaaatgagagcattttggacgaaagtgatgaggactcttgtggaaagtccaaccaaaaggccgaaaaagtgaacaacgccaaaaggcgaaaaatcgtgtatgagtgccatgagtgccaaccgtcaacgagtgcgcaaaacgcaatttcaaatcaaatgggttttggtatagaaaatattaaagtacaaaaaggggggaaattcaacgaaacaggttccgaaatcggcggtttggtccaagccaacccccaattggtctcccaattggccactgttgccggacaactgctcggcacagcactgaaagaagaaagaaacagcgcaacaacaaaattcgcaagagggcgcgggcggggacactttttctgtggccgacctgatcattggcgttcccccccccacaagctgaaacttggcgctcatttccacccccaaaatggcaaaacagcactgatcagaccgaccgacaagcgcaggacttggcgagaaccgcggcagaagcaatgcacgaattggcaaatcacatccgacaaccgaaccccgacttggccgccatgctcttcgcgatcgaagccgctctgaccgaaatctgccaaaaccgttggcacaaatgatgaagaagaacttcagccccccgagtgtcaccgctgtgacgaacgaattggaaagaattggatttttaaccattttttattaatcaccattatttgtgccaatttttggcttatttaacgattaatcactcttatttactaacaattttccatatgattgtgcccctcgccccctcattttgtaccatatttaaccctcaatttgtaccttccatttctactccagtcactattcacacataaccaacacaaatccattcacatttcatttaatcaccgataaatctgcaccaactaatagctgtcaaccacaaattaatcactaattaattactaaatctatacttgttaataaggggaattaacaatgtttatatacttttttatgcactcaatttcacttgtaatctcgggacttgagtatggtgattatataaaaaatattatattaaggcgaatggatctggttttaacttttaaaatatttgggtatttttgcataatttaaaatttgatctcgatccctaatcaccgacggataaatttcaatttaaatttaagaatcgcaaaaaatcagttctcttgtatcgaaaattgattttatttttatatattcttattttttaattttttataaaaatttctcatttctattttattttttaatgcttaaattgttgatttttaaaaaaaaatttattacaatatttttcttttgaagtttgtttatatattacctagcctcatttcatgaggcattaaaataaaatgggactgaattggacgcgaggcaaaaaatcgtatagtttttttcatatgcttaaacaatgattgtcatgtcttagtgttgtttgtcagatgcataagtgcaatcacatttttatacacacattggtgttggcataaatctcatttttatgcgaatttccccttattaggctgtcagcaataaattggcactctgccaaaagtgggcatgcaaaatgcttacaggcaaacaaagatttatgaccatgccaaaattgggcgcatagttccatagcgtgtatagtgtgggctataatagtcatagaagtatattattatgagaaaaacagaaatctatttctctatatgaatattggcactgtattttgccgatctctttcactggtgtatctcataattgcaggaacattttatttatgtatgactgactctctttctctgatgtagcccatatttggacgaacattttatgtatgtatgactgactctctttctctgatgtatcccatatttgcacagatattttatttctctgcccactctcttcattggcatgtgctatctgatttttgtttgaccgtcttccatgcgatattgcttcgcatttgcatgccgtgcagtcttttcgctgaaagtgccaatataaaagcggtgccaaactcagccaatgacacttcattttcaactactctctctcactaattgttgcacattccccaattttatttcttccttagtaagtagtattggtgcacaatgcgcacttttct

SEQ ID NO: 7602 - DNA, 1516 bp, Heterodera glycines
tgttagatagtaaacagatttttcacgattttagaaaaccttttgccagacagtccaaagtatgattccccaattttagccggttcatctggcagtccgaaaaaaggttataaattgcaaatttttactccaataaattaagttgcattaaaattgatgaacaaaaaacgtaattaattattaaataaaacgtttattttgaatgattcaaataatgaaaatgtgttattaatcattttatttttcgccttttaggaaaatcgccacatgccgatccgaaaaaaggttataaaaaaaaattcataattaatttttcttttaaaatataaaataagcaatttttgcttgaatgaaataaaaagtaccatttaacaaattcataataaaatatcgaaaacaataattttagcccagaataaaagtcccatttaaaaaaattcataattatgcaccctaattaattgtaattaagctgcttcacaccttgtgccagtaacaccagggaaagtatgatgagcaaggtaaccaacagaaccatgctaccggttgccaaattttgtaatcattagccttaaaatggtgaagaaactgtgtggaacgatgatgccaaccatgaacaaacccaaagctgttgtagtagatgtagaaaaaaaactgtggtatcatcacgctattattgttgtgtaaaaaacgatccgtttttacctcttttcgggaaaaaaaactgcaaaaaattcacaaaaaaaaaaatctcacattgtgcacccttttctatcatttgtggagtaaagaattttcgggaaagacaacaatttgcatcaaatttttttgctgaatttatgcagaaaacagcagcagcagcagcaaatccccatcgatatctcagagcaatatcatttaggacaacagtcaaattcgtgatcagcgagctcaaaaagcttataaactcatttttcgactttttaaatctcaaaaaaaatttttggaaaaggggctacaccggtggtactcttacccagaaataatttttggaaaattttagaccaattaatgctttcataagatgattttattgaaattagccaattaaaaaaaacagtgacgaaatgattggtaaccattttttaaaattccatttaaaaggattattttaattactaaatctatacttgttaataaggggaattaacaaattggtgccacgaccaactaaaaaaaaaaaaatgtcaaaaccaatacgcatgcgtattaatccatcatggagaaatctgagagaaagattaactcaaataagaccggtggttgaagctcaagagataacaccggaagaaatcgaattattaagaaaatcacttgtaaaacttaaacgttcagtgaattttattgatgaaagaattgaagaatggcgaaattacatggctaatgttcaagccgcacaaagagccgaagaagaaggcctttttgacaatctaactaataatggacgccacataaccgaatggttagaagatacacg

SEQ ID NO: 7603 - DNA, 4766 bp, Heterodera glycines
cccaatttactcaaaaaccccgggactcaattaggcgaatcttcctcgtcccgctaatacatttctcttttcccaccttatctcccattcaatctccctcatccatttcacatccgttccccttattccgtttccttccgccacttacggacacttttcacgtacaaaaggcactccgatcacaccaatcggggagggagagaggaagagcacgtaaacccataattcactcggcctctcccctccgtccctttcctccagggcttcttccccttcccctcagggcttttctcaccccaaggaattcaaccttcaatccctccagggcactttctttaccaatggcactcccaaaatccaatcaatccttccttttctaatttcaaacaacatgacacttattttaaacaattttatttatatttattttcttattttcattaataaacaataaaagtcaattcgacatttggaaataaaagggaaattaaaagggaaaattcggtaataaataaagggactttttcggacattttccctcccggcccggcacgttcccacatttctggtagcaccggatggttgtcaaacgacaacctttccatcctctctctgggcaatattgtcccatttcacctctagcatttcttcccgaaaatttacatttttttcgctcattacccccccccccccccttcccttcccaacaatattcacgcactgccgcaattagttgttcagttccaactccgactttttgcaaacaacagctgtcgtgaagttcaaaacttctcgattagcagagcagaattttttttttcattggccaattctcagatttttcgcacaaacagtttattaaagctcaaaagccctccaccacccactctttatcatcgaacatttcattttcaggacaaattgcgcattaaacattcagttttcaggccatttcgcacataaatattcaattttcaggccatttcctcgcttacaacattcaaaattccaggccatttacgcatccaacattcaaatccaggccatttacgcatccaacattcaaatccaggccatttacgcatccaacattcaaaactccaggccatttacgcattcaaattcaaatccaggccattttcctctcatacaacattcaaattccaggccatttgcgcatccaacattcaaatccaggccattttcctctcatacaacattcaaattccaggccatttgcgcatccaacattcaaattccaggccatttgcgcatccaacattcaaatccatgccattttcctctcatacaacattcaaattccaggccatttgcgcatccaacattcaaattccaggccatttgcgcaccaacattcaaatccaggccatttcctcgcatacaacattcaaatccaggccatttccccgcatacaacattcgttatcaggccatttccgtgcatcaacatttaatttcaggccatttacctcgcataaacattcaaattccaggccatttgcgcattcaacattcaattccaggccattccctcgcatcaaacattaaaattcctggacatttactcggatccgacattcagttacgagccatttcctcgcatcaaacattcagccaaatcacccatcaaacattcaaattcaaggccatttctcgtattccacattcaataaggccaaaattgcacatccccagttttcagggaagttttacacctttaaaaattgctttacacacccacatgcacacgtttttaaccaccgaacttaaaatttttttaagttaaaactcccaaaactcaattacattcctggttactacataatagcatccagagaatcacaataaaactgttaagttttatttttagtggccttatcgcaccctccttctcttgtacccttccgaatttatcggtcaaaatactatccctaaattttttcaattaaattaaatcctcaagtaccaaaattcctatgttatgcaaattccagatacataaacaagtggattaccctcactgggttatcttgctaaaaaaacaacaaaactcttagctcctctctcagtttaacctccttaaatccatgatttttcccctttgattaatttaaagttttccgtttttggatttttaattctgcttggttattaaggccagcttttccctcgatttcagaccaattccggcttcctccctgaataccaaacaatttttcccaatgattttgtttccccaattttcgtaatcaatcaattcctttttactttaatattcaaaaagcattaacggtacaatatcctggaaattaattttcgtatgttatcgtttttttaaaaaaaactgccctatttttcttgaatttatactttagctttcaatcaaattcctctggtttcctaactataattagccgaaaatttatcttaaatccatcctaaattacattaatcccgaaattagtgttttttccatgaagcccaaaatgcaaccatcttaaaaaaaagagaaaagcgattttcctcaaagggatatattgcatagatccactacaaatccaaataaatcgttttcaattagtaaaaagggctaattattatctcaattccccaactcacaagctttcatttcagaatttgtgccctatttttctaaatttttgaatttatccattagcttccaatcataatttccgtttcgtttcctaattatttagttagccgaaattaatctatccatccttttgcatcaataaatcccgaaattagtgttttgtttttccaagcgaaccccaatatccaaccattctaaaaacaaagtacacgcggattttcctcaacgggatatcttgcagagaagcaattataatcctttgcaaattaatattaaaaaaaaatttgttttttgacatcactccattcccaacgcagtttccatgtcacaatttacattttacaaaccctatttctcacaccctgcattcataaatgacgccacggcataatgcctcccgatagttccttgccctcctcactcactacctctttccgtgtcatggcattctagctttcctcctttacaaccaaaccctaaccaaactttaatgactctaataaattttatttcagttttctttgcacttcactttgagtttgcgctcagatcccttgacacttcaaaaacatttttgccgcctggtcttcactgcgtaatgaaatcacagatggacatgaattcaataaagatggaaaagatgatatgatgataaatttgatgattccattttcgatggccacattcatatcaactcttatctttcaccatctaccctcaccaaagaccagggacggtcttccgatggcgtcggaggtgtaacccacaaccccctcccaatttactcaaaaaccccgggactcaattaggcgaatcttcctcctcccgctaatacatttctcttttcccaccttatctcccattcaatctccctcatccatttcacatccgttccccttattccgtttccttccgccacttacggacacttttcacgtacaaaaggcactccgatcacaccaatcggggagggagagaggaagagcacataaatccataattcactcggcctctccccctccgtccctttcccccagggcttcttccccttcccctcagggcttttctcaccccagggaattcaatcttcaatccctccagggcactttccttaccaatggcactccaaaaatccaatcaatccttcccttttctaatttcaatcaacacggcacttattttaaacaattatatttatatttattttcttattttcgttaataaataataaaactcaattcgacatttggaaataaaagggaaattaaaaagggaaatttggtaataaataaagggactttttcggacattttccctcccggcccggcacgttcccacatttctacgccatcccatttgacggatgttgggaagtgcttcataaatgttccaccctgttcgctcaattgatcgtaaaaaaacgtccgttgttgttgccggtaagccattgactagtttaaatttccatttaattcgtttgtctaatgcttctaaagtccttaactgaattcgagcaaaaagcatcaaaaattgacaacaaatacagaaaaaaattatgttcatgatcagctcgctccaaaattctaaaaatatcctaatatgatttaattcctcatttacagattctcggcttggtcaagaattatgtccctgtcgaatacactggacatcgaccattcacggtatgttactgcaccaaaaatgcaatgcgaaatatcactattttattataatatcatcggtcaattattttgccgttgttcatttttgccctccttaaaacgtggtgggtggggaggagtctcctcaccaatccgtgcaaaaagtgtagcagctaagccattaatattattacgaattgtatttgaatattttgagccatgaaatgtccccacaaaatccacctcccccttgagcttctttccgagtcggcaaatgccattcgattcaatccccgttgatttggtgtccgagtttcgtccaccttcgactatttcttgtcaaaaaaccgaaaattttttggaaaaaataaaataattgtatttaaacacttgcgtaaaaactggtgaaattttgttctatccttggtcctccaaatgcatgtgcggcgctccttaaaagtgcgaatttt

SEQ ID NO: 7604 - DNA, 918 bp, Heterodera glycines
caggtttttcgtgccaaacattaatttagccttatttttcaaaaagtgtaagttgcacatgcccttcttttggttatttttatttacaaaaaaaagcataaaaggaactttcagcttttttgttgtgcatttggggggttttcgggagcgctgaccacgaatattacatcctcggcctatttcgaatcccgaattcgaacaaaagtcgagaattaatttttcactagaattcacatttattgtaaaatcggttcaaatgcatttcgtaccgacattttcgtacgggggacgtttttgtagcgccgatttcgtaccgccattttgcgccgttttcgtaagggtgacgtttttgtaccgccgttttcttacggcattggcataatgtaatcattttgagggaccatattgttattgatatcgttatagtgttggacgagacgaagaatccgtgcgtcggcaccgcaatacttctttttctgtgcatcatcatgcacaaatttatcataatttagttttgttttaattacttgctgctgggggatcgagccagttccctaccgccaattccctactaaggcatttgggccatttcaataccaaagatatgagaatattcatagagagtgaacttaaaaatccaagaaaatttaaaaaaatttatttgtttcaaatcacggtctcatttcataatttcgagaaattccgatcaaaaaagtaaaaaaatgattgaaaggctgatgaatgggaaaatgttggtgtctctgttgttaagtggtaaataattttgaaccatcgtgagaattcgacggtctgctgcgcgatatttctttgccttttgcggtagttcttgtccagttgaacacttcgcgaaatcataatccgataacttttgatcatttcgcagaagatcaatgaaat

SEQ ID NO: 7605 - DNA, 2503 bp, Heterodera glycines
aaaatctgttaccaaatcacatccaaaatttccaaattttcccctgcggcgcctaccggcaccgctgcccaccccagttcccgaaaattttttggaaaaagtgcgccgcaaaaaagtggttttggaaagcaaaaaaaaaaggtcgtcaaaatatatctttggccaacccctcccccttttttatgtatgatgaccactcaactttcagacggacgattcactcagagcaccgatgagacgctcgagttccttgtacgacttctttgtatctcaacaacctccagttcattctcttgcgaaaaagaataacgaagccaaatactatgcgaggaattgggaattgtttccgagaagtttcgtttcgtcgtcttcgcatatgatatgcagaccaaaaggaaaagaaaaatatcatattttgccaaactaaagcaagaaaatgacgccttggattgaatgaaaccatgtagatacatataaacctctcataattttcatatttcgaatttacaccgtttaattttgcagtccgctttggactagtaaaaaataaactaccgtattttcccgattactagactcccctttgagggggttgaattataaaaggacccttctaatatgtagaagaccccgttcgattataagtgctcctttttgaataaaaccgagtgtttttcgttagaatatgaccatttgatttgggtttaatcaatcttctgacctcaactaccaagcggatttatatgtaattaatagttgatggtagcaccatttttcacaaaaaattgtaaatggagttgattttagaagttttcgtgaccaattttgatgttgataatttctactgtaaaatgcaatattataataaattttggaaccaaatcttatcttaccgattgccccgtatcattggaaagcccataaaaatactatcagaaagggcttctttttttagaatgcaaaattacaatttatttccgatgatacatatcttacaagaaaggatgggacaacacttttaaccatgactgttgaacaattttgccaaattcagctttagcttaattaataaactaggattttcggtaatagttcggtttcgaacaaaaagtcgaacggtcagactatcacggtcagactaaaccggccagactaaacctacccccaccgttcattagctcattttcttattatgaaaagccaaatcattaggggtgtaaaaaagtctcggtctcgagtctcgaaaatcgagaccgagacttgaaaacccgagactcgagaccgagaccaaaaaaacccgagacttctcgagtcgagaccgagagtctcgaacagcactactcggcagactgcttcctccgccctccgtctcgccccgctacttgctccgtcttcgtatgctcccttttgcgaaatttttccttttaaatggttatttattttggtactgaagtgtccattttctctgggactaagttgtcccagtgcttagatggcattggttcgagtttataccttgttttttagacttagctcatcaagagctttcgaatgataccaaatttgtccgaatttgggcgttttaaaaggtcaggagccccccttttcactcaaattttcgagttttaaaccggttcaaaaaccggttttttggcatttccgcaactggagacttactttttcgtgcatagctcgtcgagacgaatcgattgttatatcatttatgtcattttttccggggggttgactacagtacaccccaaaaaaaaacccgctaaacaagtaccaacttctgaaattgaaataggcaatcaattttccagtcttctttgcaacgacataaatgttttctcatttatcacaccacacaatacaaatgaacaattgatacaaattgtgaataatggaacatcattgtgcttaggaattcaaccttatatacagacagacatgggacaaaatgcctaacattacaatacatatgacattatggggcctaagattcacacatctgacatcggacggcatcgtcacaggctgttcacgctcccacaaggcgattcatccgcaatgcgaccgctgctgcgactgctgcgcctcgtccacttccgtcctcgctgagcaccatgaagaactgaaattagaggagatttattcatatcattccgaaacgatattagaaactatgtaactcacttcgcatttgacggccaacagcgccttgatcttctggtcgaggttgaatttgaaggttggatggaagcggaacacggagccgtcgacgccgatagtcacgcggggcctctgcatgcggttgaggatggcggcaagcccacaggcgcagagatgagcggcgcgcgtgccaatcaacgagctgatgtaggcgacatttgcacagtcggcggccgatgagttcgaaatgcctaaaatgggatgttgaatggctaaagtgatcaaatgacaactcaccaatggcgcgcagcatctcgccgacttggcgaat

SEQ ID NO: 7606 - DNA, 3411 bp, Heterodera glycines
acagttttggcacggttcggaaaaataccttgtaatatttctttcatctttttagtttgtctgttgcgccgaatttgccaaatgtatctgcaattgaaagtgctgggaaaaacgcattttgggtgggtcgtgagaatggcacgatagagagggtattaattttggatttgaatgtttgggccaattagtatattcagtggacttctattaacgaagcgcatggcactggcgggagtgagtctttttccctcctttggtccctctcaacaaattcgactcactttggcccttttgacttggcgatgctttcagacaaaaatcatttgctgtacagagacggaaacgaagtgagttgcagattagcattgttttatttatttatttagtcaattccccccccccccccattgtattttttttcttttcattaggtacgtctcctccccgtcgattgtgctgggctttatccaaaatgcgaagatattttttggaatgatcctctccattgcaaatggtgcgctttccaaaatttgactggccataccgtttcgtctccctccgatgacaattccgtggatgtcatatgtcctcgagggtatctgctggagggatgcccaccggcagtgagtgaggtatttttgttcctttcatttacgccacgccacgtaacctaatttgctcatttatctgttaggtggtcccgagtgtggacggctctctgaacatttatgggaaacacctcaattcgctcgaaaactttcacgtttcgctgtgtgactctgaatgtgccaatctcgtcgttaaaagcgatttgtatgcccttcttttgttcttcatttttttttctttgccccaatattcccattttttaagaatccgttgcaaaattccgtccttccaattccattgcgacgacctttttttgtctggatccatgggcaatgtttcaaatatgcgcttccttttcaaaattgcctttgcttccgatcacccgtcccccgtcgtcccctcttcaaatttcacttatgccattcgaattgttttgggtattacgcttcttttgcttctgttttccgttttggtgctattttactgtgtcttctaccctaaatattcggaggtttgtgagcacaaattgcaaatggacaaagtcttttttagcgacttctcaaaaggctcgggaattcgaatttgtcatcgaatggtaaatgcctttccctttttggtgcaactttcgttctgttactgcctctttctttttctctttccttccttcttttcttacccattgagaagtaaattttcatattttgattgataatttctccctttttactcttcaaatttctcttttccttccccactgctttctttctctctcgcttttctcattttcctcttttcatttattttccattgcttttttccaatttctctcttttcgcttcttccgttcctattcctcatttcagtttctcatttcgttgccagaattctcctcttcctcctcctacacgcccatcccactcacagagccgcgctttatactcggcccacaattcaccaaagaaactttctctcccgttcggtttgatcatatggacggcccaaagaatgtggtgcttctgtcggatgggagtgaggtaccatttggatcgggccgagcacaagggcggtttgaataccttagctagccgataaacgccgccataggaaattgatcgagtttttcgaatagtttgtcatggcatttccatttcgcctccctaggtactgctagcccattttatagtattagattggatgtaattttctcattgactgatttttcgtattatttagttggacctgtcaaactgggataatattggaggcggtaagtttttacatttttattcgttttaactttactttaggacattttgccaaagtgtgcaaggcaaaatggcacagaaattcggcggactatgaaggaaattacgtggctgtgaaaattattcgcgacattacagagaattcctattctgcaatccaaaaagaggttgaagcaatgagtcggtgagttttgcccttttgtaaactgataaatgattcacttattaatagctgtgaacacccgaacatcgtccattacatcggtttctttggatccgaccaattgggacccctcggcaaggaacttggcctgatcaacatcgtcatggagttcatgggcgggaaggaccttcacggctacctcataaacgaaaaaattgtttggcaaagcaaagcatggttctggtgaactttataaatccattcgacttttatgagtccaattaactatcaaccctgctaattttgattgtgagaatttgcatattcttgcttctttagactttgtgctttcaatcgataccaaaagtcaaccgtttattcaacgctaagttacggtccggaaaactcaggctttatagttgattggactcttaaaagtcgattggattcataaagtgcactaggaccgattttccaaaaaccctcgctttggtttttagtctccgactattggcaatgccttctcattcatttcgcaaattgttgaagggatggcttatatgagtagtagacggatagtccaccgtgatttggcagctcggaattgtttgctcgatgatagattcgaagtggtaaagataaccggtaagagtgaattcatcgggggggggggacttagacggaatgaaaatcggaatttgctgtagactttggcctttctcggctgatggaaaagtcagcccaacaggaagggaatgagtacgaatatttgggcaagaactgcgagttgctgcccttccgttggactgccctcgaatgttttggcgataacccttcggttggtaatccaatgccttttactgtttcctcttctgctgtttcagttctcggaaaaaacggacgtttggtcgtttggagttctgatgtgggaaatattcgcgagaaatgttttgccttttccgaatatgaccagtaaagtaggtggtcctttcggttttcgttgttttctaacttattttaggaggttcgactttgtcttgagcgagggggtcgtttgagcaaattggatcggtggagttgtccggatgaactttagtgcgtattgctactaaaatgtacaactagcagaacttccatttgctccttttagccaattgatgctgcgctgttggaacgtaaaaccccaattaaggccaacttttacggaaatcagtgtagaaatggcggaaattgtcgaccatttgctggaaactgactcaaattatatggaaacacaatacgaaatgttggaagcgggacataacgaatatgaaacggtgatagaatggatgggggacaacggaactgacattctttgtgttttttatttcttta

SEQ ID NO: 7607 - DNA, 1681 bp, Heterodera glycines
  misc_feature (1677)..(1677): n is a, c, g, or t
tagataaaaaaatcgtcataacttttgttaaacgaccttccctagctcagtttcttaggccatattcttttttcttacctgaccagtgatcaatgcctaatttttggtattaaataaatgcttaaagtctcggaaattccccacgaatttcaccctaaaaagtggcttttggtaagttcgagtctcttctcttcctttggaacttaacggtctcgagcctcactaataatgctagaaagactagctcgagttttttattttttgtatttttaagttcctagaataattgttaaaaattgatacttttcaaaaaaattttcttaaaaacaagcaggtttattcaaaaatcactaaattatcctaatggcataacacaaatccatgtcgataatcccaacagaaagaacatttttatgagcacgtcaaaaattgaatttcacttttcaactctccataattcaaattgaccgatcacttctcagcaaattcgttcacttctgctgatcacttgggccgggagttgcgccgagaagcctaaaaataaataaatttggatttttgaataagcattcaacactgactgacccgtccccaatatttttctcatcattaatttcaatgtcaattctgttccattgataataaattagccaattagccgcttcttcttcccatttcgcccatttgttcgcgtctcgcacaattggacaacggattagcaaaaagcgggtgttaaagacagttcttttcaatgccaattgttcgtgagtcaattcgttggccaaatcaaagagcatgacggaggcagcaaaagatttcggaaaccaaagcacgacaatgaaattgacgggagatgaagccgaggcaaaagcctaaaatgtgaaaaaatgattaatgatattggggtcatcacaaaaagccaaagtgcactttaaaatggtatttatttttttagggattttcagggactgagaatccgattctgatatccattgcgatccaattccgaacctcggaccatatttcgaacaaaaaatcgaaaactcaatttttttcattttcttaaaacaatcataccatatctaaataagtggattgggcaaaaaaacattttttgtcagatcagcgaaacccaaagaaactaagtgccaaataaaacaattagaaagcaccgatttgaaggcttcaattgttgacgccaaattcacataatctttgttcaacgggcatctcaacacctttggcacattggttggaagtggagtgaaaagccattttgccatcgcttgtccatccgatgccgtggcactgtcatcggccggaaattcggtgaaaagattggattcgctgaaggagacaacgcgtaacaacggacaatcgttgagaattgacgggacgaattgtcgcaaacgacggaacagtttgttatccaaattcatgccacgaagatgtttttcaaggattggccaaatgttgtgcataatcaacttcaaaatgcgatcactgttcgtgtggatgaccaaattaattgggcaggcggcgaaaagtggacgaaaatggttgagaaaagcgatggcattgcggtcgatgtaactaaaaatggatggggaaaagttgccgaaaatttttgcaaaagtaccaatcttacgagatgatgatgcatttgaaaccgctaancttt

SEQ ID NO: 7608 - DNA, 2936 bp, Heterodera glycines
ttcgagattttatgataaattcgtatttttcaaaaaattttcgaaaaatcgctagaaaatttattcaaaaattttcttgaagttttcttatcaaaaaattttctaaaatttttttcttaaaaaaatttctaaattgagtttttttaaattttggcggcgcgtcccgtcccccccccccccctccccttcgcctcagccgttctaatcaagaccaaatgtcgaatgtctctgctatattttgaaatatggagccatattgggatagttcaaagttggacctttcggattaattgcctgggacatcgccgaaattggcaaattaatttcaatttgttttcctccaccctaatgactcacttatgggccaccgtctcaaacattgccacaaaagcgttacaatccaattcctccgagtcgtagaacatcaccagccaatccaacgcgccttcgtcgggcgaatgggaatcggtacgccactcaaagttatcatcggtgagatccctttggacatgaaaaagccgaatttaaatttaacaaaaaaaaaatgaattcaatggctctctcctcgccgcatgaaaacaaatatttggagataaaatcagtgagtgatcttaagagcatttttaggtcgaagatttcaatgaattcatatattttctgcaactttatttagatgagttgactttttattttttattgatattttcttaaatatttattaaatatttctgctggattctttgtaaatataaatccgcgccttattcattttgtcggaatttgttgaaaaaatcagaaaaaacctatcaatcaaaaataagatgaattttattatcagataatttatcacttcagcatagtagaaatgaatccgcccgccgattgtgagcataatccaataaaaaccactaattaacccaatgtttatctattactgttaccgtaatcccccttaattcttcaaccctaaaatgagtttgaaatgccaatattctcaaaactcaccatgtggccacttcgtcatgcgctcggagccaccgcaaaacgatggttgagtcgccaaagtcgccgtcgtacagaatgggcttgtttcgccggaagtagaccaatgcgggaaaggtgctgacgccgcattcgcgggccacccgtcggtcgtccgtcttcacaacctgccaataaaaatgggaaatatttattctaataaatttctacaatttaatttaggttccctcccccctccccgaccccttggagcaagaaaagtcttgggattgatgagtaacataatttctcagggatggcgggagaaatttaaaaaaaaaatgtcggcgagtaattcatttgtcggggagaattttgcataaaaagttataggattatcccaaaatgccggataaaaaaaagaccaaatcactcggatgcgatctattccaattctcattggtttaatttccgtatccggttcgcgcacctcaatgtacccagtcgcctcgatgtcgtcgtcaatctcttccacctcggacaacgctgtcccacactggggacactttgcacgaccgtcatctaaaaaagcgatcgatcactgatcacactcatcatttatacatattcattcattctctcttacagaaaaatacaaccaaatttttggcagtgtcccgaagaatttcgtcaatttgttcctcgtccacatcctcaatggagaactcagaatcgatctgttgctgctgcttattgtgctgttgctggtgttgttgttgttgttgttgttgtcgttgagcggtccgttgtcccttcaaagaaaaatttttcgaaaattttttaattgcatattttataattgtaaggaagaagctggctgtgtgattaaaatgcggaaatgtggatgagtgggttcaattcccacccgaggcgcctaacattttgcacatttcttattcaatggaagtttaaaaactgtattgactgaaagaaaattccaacaaaatcatcaaaaatttttaagttaatcctttaaattgaagcttaatctcgaagctcgagactgaaatgaatccgaaattcgagactgaaaatgggctgtcccgccaagtgagtacctttgcttccggtgctggtgaagcagctgatttggctgtactttgtttatgtgatgccgctgttttctcatggtgtaccacaaccgggtcctctgcagccgttacctttcattaattaatttgacagactaattagggatcagcagggacattgatctcttcggggttaataattatctcggtaaatggaaattaaattaaaattgaaaaaggattatgtatcagtgaaatgttgtaatgccaatttccaatttccgacatttttttggatcggaattacgatttccgattgccaaattttttttcagtcgtcggaattccgattgttgcaattttttttagggcgtctgcaaacattgctggtatgtatatcttaattttaaaaatcaaaatctttttctaagttttcaagtattaaaaattagaaaaataaaaaaatttttttaaatttttcttttcagctgactggtcaagaaattaaaaatttatctatataaaaatatccaaattttttatggaactgagaacaaatttttgtaaaaatgttttggaaaaaatcaatttaaaaaaattgtaatattctccctttactttgtagtggtgattgtttttgcgtgcatctgccaaagtgagaaaaagtgaaagtgcaaatgagaggagaagcagccgactgctggcggcgccgccggcgttttttggacgaacggaattggcacttctgctgatagggatgggctttcggcacggcacagtttcacatgatgctgctgacactaatgatgctaattgatccccgctgttccgccgtttgtctttttgccggacaattgccatttt

SEQ ID NO: 7609 - DNA, 1581 bp, Heterodera glycines
acagtcagtgatagcactaattattgccaagtcatcatatttcatatttcacctgagttcgttatttcgccactctttaaccacagtaaggcattttaaaacagccaaaaatgcacgaattttgtcctttgaattttgcccattttcttccacaatgtttccttcttcgtttttgccatttattaacgcctcaagtcgaacagcaaatgaaaatagcaaatttatcaaatgcgcttcaaattccgagtgatttttttgctgaatttttttgcgcaattcaacatttttaattgcttccaatttagcatcattttgctgcttaattgtgccaatttcttgcataatttgtttggtcttttcttcgcttaatattccattaattgccatttcaaaatttaaaattttcagttctttttctgcccggcatttaaattctttttcctgctttttgttttggccgacctccagaattttggttgttgacaaacgtgctgagccgaagcgacaaaaatatgggtgtttgtaataattaaatttaattattattttaattttattttccaagtaattaatcataacttagcttaagcttagtcaaattaataaaattaagtatttagcgacagctcgaagcatcctctactatttatgaaattttcaaaaaattagtaaaaatttacaaaaagttgtgactaaaaaagtgcgaaaaattttgactcaacaattttgaccctagctttcttgaaattcaataaaattttttgaaatttagcagaacaatagagtaatctttgggctatctaattatataaacaaaattaaaattgattgttttagaaaaaagttatgaaagaattaatagggtcatatttttatggtcatccaaaaaatgtaaggacatttaaatgcataaaaattgttcaaacttaaattaattcactccgtgcttgatacgaaaagatagcccaagctcaccacggttcaattttgactgttgtcgaaaaactttgagagagatgttaaaagtcgcacactttacaaataatgaattgatacagtagattttaatgatatgaaataaaaacccaagacaaaagcatgataatctttattaagaattaattgcaatactatattaccaaatttaaattaaatcactaaaatgtatatataaataaaataattaagataatatttgtcaagtgtaaattcttacgccttctaaggtttcaacaacggtagatgctgatctgaagaatagactgattaccaaaaggacttatctgacatcgttattgggtttgggaaaataccctggggcggcggaaaatcaaaacagaattaaatataccaaaaaattatttaattatttctttaaatagagttgacatcgttttcaatgagatgtcaatctcaaccagcactgtgttcatataatattgtattaaaagttaaatttttttgaattttaggccttccaataaaatattacgtcatctaaagtgtgatgaaaatactatattaaaaatacgaaaatccttaattatctataataaacttaaaaataaaccttttattcta

SEQ ID NO: 7610 - DNA, 3074 bp, Heterodera glycines
  misc_feature (2873)..(2873): n is a, c, g, or t
tttgttcacgtgcctgccggaatatcacatccctcttttaagctgtttctactcccgcttttcactgatttcttgcccatccttcggcttcttccccgcatcattttttctatccattcttcttccatcacatttcgtccaaacttcgtcctcccccatcgctcatcttcatcatcccattattcttctcttcctctcctcctcctctctcattgtcttcgcttccttcgtcctcccaccatcccataatgtcatccactttctcttccgttggctccaaattcactctgtcctcatctccagtgccattcgcagcagtggacgccgtttcggcaccgctgctaaccatggccacctgctgctgttggatcaacaaaattaattttttttaaaatcattggcatggaccaagaggcctctattagcctgcaaaatttcgaaaaatttcgatcaggttcaaaaaagttatgacaaaaatgactgctgaaacctggtttctgatgtagttttggccataaatttgttcaaaattgaccaaattttggaattttgcaggcaaatagaggacatttaaggctatcgaatgataccaacaatgttggatttggtggcaaagaaaaaatttatagtcaaaaaacatgactgggggggcccaaacgtggtgtgaagtaaaccgatcagaggcggacggacataattatccaattttttaccactaatatctttgccgaattttgccccagatgaattttaatctttaacaaatttcactttttgtgtgtcaaatgcttgtcaaataatatctcaaaataattaactaaatagtgaccaaaaataccaaaaaaatttacgaaattttaaaatccgtgcttttctctatgaaaataaattaaaatcagtatgaacagccattaactattacgaactgtctcaaaaatgccaaaataggtgtgataatagggatcaaacaccaaaacaatggcataattactttagctgtggcgaaaattctaaaatcaaatatctatctctagtatatttctgggttttcagaaaatgagactttaaaatttaaaaaagcactctaaaaaatttttttccgcatttttatttgtgtaaattattaattcttgaaaataaagtcgcctttttttggcgatttttgtatgcctggccctatcaaataaggatatgctattattgacagatgagtccacctgttgcttttgttgttccgccaattgtccagccgccctttgttgttcgccgacaacagcgacagcagcggcactttgtttgcccatcaaagcctattagtgaattttaatgacatgtttgatttggcgtagtgacagaagacccacagacaaaagaccccccacaactttttaaaaataattcttaattaattaatttttaatttcttaatttgagtttaatctgtgagaaaaaatatcaattgacaagcgaaactaataattgcaaagtattacgttgaaactaggaaaattttcacgtaaatagtattttaagcttgctttgatgcttctaatttaccttttcaatattttctgtatttgagacttttgtccatatttctatcggcattttcacaaaagttcgaaaaatacatccctaaatatggaaattttttggaaaatacgtccctcaaaccaaaaaattttgggaatttttgtcaatatttttcgtattttttgtacatctttcagcgttttgaccatatttcgtccatattacaaatgtttagtctatattaataatctatattttggaattttttttgtccatataaatccggcccctaataataatttaaagaaaattttctcaaaaatgattcgtgggtctttttattctcacattaaactcaaattaagaaattaaaatcaattaattaagaatttatttaaaaaaagttgtgggggtcttttgtctgtgggtcttcttcgttgatacctcagatttaattgcctataattggtttgcccacctgctgtcggcccacatttgatgcctgacttgaggcaattgtggctcggccgctgccccattcctcgttggccgactcggccaaatctggcagcagttcgtgtgccgacagctgagaatttatagtaaaataataatgattttcataatttttttttgctctgccggcattttgtttcccctgaaaattttttaaatttcaaaatgaaatttttaagaaaaaattaaagaaaaaaaatttttataagaaaatttcaagaaaaaaatttgaaaaaaaagctagaaaatttttcaagattttttttctcattttctaagattttttctcgaaaaatgttaagttaaaatttctaaactgagtggaacgtaatgcaacccttcgacattgccggatccaaaattatccttttttgtacattcaataaaaaatgcataaaaatgaatttaaaaatgaaaattgaataagccattgctatattaatcagtaataaaatttatttttattcaattttataaatttaaatgtttttttgaaataaatgggaaagtccgccgtttaaaaggcatatgctcacctggatcggcctttgatgtagtgccgccagggattgcatgcttttgctttgtgccattttactgatcggtgccgaagtaatgccacccgtggaaatggcagcactctctgccgacgacgcggcagcattggaggcaaacgcacgcccggacacctttttaagcgcagccgcgacaatgaagcggcgcgcggcaccctgtacggataaaatgctaggaaaaatacgatttttacatattcgttaaattttcgactcaaaaataaacaaaaatttttcgacattttttanatatccgcgaatgatttcaaaattcacctcaaacacttcggaaatgctccgtctccgttccacgtccgcaccgtacactaaccgtatttggtgccgcttctgtgaacatgggccgtgccaactcaccggcggtggtcagcttccggtatcgcactggactgtgctgggccggcgaccctggtgacattttgcgctgtttac

SEQ ID NO: 7611 - DNA, 3222 bp, Heterodera glycines
cacataaaaattttaaaaaatttcgcttacaaattaggcacttttcggtgccgacctttataaatattttaaattctcaaactttccgaataaaaaagttcaattaaaaactaaattgcaaaaagtggtgctgatcccttcttgaaatcccacacgcaccataaattgactttgccgaaaatgtaaaggctgtctgcgttttgtgtgccactttggcggagtgtgccatttgctgttggtggttttgtgccaacgctgacaacggcaccagcggaaggccgggggaacgaagacggcgcaagcagaactcgagccaagttttgatgctggaaaaatctcgtttttttttgaaaatttattttttaaattgcttacgtttgcttggccacctcctcctcaatgatgtactcgagctcttcccgttggagcagctcttcgagttgcaacgattttcgtatgtccacgcttcgataagagagcatgctgaagaaaagggtgctaggtcgtttcttaaatactgccaagttgtaggaaaacaaaaaatgtaagacatataaattcgtatcttggtccaatttcaaccaaattaataattcttggtatcattcaatagctttgagtgttctctatcagaatattaatttagaaaatttttatatgaaattctaaaaaagttatggagccaatattcaccaaatattaagacggaattttttgtccagaacttttttcaaaatcaatgaaatttttttatatgtcttagattttttatattccttcaacttggcagtttttaagaaatgacccagcacgaagaaaaggggttaaattttaagaaattacagtaaaacaagggtctatgtggaattacagtaaccgtggtaagaaattaaaataacatctaaattatcgaaagaaattttaatgaatggagtttataaaaataaaattttataaatgccgttacattgtgacataaatttttaagtagggatgtttttatgcctaattagtaatacctaaacaggtggattttttgcgaattagaaaagttctcttcgtttaaatgtacattgttattttctgattgtgagaatgtaattttaacaatttatttaacgagaaaagaaaaattaattggattttccttaaaagtgcaaaaaatgccgttcggttttaggttttgttaacggtttttctggtttatccctcctaggctgcgcgttctttatgatttttacaatgacaaatttttcaaaaaaaatttcatagaattaccggcaccgccggactaaaaattccgtaattccttaaaaatgactctaaaatctcaaagtttagataattttggccagcacaacacggatcaagtgaatcacgccaattttcgaggtttatgatcatggattgaaaaggcaatagaatcaaatcttgatttaaataaattaaagtattttttaattttaccaaattttggcacattttttgtccacttactaaagcacgtcgtggaatgacacgtcgtcacccccgtgcagcttctccatttcgtagcacatgtgcttgaacagcagccggtccttgttcgggtccacttccaaccgaccgcgcaaaagtcgcaacaaaaattttacacggccaatcggaatttggcccttctgctccacgtccacaatgttccaaacctaggcaaaattttgttcaaatttcgttttcttgaatgtcaaattttcatttttgttttgtctcattaaaactaattgcaacaatctcattatcgagattactactaatttgcccaaattaggggtgtcagctaggaccccaaaaattcgaaaacccggattaggaagtatgaaatgcagaactgggattcatattcccgaaaaaagtcgaaaactgcaacggtaaggcggcgggggggggggtcgaacgtcacccgccgagattaggcacactactaattggcccaagaatcatttggccaaaaaaagaattgagactgttcctcaaaaatgccatactcaaacgccctggctgacaaccacctgttggaagttgcggatgtccgcataactgagcaatgcgtcctcttcagaagagtaaaacagcgagaagttttcgatgataattgccaccagcaggttgcgcacaatgtacgtgatgatcaggtagaaggagcagaagtaaattagggcaccgtagtaattgccacagtccgtctgccagtaattagcgcccggcaaccaatagcaaaacggtgcactccgctttaatagcaacatatgtgcatatatggaataaaactctagtgctactcgagaccgaaaattcctaagatagtaaaaattcgaaattttcatcgagtcgggacccgagaccgagcttcttaagcagttcaaaaaaataagtgcaaaaattttcatgggtggaaacaagtcattagcgggcggcacacttttttctaccacgtctgcactcctccccttatgttttctaacgcattcaaattaaattttaaaattaaaaatattttgggcaataaatttcctggcacctaaaaagtcagtgcccaaataaacataataattttacggatgtgtcatgcattatgtcgttccaatcttcgcccgtgacactgcgaaacagcacaaccaatgcttcgaaccctgatcggaagttcacgtgcctgaaaattaaattttaaattttgagatttaatttttttttaaatttttttatggcactttgacaccgcctgcccatatttgaccatgccgaacagaatcacaccagtgtaggcgtagaacagcacaagcaaaaccatggccattatgatgaagaaggagcggagcatggacctttattttagcatcacaatttctgtatttcttttttaatgcttcttacatcacaacagtgagcattagcattttcaaagtgctgttacggcctgaaataaatgaaattaaaaaataataatatattttcaggggaattcaaactgccaaatacaaatttatatttgaaattattatttttggccctaaataattatttttgggactgatcacgattgctatttttagttttaccgatttattttatcgattttaattgaaaaacaccaatctaaaaatttgggttttagtttgacctattaagaagctggcctggtcgctaattacttactaatcatttacatacaatacatgtaattag

SEQ ID NO: 7612 - DNA, 3500 bp, Heterodera glycines
caattttggggtttgaacttgctttatggaaaagaaatcctctcgggcgatgatccgttagaattacaagctcggttccactacaattggtcggaaattatgcacggcatgaactattgctgctagctcaccatgggtgggggggagacgactttccacgtcagttaaggttcgagaccaatacccgattgcaaacatttctccattttcggcttgcattaatgctccaccataagccacagctgatgcatccgtgaataattaaaacggtagtgcataatttggcgcccgaagactcggcgacttaagtaagtgattttttaacaaattcattgctttctcctcgttctctccccattcaaattcaaatgctcctcctcgggttaatttgtttaatgggtatgctatttgtgcaaagtttgggataaattttctaaaaaatgaaaccattccaaggaatctttttatttctttgacattagttgggggtgggaaattctcaatcacttcacgattagacagcgacggctgataaccggatgcagataaaatatggcccaaatatacacattccttttgaaggaaacggcatttttggccttttaatttcaaaccattttcacagagacatctaaacacattcctcaaactctcaatgtgttcgtccaattcctccgaataaattaatatgtcatctatataaaccattacgttcggtacccccttaagtatttggtccattgttctctgaaaaatgcttggagcatttcttagtccgaagggcaactttaacatttggtataacccccaaggcgtaatcaagccacatttatacgaactttctgcatccaatgggatttgccaaaatcctgaggctaagtctagagttgagtaccatcttttccctgctgctctaaaaatgactttgtccatacgcgggagagggtatgggtctgcgattgtcactttatttaatgggcgaaagtcagcacatggacgcagctggccattagcctttttaactagcacaatgttatgtacccaaggagttgtgctctcttttatcactccaacttcaagcatttttccaatatgagcctttaactccgattcatatttttcgggaattggataaggcctaactcgttcaggcatttccgtcgaagttaaaagagtaggagcaataattttacatgttcccaaatcataatcattttccgaaaaagctttacaattttctttgagacattctcttaatctgtctatctcatcttcattttttgttcccacttccttgagcatttcttccaaaatttgagtcttcgtctccttttcctcggctaccattactttttttgttttctccatcaatttcccactttgtaagtccaacaaaaaagacaacttttgaaaagtatttcgtcctaaaataatgtcatacgacccctttccaatatttctatcaacgaccgagattatgcttttgacttcgtggcccatcaattcaatcaaaatttctgtttgtcccattattggaacaattttcccgtcaataccaaccactcctgggatttccgaattatgcagcaattttatgcccaattttcttgctgtttggacactacataaagtgatgtgtgctcccgtatcgacgagaaacaccgcgtcatgatgattgacccttcccttctttttaaaattcggaacccaattctcagtttcaattagagctaaaactgtctcgttttgcatctgtccgacatcctgtcttgcggttgtacgtacagcacaccgttcttcttttagtctccttgtttggatcacatttttcttacttggcccctttggtgcgaccgttttattaagttccatttcttcaggagacggccatctttttgttagtggtaccctcgaaatctcattcactggcctatctttagctgttagaatagggttttccttaactccgctttccattttctcgaccttttctgtattttccctaattatttttctttgagttagagcatacactctcgaaactattcggctaacatttaaaagtcgccacagctgaaccatagcaaatgggcagaacaaatttactattactgtaatcgttacataacaacaacatagaaaaacccataactgattagcacttataattcctccacgcaaaaatgaaaataaaccattagcgacaattcctccagccaattcattttgatgttcggaaaaagtttcccacacattgggttgagacatgcgtacaatttcttgcattatctttgcactctttatagtctctttgaaattttcaggcgagtatagttccgtaaaatttgttaggactttatttttaaatataggaacgcttatttccgggaaatcaattcttccgtgtcttgttaattggcgcactgattccattggaatttgctcaatgtctccggttttttgattatactctaagagtttgtctccttcatttaagtacagaaaattataatttccacagtcaacctccctagaaaaggggtgaattatgcgtgtcactgggtcgataaaaccattctttattttcccatcaagtttgaaagtaaccgggatttcagaaaaacaaacacccttttgccaattaaaatgcaactgcgtgaaaatagctaaacagggcttcacctccaacttattttccgttactaatcgtcccaccaaaaagggatttcccagaaaatatctcgccaacagagtaggattagccactgataaagtaagaatttgatctgacagaatttgcatatttgtacatattttacggacagtctcttcaaaaatacgccgggtattttgggtaagccttaagcttaaagcggtgagttcagccgataactgcgaagagtagacgagtccaacctctggatcaaatcttttctttctgttcgttgttcctatcgtttgagctttttccaccatagattcataatccgacatcaaaacagcgaaagactgatcagacaccattaattggtcgataactagacattctttttgtttaaaaattgttttatttttaaatgtaagtgcgaaatcaccactctcggccaaccatatttcagaagaatattcgccctccatgtttgccatccaaatatatgagcattgatgaccaatgtcggggtcccaaagcaggctgctttttgtacatctacatgacccggcttggtaaaggcaatttgagcattctccaatgggagtgcttatcccctccattccatggcgtgtaaagaccaccgtgtcatatacataacaattcaaaatctcaaatgtttgccaaaaaagattatatggccaaaagccccatccaacttctaaggaattatttgtggccataatagttccatttatcaaatttagttctcccgccatggaatggtttgtttctcgcatttgcctgcaatttgaggtcggaatttccatttgttccgtttttgactcct

SEQ ID NO: 7613 - DNA, 1695 bp, Heterodera glycines
  misc_feature (25)..(25): n is a, c, g, or t
caatccatcgtgaaaatgaaatatntggatttccatcataaattccgggcggggcaacagacataaagaatgggtcagccatcattatttcgcaattttcttctgtggtactgtcctgactcccatggccagtgtcctccttgtttttcgtttgttggctattacccaattcctcatgttcccgaccatgcccattttccagccaaatgtcctctatgctaggctcttttaattctaatagctctattctcgcccgtaatatatccactgactcttgaaaatcattttccacagtttcaatcttttcttggagtttcccgatggtggtcttgacattttttaattcactttctatgcgttcaacaattcgtttcagacctatcttggccgcttgtttgtaccccttgagagtgttggcattctcttctgcctgatcctccaatttcacaatcctttccgcgaagtcaaaattactcctttcttcaactgtaatttgctcattcaccattctctccaattctctgatttgttcacctttcctctccgactcaattctcatttcgttttccatctgacgaaattggctgcacacggcagcttcaaaggaacggagtctcggtaacaaattttggaagaattcgttttcttccagggtgaacagggaggaatcaaaatcagagccattatttcgttgttgatcaatcggtgattgacttctcgaaaccatgttttttttttctttggcactaagcccggctgaaactacacaagttgatcagctcactgaaatttgatcagttttctgttttttttggatctccggctggaagtacttaactttgaccagctcaaatgaatttcggcactggaagtactaaactttgaccagtccgatttcttctacgaatcaggggagcactgacggcttactcccgggtcgtggcaccaaaaagtgctatgtccctaagtgattcgtacccaaaacttattcaattcacaacaagttaaaaggaaatttatttaagcaaaagcaaggcaaattgtgagtaagtgattcaaattttaaagcaaagaaatggcaggcagggaacctgacccaaaatgagaatgagttaaaagacctgacaaataaatggatttgatcgcttttatatcgtttgtgaggggtgtggtcgagaacatcgagagagagggatgggatagcagtctgttgttaaacatcaaaagcgacaaaggaaaaggacagaatggaaaacataggaaagattaaatggaaacattaggctgggaaaagagagattaatgcttaaaaagaaatggcaaaacagacaggcatcgaagggatccaacaattattttggcagtttttagcaactataaatgtgagccctacttatcgtactatttaaatgaatttttaatgtttttgtaataattcaaacatttatttcttgattttttctttttattccataattttcggcgcataaaatagaagaattaatttaatattaattttaatgttttcctaaattccttaattgataagatctactaaaactttgaaaaccctattatcattactataattctggtcacgatctgacaattggacaaacacgcttgattcataaaatttagaaaactattgaccaaaattgtaaaacttattattttacgggcaaaccttaatta

SEQ ID NO: 7614 - DNA, 2401 bp, Heterodera glycines
ttcaatttcgacatcgatttttaaagacacaccattagcagatataatgacaaatgagtgaattttctctcccccttgggggagatgcgccgttcccggaagtaagtgcaatacgagacaacgcgtggtcaagcgaatgccaaaagacaaacacatcgaccaacttccaaaaagtgttatgctattttaggtaagtcattgttagagctcccacggaaggttaagatctgaaaataataatatcggaacaaaagttttgtccagcagaaatatatggggagagaaatgagtagggatttttcgtgaaaattttgctaaaaaattatttttttggaaaattttccggtttttgaggtcaaaaaggccaatttgtctgttgtgggccgatctattagaggttttttggaaaaacgccaaaatatgcacataaaatatgcacgaaatgccaaaatatgcacaaatatgcacataaatcgcgaaatatgcacaaatatgcaaaatatgcacatggaaagtcatcctagaagcttcaaatcaagcaaaaaacatgtttttcgtgcgtttcacgcttcccgcagtccaggaaaaaaaatatgcatggcatatttttggcatccctagaaatgagtgagaaaaaatggacagacaagaacagagaaattagaaaataaaatgtgcagagagaacagtagcaagcatccagagacagtgagtgcagcagaaagagtgtgttgtatcggcgacaaagaagccagatactgacagacaatacacacttaagagtgaaaagaaatttaggctttaattggcatacattagcgaagaaaaaaaacaaggaattcgatggaacgattttaacatttttctttataaaagaaaccaaatattttatttgcacaattttaaatccatggcaacatcggctaaccatcggccaatcttcgaatttattgtcgaattgggtaggtaaatttttactatttttgggcttttctgcaattttcaaactattatgttccatctttttaattccaaaattacctttccatttaaatattcgagaaatgtccgattttgccgggaccctcaaatttcggcattttgtccaatacgaaccccgttccgaatcgaatttcccccatttatttcccctcatttgggcaggcattcgtctccaggccgattcgctgaccgtcgcctttgcctcggtgtattgccatcgcgtgttgcgccaaaaggcttttccgggcgaccaaatttgtccctttgtgagcttttttttaggttatacgcaaattttatggctttagtgagttttaggcgtccaatcattactttcttttgcacatttttcttatttggtcaactctatgtttttggcatcaaatgaaagcaaaaaactctatagaatttttttgtggacctaaattcttgactaaaagcaacaaacaaaaaaggtattcttggatatgctcgaaaaagcaacttttcgtgttttaccgttgcaattttttcgtaatgtcagatttgcttttttctttttatttttaaattcccgggactttaagctttcatttggtaccaaaaagataggcatttgccaagtaagaaaaaacgtatggccaaagaaactaaagattggacgcctaaagtggcactagagccaatttttgaatcaattttggccgtttggctctttttttgttgaaaatgcttaaaattttccggttttgtcaaatcccccccttcagacaatggcttccgcctgtgttttggtggccggcaaagtgacgaacgacgcgcgcattaacacgcgcgacgtgatgaacatggcctacaggttttcttttttaaacccattttttcaactgtcttttccaaactcggccattttttgtgccgtttattggcctttatcctttcaccttcgacaatgcctttttgtccagcgtcgaattctttggcgaattgttgaaatttgggcaattgttaggctcgaaaacccaatttttttcatttttatatttttcatcgtttatttccctaattttttccatttcccccaaaaagtgttctccacccgcaaatggccccgttggaaattggcgatttgtcctacgcgttgcgcgaagggctcgtcgaaatggagttggtggtgctccgtttcctgcgctttcgtctcaacttagagcacccacatcaggtcaaagaaggggaagggaagggaaagggcaaacgaaaaatgggggataaaatgacgacaacgaaccttgaggattttgggggacggaagtggaccgataagcaaatcgcaacagaaaaagacgacgtaatgttaccatcgcaatttgtgggttgataaagaattcggggtcaacctcgggactttatgaaggcttag

SEQ ID NO: 7615 - DNA, 1016 bp, Heterodera glycines
caaaatttggcgtgaaaaaaaaattatagaaaaaaaaatatttttttatttgaaacggaatatgaattgctctcggggaattaaacacccaaaaaggaaatgccaaatactagacaaaaatttgggaatataaattgtaaaaatttgccaggaacgctttactaattaactaattaattaaatttgcattttttcaattcctcccccccctccccttaaggacctcattttgatgctccgtctgctccgcgattggtaccccaacagtctcggccgacgctttgacgacgcgtgccgcgtgtccgccatgtttctgcaggtgccatcgacgggcggacgaaaattccccccccccccttcgactgatcgaaaaacatttgaattttttccaaacagattttgtccctataatacccacttttggtttttggagttaattttataaaaattcctgggagatttcgaaccccggcggtcatacacacacaaagggtgcgagttattctactaaaaccctttcatacgttgaaaagggggaaggggcgacaaaaagttttgcgaagggcggtcggccgccgattacctttttttgcatttcaaaatcgttttttttgcggcgcgcttttccaaaaaaaaaaaacaaattttttaagaaaattgggatatttggggttgggctcacggggtggatgtgttggatggggaaaaagtcgggctgccaaaaacaaagtcacgacaaaaccttgattttgtatttaataattacatttgcaacacaggatttgtatgccgaaccacaaattgtgctggaccacaagccgagaacgttggccgttgcggtaggcgcatttcgtccatttatcacaataattccgtccataatttgctgactacacccatttttaaattcaatttcctcgcttttttaatttttggggttttttgagtttcatttttcggataaattagccgaacaatcgggaaaatttttgtttttggattttaaaatacgaaaa

SEQ ID NO: 7616 - DNA, 1507 bp, Heterodera glycines
  misc_feature (46)..(46): n is a, c, g, or t
  misc_feature (49)..(49): n is a, c, g, or t
  misc_feature (54)..(54): n is a, c, g, or t
  misc_feature (57)..(58): n is a, c, g, or t
  misc_feature (60)..(61): n is a, c, g, or t
  misc_feature (73)..(74): n is a, c, g, or t
  misc_feature (88)..(88): n is a, c, g, or t
  misc_feature (97)..(98): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (116)..(116): n is a, c, g, or t
  misc_feature (118)..(118): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (185)..(185): n is a, c, g, or t
  misc_feature (188)..(188): n is a, c, g, or t
  misc_feature (190)..(190): n is a, c, g, or t
  misc_feature (199)..(199): n is a, c, g, or t
  misc_feature (203)..(203): n is a, c, g, or t
  misc_feature (209)..(209): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (224)..(225): n is a, c, g, or t
  misc_feature (229)..(229): n is a, c, g, or t
  misc_feature (231)..(231): n is a, c, g, or t
  misc_feature (236)..(236): n is a, c, g, or t
  misc_feature (238)..(239): n is a, c, g, or t
  misc_feature (241)..(241): n is a, c, g, or t
  misc_feature (244)..(244): n is a, c, g, or t
  misc_feature (251)..(251): n is a, c, g, or t
  misc_feature (259)..(260): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (279)..(279): n is a, c, g, or t
  misc_feature (284)..(284): n is a, c, g, or t
  misc_feature (287)..(287): n is a, c, g, or t
  misc_feature (294)..(294): n is a, c, g, or t
  misc_feature (305)..(305): n is a, c, g, or t
  misc_feature (317)..(317): n is a, c, g, or t
  misc_feature (319)..(320): n is a, c, g, or t
  misc_feature (326)..(327): n is a, c, g, or t
  misc_feature (342)..(342): n is a, c, g, or t
  misc_feature (347)..(347): n is a, c, g, or t
  misc_feature (367)..(367): n is a, c, g, or t
  misc_feature (371)..(371): n is a, c, g, or t
  misc_feature (375)..(376): n is a, c, g, or t
  misc_feature (389)..(389): n is a, c, g, or t
  misc_feature (392)..(392): n is a, c, g, or t
  misc_feature (426)..(426): n is a, c, g, or t
  misc_feature (437)..(437): n is a, c, g, or t
tgcttaatgttagccagccggtccctttttcttttcttccatggtnaanaaagnctnnannaaaaaggagggnnggctttttgaatgnatgaattgnngttttantnganagaggnangaagaggtnanaanaagaataanaanaatattattagtttgaanaggtnagntgantttgaaggaanttngnatattttgnagtngaatgnttngnanggtntttnnattngntggtngnngnaanagggagnaaaagatnnanangngananaagggatnggttnttngtggttnggaaatgtttnatgattaattgngnnaggtgnngttaatttttggaanattgnagaagtaaatattgatgggntaanaatnntttatttaaaatnagnaaaattaagaattgtatggaatgatttagtgatnaaattttaaangacgtaacagccgactcgattaacagcaaatcgttgtcttttattgaaaataatgtaagttcttttatttgtatttgacttgcttttttttctttgctttatccgtaccttgtagtttttttaagtatatttcccaccagtatcttttggccacttatttatccataaaacggacacaaagtgaaatgaatatatattcttaaaaatgtcttaatttttttccgcgattgccaacgataaaatatgcccaattttatttttcaagaacaatttgttgttgccgaccgaaatgccatttcgcgaccgaacggcggaattcagaacagtggcaaagtcatgtcaggttggtttgttggatttttttaacaataaatatgaaattacattaattggcagcttcgacagcagccaaatggatatatgggaaagagcgaacgagaaaaaatcgttaattcttcaattcagttcaaccaattggccaagttgttttgtagcattttctgtggtagtaatcggttttaaggcgcattggtcgggatttaagtatgacatgtgccaaaatggagaaattggcacaattggccaagaaaaaatcattgttcgatgacagagctggggaagttgaagaactttcacaaattatcaaacaggtttttgaaaattttatggaggtggcatttgaccaaacaattttcaggacatcacgggcctcaacaaacaaatcgccaatttgcagcaattggccactcaccgcacttccggcggctcttccgtttcgttgcggcaggagcaacaaagccaaaaccactccaagttggttgtgggtggggttgcagtcgaagctcgccaacattagcaaaaacttccaaaatgtgctggagattcgaacagaggtaaaaccgaggaacggattttaggaggaaattttcgtattgacagtcctttaattacgacaccaagtttgtaaatttttagaatttgaagttcaaaagagagagacgagaaaagttcagtcagtcgggggcaattccttcgaatttgcccccttccacaagaagtggaccaagcga

SEQ ID NO: 7617 - DNA, 3621 bp, Heterodera glycines
aacgccatggaaagcatgaaaagcagcatctctgagctgggcacgattttccgccagttggccactctcgtctcggaacaaggcgaaatgatcacgaggttggtttaattggttttcattttaaatttaaattatgtagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctgatcggctgataaactcagttctgcggagattccttcacattgtcatcataatcactcacagaattttattctcttaaacagcagtcaaatcattgaccaaatattcctaacttattacccattctttattgtgttaattgttggtcatcattaggtctttctgaaaatcgctttgtgacggttccattcgcccgttccttcttctgtttaaactcttccactcctctttagtccatgtgatagctttgcgactcttccgcttctgaataaattattttatgtatttgttcgtttcttagaaagattctcatatttctgtcttattgtctgtctgttccttcgttccatcagttcctttaagaagaaagaaagagaatggtccgaatttcggtgtcatttgtggtcctggcaagctttgtctctaccgtcttgaccattttgaatgctttcttcctcaagaagcagttctacccgtccgttgtgtatctttccaagagttccacttccatggccgtgagttcgtctctcccctattcatttccatttgcgtttgcttattttaggtcctttacttccaagcagccgtcctcagttacctggtcttttcgttgcttcgatgccttttcttcggccagctgagagtggccgaggtcgaacgtgcccaggaacgcgtttggcacacgctgatggagacgtgtttggcattcagtaagtgcgtgttctgtccgactcgaattcattgattttattcagccgtttttcgcgatgacttttcgccggtgttcgttgttcagtttgttgttctttttttcataaaagcatttcattggctcgctgaggaccgcgtcgattatatggtaattttcaattccttttacaccctttcacatttttatttatttttacataccttaaggagaggagtcccatgctcactttgcttttccatgccaggattctggggatcatttcccttctcagtgccattgactcttacttcatttctcacgctttcttcacaactttgatgcggggggccggcgctcaaattgtgtttggatttgaggtcctaatttggaatcatttatcaaaataggattatgattataataataattgcaaaagaggctttgcacgttaattacttccctcctcaattagtacgccgttcttctcacaatggttgcgcatatgaccatcaattacattttgcatttgcacgatttgcgttcgccgcacccctgggaaaacaaagctgtgtacatgttatatgccgagctgctgacaagttgtgtttgtttctcctttcctgaaatctgcaagttttctaggctttcttcgttgtgccctttacctcgcttttgctgctgttatgatgaaggttcgttgtgacacagagaattcaaactttaatttaaaaaaatctttcaacatgtacaatttttattaattttcttacgaaattttttatttggaatatttttaaactttttttattatagtgttggtttggaaaatttgctttattaaagtttgtaaaaaaatttatacatttctttctcaccgctcttccagatgcacactttccctctgttcgccatccgtcccttttatttgaccgttcgtgccttccgaaaggctgtcaacgacgtcattctgtcaaggagggccataaatgccatgaacaatttgttccctctggcaacagcgcaggattggcagaaagtgggagaagaaaagtatcagtcagttgtgccattgcctttttcactcttcagatgacaacacatgcattatttgtcgtgaggaaatgaccgtcgaaagtggtgccaagaagttgccatgcaatcacatcttccacccgaactgtctccgctcgtggttccagcggcaacagacttgtccgacctgtcgaaccgacgtcttgagttgtttgctcgttcagtttggaaatgtttgccctttcgttcagtccaacggcgtccgtctaccgctgccccggcacaaaatgcgccgccaccccaggcccagcgtctcttcgccgctcctcttccgccgtttgcccacccatttcagtttcaattccaatttggagcggcccaacaacagaacaacttcccgccacaacatccgccgccctttttggcgccgccttttgcctttgcgcctccgccacaatttggggcgccacaaccccaacaggtggccacttctcaactgtggcatgaataatcagaatggaatttaaggcgcagcagaatccccaacagcaacagcaggcggcggcatcgcttgcgaatggttccgtcggtgaacagcctcaaacacttgaccaggaaagggtgcagccgcaacagtcagcaacggatgggacgcagcagccaagccagcaacaagcgcagcacttcccgtggtctccgcagcagcctttctttatggttgtacattcggtgccattgtctctcattctttcccctcttttagcctttcgggggtttgcctccgccccctccgtttctgcctttcccacaacctccgctggtgcgttttctgtttccgttttcactgggccattgccattttcagtttgccggtctcagtgatgctgaaattgccgcaatggaagggacggaaagacgggcggtcgaggcgcgcattcagtccctgcggaacatttcgacccttttggacgctgcactgctgcagttccagcaatatttgagcgtctctcccgggatagcccctcaacaaacgcaaagggacgaaaactttgcgcaaaacctttcgacatcggccgacagcgcaacggatgcggaaacaaacggcagggaaagtcagcggaatgagacggagacgtaagcaaagaagcggaagagagatagagagagagactcacaccagagaagcaaagagatggacagacgccaaaattctacgctttatcttttatcagttccatttgacggctaattgtaagttatttgccaaaattgtctttggtttgtacattttcactgactgaaatttctggtgatatttagaggatgacttttgtgtgatgtcatttatttgctatttattgcatcgtaattctcttcccgactgtgcagttttgcattttcatttcatctcggaaaatcttttttaattcgtttcaatggatttccggtatttcctcccccttttttctttaagtgccttcgttaagtattaatgtaagttgactgctgggggtttcttccgcaggatttacagagaaaacgaagtttggggtgccgtgaaacagacgcttattggttggattgggtgtttttcgaatggat

SEQ ID NO: 7618 - DNA, 957 bp, Heterodera glycines
  misc_feature (54)..(54): n is a, c, g, or t
  misc_feature (945)..(945): n is a, c, g, or t
tcaagcgaatgttggcagtcgcttggcttttgccactttttctcagtgttcccncaatgtttcgtttttcgcgtgtttgagccgtccgaattgcccaacttcaggtcagaatcccccatgaaacattgaaattgaccgaacaattctctgaccgattctcatcagacagtgcacgcccatttggacaattctcggatacgaattggacgtggaactgagccaaatgcgaggcgattggcaggacgaggcaaaaaatggacgaagaaggcaactcattgaacaatttgaggaaggtaaagcgggcgaggggagggaaggagctgggaaatggtgaaaggcggtggggggattaccgtagtcaaaagggcggacgaagtgctggggcttactgtgccccccgccccattcagtgctgaagtgggaaagggcgtacaacttggcccaccttctgttcgtcttctggatcccctcccttatcattgccgtcagttacatgtccatactcgccacgctcaactctttttccgttgtccctcaaagcattcgactttcgggtgataatgccaaacctttggagttggcgtaatgccaatgataagataaaccgtcttttccacccaaaaggtgccagtttgcaaattcgcagaagtgccaaaaaaattgtgccggaaaatgggaaatgcggcgaagaaagtgggggaaaagcggccgaagacgaaggatcaaaagaaggaagcgaagggacgggaagaaagggaaacggcagcacgagacggagggtgggcgcattggcagcacaaacaattgccagggccaaacaggtggggaggggaggtgggagatgtcgatttaaaaatggcagtattttcagaacgccaaacgtcaagcagtgagttttacgggcggtcgttcacttaatggattaaatctcatttaaatctcganaaagttaaatga

SEQ ID NO: 7619 - DNA, 2418 bp, Heterodera glycines
cagaatttttaggtaaaaaaaatctaaatggattttctaccctagaaaaactttaaaaaattctttaaagttttttacgaattttttcagctgattttttttttaatttgttgaaaatttaagtgttttaaaaagtttttctaggctagaaaatccatttagattttttttatataaaaattctaagttttagttgaaattcttagaaatttttttgtacgagttgccctgtgtacgagttgcctattgtacgagttgccaattgtacgagttgccctgtgtacgagttgcctattgtacgagttgccaattgtacgagttgccaattgtacgagttgcctattgtacgagttgccaattgtacgagttgccctgtgtacgagttgcctatgtacgagttgccaattgtacgagttgccaattgtacgagttgccctgtgtacgagttgccctgtgtacgagttgccaattgtacgagttgccctgtgtacgagttgcttattgtacgagttgccaattgtacgagttgcctgtgtacgagttgccatgacaccatgaaattcgtatttttctgttttaatcaatcgcgcggaatcccgtccctaaaatattttttaaaattctgcaactctcagcgggatacacagattagaaatttctggtctttaataatgagatagtctctaattgagaaattctcggttattatgtgtttcggctcgaatctctagctaaattatcggttcgcaagccaagggataaattattaatcactcgagtctcggaaatactcatcaaaagcaacaatataaatcattaaatacaaacagcaggttggcccaagaagcatggccggcgacactgtcagtctggtgatgagccaacggaacggcatccaacaagtggtgccgttgacatcaatctcaaccggcgcgtcccgtgccggctccggctttgtgacaccgcggcacgacgcgcgatttcaggccaatgttggcgccacattgccacgcgattacagggtcaaaaaggtgtacctgtgagatgccaacacaatttttaacatccattttttgaaattaaccacattttattttgtttgccattctcacttttattcatatacaatacaaaatgccaaattggggttggtttaaaaaatttacaaaaattgaattttgttgttttcctattttttttcacttatttcctaatatatttttttgaaattttttgtcttaaaaattatggccttagcggtatggccttttattcaaatttccatattttcaaaatttttgaaggggtgaattaaaaaatggattttttgaggtcgccaaaacatttcaaatttcaaaatttatcttcggcttaacctcacgttttgatcgcgtttttccataattctttcccttttcattaaaccggtgtgccttcttttatttttataataatgtcacttttcattatgatcatttgatgaaaaaagttaattttattttgaaatatttaattttaaatatttaaattttgaaaaattaatcatcatatgatcatttttatccataatccataaaagcattggttgatctcatcaacaacagaagtatgtacaatattcgtttccattttcgaatgaatttttaattttaattactttttttaaattgtaaattttgaatttttatattcaaaatttcacccaagtttttcactttctatccatatccaaacctcattttatgttaaccataaatttttttttattaaattgtctgcctcctctgatttgttcaatttcatttaatttgtttaataaacttttttaaaaactaatttatgcaatgataattaaacatacaaatagcagctacttaattatataaaaatatttaaatttcctatttactaattaaattttcacttatataaaatgggttataaatataaattgattttagttattaaaaatatttcttaacaaattttcattcatcgcaattcaacattcacttctgttgctgctgctaatcatcgtttcctgttcacttaaattttttttaaatttaatattaatttatttatgataaaaaatttgtttaaaaatacatttaaaaaataaaataaaaaatatataagaaacccaatttattatatatattatttatgaaaggacttaactcaaattcaatttttcaattaatcaattcatttttaattatgcaattaatttatcaatccatatttaattatgcaattaatgatagcaaccgaatttaattgctcattaaaccttttgtatgaagtaatgatataatttatttaatgatctcaattagttatggaattaatcattatactattaattaattatacaattaaatcaaacattttttctcgatgttggcgcgggtggtg

SEQ ID NO: 7620 - DNA, 1886 bp, Heterodera glycines
cgagacggtgacgcactttttcgagacgtacttcccgccgtattgttccgctgcagatttcgactttttctgctggtgtcaacaacgggacgaagctgtacgtcatgctttttgttgatgatgttatccgtgatcttgccaagtctctgcaaatttgaaagatttttcttataaaatcattgaattctaaaaatagaaatgaatattaagaacaaaaaactgaataaattttttcataatttcttttttatctcattaatgaattattttttaatccgattgagagaataaataaaattttaaattgaaaaacattttttgagtttaaaaaaagtattttattaaaatataaaataaatttctttttagaaaaactttatttacctcaattaaataaaaaatatatttataattcaatgaaagttttgcaaattaacccagctaataaaattaattaattcttattacttaaatttttttttccatttaaaattattattcccatttatatgaatttttagcactctttgaaaatatattttttttatgaattattttcaaccaataaatcaaagttcccggccaaatccctcacgctggtggacaaaagttggacatgttcatcatcagaatcaccatcgtttgcatcagaatgttttaaatcattttttgtttttacatcattttgtttgcccaacgatttgctttttgccattgtgggcacaattttttcggcattttttggccccggaacagttgaatgggctggctgtgcactaattttgccgcctttctttggtgaatttggcgtactgttttttgacggcaaatcagggcttatagtctaaatacaaaaatcctatttaatgatctcagaaaagtcgaaaaaaatgcaattggttacagaaagtttaaaaaaaagaattttacaatgattttttggtgtatgattttacatttacataaatttgaatgggttgaaaaatgaattttccccaaaattttcccgaatttactaattggactatgggaagtttttgaaatggaaaaaatggataaaaattaaattaaaatatataaattaaaataaatttgtttaattacaattattggacgttgatttggaactgggctaggcgtcttcggattttgtggtggtgaaattttgtttttattatgttgcactaaaacggtgttgttttttggagaattttgcttctttggtgaaccatttaaatgattctaaaaatgtaattataaaataaaatatttaaaaaattcaaaagtttaataaattattttattatataaaaaaaataaaataaatttttgtatcacttatatatagaaagaataatgagagatatatttaatattaatattaaatcataattcttaaattaaatttaataaaaaataatatagtaaaaaattaattttttttttgttgttagctttaaaaatgtttttttatacataaaactataattaattaaaaataaaatcgttttatacaatttcttcccgttttggtgaagaattttgtttgaccatttttagcgattttgttttttgatttggtgatgattgttcagcagccggggtttcagctttgctccaactatatatatttcccaatttattcgcctgaattttaaattattattttaattgccattaaattaatttatcattttttttaccatccaaccagaccattccctggcagtgtccatccatgttgtcggatctcttttctgatcacttttttctgaatatttacataattgtcagtattcagttcggactcgctcaatagagccccggcacgtttgggctccgggcagtaacttttttctttgtcaaccaaatccaacccattgctt

SEQ ID NO: 7621 - DNA, 2115 bp, Heterodera glycines
  misc_feature (60)..(60): n is a, c, g, or t
gcatggaataaatgtgccaggattaagatggtatggattttttgggtatttggataattntgggtgtcaccatatagttttatacttttttcattttagcgcggatcacttttttgatcacttagtttatggttgtttaggacaaggatgaaatgggcattatgaaatgtgtcacggttggatgaattgggtatatggatgatttggatgttaccgtatgcttttttgtacctttttcttcatattccgccccggtggttggcatgcttctcgatttgctatattcattttcattttcaattgcctgctttttgccgtcaccatttgttggcaaactttttgatttaccgtactttccatgcgaattactgtatttgtcatagggtttactgtaataattgtcaccattttgcaaatgtttttgcgcattgtcatcactattttcttcattctgctgctgttgttgtccttctaacaaaccttccccaccataccgctggaacataattatttttaatgaatacttttatcggggatcactattctttgtttattatattttaatgagttcaaaatccattcagaagttatatagtctcgatcagattctcatgcacgaaggctaattaatgcgctttaattattttatttttaaatttgataactgtaattagctaatctaattactattcgacagtttcattcagattttttttatcgcaaattagcaaaatgataaattaattttgaatttgataaatttatattagctaaatgctaaatcaggtgttggttataccccgtaaaatgcaacaagttttcgggctcggaggctgagttgggggccctccctatcctatttttatgaataattttacaaattgaaattttaattacccatttttcaattctacaaattaggcccatttaattgccctcgtttaatgaaccctttaccatcagttcacgccgttttatcaggttgtctaaatatccttctaaacatgacgagccaccttttggcaacaaaattggcattacgttttcaccattcaaaatttttttaaatatttgattcatctttttctccgtaatataggaatgggcacgagttttttcgctactaccaccttctgctttttttagaaattttcttgctttgttcacatgtcttatcactgaatccatgcgtttgatgaggttatggtcattcttattttctaactgaaaaattttcatttaaatagatttatttttatattaaaattatttttaattggttttaacatgctcttttatggtagtctaataattgtatattctataattattaattatattaatacaattaaattaatttaataatcaatttttgggttaatttataatgataattaaataatgacttttgcagtatcatcactcagtttaagaaaatttataagcgacccaaatattgctaaaatatatataaaagtacggtatttttactataaaatttgaaaattttaaaggaactttcttctacatttcattttaacagatttttaccaaaaagtgccaaaaatatgaattttttatttttaaatgagaaaatatactgtgcggcggtgccgagtgacgtcgggaaaattttagaattttgatttcttatagatattcatcaaatattaataaagaaataaaaagaaagaattgttttaaaaattggccaaatgatctaaatttctttgaaaatatacctttcctttccccaaattttcatttataaaatgttcacgcctttgcagtaaactgtccaaaatgtattgcatattatttgcatcgcctcttggcaacaaatcaattgcaatcggttggccatccaaaaattgtttgaatttggcatcattaatccaacaatcaatgtcatttgttttgtgtttaaatgccgaagccacacccaattcgacctcggcatgtgtgaaattgtcccgagcatttttaatcaaattaatcaaatcatccaactctttgagcaagtttctataataaaaattattaattaaaaattgctcgaaaaaagagaaattggctcaattataaataatttttatttattacctttcattattg

SEQ ID NO: 7622 - DNA, 2968 bp, Heterodera glycines
  misc_feature (7)..(7): n is a, c, g, or t
tattttntgggttttcctctaccactcgaatttgcacatttttgcccttatctggcgaactgttcaatttctgtgcattatcatttttcactgtcccttcttttggtgggctattaatgccttgtttaattgaattgtccaatttaggcacattatcactgttaattgcccttgtcattagtggattattaatgccttgtttaggtgaattgtccaatttaggcacattgtcgacgttgggtactgcatttcttggaccattactgtcagtttctggccatgtgttccattttggcaatttgacattgttaattactgtcgtcttgggtgaactaatgataccattgtttggccaagtgtcccatttcggtaatttgtcagtttgctttattttaacctttgatgggctattgatgagctttttggatgggctgctgaccaattttggcgaaatgtaatggtcaatctttggcatttttgtcgggctattgatgccacggttaggcgaattgtcctttttatgcggtttgtccactttttttgttttttcatttggcaaattttttgatgtttttattggccgtaaattttttgcaatatgcattaaatcgctatcctgttctgatccattaatttttatgctgacatttggtttcatctttaccaatgacggtcttttctcaatctaaattgaaattacaaaaattgaatgaaaattcttagattttcctatattttttcgagactattctatgtatgatgggatttaaagaaaaaaatcatcaaaatcacacttatcagtttcaattattaagatatttagtgagctttttagcacctctttttcgggttgcaaaacattcaataccccctctaaggaaatttttgtttttaataaaaacttgtttaaataattttttgttcactaagttttcaaaaaatataaatataaaaaatgaacaaaattaagttttttaaattaaaaatttacaatttactggttttagaagcgcctggcatgtaatgacaaaaagtaaaattagagcaaaaaaatttccatatgttatagaaaaatgatgctttttagaagatttattggattaaaatttgctaaaattagtgtttaattacaactaattgaaataaattagggtctcttaaaaaatatcaacaaaaaataccattttattgcgacgtttttccaaactgttataaattgtgtgcaaacagtttggcccacccttggacaacaattcatgttcaatgtcagtgccatacaaaaatttgttgaacaattcgtcgtccacttcacaattttggagcaatgctttgccatgatcttctggcattaagccattctcttgatccctaattaactccgtttttcgccgcttaattgcctccattaaattgtttaatcgttccaatatttgaggcccctaaaaggtgaaatttttaaaataattcatttttaataatttttaaaatgtttttctaagtcatcagttaaaaaaaagaatattaaattatttttctaaatgcttatttaataattatgaaaaagggaggaacattttattttaataaaaaaaaagaaaaaaattttccattttaggtgtatattttttttttaaattggcgtctgttagagtacggggaggggatattaatttttgtatttttggaaaattaaatttccaaaatcactaaaacgatgccaaaaaccttctcatcaagcagcaattggtagcgttttctactgctttcaggtggactctgaaaatgaaacaaaatttaaataacttaattaattttaatttaaaacacaatttaaaaatttaatatatatatataatagggcgcggattcttagttacgaaaatagtaatgaaaaaatggcaaaaaaaatgatgaaaaagtatcaaaatattaaataattcaaggaaaaatgaataaaaaaaagttttatcactagttgaagaagactcgttaaagtaatgaaataaattttttttttattaaactgaaaattttatataatttaaagctatttttctggcactttttcaaaagattatcgaatttgtaatagcagcctagcaaaaattcaaattttgagtttttaaatccattcttaggtgcgtattttgtttgtattgcttttgtgttaagacaatttcttataaatctaaaaaacgagtgtttttgtgctatctctgcaaaaaaaattgctgcagaaaaaatagttaaaatattttaaaaatccgtgccctaataatgaaagttgataagttgaccagtttggtattatgttgatcaataataggttttgagctagtattctggaattcctgtaggatttaaatttacgaattaaatattttaaataatataatttaataaaagcattcatttgagaaaatatttaacttgaccttttcgaaattatgtcgatcaacaagaggttttgagctaatattttccaattcctataagatcaaaatagctttgaattttacaattattatttttaattaaaataatttaataaaagccttcatttaacaaaatttcacctcctcctgcccatcttcgctttgttcatcattttctgtttcatcttcattatgcggttgttcttctatctgaggaattttttttccataataaaataattaattgttgaacattaaaataaatgaaaaataattcataattaataataattaattgcttaacagtttaaataaatgaaataaataatttatataatttaaaataatattttgccactttatttattggcagggcatcttttgccaaggtctaaaattttcctcaattttttaatttataagaagaatgaaaaccagtttctgatcctcttcattgaacattgagaatctcactctctttttaacatctggacctccctaaaatcaaatttaaaataatttaatttctttaa

SEQ ID NO: 7623 - DNA, 6405 bp, Heterodera glycines
  misc_feature (6)..(7): n is a, c, g, or t
  misc_feature (29)..(29): n is a, c, g, or t
tgagtnngtataggcattgtcgaagtgtntaataaatgccataaacaattgagactcagtgctggcttttatttatgttattttgtccaaaataaatattgatagcccatgaattataagtaatttattaaaataatagttttatatcataaaggtcgaaactagcagcataaataacgcttagagccttattttgcgtaatttagatcaaaatctcggccgacaaggtgtttaaaattgtgccattatattgcttttggcgaaatgtattttaaaattaaataatataattaagtctcagtaccaagccaattattttatttttagctaattgtccttatttttatttaatttatatctatatgaactaaaatttattttattcgcttttgatttaattattacttgctaaatgaggatgaaaaactatttaaaccatcatttcggctttttctcggccgacatggtgtttgaattagcgcgttattgatattattaatttatggcaaaatgtatttaaaaatgatttcaaaaaaatgttttgattagtaatatgaaaagtgtgaaattattgtttattatgctaattaagatttaaagaggttatttcttttatatttctaatgaatattcgtacaaatttcactaatttaatttgtctaattttaaagctttttagataatatatttttttaaattgctttaaatctggagatgagccgacgacctcaacatttcgtccgtcgaaattgcgggcaaattgctgaaatttaccaaaacaggtttaatttcattttcatcattcatttttctggggaaaaagaaaaaaaattaattcagcacttggtgagtgattgtggtcagcttgaccgttgtttttttttaatttctcatggggaagaagaaaaaaaaatgtcaccaaaatttctttgaaaaaaaaaaattattttatttttttacgaattcagtctaaaagtcattttctagcatttattaaatgaccaaaaagcatgtcttataattagggattggatatataagaaaatttttgccaaatttttcagtttcagacactcaaaattagctcctttttatggtggcaattgctctcagtttgatgctgcgcacttacgccgacgtttggatgtgcaaaatgatttttgattcttttttaaaaatttctttccctttttttcaggattcaaacgtccacaaaaattgaggcgtaagtttgggttttccctttttttgtttaaattttttttacaattaaatttgagtgcaatcatttcgcggcataagccccgtttttggaggtcgcttaccgaatatttgttgtgtatgccactcgtttcggtgatcaactcatttttgaaggtcgaataattttttgaaatttttttcgaaaaatttgtcccgttccctaaaattttcagtccaaattctcgaaaattctcatttaaattaccataattcccgacccttttagctgagtctttgcgagttgaaattgtgcttccgcgaacggctgactcaccacttttacgcgcagtatttggacgggttcaccttctacaaaatgaccaatttggacaatcgcattgccaatgcggaccaattgctgacacaggacgtggaccgcttctgcgagggcatcgtcgagctgtactccaacctttccaaggtgacttttcaattcacataaattcaaaaaaaacatattcccactcggtgcacttcgaaaggtcgcggaaggctatattttttgggtacgccccaaaaccttgccgcagaaatttaaaaaaaaacaaaaactttttattttttggattcacatgaatttttattttattttaatgggttgttatattgctatagtttttttaatctgattgttcatgccctcaggcaaggcactgtgctgtttgacatttgttgaagcagcgatctgaagttgcgcattgctattggctgacgtcgcagttgcagcagcgcactgttggcggcggcggcggcaccaatttgtttttcataaaaatcgtaattggatttttcttcgcgcgcaaaatcggagtcaaccggatttaggcgattggcaatagtgaaattattagaaataaacattttaaattcatataatttttatataactccgcaactttttatttttttttattaattgaatgaaacaattcaagtattagtagtaagagatttgtaatttttggtgagtcagctgtctcacttacaaaaagaaacatttttttttagatttaatgtaaataattttaatattatggctcaaatgtttatttaatttagtgcttgagcgtattcggaagtgtgcacgcattttggaccacgaccaatgatgtgccaaattgatgcgaaagacaaagatggtcgaaaatgatcaaaaaaaaattttttttttaatttttacatttttgtattattattttttctactattttattgttaaatattttcaggccctcaagcgtggaattaaataaattgaaattttatattgaacttgcaattgatgtcttctttttaggcaagacattaaaaataaaaatatgttggaaatgttagacaatttgtgaaatttctaaaacgtagagagtcggcaacttacatatagtgtttctgataagctcagaagtataaaaataattattgacttgtagaaaattgtgattacgtcccgtcctaacccaaaatgattgaagtgttcgatttttggtgtcgattaaacttttatgctgaactgttggcctacctccgcgacaagaacaactggaaaaaggtttcggctgtgggtggtttagccataaagctgcgccatgaacaatggcggccaaatgcacccggagcaagacaatggcgcactctcttacctgatgtatggtaatggagttgaccgaaaggtcacaaccatctttcggaagggcaaggaggtgctgccgttcaccgacgagactgatgccggccttgagcggttttttttgtttttttttgtaaaatggttcaaaaataaggttttttaacgaaattgtgaatggcccattgccgcaagagtggcgatatggcacacgctggtttgtgccagacgctaagaccaccgaaagctatcggctgattagtgaactgttcaattcctgtaatggggcatatgggaaaatggtttgagctgaagattttggtattttgagtggtaaaaaaattagggactcgacaaggatgccacgctcattcgtgggatctgcgcaccgcccgagaccagcctgttcgccctccaccgtgaggacgagcatgtccaccatttgaattacaactaaggaccgggtttaaaggttttttggttctttagttaaataaaaaaaaattttgaaaatccatgaaaaattcagttgtggctcttcattggcggggaattcgaacagcaggtttcccaattgggccaggtgctgttcaccgatcgttggcccaattgttcaaatccgcttggacacaatagtttctttttctcccctgcgcaactgcgtcaggcgggaattacctttgaattccacatccagcggcccggtgatgttgtgctcaccgttggcctgcattgcgggatcaatatcggagcttcggtttgccttgtgaaggagttgtgtagcccgagggcagcaaaacaatttaaaagtaaaaaatgggctccgacaatgacttttcaacaattttaatgatttagaagtgggggaacacactcgttgtgactgcaaagagcgggaagcctataaattcaccgaaaagcaaaccaaggagtatcttggtggaattaagtgagatgaattgtctcattcacaactaagtcaaattttaaagagccatggaaagcgaggccagggtcaaggattatcgcctgaaatatgagcaaagcggaaagcgcgtgcgggcggacaacgaagtgttgccagcccagcgccgtgctcagagggagaaacagaaggcggaggggcgagtgcccatcccgaaaaagaagggcacctcttcggtcatcaatttagacgagatcgatctcgaataatttcattgatttggttaaataaattttgatgttaatggttactgtgctactaattcacaagatctttccaagttctcgtcctcttcctaaggtcatactttcttggttccgtatccgttttttcattgacatttttctcctcatcggcttcaatttctggtcttgtttccggctctcgggcgtggatttcctctaaattttcgccttcccgggattcggggtccatttcatttcggattcacggacctttccgaactgacttcttccacattttgtgtcttttcaaggcactttttctcttcaactggttgtgttggcatagtgcagggagggcccaaaatttcgaaacactttttaatttggtttaagtgaagtctttttgggttcgaatttggcgaagtgcaactaatcacagtaacataaatgccatcaattttgatgacccgaaaaattcctcgccacggtaaatggaattttttggatgtgcctacccgtccgtcgtagtttctgatcagcactcgatcaccaattgtgatttgttgtggccttgcctttctgtcatattgttccttcatttttcgctgagcttttgcatattcatcagctgcggcgtgccacgcgtgtcttatggcaacgccaacttctgtttaaattcatttcggtccgaaattgctatcggatcacgaacctttgggtcaattatttggtctacacaaaaaattgggtcacgcccaaacataagaaaaaatggagtctcacccgttgaagcatgcactgacgtgttgtaacaaaaattagcagcatccaaaaattcatcgaagtcgggctgagtcttcgaaatatttggccaagatgttgtgaaatgtccgaaaagtgcgttcagttgacgcattgccttgactccaatgaggacaggcattgtcgcgaaaccgcgacgagagttggggtgaaggatcgggccaattgtcctttacccggggctcgggcgggcactacaatgcccgtaaaatcgatgaggaggaggagaaccgatgggccaccccaggcgcatggtttactgcacccccacgagtctcgggcccgaagaagaagaagccgtggtaccattgatgatcgggaacattcccgttggtcagtcggtcggagcagaagatcggagagatgacgaaacccccgccaatctggcttttcccttccttttcgtccccttcttttttctccctattatttaaatcatcattttccatttcatttctcattatctaatttgtctaccatttcacatctgcatttttctccatcttttcttcgccccatttgcattttttccatccattcacattttcaaattccttttgttcggcccgattgggcatccttttctcaaaatgtttaccattatctttctgcccgccatcccctcttttcatccattttctgtactctgatccccccaacatattcagcgatgcctttttccctttgtctctcaaaaatgcccacttttctccttattcacgtgtttttgcatattttgctcgggggctatttaatcacagggcccccctgcttccttcttctccttctctttttctgcgtccatttttttgttgatccccaattttgccttctgttgacctatttactcttatcgccattttctttcccctttggcaaataaatttggttgtttggtttgctgttcctttttgcctaagggacgagcccctctctttggggaaatcgccaattttcgttgtttgggggcattcctcgccccagggtccgcgtcgtcaagagcagccaaattcgtacggggtcggatcaactcctctgatccgaagcccatcccctcccttcgcctccccattttggtgattggaatcgggaccgatcccggcgcacgagaaggaggttcactcactccaaaactgagtggtggtgccgttagacccatccccacccttgtgctgcaaatcgggatccgctcccgtgaccccgcatttgccacaggcatactttttgtcaatgtaaagcatggagcaaaattctctgaaaaattcggaagtgaaggcagaggcattatcggtatcaattcaacacaaccgccgtattttaagtaacaattggtgagaaaagcgtgggcaattgtttgtgcttttgtttcggggactgggacagaaattacgtatttggtgaaccaacaaacggtatttaaaatgtgtttgttccctttttgagtgactggaaaggggccggccaagtccatgccaactttggcaaaaagagtgatagctggcaccatgagcatctcttcccggtac

SEQ ID NO: 7624 - DNA, 6298 bp, Heterodera glycines
cgatgcgcaattaaaagaacgactcgggctgccgtgtgcaaatgtcaaagaacttggaagtgtaccatgggacatcggagcgcatttgtttggtcaaggggaaacttgctgctacaatgattgtgtgagttggggagggagggtaattgttgttttatgattaccgaaaattaaattattttgtttagaatgggcgcaattttggaaaaaatccaggaaaaaattgacgccaaccacgcttctgaccatttcgacctgaagggattggaccggaccaaagaggttggatgacgagggcatttccaatgcgacttttaatttgttgcagatgaaatttgttgtgccaaacacttccgccggaatggtcataggaaagaacggcacgagcatcaaagagattcgggacacaacaacgggttggttcagcttgacatttgaccagcgcaggaattcaaatgttgtaattttgggttttcagcaaacatccaaatctaccccaaggcgggctctgaggaggccaaaatttcggccgagagagtgattacggttggccacgaatcgaacgaagttttactgagcgcagtgcaacgcgttctggaaaaagtggtggctgatccgatgcatgcgcagccagtcccagcggagagtcaggcgagcaacaaagggaccaaaacaatttcggaatttagttttattagggatattattaataaccaaattcattttttaaaaagataattcaataagaaagcatttaaatgcaggacataaaaagggcgtttcattatattaaatgttttctcctcactttgtcagttggcttcgggctttgaattcggcggatcgcggctcagtgccgggagcaatcagtttgggggaatttcaaacatgggcaacaattcgggtgagcagaaaccaaatgtgacattcgtgtgtcttctaaaacgcctttattttcagaagcaatgcatgggaaatcatttggagggccttccttcaaattcaatcccctccaggggacgggaaacaacgaggcgagtcattgttttgaatgacttctccattcagtgtatatttttctaaaccattcccgttcagctgttggcttttctcgacaatttgcagtccactttgcgctcttccggattcaacgaccaatcggtgtcagaggtgatgcaggcgatgcaagtgctggccaaatacaacataatggtcaattccatcaaattcctcgctgtgattcccctcatttaacgtgtgactttagggtcttggcctgggcctcggtgttgcggcgatggcccaaatgcgtaacactgagagtgcgatggcccagcagaatgtgctgcttggtgctgccgcatcgaatacgccgttgcaacagcaacagcagcgctacgatatcatgtcacagtcgaacatcaccgggtcactgttggactcgtcgcagaacattgaccaggtacaggagaaatttggcatttgatttttgcctttgcattcagtcaatcgttggaggatcgggcggtgttctgatcgatgtgatgagccaaaagaagtcgggcacaaatggaacgaatactttcgccaactccgtgatcaaagaacgcgttgtggaggatggacacactgaacttgaggtggacaggcgtttttcctatttctttggaatttgagcacttttgcataaaatgtgttgtttttaaattatttttattttttgcttgaatttttgacaataaatataagacagtttgttgcttctttgaattcaacaaaaacgtgtttttgggccacaattaaatcaaattatagaagttgattattacaacccaccccacccatctctttgatttttaatttagattgagtttcttgtattaattttcctaattttatttatttttattcctgctggcgttttcatattttttgtgttatgaatttatttattatttttcaggttcccgataacattgtcggcgccgttttggggcccagggcgaagacactgatcgaaattcagcagctgagcggctgcaaaattgaggtgcacaagcgtggcgcgaacaccgccagcccgggcggacgcgttgtgaggtcggttttggccaaatgtttgttccccgccggtgtttccctccgtgttgatcattttgacttggccattcgtctgatcaacgccgctttctttcatttatttgtcatgcactttccgatcatcacgctcctctctctcttcagtttaactggagacaacaatagcattctgaatggacgcatcatgatcgagaaagttattaaccaggaacagcaacgtcgttctatgatgggcaccgctcgctgagtgtgcctcccgtgtttctgtccattttacaaccgatcaccgtcaatcttttcaatccatcttttgtcgtttctttctttctgatctgtctaaaggatggggtgtgacgtggcgcattttcaccaaattggacatttttagaatgcgattgtggtcattttaataacactgatcagtttctctttttctttttgtccattctctttttttctttcccctgggacatttctgcgtttctgtcacaccctaattctttcgctctctctctctctattttcattctctgcctcttcgtttctgtctgtccgtctgtttgtgtgtggtgactcttcctctttaatattacaacttttgcaaatttttaatttgtcaaaaaggcagaaattcgaaataattcataccaaaaaactattattcgccctcaaaaaacaacttatgcaagccagctaaaagaaacgattattatccttttcccgtcattttctacgatcaaattgcacttttcactattatttttcatcatttgttatttctttaacggaagtccgctgtcgttcttttttattattgaataaccagacaatgcattcgttttgctcttgtttattttctccgattatcacatcattacaatatttttcatcgtatttttttgttaaattttcgtatttcgtaagattttcatcgatcatttcattattcatttcattgctgatcgcttatttaagaatggttaaaaaatgaacaacgctattcgtaatatcaactgtaatttatatcattaaaaatgctcactttacatttttatgcttttcaaaaaggggtggattctgctgttgcctcccctaattttcatatcagtcatcaaaattaattaggttttttgggttttagtcattgcttttaaattctcgaacaccgtttgatcttctatttacaaatccatggtatgttttcgtcggcttatttcgctttcgaattgctctcttcgttttcaaatcaatcgtcggctgtttaatgcgtcaaatcgtttcaattttcagtcattcattttctttctgctgagccatcactttctaatgaccgtgaaaagccgttgaagatgcttaccgatcatacatttgtttatctttcaggacaggttaagctgagaccgtcagcctcttaacgaagtgatcgatgtggagaagatctcgagactgtgatctatttattacgaatgaataccaattaaagagaaacgcgaaattaattgcattcgaaaaaattagcaaatgttatggggtgtgagtgtgagtgggttaaaatgggcactgatgcagaattatggtctcaacttttattttccaccgagttttcgagtgtgactacgaatccgacaacaggatttctccacacttcctaaacccggaacagaatttgatttttttattgcctaaacgcagacaatttgtatatttaccttcttcagactcattgttagtgcttccgaatgataccaataatatttattcgaacatgaaaaattgtggtccaagagtaattttatgtgcttttttatttcatatgtatttttgtgtagaattaattaaaaacgcataaagcattttttaaaatggccgatgttcagtaaagtcaaatttcaaattttttccttcggcgccgggctcccaatacgtatttttttttaaattggctcaaagtcgaaaaaatgggcatttttggtgaaaatcttttaacaaattgcactttaattctctaattttcaacaaaaaaatttcccggtggcgcctatcggcaccaccggacccctatttccaaaacgttttttggaaaaagtgcgctgcaaagtgccgataggcgccgccgggagaaattttgaaaatttgagtgtgatttgttaacagaatcttataaaaaaaatgccaattttgcgatttctttttaagaaaaatagtagtttttggtcaggtggtttggtcaatttttattggtgtttttgtttaaaaatcctatcagaaataaattagaaaagaaaaattccaccagtatcgaaagtcactggggctgggtttgaagcgcccataatgttcgaaattcggttaaaacacttccgaatttattttacatttttaaacaatgataaaactaagtgagaataatatttcacattaagcgagtcaatagatagatagcctatcatttaatgatcggaaaaggccggccaatcactgaagcactgttttcctttccctcctcgtccgtgcaccgcttaacgaccacaacttcggaggttgccgatttaacaccatccattgacgaagacacagagcgaattgccacccttgggaaaatcaagaactgtgtcaaaaaaacggcttttacttaatgtcttcggccgggttcaagtccgtaatgcgcagtcgccgagctttggctttgaccgagtcgcattgctttccgtttaggaacagttcataagctgaaagtacaagcagagggacgcttttgtaaatttcaataaaccgctaataaactgaaaaactcacagtccacggaattcatcagcggaatggcattctcccacataatgtccaacgcatcattacccttctcgccgttttcgtgtcttttgcaggtgatatttattggggttgggatgagcagtgaacgcagttgtcggtcctgagcctgacgatcagacatttccatctccaattgctgaaaagtgtggtgtttaggggaataaatggtaagcaaatgcatcgagaaaattgccttaatttttgcggccaattcttggaaagtcagcacatgcgcttcgttgatgcctgtcagcaatttgttctgctcgaccaattcgtttactttgctttgcaatgcgcgaggcgttggctgtggcgcgagcgccggagagaggcgtttggagtgaaggccaatgcttggcttcctccgaatgttgagcttacgggccaaattgctgaatcgtccctgaaatttaaattcaatatttgatttacttgatttttttctttcgtattaaatagttctatgataagattgtcgtcacagccgaatcctttgcaaaggtcgtctattataaacatgaggctgtctcctcataatttgtcttggatgagttgaagcacggggtgacttcttttgggaaggattccactgctccgtccatctgtttgtgattcccccccccccctctccccacctttttccttccgcttcctttgcttgagcctgcgctctcctcgtccttttgctccccaacgatgctcttccgtctcattgcgccgactttccgttcgctgttttgcataattttgtgcctgtgccccgccgttgactttgacgatgacagcaccggtcgcagcgattgcttcttctgttgttgctgaatggcttcgatgtcacttttttgaagggtactgaattggcggtgacgcgctgaacgcgcagtgagcgacgaaacattgacaggaatccgtgaagaaacgggcgaagagacagaagcggtggaagagggaggcaaaaggcgggaggaagaaggcggaggaaagaggggaagagcatccggcgagggggaaaagggaggggcagcgcaaacggacgaatgttgctgattgtgaggaccaatcgaatcactttcagttctaaggaaatcgaattgaatgttcatggagatatatgatgttcaacttcaaaagcagccaaataaattattgagacgactgtttcttacttggagaaattcaatcggacggtgtcgaaactgctgccggacaaaataacggtgcgggtgggcgaaacaggcggtaggacaagcgttgagactgtccgattcgtgtcacaactacaaaatggtaaaccccttatttgtccattcattccgtcctcacccgtccatcgccgaatgactccgttcttttggcttttcct

SEQ ID NO: 7625 - DNA, 1464 bp, Heterodera glycines
cgaaaagagcgcgaccgaccgttcgggtgtgaaaaccattcgccttaaatcggaagaaggaattacacaaacaaatgatgatggcaatgaacaaatgagcaaacctttgagtatttcctgttcattcaaaaaatacccatccaattgtttaaggttgagaacacacgaaaagatgaagggacggtaggaaaactaaaaacttagaaacactgtttcgttgaatattttaaaattattaaatttcgaataattttgaatgaagtgtacccccccgccccatttttttggaattggcgtactgtctgtagaccaacattattcactcgagtgcacgggttgcccatgacgatcaaagtatccttaaaattaaaaaacacccacgtttcgtactacacaaaaaccgcaccaaaaacaatccacaattgttcaaatggtgaaattcgcataggtcggacaacaaattgccaccaatgtccaatatacggagggaatttcttgggagaaaattgcggacggagtccaacgaacggatggcattgccgtgcaaatccaaatcaacgagggcagtgagccgggaaagattgggcaccgatttgaggtgattggaggctaaattgaggtgacgaagccgagagagttggtcaaggacggggaagtgctgaaacgaattgaaattggtaaaacaaaaatcaaatgtaaaaaatattcacctcaattcgattgtgcgacaggtccaatgtttggaggaagcaaaaactgttgagggagcccaacgaactgatccgattatcagtgagacgaagatggaccaaatgggaggccaacggagagagacaacgcatttgggagagttcgttgtgggagacattaatctgtggaagaaacacacaattcatcaaggttttgaatttgtcaatttaatttccaatttggtattccgttcggaaagtctggcgaattgtcaaaaaaaaacctcggtacagtgctgcagcggaaggttggcacagtccaacgaccggagaaaattctgcgagacattcagctggcgaatgggcggccgttcgtctccgtccgccgccgtctgtcctttctgtcgtttggcccccgcgtcggtcagtacggccaaatgctttcccgacaaatcgactattccgtttttcacttcgctcaagagatcaatttccgttgcagttgttgaggtggcatcagcagcagagctgaaaggtgggaaaattcactagaaaaatattagaaaaaaatttttggaggtttttgtcaattatttttcgggtcactgatttttttttaaaactttgcaggctaaaagtgggaaaactgatggacctaaggccagcaggggtagaagaaagtgaaatggagggcgatttgacggaacagagagtgggcgagtgcggcattcgtgaattggaacgtgggaatggcgaaagcgatgaatcgttcaca

SEQ ID NO: 7626 - DNA, 3302 bp, Heterodera glycines
aattccaatgcccgcagcaattgaagcggcagaagaagccattgctgctgctgaagagcgaaaaatttcgacaatgagtggtcgaatgaaaacaattcaggtgacaaattggtgagaattacaataaaaataaaattgatcagcccattagacaatgatgatgatcgccagagatgccgcctactgtagcaagagggcggggccaggtacggtagtgccgaaatgggcgacactgcacaaaggagccgtaatgggaaatgataggagcggaagggacgaagagggcacgggagcaggcgatgccattggagggcaacagttcgagtgcaattcaaaaagtcgaatgcaattcggcacaacggctttgaaaagtgcgccgatttgccaacacttggccaagtgagaaaagttaatgggcaattcaaaaatggtaatgacaaaagtggaatgattcaccaaaactgagttagcatcaaaaattagtgccaaaaaagaaaaggttttaaggaattggttctggaatcccgacattttcactcaatattcgtgacaaaattttcccaaaaggttttaccaacagttcggcattcggcactttgttttggtgggagttttggcattttatgccgtgtttggcggtcttttgtttcaagtgataaatttttaaacaaattaattccctctttaaatgattccctaattaaggcgattgagaaggaaaatgaatacatcagcctaaataaaaacaaagaagctttggacgcaatgatcgaacaattggctaaggtcaatataagatttaaattaatttataatttttgattttttcgaaataaaattaattacagacggttaaactataaattaggactaattaactctctccccaacaaattagaatctcactgtgctgctaaatgttcagccatcggccgacaaaatgatcgcgatgcaacagctgatcacgtcagttactgtatcagtcacagtattccctgttacagcaatcaaaaattaaaatactgtaaatttcatttcagaaaagactatcaaatattgcttaaggtaaattaacgaagtttttatttatttatttatttattttgattttattttcaaagattgaaggcaaatacgtcggctcagtgttccacaaatatgagcacatcgtattccatctgaattggtgttttggaagctccatattctacggtaatgaaaaatccatacaattgtttacagtattattggttttcttcggtcatttaaattttcaaattcaaactttgtagcaatgacactcttcacgacaattggtaattagttttcaattaattgctaattatttatacaattaataatatgtaaaggttacggtaccatcgcttgccaaacgcctttgggcagaattgtgagttgaatcaaaaactttttcaaaaagatatttcccattaaattaagttatccatcttttatgcactgttcggtaattattaattaattagcatttattggccaacccaattaaatttatttgtttaattgccaatcccttttatgtattcctcttatgcttgtcgttctcagcgatattggccaattgatgttgtgctttttgacctgttgttacaatcgtctctgtgatataattaggtgaagcggaaaagtcggacaatttaaaattaattaattattaaattttgtcagtttttggctccgttcattggcttttcgcattttggaaattgacgaggaagcggcacaagtggccaaggagaagaaggcggagcagcaactgcataaactgcagctgaacatcaacactaaaaataccggagaagaagcagcgcaacaacaaaaacaacggcacaacgcgtggggtgccgccagagacacggcgcaaacgcaaaaaacagaagcagcagcaggtgaccaagcagggcacaatcacaataagctaattatgacgcactttagcagcatatttaaattttgtaacgaatttttcacaaaataaaatgaattttatttgtaggttttggggggcaacaaaaggcacggatgcacactaattatcatatgtttatctcttattaactcaaaagcttaattataccccaaaaattattctgctggtttctcgatgccaatttttgcctaaattggcagatttttactacgcgaccgactcggaaaatatgctgatcagtagcaacgatcaagaggaggacaacggcatcgatgccgaccgttcttcgtcgtcctctgccaccgctttcgatggcactttcgctgccggccaatccgccgccgatggtttgccattgttcgtttccgtgccgcttgtgctcctctacctgtgcttcatcgcgtttgtggtcagctgcttcgattggcccgaccaacggacgggcgacgacggaccgccactgtccttcggcgaagcgttttattttgcgtacggggcgacataatggcaaacaatgagatcgaaaaaagggacaagcatttttctgaacagcttaaatcctccgaaatccatggacttaatttagttttgtggtttttggaaaggtcgtagagatttattaaaagtgagtttttttgggggttttaaatccaaaaattggcagctaagtcaaaatctgttaagaattttcagctaattttaaaaaaattaacaaatagcactgaacagattaaaagtcttgtgcttatccctccaccgattagtgaatttgttgtttaaatgaaatgacttattaatcttttgtcattatttaaagatttaattgcgaccaaagctctaattaaattaaaataattagaatgattttttaaataaaatttcggttttcttcatattcataatagtaataatatttttgttttattttgaaataaaaggttcatctcattgtccaccattggccttggtgatgtgatgccaaacagcatcgaattctcgccccttcttgccttacttttccttggcggtttggcactgctaagtgtcgtcaatttaacagtaattaatactaattaaaaaatcaaaaaaatatatttaattttttcccagatttatcaacatattcaaagccttttcctctttctgtttgatcatttggtgagaatttaaaataaatatattttaattttaattgaaaataaatcaggaagcctttctcgacgacgtttattctgttcaaaatgcgcaaaatgatgcccatttcgtctttacttcactaatgccaaacattcaggcaaaaaatcacccaatattttaaaatgccataaattaa

SEQ ID NO: 7627 - DNA, 2017 bp, Heterodera glycines
gcaacaacaacagcaccgacgcctgctgaactgctccatgttcggtgcatgttcttcgtcagcagaataccgtcactgctccattcggacaattattacccacggaaaggcaccaggtagtacagtatactcgagttgttgtcgccgaacaaaaacactgtactgtaccatttcatctggattttgcggactttgtccctgcgggattccatcccgaaaaattttgagttcaaataccgtagcggaatccgaaaatttgggatttccgggctaatatgacatcctaaccgatactacttgagaacatcgaaaaggcttttttggcacgaaatgccgtttttaagttccgccctttttcagagttcgtgcattttccatcgcaaaaagtgaaggccaaccgtaccagcaataccataccccaagcagtgctcatcaccggtctacctaccacactgtgcatggcactgactttcgtcccacccttggcattctgtccacggcaccgtcgtcgcctgcccgttcccgagggccttccatccgatcgcgcaggacaagcgcacacaaaataccaggtgatttatgaaataagaaatggcaaaatgttgggtccatcggttgcgcatcgaacccacgccttccgcgagcagctttaccactgagccaccgagacacaatatcatcagcctaaattttttaaatgtactaacaataagtactatttttcatctcaaaaggatcacccgcttcgcagcgaccgtgtcgaaaacgagcaatgacaattggatgcgattttgattatgccaaaaatgcgcacgacgcaggaggcggtgacaataatgccaatgttgacactcgccaaaaattgagccggcataagtcaacttcaaacgtttggtggaggacagcaaaaagcctagaggccatttcgaacaattttggaatgaaaatgtcacgaaatttggctgaaaatgaagcaaaaaatgatgacattgaaatgcaacgagacgaaaacgaaattggcacaatggcaaaaagggaatacgaagcgaaggcaccgaccgaacggagaatatatttcaaaaaaggtggtcaaattaggcaagaaaaaagaaaatcaaagtttgtgaaaattgtagtaaaaattgtcaaaaaagagcaccagcagctgatcagagtcccaaatcatcctctccaacaccaacaatcagatcatttaaagtatccaaggaaccatgttttcagacatttttggccgtaactttgttcaaacttgacaaattttttaaaatttacgtgagctcatagaggactctagataatgaatcaaccccgattaatccagcaattccaaaattcgggtttgtggactgggatcccgactgcgcggggtaattaattgagtcccgggggcatttattaggaagaaacaaagctattttgtctaaaacccttgtgctatttttcaagtttgaagatgtacattttgtacaaattgcccttaaaaaattaaattaaaaaataataattattattattttaacagaaattgccgaaagtgcggcttcgagcagtacagcagcagcaaccactaattacaagcagatccgccgcacgcacagtgaacgcgtgtcgcaacgacggcgccacgcacacggcggcgcccagctgtacgtgatcaatgagggggagtcgcaccagcagacagtcgccgggggcgagcgactgttgcgcctgcggcgactgcgtcggcaacgctcgcgccaaaacgtgtcgccgttagtgcagcagcagcagcagcaacatggagacagcagtggcacggcatcagtggcacaaatggaaagcggcgatgagcggacacagcgatgttgcgacgaaagtgtagcatcaagtccgagcagttcaagacggttgcagatgcacgccgggccccaaccgccgatgggcgcggacaattcgacgaacggcgaatgatgccaaaagtaagaaagacaaaacatttaaacgctttggcaaa

SEQ ID NO: 7628 - DNA, 1755 bp, Heterodera glycines
  misc_feature (1443)..(1444): n is a, c, g, or t
  misc_feature (1567)..(1567): n is a, c, g, or t
  misc_feature (1609)..(1609): n is a, c, g, or t
  misc_feature (1614)..(1614): n is a, c, g, or t
tttttaaattcattcattagggttttacctttgagttccacgatcatagaattataaataattgatgtaatgtattgttatatggttatcaaattttcatttcattatgtctaacggcataaaataaggacaattttacggtaatttgggagcgttggtgcatatttacagtattggaccgtatttattcatctgtgatcaatcactcttcccatctttgccaattccttctttctgatggatcctcttcgtcctccccgtcgttcatctttcaattttggtccgacccgaatggcatggcatcgcctcccatccccccgggcattcctccaggtcctcctccgccacctcccattcctccgggcattcctcctcctccgggcattcctcctcctccgggcattcctcctcctccgggcattcctcctcctccgggcattcctcctcctccggacattcctcctcctccgggcattcctcctcctccgggcattcctcctcctccgggcattcctcctcctccggacattcctccgtttccgcccattcccattggtgggcccccctgctgctgttgattttggtcaaacccataactttgtgtttgaattggtgacacgacgaaaagcacaacgccaatcatagagcaaattgtcagcagcggaaaggaacccattttgacttaaaaacggaaaaataattatgtaaatacctaaatcacttatcggtggcggatttaaaaaatctgtgttttgtgccaattttaaatgtggaaaatgctgagagcgaatctttaaataggctcagagattcaagggtcgagatcgaaaatctcgagaatactcacttaaaattgttcacatgacaaatgggcaattgtgccaaagggcggggggggggcaaaggaaggcaaatgctgcgcaaacacaacaaaaagcaattatcaaaaatgaacactcgagaatggcttacgcaattcgagatcaagtggacaaaggcataactgttgaaatttttgtgaaaatttctaaaattcaaaaaatgatgtcataattggaatttgttatctaaaaaatttcgaattttcgaaaattattcaaaattattttcggatttaaaaaataaaagtattttcaaaaaatcaaggctacataccaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatctctctttctttccttccttaatgttttctctatttttggatatctccaattcaaatatggtctgctggctaaaccttctgcctttcattatttttctcttgnngtcaattccccaacggtacagaatttttttaataatttctttaaattattttttcaatttaattttaattaataaaaatatttcaatttaaaaatattattttttcttttttaaaacagctanaactgcaaattaaccaaaaactttgatcattttttgacaagntctgntaatatattacactcaaattattaaaattttttcccggcggcgtctaatcggcaccgccggaccccgcacccatgtttccaaaaaaatttttttgaaaaacagcgccaaaaaaaaaacaacttaaaacaaaaattaaaaaa

SEQ ID NO: 7629 - DNA, 1135 bp, Heterodera glycines
tcatttagagtcagcaaaaagtcatttgacttaaattcccatccctagtcatcattttgcaaaatattctcctctttggtggtcctcctctgttgcgttccctttttcttcctcttccaatcggtcattttatgccaaaatgtttccgccccttccgtttttgtcaatgatttttcgcctcccattggcacattgtccaaccccatttaaggcaaaaaaaatgtgattttcgtgtttctttcatcaagtactatccgtaaaaaataggaaaaatctaaaaaaatcagggctctctctattcatatacaaaaaatattcaccaattcccttttcatgactataaaaatcttttgttttccgctttgactcattaaaaaaataaagtttccaacgaattattattctgctcttttgtttgacatcattcggaactcggccaaaattgtgctaattgcaaaaaatgaaccgacggtaaaagaattttaaaagtctaaattcagcattatttagctaaactgttttcctatttcagttggatttgtaacgacgtttggatggacattttcccatcctttgaccatgctcaactcggcctcaaattggcacttctttcgccacgtttcaatgcgttggtggacaaacatttcaatggcaaaagcgaattgacaatttggagaccaatcgaaattagcaaggacaaaggaccagaaccgaagctgattgtacaaatggatgacaaatataacaaatttatggaatttccattgccggaccgtccgttgcccagcaaaatccgatttaagcgccttcgaatttagtaattaaaaatcagagagctatgacaataaaagcattccttccattttcacagatacatcgatcactccgtcatcgcttttcttcgttcaaatcaccaaatatttcgacaaaagaggcaccaatttacatttgtggattccatcatcacactctacgaatggccaaccaatttgggacattttggtcccaggaatttggccaattttttctgaaaacattcgccacttgagccttaacgatggtgatcatttggacaatttgcgtcgtcaaattcgccgacaattctcactgatctcaacccaattgacttcaatca

SEQ ID NO: 7630 - DNA, 5178 bp, Heterodera glycines
  misc_feature (5050)..(5050): n is a, c, g, or t
agcaaacaaaatgtgtttaaagtttgggttccagagtcaattaagtcaactagcaatcatttcattactaacgcttaaaacagtgggatttgatcattttcactgcttaggcattggcccctgaacccaatcattcctattgttatacatgtgcagaaggtcagcaccacaccctccgaagtttgtcgtacggagcagaatacataccgacaagggatttgctatgagttaatttaaacccattatttcatttggccgtatgaattattggccgaccctttgcacacgtacaaaaagaaaccgtctgttcagtgaaaatttcatccgaatctgctacatagagatttgataatatatgacttcgaattattatttacaatttctggcatttgtcacattgcagtttttgatgtcctttgctaattggttgttgttttatgtgttatggttttaatgcgtgcattctttgaagaggctttggccaccctttccatcacagaagcaatcgcatcggtcacatttcggtcttgcgtctcgctcaatttagacggactcagcggtttgtcgtcaatttgaggcgaccggtccggcaacatttccatttcggctgccattttatcctctgcgctcattttgatgtgattggtctaaaaaacaaaacggcataaggtccttgtccaaaaattgctgttttttgcgattttgacaatgagccaaattttttttaaagaaaataaggattttggtccgacagtgccgatatatcgccgccgaaggaacagtgagaatttaggccatatttttagattttcaccaaaaaattggtaattttgatgaaaatttgggtgatgcaccaacaaggaaaatcaaaaattttttttagcaaaaatactatttttacataaaaatttcgaacgggaggcctcggaggggggggggggggaggtaggacccacatttcagtggcaaaagcgaatagacaatgcgtagaccaatcgaaattagcaaggacaaaggaccagaaccgacgctgtttgtacaaatggatgacaaatatatcaaatttatggaatttccattgccggaccgtccgttgcccagcaaaatccgttttaagcgccttcggatttagtaattaaaaatcagagagctatgacaataaaagcattccttccattttcacagttacatcgatcactccgtcatcgcttttcttcgttcaaatcaccaaattttcgacaaaagaggcaccaatttacatttgtggattccatcatcacactctacgaatggccaaccaatttgggacattttggcccgtgaaatttggccaattttttctgaaaacattcgccacttgggctttaacgatggtgatcatttggacaatttgcgtcgtcaaatttcgccgacaattctcactgatctcaaccaattgacttcaatcaattcctatgatttgtcgcccgctgcgtttggtgatggttttgatgggccaatttctgctggccaaatgttgtccaaatggttgcactctccgagaaaagatggcgaacccaagcgattgcgttgcgataattacaacgcacaagcgaacactgattgggtcaacaatttcaaggaggtgtggccccacattttcaacaaatcactgatttttgattgcctatatttttgttttccctaattgtttagcattttcttcgtgccaatgccatttcttccgtcaattaccaaattcatttttctgttcatgtgtcgccaatgcaaatggtgccatttgaattggtaaacgaatggacaaaggaaaagctgacattggccagagcaaaagaaaatgaatgggacaaccgatggataatgaaacgatgcaaatttggggagacggcagcggttcattggaaagacggaaattgggacaacaattgtaacaatgtgatcattttgcttggtggcactaatagcattgggtgagcaattagaaaagacatttaattttgtttaaataattcgaattgcgcttaattaaggccattgtctcctccaccagcagaagaaactggacaaagcatcacaaaagggcgaaatgagtgacggacaaaacaacaaaaaaacaatgatcagccgcagaagaagaagaaatgaattaattgagaagaatgaccgactgatcataattaaatcaatgatcaaatgcaatttatgaagaaaatcctcttaattggtaaataaatcggatgcataaaaatggcttgctatctatcgagtgtatgaatttctctctgcttgaaaattgtgacattaattttcgggattttgacgggggatttacgacgtccgttagcaattagcacaggcaatattttaaaaagtgtcaatttgctgctgttcctctctcttttctgcttcattctctcctctttcttctcttccttccgccgaatttttccttttccctttcctctctttctcttccgtctctcctccttccccagtgctatttccttccttttccacctcttcccttgtttctccatttttgctgttatccatcttcatctccattcccaccaaaatttgcttttgttgttgctgctgtactgcttgaacttcttgcttttgttgttgttgtttttgatgatgttcaactgcaactttcttttccttttcctctgcttccgctgctgctcctttttctcctcccttttcctctcttttccccccattttctcttccttctcctcccccttcgctgtttcctttttgctgttgttgatttggtgttttcttccgattgtttggcgccgacactgatagtccaccaccagcagtggagccagttgaatgttttgatttcgccttaaaatgccatttttaaatgtgtatgccatggaggtgttcggcaagccataaatgccggaatgtgtaattccgtcgcaaaaagctcccggaatgcggtcccaccactgacggtatccggattccggacaatccgtcagtggataatctttcggaagacaattctatcagtgacggacaattcatcagtgaaggacaattcgtcagtagactgacgttccgtcaaaggacatttcgtcagagaattaaaaaaaaaatttgttgacggattgtccactgacagattgtccataaccgacggcggattgtcttacaacagattatcctgcattcccactggcgcacatccagtagcaactttttccaaaaggcccaccgcttactgtatgccaactagctacagtatattattgttacaaaaacccatcccaagctacagtacccttcccctgctgccgccgccgtcctccattttcgttgttgctgttgttgtgctttcctttttgtgccgcatgaagtcgatcattctgtcctgcacaatgtccggctcggaagcagcttcatccccctcatttcgtgactctgtcgaaatggagcgaccaccgccgccgccagcagtgatccatcgctcttaaaaatgcattatcccattttaaaatatttcttttatctccgaatgccgtgccagatcgtttcataaatccgccaattttagcaaatttttcgacaaaacatggcataactttgcttaaagtcaatcaaattttagattcttggtaccattcgatagcccagctttttctctattagcttggaaaatttcaaaaaagttaccaaatttaacataagttatggcagaaatagtacttattttcatacaactttttctaaagttgaccaatttttatttttattttgcgggctaatagagaaaaagctcggctatcgaatgataccaagaatatacaattttattgcatttaagcaaagttatcccatgttttgtcgaaaaattcgatataattggcggatttatgaaagaattggcacctctgaatgctaagacttggcaccactgttttggaaaagggctgctgctggccagccgcgcattgaggcccagaaaattaggcatggaaaatttgagactcgacaagactcggaccgagattgacctccgaaaattcgagactatagacgggaagggatcgggatcccattaggatttcccgagacgccgatccgtttttttttattggaaaacgggaggatcgagatcccgacaaaactgggactcgaatttcggtgtcgggactcaaatcccggcaaaactagttgagggccaagtaaggaaggacaaagcagaaaatctgtgccacaccgttcggtccccatggatatttaggcaaacggcaaaaaatattaaatcggcaattcggatcggcggaacttgaaccctggcaccgtgccaagaaattcttacctaaaatcctccaatttaaaacctcgcaccttcggcccaatggcattatgccaaaaaatccaatttcaaccctctctcgtgtccatgtaaaattgtccaattctctaagccagagattcggtggggaaggttcttagttctggcctggtcaatgccagggctcccagatgtgaggctttagcctcattttgtgtttttttgataggtcaatgaggctaaattttcaaaatgaggctttgaggcgttttgtggttttttgagaaattttgaagatttttggggaaaattcgtcagattttttaaattttgattaattttgataaaatggcataatgtttttggccatatttgtcgacaaatctgttaacaaatcgcattgaaaattacaaaatttttcccggcggcgcctatctgcaccgccggcccccattattccccaaaagttttttgaaaaaagcgccgcaaaaaaatcaacttcggtttttcatgcttagaatttcacaaaatgtttatttcgaacaaaaaattgctcaaattgatcatgggcaatcaaaaatataaaatttgaacattttaagcgtgtttagaataccttttataaaaatgaggcttttttgcctgccaaatgaggcttttgaaaattttgatctgggagccctggtcaatgccaataattttctgctctcgaccattggcacacagtgccanaaaatggttgtcctatccagggctgtacgtaactggattttccattacgcgaagccgtaattacagctatttttcgacacggaagccgtaatccgtaattacggagctcaaaaaccatgtaaattcaa

SEQ ID NO: 7631 - DNA, 1627 bp, Heterodera glycines
  misc_feature (11)..(11): n is a, c, g, or t
  misc_feature (22)..(22): n is a, c, g, or t
aattttatttncacctttttantcattttttaaaaaaaagatacaaaaataaaagtgattttgggcttcgggaccataggggggtgcacatggtttttgagtgaaaaaaaattttcaccaaaaatcttccaaaaacatcgtctttaggcgttatttgggccgctgatcacgaatacgtgatcagattttacttttgacatcgtcaagacctcagaatccctgtgtgattggggattctgggacatgttctgagggggggggcggcaggttcgaatccggccggtgtacattatttttacgtgcattttttgattacttttacatgtttaatttcatttcaaattaaataaatattcaattaataatttccaaggttgtttttaattaataaaagagtattttattattaaaaaatttttaaattaaaatgcactcgaacgggcgcgaagcgcccgtataagcccaacaaaatttaaaaaacgggcgcgaagcgcccgttcgaggccgcgaagcggcctaaaagtcccagataattttaaaaaaattccaaatctccacaacaagagctaacttctaatcactgttgtacctcttttaatcactgttgtatctcttctaatctctgtaaggccaacaaaatttgaataacgggcgcgaagcgcccgtccaaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgaagcgcccgactgaggctgcaaagcggcctaacaagctaaaaaacaggcgcgaagcgcccgtatgagttcaacggatttaaaaaatgggcgcgaagcgcccgttcaaggtcaacaaaaattgaaaaacgggcgcgaagcgcccgtctgaggccgcgaagcagccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggcgcgaagcgcccgttcgaggccgcgaagcggcctaaaagtcccagataattttaaaaaaattccaaatctccacaacaagagctaacttctaatcactgttgtacctcttttaatcacttttgacgtcttttaatcactgttgtacttcttttaatcactttttacctcttttaatcactgttgtacttcttttaatcactttttacctcttttaatcactgttgtacttcttttaatcactttttacctcttttaatcactgttgaacctcttctaatcactggaagcggcctaaaaacccctaacatttttttaaaaattccaaatctccaaaaccagagctaatctaggtagcgaagctcccaaagcgcgaagcgctttttcccagctaaatagccgacggttcacgcacccgctagtttatactactatagagaaacgttgcagttcgtttcaaaaaacaaaatctcccggccgaaggccgggagcgccccgaaagtagtggaagggtcttacaactttttgaggcgcatctgggaaaa

SEQ ID NO: 7632 - DNA, 2767 bp, Heterodera glycines
tttaggattttttaacgattttcccagaaaaacggagaccactccaaaacatagttttcgagctcttcgattgtaatttttcggaaaaattcgatttttcccggaaatagaaaaatttttggcctcagcgggacatttgagtcccgggcccatactgggtcaggggttggttttagccaaaaagtgccttagaccaaaattgtagagctttttaagctctatcgaatggtgtactacatgatgtaaaattttcaaaaattttcgagctaggccccctagaaattttcggaaattttttttcggacgaaaatgggggtgaaaaatatttttctggggtattttgatgtgctgagtacgaatatgatgtctattttaagtttcataatttttggaattttttaaaaattctttattttttggcaattttttggccctcgggattttgggtgaatattggaaaattcataactcggtgatggttgcatcaatttatctataataaagctttaaaaatagagaaaaataaggagaattttatgggatttatttgagttttttatttcaaaaaagaaaaaagttattccagaatttctggaaattttcgatttttcagaaaaaaattcgtagctggcttctgaaaagctattcgggaaaagtaaaatactacaaaaatccgcaatttttttctctataatataaattttattttacatttttatcacttttttgcgaattgttataaaaataaaagtgattttgagattcgggaccaaaggggggtgaccaggatttttgactggaaaattatttttcacaaaaatcgtccaaaaacatgtcattaggaccattttatgacgcttattacgaatatgcaatcagattttacttctgacatcgttaagacctcagaatccctgtgtgattggggattctgaggcatcatttttttgggggggggggcgaagttcgagtccggacggtgtaaattattttctttgtatttttgctgtttttacatattttaattaattgaaaatcaaaaatcatccaaaaatatgtctttaggggttatttgggccgctgatcacgaatacgtgatcagattttacttttgacatagtcaagacctcagaatccctgtgtgattggggattctgaggcatcattttgagggtggggggcgaagttcggatccgatcggtgtacattatttttatgtgcattttttgattacttttacatgtttaatttcatttaaaattaaataaatattatattattaattttcattttaataaatataaatagttttgattaatccataaaaaataaaattttttaatttaaattaaattatttttttgtgaaaaatgttttaaattaaaataataatttatttacttttattaaagaactcctgtattttttaaattagaatttgtaatattaatttcaatttaaataaatattcaatccctgtacatttcaaactctctttttaattaataaaaggaaatttattttatttttaaaaatttattaattacattcaatttttaatcttactttttaataaacgatttccttaattatttaattttaaaaccatgattgtactctttttaaccattgttgtaccattccaacaatttttgtacctctccaacaattattgtaccttttcgacagtggttgtacctcttctaatcacttttgtagctcttttaatcacttttgtacctcttctaatcaccgttgtacctcttctaatcacttttgtagctcttttaatcacttttgtacctcttctaatcaccgttgtacctcttctaatcacttttgtagctcttttaatcacttttgtacctcttctaatcaccgttgtacctcttctaatcacttttgtagctcttttaatcacttttgtaatttttttttacttaaaaattttcattatgtattttttgaatttgcaaaaaaattaatttcatttcaaattaataaatattcaattattaattttcaacattgttttaattaataaaacgagtattttattataaaaaaaattttaaattaaaatgcattccatttttaagtgcgaagcgcccgtcctgaggccgcgaagcggccgaatatccaccacaaaatttaaaaacgggcgcgaagcgcccgtcctgaggccgagaagcggccgaatgattactacaaaattaaaaaacgggcgcaaagcgcccgtttggccccaacaaattttaaatgggtgcgaagcgcccgtccaagcccaacaaaatttagaaacgggcgcgaagcgcccgtctggccccacaaagtctaaaaacgggcgcgaagcgcccgtcctaaggccacgaagcggccgaatgattactacaaaattaaaaaacgggcgcaaagcgcccgtttggccccaacaaattttaaatgggtgcgaagcgcccgtccaagcccaacaaaattaagaaacgtgcgcgaagcgcccgtctggccccacaaagtctaaaaacgggcgcgaagcgcccgtcctaaggccacgaagcggccgaatgattactacaaaattaaaaaacgggcgcgaagcgcccgtcctgaggccgcgaagcggccgaatgattactacaaaattaaaaaacgggcgcgaagcgcccgtttgaccctaacaaaatttaaatcgggtgcgaagcgcccgtccaagcccaacaaaattaagaaacggatgcaaaagcgccagtctgaggccgcgaagctt

SEQ ID NO: 7633 - DNA, 731 bp, Heterodera glycines
gggcaggggggaagcgtggggggaaggttggggagccacggatgttgtggtacacgcatcgattatggaagccgcgcatgcactagcaacgaagtcctttgcgcgaagcgctcatgtaatgcatattcttttcatctctcacaagtatactgtctacaccgagcaattactgtgcaaagcatactgtctacaccgagaaattactgtgcaaagcatactgtctacaccgagcgaatactgtgcaaagcatactgtctacaccgagcaactactgcgccacacgctagtttatattaccatagagaaaaagggggtttcgtcttaaaaactaatttgagtcgaacggctgtcgggaggggtctgaaagtggtggaagggtcttacaactttttgaggcgcatctgggaaaactataggttttccgctccggtggccaactgagtcccggcggctaatttctcacttttgcttgcgtttgaaggcccgtaactttttttctaaaactctgatcaaaaaatgcttgctggtaggaaactaagttgaagtgttttctaatttttaaaaaaaattccaggcctctacctatacttggaagggctgcagaaattggcaacttttcagtaccaactttttccagttcagtccccgttgaagaactcattaggctttgacctgagcgcagggtggccagtgagcttattgtagagctcggtgagctcgattttccaaat

SEQ ID NO: 7634 - DNA, 2114 bp, Heterodera glycines
  misc_feature (49)..(49): n is a, c, g, or t
tcgtcatttccgatcggtactaatttcaatggatgaactaaaactttcntgggcattaaataacaaaatttaaaacattttaagaaaataatcataaactggaattttttaacgaaaagcaacacccacaaattaaatcctactgtatttgtactggccctagttcaatgtaattacatttttttataaagtgtatttcgctgaatatttctaaccattcagtgccacgtgcttggcattttttttaaaggagtacaccccttgattctttgcagaaaagtgcacgcatttcgtcatttccgatcggtactaatttcaatggatgattaaaactttctgggcattaaataacaaaatttaaaacattttaagaaaagaatcataaactggaattttttaacgaaaagcaacacccacaaattaaatcctactgtatttgtactgcccctagctcaatgtaattacattttttatcaagtgtatttcgccgaatatttctaaccatacagtgccacgtgcttggcattttttttaaaggagtacacccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacccccacaaattaaatcctactgtatttgctctgcccctagttcaatgtaattacatttttttataaagtgtatttcgccgaatatttctaaccatacagtgccacgtgcttggcattttttttaaaggagtacaccccctgattctttgcagaaaagtgcacgcatttcgtcatttccgatcggtactaatttcaatggatgaattaaaactttctgggcattaaataacaagaataataaactggaattttttaacgaaaagcaacccccacaaattaaatcctactgtatttgtactgcccctagttcaatgtaattacatttttttatcaagtgtatttcgccgaatatttctaaccattcagtgccacgtgcttggcatttttttaaaggagtacaccccctgattctttgcagaatcatttccgatcggtactaatttcaatggatgaattaaaactttctgggcattaaataacaaaatttaaaacattttaagaaaagaatcataaactggaattttttaacgaaaagcaacacccacaaattaaatcctactgtatttgtactgcccctagttcaatgtaattacatttttttatcaagtgtatttcgccgaatatttctaaccatacagtgccacgtgcttggcattttttttaaaggagtacaccccctgattctttgcagaaaagtgcacgcatttcgtcatttccgatcggtactaatttcaatggatgaaacaaaactttctgggcattaaataacaaaatttaaaacattttaagaaaagaatcataaactggaatttttaacgaaaagcaacccccacaaattaaatcctactgtatttgtactgcccctagttcaatgtaattacattttttatcaaggtgtatttcgccgaatatttctaaccatacagtggcacgtgcttgggattttttttaaaggggacacccccccgttttttttggaaaaaagggccccttttccccttttcccacgggaataaattttaagggggaaataaaaatttttgggggtttaaaaaaaaaaatttaaaaatttttaaaaaaaaaaaataaaatgggaattttttaaaaaaaaccaccccccccaaataaaacccactgggtttttaccgccccccaatcaaaggaaattcattttttttttaaaggggttttgcccaaaatttttaaacctacaggggcccccggttgggatttttttttaaggaggacacccccccattttttttaaaaaaaaggacgcatttcctccttttccaaacggactaatttttaagggagaaataaaaacttttgggggttaaaaaacaaaaattaaaaactttttaaaaaaaaaacatctacttggatttttttaaaaaaaaaccccccccccaaa

SEQ ID NO: 7635 - DNA, 1148 bp, Heterodera glycines
taacaaaatttaaaacattttagaaaaggaatcataaactggaattttttaacgaaaagcaacacccacaaattaaatcctactgtatttgtactgcccctagttcaatgtaattacatttttttatcaagtgtatttcgccgaatatttctaaccatacagtgccacgtgcttggcattttttttaaaggagtacaccccttgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacacccacaaattaaatcctactgtatttgtactgcccctagttcaatgtaattacatttttttatcaagtgtatttcgccgaatatttctaaccatacagtgccacgtgcttggcattttttttaaaggagtacaccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacccccacaaattaaatcctactgtatttgtactgcccctagttcaatgtaattacatttttttatcaagtgtatttcgccgaatatttctaaccatacagtgccacgtgcttggcattttttttaaaggagtacaccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacccccacaaattaaatcctactgtatttgtactgcccctagttcaatgtaattacatttttttatcaagtgtatttcgccgaatatttctaaccatacagagccacgtgcttggcattttttttaaaggagtacaccccctgattctttgcagaaaagtgcacgcatttcgtcatttccgatcggtactaatttcaatggatgaattaaaactttctgg

SEQ ID NO: 7636 - DNA, 1370 bp, Heterodera glycines
  misc_feature (186)..(186): n is a, c, g, or t
ttgtaaaaaaagggggtaatgatttttttcggaataatcaatcggtggaaataaaaggggggggggggggggaatttgtggaaaagtatgaaggaatgtgctgataggaatggatgaaccctcgtaaaaatatgtaatttaatgtttaaaaagggacaaagggcggaggagggaaatttcactgtntgatcagaaacagctgaacctttctctgatcagtttatgagggatttaattttataatgaaactaggcagattttagtacataaaaaagaaactttcgaatgataaaattagaaatttgccataaaaagccttaataaaataatgtcactaattgacaaatgacgcaactcaattacgtagcgaatttctcatgagaacagttccaattttgagctttttgccatttgaaataatattccgttggattatggcattttataagtgagtcatttgtcacaaattcacacaaaaaacaaaaccaaattagcaatggtttaaaatattaagaaattatgtttatacgcaaaattagtgaaatgacgaaaatgttctgctggtaatttcttagcgtacgaaaacagagcgcacttcttcaaactcaaggacagataagcctatctccaaggacaaggacaaagtgatgatttcaaggacactgagagaatttggcatttaatgaattatgataattttggtttcaaattttgtgtacataaattttttaaagaaagactatgaaatttataatataaagccaaaagtcagtcaaatggcaaaattttcggtagagaataaatataaggcataattattgctaattaaaaatggaattgattatttttagcagcgcacaaatgaaaaatgaaaatggtaatggcataaaacccgaaggttaatgaatgaatcgtgaaattgaaatagcaacaaattaaatgctgccccttaaaatgcccattaaaggcataaaatagaaatttcgatacaattttctttgattttggtaaatgccatttacgtaacttttccctctgaattggcatttccttttcgattttctgcgatttccgtctctctccaacttttgcttttgtcctttcccatgtttcttctgtgacttcacacattcaaaggatttaaatgccaaatgacagcaaagatttgaagatttgcgttggcattaaacaaaatgtgcctttttctttcgtttggagggaaatccccgcgggcattgcgcaaagggacggattataagcacacattaagcattactcaccccgtcaccctttcctttttcgtttcgcgcactttcagccaaagggtcgcgggagagggggggggggggaattggggggggggggggggg

SEQ ID NO: 7637 - DNA, 1998 bp, Heterodera glycines
  misc_feature (103)..(103): n is a, c, g, or t
  misc_feature (121)..(121): n is a, c, g, or t
attttcccgccccattttttgcgccgtccaatggccatccgtgtccaaaactttttgggacatcagacggtgcaaaaacaaattttgtcccgccccatctganccgcataaatagccgtcncaattgcagtctcgattcagcagatgacagcatccaactgtcatttgggcttaatccttttcaaataaacaattttcaccggaaaaatttccaaaaattagccaacaaatatgccatggacaaatggcactttgttaatttagtcgctgtgagtgaatccccgcctctgaaaatggctttttcggcttagtcatccgctctttcattctttcgatgctgcgttctcatctcttttctcatggcttttctgatactaataaagcttcatttcttcagcaaaaaaaaaaacttttccaattttccctcaaattttctttcgaattcaaaaaatggcccctctcttccatcgcttctcatctctctttgtctttctgatgccgttcctttccgttgtgcttctcccgtcaactgtttgtaccggctctgacagtgccgccgcgccgttcgaccgaaagaattatccgaaaatcgatttgcgagtaattaaacgcctaattagcatattaaaaacaatccaaaatcccctttttagctgttcgagtggcccattgcttcacattcgggctcgtccgctgaggtctcttttatcgccgtcgactgctacacccaattggaccgttctttcatctcgaccgatgccgtgctccgtctcaacaattcgttagcacttcggcaccgcgcctgtctcttgcgcattccgacggggacgcggctgacagtgaccgaaatgcaaacgaccaacagaaaggtaaataagtgattggagagaaattggatgggagggggagcagtgatcgaaataaactttgcttttccaatttagagttatgccaccgttttggccggcgcttcgcactacgaattgccgttgcgcactgagtacatccgcaaaggtgggaaaaatgcattgcaattcaatatctaaacagttttccctccaaatttaggacaaaaccaaaacttcggcccatggcacgtgccgtgccaacaggcgtatgtgctgttcaactcgcgcgggcgcaaaatggaatgggtcgaatttcgtctggacgacgaaacggaggcggacaaagagatggcgagcgcggacgaatgtttggcggacgaagaggaggacgaagaggaagaggagaagggataccgcaaaaagcgagctcattgagccgctgggcagcagactcttttggctttgatggttcggctttttctaatcactttctctccaactttgaatttatttgtctttcagagcattgaaaatgggcaattacggacaatcggagccaaaagaatgccgccgcgtgttaatgatgccaaatggatcaatttcaatgatattcccatctcccacaacgatcaaaacccattcatttcgggtgaattgccattgtccccaatcatatttatccaaatatttggccaccgcatttctcgatgataattttttaccacaaatctttttgagtccctaaattataccaaattatttaaatctcccttccggtgatctcataaaattactttgtgttgtaattggagataaatatatttgtgttaacttttggttgtgagttttgactttttaatgggttaagcgtctgcttaaagttgctaattttagtcggaaattaatttaattgcctctcttttttctgttcttttcttctttctattgatttttttcttgcaaataaatggctgtgaatggtccctttgtgccccgaggggagaaaatggcggtggggtgggcaattccggcacactttgtgcaaaagagagaagtgaagaagaacaacaaacaactcacccagcagccgaaccaaccgaccgatggtgccaaacggcggcgggtggaaaaaggggaaggaaattgagga

SEQ ID NO: 7638 - DNA, 1907 bp, Heterodera glycines
  misc_feature (1863)..(1863): n is a, c, g, or t
attgaacggtcgaaatgaccgacggtgagagaaaattaagtctaaaaaaaagaaaaagcattttgcattttcagccggacattcaactgttatggcgaccacgcgagcggcaacttgtgagttaattaattggtcatttaaaagtaattaaagaaaaattggaaaatgaaaaaatcaacgattaaaacgacccattctgttctggtttgtacacatccgctgacaaaatgttgatcaaaaacaacaacaaacaaactctcgacaaaaaatgacatgacctttttaattttaaaatattttattacacaaaaaaacatttcaaataaagttaattttctttcaaaaaaatcatcactttttttctcattttatcagttaaaatgattgtcattttatcgggacccaattatgcttttaccaattttccgcttctttgaaatttaatcctttcttcttttcttccatattaattagaaatgaaatgccgcctcacgcaaaggcaaaattggagaaaaaatatattaacgagaaggataagcacccatccgttttcgttggcatttcctccatttgtcccacaattgattccccccccctccgttggcatttttctctccctttgcctttgacattggcacaaattaataaatgatacaaattcatctgaaaatttggcacaaaaataaattctgagcggtttcattctcgcgaaatggcatatttgctcaaatattacacatgtaaaaagcgaataattcaaaataaagtgccaatgttaacaatttatatttcgaatttcttctcagtttccgccaaaattcggacgcttagcgatttccattcgcgcatcgtttgccaacaacagccgccgagcagtgccgaaattgtgacgacactgcgctattttcagcaaacactcgtcgggcaagtggccgatgaatttttaggaacaatcgaacacatttaaatgatccattaatgctaatatttgagttttaattattttcgaaaatagaaacttataatttttataattttaagttttttgaaagaactcccggctaagcgcagcgaattgttcgaagagttcagtgccgagaacacgacagttcggaccgggctgtacccgaacctgaactattcgggactgttctacggcattaccaatttgttggacgccttcccaatgctcagttcggcacacaatggtccttttgtgatggtcaacactcagagatgaaaaatgaatggccaacaattcagatattgctgaggccattttggacactttgaaggcgctgtactttttcgttgatcgggactgtgttggtcggttggggtattatcttccgcattgtccaccgtatattaccttcccatattaccgtatattaccttcccatattaccgtatattacctcccgacgttaccgtatataacttaccgtattctattataagtttgcattatgtataatcagatattaaggtttattttactatccaatattaccgtatatcatttccctttattaccgtatatcacagtctgatccgccaccccgcccagatcaaatgccgcttctgctggctgctcaacttggcgttttccctgcagagatggaccgtcggcttgtccacttgctctgcgattgcattttgccgtactctttcggcgaaggtgccaacggtcgcgtgtcagttccccgcggtgcttatgctcatccttcaccacccgaccgatccgagtgtctttcaaaattaaatattttggataattacattcatttaggcattcacacaatggcagtcgaaagtctaatgcgaactttgcccgacatttacaatggtgaaaaacccttnaatatcgtctgaacaaataaatttaggcaatcggacaaataagg

SEQ ID NO: 7639 - DNA, 1866 bp, Heterodera glycines
tcatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactgcagtttctgtaaaaatacttatgaattaattatgcaaaagacaaataaataatgaactctcttccttaataattttcctgcaccgaaggtactcactcggccgcttcgcggcctcgggtgggccttcccctcgcactccgccaccccgcccagatcaaatgccgcttctgctggctgctcaacttggcgttttccctgcagagatggaccgtcggcttgtccacttgctctgcgattgcattttgccgtactctttcggcgaaggtgccaacggtcgcgtgtcagtccccgcggtgcttatgctcatccttcaccacccgaccgatccgagtgtctttcaaaattaaatattttggataattacattcatttaggcattcacacaatggcagtcgaaagtctaatgcgaactttgcccgacatttacaatgtgaaaaaaccttaaatatcgtctgaacaaataattaggcaatcggacaaataaggacaaattattctatttcatttagagaattgttcaaattaattagtgaacattagaatgatagattaaagccttgctttttttctgtaggaccttgtgactgtaattgcgtcaggcaccagcgaatcgcgaatcgttgcggccaatctgctctttcactactggccactgatgaatcctgcgattttgcaccgcagatcaatccaatacaaaatccatggtatatatcccgttgccatggtccctttggcattcattggtctgtccaactttgttcagtttggtcccctccgccatgtcaaaacatcggttgcgctgagcacggaaaaaggtaaacaaagcaaaagcattgttaattagacaatttgttattcattgtttcttatcagcacacgcctcacttttgagcctgctttgtgtgctttgctcggcgacacttccccaccattggccctttgcgaccgttgtgccgactcgtgccaagcggaaatgccaatgccttttctgtgccaacctttgcccgtgctgatcagtgccacatgccaattaaaagtgagcaattaaggaaaaatcatccaaactgccaatgaatgatctgttcggtaagggttgccaatcgtcgagtcgtattgctgtcagcacgtgttttgacgaggattgcatccgagcccatgggcacgtgccgctcagactgtgccacgaatgctccgtccatttgcacgctccgccggtgcgtgcccatcgctgccacttcggacccggcacaatttggggcacgcctttggagcacacaatggccgaggcggtggtgaaactgttgcgcgagacatccgcaaaccttgtgtcagttttaaaagaataaaacggcaccgaataataatggaaaagccaaaaaataaattgcaaaaaaatccgatgattttttagaagttcatccgacggtgaagcggccaaacgtccgaaatggctgaggcaattggaaagcggtcgcgagttgggccgggaagtcgacccgttgagcgacgaacggcgaatgctcagccgatttggcatttggctgatggccgcccataatgccacccagtggcggaagcaacgcagggaacggacaag

SEQ ID NO: 7640 - DNA, 5310 bp, Heterodera glycines
attaaaaaatattatcatatcaaaaaacaaaatccaaaactcaaagaatacgaaattgccgcaaaattgggaatttcaatgagctcattatacaaatacagcgatgaattagtcaataaacacattaaaatatgctaattattccaatttatcgttttaattctttttttattagaaataaataaatttgcattttccatctgttctttggatccatccttgtccaaattagagtcaaatccttgtgatatttttcatgatacaattattcatttatatgtttggctttctgtgattttttatacaccaatttttctaactttatgcttaatgttgttctattctcgtctgatccaattcaatcaataattttgataacattgttttattaacacgcagtgggatttgaaccatacaataataatattatgggatgaaacatttttatcatatgtaaatatcaaacataaaataatttatgggttgaaaatttgtacaaaataatataaaagaaattgtggaaaaatttcataaaattaaagaaaaaataaagcaaatgggaaagaaatattcaaacaaagaatggtataaaattgaaaaaaaaattgcacaaaaattgggaacaaatcaaagggaaatttacaaatggaaaagagaatttggattgatcaaagatagttattcagaagaggaaaaactcaaaatattagaacgatttgatcaaatatatgaccaaattaaaatcaaattaaaaggaaaattggatggaaaaggaacaaaatgccaaaaaataatagcaaaacaattgggcataagtttaatgagcatttataaatggaagaaacaattaaataatgtaaattcggtggacatccaaaaaactgatgatgaaaaaagagaaattatagaaaaatattttaaaataaaaaacgaatttatgcaaaatggaaaacattcacagaaggaatggaaagaatttagagcaaatattaaacaaatgattggtgtgaatttttggacgattgaaagatgggcaaagaaattaaatattaaacaaaattttcaaaaggttgaatttattttgaagggttttataaatatcaaaaaaggttatccaatttttaaaagattatgaaaaatatttgttttgttgaataatcaaaaagggaatgtgccgtatcatttaattaaatccaattgactaataatattttaatttattttagctccttccgcttcggctgacagaaaagagaaaagtacaaccaaaatattacttaaaataattacatttttaataattaaaaatgcaaaacagtagaaagaacagataaataataatttaaacaaaaattatcgaaaatttaaaaaaaaaaatttaattttttaaaataattattaccattttcaggaaaagaacaaattatcaaccaatttaataaaatgaaaaacgaattcttgaaagcaaatctaaaggctaataacagaaaagcagaatttaaaaattgccaagtaaatgggccgacgattcaaaacaattaatcggcggcgcaaggagctgaaacagaattctaactgacaaagagcaattggcactgtttttaaaaaaaccggcacgtcgccaaggaaaattttaaaaattttgatgaaattacagatttatttaaaaagcatcaaaaataagtaaatcaaattaaattgtaggcaaatcatgattcttttttgactgttcattttaatttaaattgtgatatttataaaaaaatgcagaaaattagtaatttaaaaaatattttattttgacacaaaaaaattaataatttaatttgtcccatgcttatctgtgtttctgtgtttattcgcataattttttaactggcaaataataataattttataatgaacaattttgaaattggagattttgaaaattcgaaataattcgtaaaaattcaattccgaacattcgctgttgctacgcgaattgcccattgttgttgctgcgttcctatgcttgttgcgtaattggttggttgaagaaacttgaacactttttgaaatgctttccgatattccatgctgaaatatttttaataattaaattatctgattttttggaattattaaacgattaaatttcattaatttacaatttttttcaaattacaaatttatgtgttttttcgttcgaattaaatttatctccatttgaagaaaaatgagttttttattatagttagtcataattaaaagtatattaataaatttattttatgtttttttagtgattttttggatttatccagagcaggttctatttctgggtttttatgagttttttgtccagaacatacggttctaggccaaacatgaacccagatccatatttatacttttcaaaattttgatctataagacgtagcattaaaaattaaaatcatttttcccctaaaatttacttcattttgtaaagcactggcccattcacagccagcacaatgtttgtcaagcagctgagcaaaaatgtcgagacagctttactggtcacagacaattggagttgcggaatggtcagccggccaatgcttgacaatgtgtgcccggcgagctgaagtgccaccaaaaatgccaatgccttcagaattcgacgggtccaagcatccgatgaattgtctggcaattttgaaaatttaattaaataattaatggaattccatttttaacacccataacaatgcctttgtttttatatgttagcgccatacttaatttgataatttaaaaatagttttttaatttatttttgattgtattcatttgctactttttgaaatccaatttttaatgagtcttcaaaaaaatctgaaaaattattttctttaactaattatgttttttgtttatataattattcaatatttttgtatatttattactcgtattttgggcattctgatttcggtataaaagtataatccatatgccaatgtatgtggcaacggtggtgcccgtgatgagtgtattcaatgcgtaattctgattgcttgcccaatcccaaatgcactcatgcggagcgcacataacagaccttaaattgaaaaaattaattaatcaattttctattcatataaaatacatatagtgttgttaggtttttctaaatcaatagaaaaacgaaaaaatttgcttttttttagagaaaacaaattttaaattagcttttgtaaatagaaaataaacaattttcgacttttataatcgagacattttttcaattcaaacagcattttttgttgttaccccacatttgcgcctatgtccaaaatcgggttcaaacttaaattttttcaatcccagacagattttaagctatcagggcttgaaaaaatttatgtttgaaaatccgattttgcacataggcgcaaatgtctgaggcgcaaatgtgtggacataaaaaatttctggggaaaagagggacccgccgataggcgccgccagaaaaatcaaattatttattttttcgaaaatttaattctttggactcaaaactaaataatgccaagaaaatatatttttttacttttgttccggtatgtttagcactaaacgaagaattgcttgaacaatgaaaccgggaaataacaacgaactcagcaaaacgagaaaaaacgaatagagacgtgatggtttacgcatggcatacctttcaaatttatattaattaggtaattagtcaaaaatttcaaaaagataaatttaatgatagataataaaaattttttggcaattttaaataagacaccaaattgggaagcaaatgctgagaagtcgatcaaaagcgatcaacaaattggcggacattgaagcataaactcccgtaatgaatggtagcaacaggtaaacacagcacaaacgaattggcacaaattgttggcccaccaaaatttggaacatgccaatccatgagccaatttcaaaccaggcacaagcagctgcatcaaaagcgatcagaatgttgcaggggccattcaatgagctaaattaatgatattttaatttttgatttcggcactttgtaaaataattgaaaaatattcggaaattcattaaaaaataaattttttctattttttcacaaaattaaaattaaaatagcggatttttaaaaaatttcgaattaaaaaaaattctaaaaaatgaaaaatgaaaaataattaattctaacaaataaaaatgatttaatttattttatcatttgttattacttggttttgatggtgacgtatactagcgctaagttacatattatcccaattgtggagataaatgttcgtaccgctgttaaagcgataagtgcccatggcaaaccgtcttccgcataaagctcaaaaagctaaacaccaaaatttttattatttttatattatatatttattttaaataccgtttcgttttgattcattttaattgatatagtaagcaatgaataaatgattctaaaacttaaatattgtgaattagattttttctttattttgattatatatataatcgagaactccaaaaatttaaaattaacgatccgttaattttgtataattttaataaattaattgactttgccaaatctcacattaatatgaaattattattgtgatataaaaaatcgctaagtttgagacatttgcgttacacattttcacacattttgaaaaaattttcgtgagaaaatgaatgaacgtatataaatttttgaatttgtcctaaaatttccacgccagaaaattataatgaaaaactcttaacaattggaaagaaattaataagaaatgttaattaaaaacgattcctatgtgtgaaacagctgtaggtaaacttccaaatttttatgaaccaaaaaattaattaatttttctatttgccagcggcagatttatgacgctgatggaaaaattgtttaaattttttaattaattagaaatattaaagctgataattttaacaccaagctgatgatgaatgaagaaattttgaatgcttttatgaaaaattaccaagaaaaattattgccaatctctgagataatattgcattttttgtgattagctaattgttattatattgattagacaaaaagttttcgaattttcaaataaatgaatttgtaatttatgtgaaattattacccgagattattcacaaaatacataaatgaaaaaatacataatcaaaataattcgtatacaatttaattaaaaatcataaagtaaataatttttttttggtccattagacgaaaaaataactgac

SEQ ID NO: 7641 - DNA, 2381 bp, Heterodera glycines
ggcttttattgttcaacccttcaaatattactacaaattaatgcaattttttcagaagcttcttttattcaagtttttacgaaaaactacgttgattttttaactttcaggtgccaaatacaaattattttataattaattatggacgcaacaaaaaccttacctgaatcatcgactaaaaaagtacctacctattaaaaaattcttttcaaaattacctatcttaaggtttgctgttactgcatcaatccttgttcttgtgcccaccaatactggaagtgcaaaaaaccttgccatgcgattgcgccatgctcattttcacatgacggcgaagagggattcggctcaaaagtcacctgctgtgtgtgctggctcgacgatgacgttgaccaaagcgcgagtgccgtcgtttcaacagaaccaagcagcaaacaaaacgacgaagcattgtcacagttcatcactgaacaaattgttacggaggacaacaacaacatcaacgacgctgtagaatgggcttatcaaaccaaacgcaaacgccgtgcctacagcatccaagagaaagtcgagattctggacttcggcatgaattcttcgattcatgccgctagccaccacttcggagtcgaccgaaaaatggtccgtgaatggaaaaaacgaggcgaatttgaggaaagagtaagatgcctgtaatgtcacaatgttttaattcgtttaatttagggccgaatcgtcaaaacgaaaacgtttggaagggggcggaaggaaagttccaaacaggaacttcgaagaagctgtgttccagtgggtgtctgaattgcgacaaaagaaagtgcgggtgacacgaaatatgattgctgcgcaagcaatcaaaatgagcgccgcctacgaagacatggaatgttttgcggtaacatttcgaaaaatttttgaacatttttcacttaggctagtaatggatggctggaaaaattcatgcaccgtcataaattttccttacgtcgaccgacaacagtagcgcaaaaagaacccgatgcatacaaaaacatcatcatcaacttcatattatatattcaacaactcatacacaaaaagaagtaggtaaatgagaaattttttttcaaacgactaattttcagctacacacatgtctacgcggcggacgaaacggcggtttggcttgacccgggtggcgggacatccgtaccaaacatcatcgaccgcttcaaaaaaacacttgttttgtcatggttggcagaacatggatggacaacgaattgacgacggagtacttggaaaaggtgcagaacaatgacaataattcattaatagaaacttcttaaattaagattttcgggaatttccatttcggcgcccgtctcttggtttgtaaaaaccgaaaaattttctttttgtaagaaacttttggaaaattttttttatttaacttataaaaaatttttaaaatttagaaattcaatatttttgcaattgtataaaaaatgctccttagcccttgttgtggtgatttcaaagtcaattcttaatgtacacacaatttttggcatttttttgaaagataaaagccattttttggcagtttttaaggcatattttagtgcatatttgggtatttttcgggattttagtacatatttgggagatttttagtgcatatttatgcgcatatttggcattttttagtgcatacaacttcgaccctagccataagaaaagggtccactgcgtttgggcgctggcgtttgagcgcggccgtttggccccagctcgtttgagcgctggcgtttgggcgccaaaaaatatataaaaattcaaataatttggtaaaacaaaaactttttattaaatataaaaaacaataaattggtaacaaagagcaacaattttcaagggttcatttgataattgtgggaaatgcctcgaagaaattccaaaataatgtgaaattgattgggctggggattgggtggaagataatcatatatgcaaatttatttattgttttttatatttaataaaaaaattttgttttaccaaatatttgaatttttatatattttttggcgcctaaacgccagcgcccaaccgagtaggcgccaaacgccagcgcccaaacgcccgcgcccaaacgcgtgggtcgcataagaaaacgccaagagaagtgtccgaggccgtgaaactaaacagtcccggtccgttctgaacagggttgccagattaaaattttaaaaagcctcattttgggtcaaaaagcctcattttttacaaaatttattcaaaacacgtataaaatgttcaaatgttatatttttgattgtacagtgatccatttgagtaattttttgttagaaataagcatt

SEQ ID NO: 7642 - DNA, 2031 bp, Heterodera glycines
ggaagttgattttttgcggcactttttcaaaaatccaaaagtggaattttgaccttccaaattagacctttaccatcgactattttgccttcaaaccaattaggcttgccagaccttccgtaattcaacacgagaacagtgtcgatgcgattagccgtgaaaggacatcagcttgtccaaaactttccgatttcacatatttgatgatgaagtcgtaattggccaaagtcagcgcccagcgctgcaaacgagcggctgtgtagatcggaatccctttcttactgccaaaaatcgctaaaaggggcttgtgatccgttagcaatgaaaaatttcgcccataactcatgcggtgaaatttttgacatgcaaaaataagagctaaggcttcacgttcaatttgcgcataatttcgttcacttggcgtcagacttctgcaggcgtgctcaattacgcgttcagagccatcagggaacttgtgactgatggttgcgccaattcctgactgactagcatccgcagcaacgataattggttttgcggggtcgtgtagtgcgtcaaaagcaagtcggactggagaatctgcttagccttttcaaaagcattttgttgatcatttccccaagcccaaggaacgtctttacgcaaaagaatgtccaaaggagcgcgaattacacgcatctctttgataaaccgaccataataattcagtgcgccaagaaacgaacgcaaagtgctcagatcatttggcggcggcatttcgcgaatcgctgcagatcgagccgggtcgggttggattcctttggctgaaacaatgtggccaagaaattttaattcagtttgcaaaaaatgccatttttccaaacgaatgcggaatccaaaatcctgaatttttgaaaataatttggacaaagattcaatgtgatccgtaatgtttgctgaagcgatgataatgtcgtccaggtacgcaaaaacaccaggaataccggacgtcatttgatccataatcttctgaaaaatcgaaggggcagacttaacaccaaagggcaaccgttggtactgaaaaagccctttatgcgtgttaatccccactaacgatttggacttttcatccaattccaattggagatatgcatcgcgcagatcaagttgtgagaaaacttttgacccacgaagtgcatggaaaatgtcgtcggttcgtggcaatggatgacggttgagttccaacgcatcatttagtccggtcctgaagtcgacgcaaacacgaatttcaccagactttttgcgcacagcgaggacaggtgccgcccaacgcgaaaaatcgacggggtggatcgctccaatttcaacaagacggtccaattcgctgttgacggcctccgaaactccatgcggaacgggcctagctcgacaaaaaacgggctgagcaccaggtttcaaatgaagcgttgctttcatcttcgtgcacacgcccaaacctggccgaaacctgcaccgaatgaatttgcccgggaccagacaaagcggcggccgaattttgaagcgattggatggagcggcactcttccataagtgcttccaaagtcatggacctcggtggcgttgactttcgcgctttttccatttggcggagacactcttgtcggagttctttgtgcgcgtcgctcagacctgtgatgaaaatcaagcatttgacttcctcctttgacagcgtcatgtcggcgcgttcactgcgagcgttgaccatggcgccaaactccatgacattttgtgaggggccacacgacagctgaaagcattcgaagtgcctgacaaaaattgatttagtgtcgccaaaaagtgacttaagagtggaaattgtaagctgaaattcgatttcggctggcttcttaggaagaacttgctgttgtcgccggtcaaatccttaccgtccttttcgacaaattgtccaaaacgatcccaccaaagtgagaatgttttatctgcctcggggtcgtagtggaattgcggaagttgactgttgatttgactgaa

SEQ ID NO: 7643 - DNA, 3610 bp, Heterodera glycines
  misc_feature (15)..(15): n is a, c, g, or t
catacactaattaanttgagcacctggggccgacgactcgctcagcgccgtctccaaatagccattggtcacccaatgcaacgaacggatccgcgtctgtaagctcaggtcctccgcttcttcctccgttctggaggcaattaatttaaaaattaaatgattttttaattcaaatataaattttagagagcggattttttttaattggttatttttcaatcttttaaatgctaacaaattgaaaaacacacaaaactctttaaatttcaataaattttgtaaaaaaatcaagcaaaagaattttcttctgaaaaaacttatttaaaaatgctttttttctggagttgggagaggggaggcgttcaaaatgagaggaacaaatggcgccgtgccgtaccgtgagccaaacagcacggggtacgcacgagtgcacacaaagttctcaatttccgtcatgaagtcggaggtgctgcacggcgtggcggcgccgtcccccgccgttgcggcggcgggcggtggcatttgcgcagcaaatttgacggcactttctttgatcgattggtaaaatgcctggacgagcagagagagctcatcgcttggcaaaaattcactctaaaattggggggggggggaggcacaaatagacaaagtagttgcctgtccaccttgaacaagttgtcaatgaacacttggcactgcttgtccaactctttggcataaacgtgggcaaaattggcctctaaaaattggtgtagatgctcctgggcggtcacagtgtccggactcggtggcctgaacaggtcgaaatgtttgggatgtttgagaggttttcgtcgacacttttttcgccaataaaatatataaaattatgttttatacctcggccccaaagtgatgagcggcgattggtctaaaattcggaatgtgttttaaaagatgcaaattagcgacccatgaaaaaatttgaaaaatttggtaaggcaaaactattttaaaaggggcgggaaaacaaaaaaattatatttttacacgttgacagatttctgcccaaaagtgaccaatttagagaaattgggggaaaactttttggaaaatctaaccgaattagcgcttttattaatatttaatttccgcttcccttggttaccggcctaaccaaacccaaagtttccgtgtcagttttcggtcaaaaaagcaagtctgacaaaaaaaaattcgactgaaatgccggggcacaattcccctttgtattttgctatgcccttcgcatcggccaacccaccgcaagtgctggcggataacacggacggcgacttcttcaccagcgtcttcagcgagttgaagcgcgcgtcggagcctttgcgcgtcaccgccgccgccgacgacagcgccgccgcacttccaccgcccgcaccgcttggccccgtcgcgtgctgctggtgctgtcgcaacactttgatgttgttttggtagtcattttgccgcttgctctccagctgaaagtcgcgccaacagcgtgagcacaacccgtcgcactggggcgtgccgtagaagccgcaccggttcctgcacagctacaaaagcggcacgaatgtcaaatttatttccacccgcccccaattaggcattgaaaatttgttttatttcgaaaattgtgcgatatatttgacaaatccttcaattctttatttctccatgaggccaatctacctaattgtaagctctaacaatgcttttgacaaaattataaaaaaaaatccattaatagaattttcgacaataaccaccccaaccattgaggtcgccaacatggcgtggcgcgaaatttgctcatcggccgaagaacacattattgaacaaagataataaataataaaaaaagtcaaagtcagtcaatttggtaacacaaatggacagatttatgagagcaaaaattgccttttttagcacgcgtttgggagggacgacaatccgagaaatttgctaagcaaacattcaaaaaaatattctttcatttatggccatgaccaaattgcaaatgtgtaaataaacattatttacagcaacaacagcagaacaaatatgtgcatatacatatgcatatgtagcgaatgaaatgatgtcacgtgaagattttttaataaaatttattcaaattttgtgtaaaaaatgttaaaatgtgtaaaaatgttttccttttttaagatgttggcgatgacgatctgatcagtgagcagcaatcaaaacagacaacaaaaacatcaatgataacaacaatgaagaaaacgccgggggggggggggggaaacacacaattaatttcaaaataactgaaaatgggtgcaaaacaatcaaaaaatggtaattccccgttgctcctcctcatcgtcctcctccgatcagatggcatgcaaaatgtgtttggtgttctcgtaggtgatgaacagcgcagcgctggcaaagcatgttcggatcagtgtcgggaacagacccttgtacagagcgctgacacctagcgagaagaattgccaaaatgtacgaatgaacacagagagagacacgaatttggtaaacatgcggaagtggtaactgatttacgggtttcccggtctcgactggtgcacactgaactgagagtccccccgataaatcccagagcccacgacctatttttttaattcctcttcgtcccaattaattttgaaattttttgcaaaatttttgtttatggtaatttagagagagtcgccattatagcgccaaaaatgatcaaattggccttaataattttcaagcctaaatttgaacaaaatcaaactagtcaccttcttgtttgacaatgcgcaaaaacagttgggtcgaattttgttctcccgtaatttgcattcgacttttaactgaaatgtgtaattttttatgtaattaaatattaatattgtaacattttctcaccgacgtcgacgggaaaaatcgcagtccaaagagcctttaaattgagaaatcataagttgtttcaaaaaataaatgtcaaaaagacgaacaattcctccaaatgcaccggagagtgccgtcctcgcaatgccttaaattcggttaaaatgctcaaattttccgaaaaaataaacagagttaaacaaaataaaaattgccaaaattaaaaaatgcataaattagtttttttttggaaatttattttggtggccaccaaaaaagaccaaccaatctcctccttggcggacccgtccggtctcagcattgtcctgctcagttcgtaggcaccgaagaagcaaaaatagccgggaatttcgcgtgccattgttggggccaacccgttgaaaaatgaacgcaatccgtttcctacaataggggggggggtaaacaaaataaaattttaggcccaaaagtgccccatcctacgaaagaattagatctggaatgggttttcgagaccaggttaaggggacagcagagatttacattattttaaataaaaaagtggaaaattcgaacttacagtaaaatttaaaattcgaggcttttttaaacaaaaagtccaaattaattaaaagccgcacgtctttttcaatatatttcttctcatatactcact

SEQ ID NO: 7644 - DNA, 1703 bp, Heterodera glycines
  misc_feature (1638)..(1641): n is a, c, g, or t
  misc_feature (1672)..(1673): n is a, c, g, or t
caaggggctcatttcctttgtggacccacagccggtgaggcgggcaaccaacttttggcagaagccgtaggaagtgaacagcaccgcattctccgccacattggcagccaacgcggggacagtgcctgggggaagaaaagtgtggcaaaattgggtttgatgacggcatcaatgggaaggaaatgccgtcataaatgtggacccagacaaaaattcgcgaatttaatatttccgcacacaaaacttttaccgaattttggtaagaaaactgatttgaaattttaaaaaatcgccccattttctttaaaaaacttttagtgccaatgcttaccggcgtaaaggccgcggacgccctcggcacggaatgtccgtctcagacagcgcacccaattgccgtacaaggcgggaaatgtttgcatcttcacttaagcaacggaacatggagagtgaatgaagcaaaaatttgatactaaaaactatgtgtgatcagtttccaaacctttgactgtgtccagcggttgtgcggtgtaaaccgtggcaacgccacctgtgaaacggggaggaaaatgaaaacaaaccaaaaaggggagtgcaatcagagcggaacgattgagacggcttcacaataattcattttgttcgaatatcaatgactttttttcggtttttcaatttatgggatgattatagaaaatagaagagacttcaagcaatttccaacaactcaccagctgtgccggccacaaagtcgatcattccgtcttttaaatgcgaaatgtgagcagtgtccgtcagtgccgaatttatcggcaccgtcgccgaacttttgtcgttcattcgcttttgacaaattccaaaaagcggaatttgaataaaaacaccaaattaacgaagtacgacagatattagaatttaaaaatacaaactgataagtggcggaaaacgaggcccattttttacactgtcaaaacagagagataacaaacacaaatcaacactgaaaatatttaaaagtgacaaaaaatgataagccatttcattcatttaatttgtgatgagttcattgatcagtctcatttcgattattctccttctcctccctcagataacaacaaccgcacttttgacgcacattcttctgattattaattaattcattcgttcgccacgggcggcacggcgtggacacggacggacttgtccatgctggcggacaccacggacttgacatcgtcggcaaaacagacgccggtgactggctgagagtgcgcgttgaactgggcaatgttgttccaacttttggcctggaaaatctgcacgttgctgcccccgacggccaaataggcgccagactggtcaaaagtgaggcagttgatctgagagaaaatttcgacgtatttaaaaattaaaaaaaactttggcgctatattaaaagtgacaggttttgaaaattttttcaaaaggggggacccttttgttttgcaaaacttttttgagataaaaaagcatgataatttgttatctggggttttaaaggtcgctaatcacgaatctgacatgtattttgactaatttctaatccctaacccgaactcgaataaaaatcgaaatttttcaaatttagattaggaaatcccnnnngatcaaaagaattgagattcccgatcggtgnncccaaaaaccccagagaataattttttatg

SEQ ID NO: 7645 - DNA, 1246 bp, Heterodera glycines
  misc_feature (1224)..(1224): n is a, c, g, or t
caaaaaagtttgcaaaacaaaagggtccccccttttgaaaaaattttcaaaacctgtcacttttaatatagcgccaaaacttattttaaatttaaaatgatttttaattaaaaaatactctgactcaccgcctgcttcacatcgtacagtgtcaagttcttcagattcttcagtttgcgcaggtcccaaattttcacttcgccgtccgttgacccggtggccaagtagtagccattttcggaaaacgaaatggcaacaaccgcctcctggtggcccgggaattgggccacgttgatctgctccttgatatcccagattttgacgacgctgtttttgccgccagtgccaaagatgagtccgtcggggtgaaactggccacagcaaattcccggcacatcgtcgtcgtcggatttcacctgtgccaatgtttttggttttggaaaaatgtatagtgcactttttccactggttgattgatttaaaaattgtttgcacccagccacaaattaaatgagaaattacaaaaatatcctaacaataaacaatttaaaaacttaaaatttctggggctagaaaacctggctttgttctccacattttttaagactatcgccatcaaaacggctttgaaaacattgtaaaaatatttgtctcccccccccaaaaaaaacagttggcaaaatgtctctgtgactgacttttatcaacggacgtccagcattgaggtcgatgagcgaccaatgcgaatcctcagaggaacagagcacataatcgccggttgggtgcagagacacgtcagtgacgggtcggtcgtggatgccaataacatttctggcactttgatcatccgcgttccaaattcgtatctgaagcgagaacggatgactgggtagtagcagcaaaaacaacaaaacaccggggggggggggggaaatgggcataccgagttcctattttttggaaagcaccaaatgttcaaatattcagaccactaaaaaataatgcattttcaccttacaatttattgttactcattttttgttttttccttccacgcttaaaaaataaaataagttacctagcaataagtgtttactctaaatcggatatttgaaatgccaaacaaaagcaaaacctgtgagtcaaaagagcccgagacaattgtttgaaggttgggatggagacggacggcactgatgtgtgggctggtgcccccttgaacgntgttcttgaatggtctccgtct

SEQ ID NO: 7646 - DNA, 1324 bp, Heterodera glycines
gatttgtgtttaaaaacaaattccccggggggcttttttttgaaaaaaacgatattggaattaaaattttaaaaaagataaaaactttttttaaagaattttattttttttttagcaacaaaaattgggaattgcaaaagtatgaagagcatttgggaaagggatttacggaaggtgcctaattccttatgaaaaaggggcccttatctgagtgttccgcgccaaaaataaaatgtggtgttgctttcagtgcgcttttatatacgtaaaagttccgggcaaaaatatttttgctattcatttcgcgtaacacaaaaaataccatcgtcatccacacatcacctggccaaacgaagaaaatgtgaccaccgccaggccaccaccgccaccaataaaaacgaaaataattataaaaaaagaaagaaaaaatgttcggaaaaaaaatttacacctgggccattaaataacaagaaaaaaaaaaacattacaaaaacaaaaacattttttggtttttctaagaaattttatatctaggacaaataataataagaaaatatcaaaacaaaacattttgggtttttctaaaaaaaaaaaatttacacctgggccattaataacaagaaaaataaagcaaaacaaaaaacattaccaagacatattttggttttctaagaaaattttttacctgggccactaataaagaaaaaaaaacaaaaaacacacctaagccattaataacaagaaaaagcaaaacatacaaaacaaaacatattttgggtttttctaaaaaaaatttacacatgggacattaacaaaaaaaaaacattacaaaaacaaaacttattttggtttttctgaagaatttacacctgtaccatcacactaaacaaagcatatttgggttttatgtttttgtttcttttgtttttcctcattccataaattctgagaaaaagcatgtgatgtgtgtgggcgtgccctttttgaagaaattacgaatactgtgtgctcttgccctaaatttggccctctgctatgctttttgaaaatgccgaattttttcagggttcgaaattcaaggccaagagcttggcactaatgaattgatatattgggatttctaccctcgtcgcattataaggtttttcctcccatctcaccttcgtcgggattcaagactgagatttccaagaatttgacatgaacaccacaagactaatgccagctttcaaaaaccagagactaggtccggttaagcgaagccaaaatttaattgaaaacactcaaaagattgagctttttggctgccaacgagacttttggc

SEQ ID NO: 7647 - DNA, 1841 bp, Heterodera glycines
  misc_feature (28)..(29): n is a, c, g, or t
  misc_feature (51)..(51): n is a, c, g, or t
aaagttcaacaaggaaaatccatgcgcnnttaatgacgcattttggttttngaaaaaaataataatttaaaaattgggtcgtctttattcaaattaaattttaatttaaaaattggatgtaaattaatatgaaaaaaaactagaaaaaaagtttatggcacgaaaccacaaaaaatcgtcaattttcggaaaaccaagatgtcgggttgtcttaaaacatttaaaaaatcgcttattgacgcattttgttttagaaaaaaaatatatgtaaaaacgaaaaaatattttatggcagaaaaccacaaaaaatggtcgactttcggaaaaccaagatgttgggcggttaagcttaaaataaaatatttaaaaaatgccaaaagggattatgccacaacatgtttttgaaccatctgaaaatgccaagaaatccacttaaaagagaaaaaaaaggaatttaaagggtttcttaaaaagataaatgccattaaaaatgcacttttgaggaaatcaaaatgtcttcaccaaacaaatgaaaaaattcttttttttctatttttaatttcatttttctattgcgagggaaaaaaattcgctagaattttaatttcctaaaaggacaaatttactatagtttttcatttcatattttattaaaacaaaaagtattcaaattaatttcaaaaataaaaaccaaaactaaaaatgaatagaaatggcaagacgccggtggttgaggaaatgaataaataaattctcggcgcaagcagtaagtatatgaactaaatttgccaaacttagatctttaaaaaatcccaagaaaaagcatattattcataaaacaattaattgcatgggaaaaatacgaaaaaataataaaaatgaatgtgagaaaaatgtgcggcgcgacacggagccaaatttggcacacaaatattattatattgcgcaacaaattcatgcgaaaaacatgctgcaacacatgtgtaatgcaatgccatgattagtcagtctatcacaaatgtttacaaattaggaagaaaagaggtaattaaaattaatgtaaaatgcaaaaaaaaaattttttgaattattaacaataagaaactaataaaaaataaaggcgctacttgcaaagtataaaattgttctcgtaagttttccggttcatgatcaagaacctgacaaatatttcaacacattacgaatctctcgaacctaattgaacaaaaaacgaaatttggcataattgattatttttattttttcgatttcgagttagggattaggaattggtcaacattaatgtccgatttgtgatcagagaccacaaaaacctaaataataacctgatcaaagaagaaattaaaaactgatattttgttaataatttaaaaaatagtaataataataattgaattattatttaatcacaaataagaatttttcaaaaaaaaaattgtctcatttttttccaaaataattagtaaataattatgggctgaccatccgccgcccctcgccactatatatttttgtttacaagactgaaaaatgttttgttgtgcttttggactttggttgttctttgcagctaacaaaaatatgagtagataaaatttggtcattgttcaaaaaagcgtatttttttggacaaacgattaactaatgcatttaattagtttaaaaaaatagattattattaaaaaaatataattaatttatccaattctaatttaagaaaagaaatccatttacatttccattacaagcagtttttgttccttcaagatttaattttaataaatattaatataaatttgatcaaaaaacatttttttggg

SEQ ID NO: 7648 - DNA, 1942 bp, Heterodera glycines
  misc_feature (1888)..(1888): n is a, c, g, or t
taaataatttattttaaaattttttagaaatataaataatttaaaaaattaatatttaaaatcttttacatatattattttaaattaaacaaatgttatccttccgcccacctttatatgcgaacaaggcttctcaatgtactagcaaaaagttatgaataacaacacccaaattaggcattaattaattaattttcatcaatcactaataatggtagacttaattgcgaaaaaatttaataaatgccaaactttgtgggaaagcttcttttttggcattttgttccccgccggcggaagggatttttttttctgttatttatcccacttatccgtcccggtgaatattaattaattaccgcagcccaaaatatacatgaaggtgaagcacaatcttttcaacattttaatatgcattattatgagagagcttgttttggtgggcgcaaatgtcaccgtccgcgccctggcggcggcgacggcggcggcgccaatgaaaggcttaaaattgcatgcgatgaaaaaaaaacaaaaaaaaattggcaattagaaaatcggaaaaatatcataaaattcaaactcattaaaagcggacaaaatgtcatcaaaactaaaaatggagaagccactacctttaccaaatttcaattaaaccaaaattaaaaaaaaaagttttttttaatgagttggacaaaatttggtaaagatggctgaattttttgagagtttcaactagaaaatgccacaagaaagcaatttattggaaataattattaaaaacatttttctgtctctattgtacaaaaaattattatttaaaaaatattaatcattttttaataaattagtaaacaacacttgaactaataaaaaagtggtggattgttggaggtttttatttgcaatttgcattacacaattaaatgcttttgcattatcatgaaaaataatctgatttttgatcggtttctgaacaaagagtggagagaaagaaaaaaaattgttgctaaacaaatgggcccaacaaataattaattaattaattaattaatatgtacacattctgagaaacgcgaacaatcaatttttgcacgtgaatttgtttttattgttttctttaaatcgcgtgtttataagaatttaaaaaaaattgaaaatttattttgtttaatttagttgagaaatattttatttggctccagaacagtatttattgtaaggattaagcaagcggacagttcaaatttatttaatttttttaattttgaatattttataactcaaaaaattattaatttatttgttaatactactaaaaaggaaatgtttttgaaagaaataaaaaactaggtctagtccttatacataatcagaaaaaagtgacgcacttacaaattagtgtaaattaaaaaaaaagaaatgccacgacccgggattgaaccggggacctttagatcttcagtctaacgctctcccaactgagctatcatggcgacaagagtttggcctaaaagaagaaataaaaataatttaaaaaggaagtgcgaatggtgatggcctaatagcttaccattttatacaacaatttattctattgacagtattgaacatattgtggattttgcatttcgcaatcgcgacatttgggtattctttaagaattaatgagctggattttattattcaaaatatatttacgcggggttttcgtggtcactgatcacaaatccaacttccattttgaccaattccgaatcccttccgaatcaaaactctaacaaaaatacggaaaattatttttcgattttgatttatgtccaagtttaggtcagtgaattttgaattggttgaaatactggttcacaactagagccgattttggatccanaaattatgaatgccctgaagtctgttggactggtaaaaaaaatgatgataaaat

SEQ ID NO: 7649 - DNA, 1450 bp, Heterodera glycines
tgaattaaagttaattttattattggtcattgatagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaatggggtttaaaacttaaaaatgcatattttttattgttgttcgttgtatcaaaaacacctccaagtttgccaaatttcgaaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgtttaaaaaattttttatgaattaaagttaattttattcctagtcattgatgtgtagtgtggtgtagtggttagtgaatcaaccttgacattactttctgtcgtgagttcgattcaggttgacggtttcttttttaatttatttttttaattttaaaattcacctggcgctgcctatcggcatcgcacgcccaaaaattcgtaaatcttattaaaaaaattctctaaaaattgcaaaacctatcattttttggacaaaatctattaacattcccggcggcgcctatctgcaccgccggacctctacgctcgcacattcaccaagttttttttttttggaaaaatgtgcctcaagaaaatatgttacaaatctgagttccaattttgagtaaatcatgataatttaatatattaaaaaacaaaaatttatcgtaaaaatcttatttttttgtaaacatctgttagaaatcgagcttaaatttcaaaattcgccaggcggcctatcggcacctccggccccccaaaaacctattttttcttaaaaaattagccaaaaatctctaaaatttggtaattctttagacaaaatctgtgtaatttatgccaaaaggaattgaattgaggcgatacattgactaaaggaatgtggagccatcacatcattcataaaaaattaattttttgtaaaattttttggagttaattcaaatcaaacccccgcccccgtccccgcgggggcggaattatcgcgcccccgt

SEQ ID NO: 7650 - DNA, 1762 bp, Heterodera glycines
agcttagaaaaagcctctaaacatgttaagctttgaatgataccaaaaatgttggatttggatgaccaagaaaaaagttacagaaagttatagtggaaaaacatgctagggcccaaccgtgccggcccaatagtgccggcccaactgaggtaaaccggctaaaattgatgtatgctttaaaaaagcgtcgcaaacagaacgccaaaaatggtcacgccaattaagcaatcattcgaaaattccatcgtacccatttgcgcatcgcaacgattgtttgttacgcctattagtttattatattgtcttaataaccccacaccagcggaacagaactgcttttgtgatcatatcttgtataagtttatgataaactaccatttagtcttgaggattatattcgccgaaaaaattacggtaggcattttttttggaattcctactgaattacatttatcattttaattggacaaaaactcggtcatcaatatacagtaggctatttattaattgatgaataataaccggtttttgattattaaataaaatttaattagcttctaattttaaggagagaaaaataggtataagtaaaggcttcaaaagttataaatttaagagaatattaatttattaaaataaccgtttttttaatttttatttctgttattgggagggttaattttttaaaatttacaaaatttctaaagaggtctttcaaatgcgtaattttcgaaaaacaatttaacaattgcacttagaaagattcaccattgtcaatgagctcaacaaaacaatgctaaaccaggaattggtgccctaattatttgattttttaaatttaaaattatttagtaaaagtgtgttaattagagaaacagaatggactaccgactgtctgccgactgttactcacaaataaatgtgttatctttaaatacataatgttttaatggacgagaaaaaaaaacatataaataattagcagcaaccgtcagcagcgaatgcgaatgttgcgcaggcggtcaaggttagacagcgcaaaagcaaaaaataaataacaaataattaaaaagtcaattaagcataattagtgggggtggggagggaggcaagagaggcgagagccccagcagagatcgcacctttctgtgttcattttgtgcttaatttattaccattatcgcaaacggttttgccgagaaaagagatgataattgttttttgttgtaaatttatgtgttttgtatgggaatggatatgataaagccagccgatcgacggacgaaagcgattgattttgatcatttgtaaggtaattaaataattaatgaattgaacaaaaatgcttttgtgcggtgtattaactcattttagtgtggatttttcaaattttagggattttacccttcgtttttatggacttgctttttgtaattaacggggtggtgggcttcatcccgataaatttgttcatttttatactctaattagttcataaaactgaatattttaatttagttgctattttaaattgataatccacttatctgatcaaaaaacaaattttccatgatcatttagagcctgaaaaaacaacgcaacacttatcagcgctgataggcttatatcaggctgcctggcttggtaaatcttcaaatactgataaacaggcttatacgactgtttattgttagcttggacctagtccaaaaaaaaatctagggccttagcctggagatttcaaatttctgtgctctgacaa

SEQ ID NO: 7651 - DNA, 2248 bp, Heterodera glycines
ccatttaaggaattggggtgtccgtcctgtgagcacttcatccccttaataataaatatataaaaagcagccccctaaaaattggccttcaaaatttcaaaaagtgttttacaaactatgagaaattttccattttttaaactatgaaaattttcccaaagttgatcccaaaaaataaattttcttggacaaaatttttaatctattttctaaaaatgacaattattcaaaataaacaaaaatttgttcaattttatttttccaaaatttttcaggtgactctggttaaataatagcaaattttgaataaataaaatttcaaaaaagccacacacctaaccgccaattaaaacatttgttttccctgaaaattgcgacgaattctggcggaatcataaatatgtatgaccttggccatcagccggcgggaaaaaatgcccggaaatccattcattcattctcccacccgaccagcctgtcttcatgttcagcgcggagttcgttttggtgcccaccaatctctgcccaattttctcccctttttatagtgctaattgagggggttggagaattggaaattgtcaacaaaaaaaaaaattggtgaattgtgggaaggttattgtcctgctatgtgttatgtgatgattgggtaggagagacaggactaaaaaagatttaatatgatttaatttaaaaattcaactccaatttaagaatggttttaattagtatttttgaaaaatctgctgctgggttatttttgggcaaaatgtgtttcaccaaacaaaattgaaaaaacaaaactaaataatgaacaatgaatcattaaaaaataaattggtataagtttgcgatagaattaatttaaatattcgcaatcagtttaataaggaccgatatacaaaaaaaggaaaaaaacattaaaatgcattttcagaaatttgaaataatttgatgaaatttgttattttttaaattcatcattaaaatttttagttttacattaaaagaataaattgaagaaagtgaaaaaaagattttatgaacaaattgaaaaccaaactaccaaatgaaaaattgaattagagaaaacattttggtttaatttctaccaaaacttaatgcaacattcgtcacgaataaaatatataatcaaattttctcgacatgaatttctgtcatggcaattagcgtcaaaatgatttgtcccaaaaagaaaaaaatttcgaataaaaataaccaaattgaaaatgaaatttaattaaattaaaaatattatttatttcgaaaaaggaaaagtgaacaaaaacaattaaaaattgtaaaatatttatacttttatttaataaaaaaataaaaaaagtgatggaaatggtaaaccctttagagaaaattgaatacgatagattaaacaataattaaactgctgctaaagtggtttgcaaaatgttgtacagaaagtgacaaaaacaccaatttttaaacattaatttttattgaagcgaattcttttctcttacacacattgtggaagacacacaaaaatgtgaatcacagcttcacaataaaacgatggaatgttttttaaatttgaaaggtgaaattctcaaattcgttaaagaaattttattttggaaatttcgaaaaatcaatccaaaatactaaagaattaaaagccgattaaaatgggaaaagtaaaattttaagtcaaacaaatagaatttacctaaaatgcgttgggaaagaaaggtatttgcatataaaaaatggaaaataatattttaagaaaaaaaaaataaaaagattttcgagcctcgaatgaaagaggtacaatgaaaatagaaacccaaatataagggttaaaaatttgcaaattcttctaattcataggggggggggggtgtaaaaaataacgtatattttttggcacaaaattcgacaaaaaaatttgccaataaaaaataactaaaaagtaaaaattgagacttaacagagcaaaaaataaaataaaaataaagctctcggccataaactgaggcccaaaacattggacacagagcagtgcaggagagagatttggcggttggattagggacgaggagatacggcttaggggttggttgggctgtgggtaactgctctccaaattgggggacatggggaggtggggggtttctctatgttaaatcctccccactttttgcatagcgtcagataagaaaaatctgactgtttctatcctggtttt

SEQ ID NO: 7652 - DNA, 1308 bp, Heterodera glycines
ttttgagcggttttcaaaatttaaaaaaaatgtgcgtgaaggcactcttttattccaaagaaatggacaatttgcaaaacaagttaattatagttgggattttttgataaaacgaaattatattctaacgtatcagcagggcagtaatttatgactcctggcctttaaattgaaaaaatttgtttttatttgtaagccctaaaataaatcgtcaagaaacaaaatgataatttaacagaaaatatttgacttttgatgaaaccgaaaccttatttatccctccccctaaattttattttttaaattcataccaaattttacatttttttttataaatcctatttttggcttttcaaatcccatatcttacctattttggagtttttctcgctaaaaagattggacaaacttatatgtagagagagcgaagacggctgaacagcgataaaaattgaaaattttgcagattttatctaggccaggagggggggggggggggctgactggccggcaattttaattttaattattttcaagttttttacaaaatgctgagatggttaatgtgattatggtggtggtggtggtggtaagtgctattcgcccccccgccccattcacatcaattaatttgctaaaaataggcaatgttatttgtgtgacatgggggaaacagctgaccccacaaaaaaaaacaacaatgttttctaaaaattggatttttttaaatttcttattttggaaagaggaggagcgacagctgaccaccgaaaattttcaattttcaaattaaatgatttaattaaattttgctggtcagaacggtgattgatgaatgtggttgcttttgaaatttttgccacgtcaactgacagcacagcgaagaaaaggcaaaaaaaaaaaatttttttttttgaatattaagcatttttaaattaattaatacaaaaaaatacaaatgactgttctaaaaaaacaatttttgttcgtataaatgggccttttaaataaaaaaacaaaaatatttgcagataaaaatcacaaaaatgctaaaaaatacaaaataaagttttaaatctaataaatgcaaatatacacaaactccaaaatatgcaaaaaaaggggtcactttcgcttttcgcttatttcacatttcgcattttggcactttcgcttttcgccattttagcattttgccactttcgcttttcgctttttttcgcattttgcatttttttttcaactttcgcttttcgcattccattttaaaagtgaatggtccacccttaatttgcgtacactaatcca

SEQ ID NO: 7653 - DNA, 3194 bp, Heterodera glycines
cgtccttgcagattttcgctggtgtgaaggccgtgatgatcaaagttgccgcgttggggctgacccccaaacatttgggccattcgcttgaacaggtcagaagagaacactaatgacggtgacagcggcgggttgaatataacgatttttttgaaaattcccgaaatttttaaccttttttttacaaattttacatgctttgaatagcaaaaaaaaaagtcgtcgccggagaaaattggggacattcgtacgaaaaatttgttatgttttgaaggtcccaagttcaaatccaacatcaaattaaacaaattttaatgaatgcttaacaaaagtaaataatcttggctgagcaaagagtcgagactctcgcgatgcattaattataaaaattctttaattttcaattatatattttttgtttttccccgcattttgcagatgcgtgcccatttagtgtccatgcatgccaagtatgggctgcacgtgtgcggcgagggcggtgagtatgaaacatttgtgctcgactgtccgatgttcaagcgacaacgcattgtgagagtgtgatgccaatttttaaaaatttatttgggaatttgaaacaaaaattcgttgggggaaatgaattgatgttctattgcttcatggctgggcaaaactaatcaaaaccaacaagaaacgagaataaaacattttcggatccggcctcaaaatttggggtgcaccccaaaatttcgtcgcacgaaatttcgcgggacataatttggccgccaaaaattaaaaaaattaaactttaaaaattttctggatgccaaaaatggcaatggtcaagaattggtgtcccgacgaaaaaaaatgttaaaaatttcatagatattttatctaggcttaaaaaacgagccgatcacgaatctgaattcagattttgaaaatcactgatttttgtctatgatttttatcagctacttgattttttccaaaattttaagaaaatagtctggcataaaaaaactcataaacagatgttgtagagcttaaaaatcgaatgagctattgaatttatggaaaagacaagtttcgatttttaatgattttttgaaattaataattaatccctaggggtcacatgagacgggggcctggggttcgagtccgcttggctgcggtttatttttttatgacacttgatgaaaaatcatagataaaatgaaggttcatgcataatcagtgctcagaatcatgatcagagtattttttaaccccaaattcaaactggcatattttcttgcaattgatttttgatcaaaatgagtaattaattaattgccaattaagtcattgtcttctgatcagtgatcactcaaaaaacattcaaaaattttgtggcgatggcattccgttgtgactgctgcctgttcacctttgcctcatttgggctgctccatgaccatttactctacatgggtgagcaagcattttgtaatgcgtttgtattgtggtctctaaaagtcttgacgaattccgattggaactggacttaattggattttaattacgcaacaccgtggctcgtaattacggagtgtttaatcgattacggaaatccgtaaccccgtaattacgggagtccaaaaaagccttgtatattttcccccaaatttattttcaaacgggtaatgagggctattataccgaacaggggtcggacaatccgtcaataatggataatccttcagtgaacaattaattctcagaaaaaaattttttgagcaccgatcaaagattttcgagaatgattgttaaatttaataaataaaatttcatatttcttaaacattctattatttaataattcgatttaatagattatttatagaaatttcattttttaatataaatttattgacatattgtttactgacgaatgttcgggagccctaattccgacgcccaaaaatttttgaaaatggatttctgctcccaatgcagaaaatgtaattccgaatcatgtctatctttgtaaattgttgcgacagtgtccgcctcgtcgttgtcccatgccacgcattcgttcgtctgtccgttgtgcagcgtgccgtccccgtcgcggtcgtccgctccaccgcaacaacaatttgccagttcatttggttgcgcaagcgtttgccgaacacattgacatggcacacgtggcccaaacaccccacgaaatggtggattgatggctcatcggttaagagccttggacaatctcaccaaagaggcacgggcatttggacgaaagactcactccatttcccactccaaattttttcacggctatcaaaccgctccacagaaattctgacagaatttatttttttttaatgacaacatcaaaatacataataaatgcccagattaagcgatggacaactgcttgctgcttcatctaatgctgatgcgatggcggcgtccacttctgctgctgtttctgtaacggcacggcacggcaaacggaggactgaggaggcagtatcacattgtgtgcttgaaacaactaataattttccagttacaccagaaataatgaattcatttaatgccccgggattccctgttcatgaattaaaattgaagctaaactgtaagataatgcttctaaggaatattagcattgaaaacggactttgtaatggaacaattttacaagttaaagaattaaaaaacaatgtattaaaatgtataatacttggtggtgataaagatggttctgaagcttatattcatagaatttctctaataactgaaagcgaatttcctgttccattaaaaagacatcaatttccggttcgcttagcttttgctgcaacttttataaaaggacaaggtgcaacatataaaaaaattggagttgattggacgagacaaagtttttctcatggtcagacatatgtagttttatcgcgtgttggttcatggcaacaaattaaagttcaattatcacatgaaaatctaaatgcaaaaattgataacattgtatggaaggaaattttataattttattaaacatgaaaatacgaaaaacaattaataataaaatatttggaaaattgaaattgaaaaggagcttttaaggtaagttaatcgccacattaatgaggggggtgtggtgtgtgatagggcgggaccctattgtccctctaactatcacagaa

SEQ ID NO: 7654 - DNA, 3023 bp, Heterodera glycines
tgctaattttatgtaaatacatatttttttcctagattctccttagcctaattagtaggaaaaacactttcttttttgtgtttgcgaacaaaagttgggacttttatttacatattttcgaatttttctacatattacatatgtacatattttggactttttcgtacatatttttcatttttttacatattttgaggatttttgagaatttatagaaattttttataaaaaatttaaaaatttttttttgaaaatgtatctctaaaaaatcgatttttttcaaaaaatgatatatcaaaaattaatttgtaaaatattcaaatgtgattctaagcctattttgttcatttttttggcattttgtgcctatttcactttttacgaagaatttttttccaaaaaataaccattaaaaaaattttatttacatattttagtacatatttgggggtttttgtacatatttcacacatattttagcattttttatacatattttatttacatatttcgcaaattttgttacataaaattagcatccctactgatcactatttcaaattcattttttttcaatttatatggctgtataatttcctattttcattttaacaaaacctcaataaagtttttaaattatattattttattttataattagatttgttagttatcttgaataaagaaaaattttttaattcacttttgcgtaaataaatgaaaaataaataatgggcttttaattctcatttgaacatttaattcaagaaagacgcaatgttttattcttttattttcgtaattgttattgctcatcattttctaattccattttcaaatgcaaaacaatcggcgagtcaatttaatcagggaataataatttgtctgatcatttttaattaggtggaagataaaatgctaattgcttttgtggcaaatgatcagaaaatgcaaatcagtgaatattctgtgcaaaaatatgaggcataccttggcattatgtattatatgagaaagaattggcactgtgacaaaataacagatgaatttgaagaacatgaacggacagaatgccaaatatttcaaaattatttgaacattttatacgaatatttgttcagagagtatggcgaaattccaagagtgaagccaaaatttgtatttaaaaatgaaattcaaattgaaggaaaccaaatttaaattgaaggaccaataatttatgctttgaattgtttggttagaatttcacagttttattttataaaaacagtgggacaagaagataaacataagttaaaaaaaatcttcaataatttgggaaaatttgaaccaaaattgttgaatgaggagagattaaattatgaatttaatttgaaagatgaataaaaaatgccaattaatgaaatgattttgcaattggaaattgaatcagcgaatgaatgtcaatctaatgaaaatttagacggaataatccaagaaaaatttggaggaaatgttcaaaaaagcagaagaaagggaaaaaaagaccgtttatggagagcaaatgaaataaatgatgacaaacattggataattttggaatcgaaattcgattatatatatatatatatatatatgggtgagaattaatagaattaacatttaatggaaattaactaaattcaaattaagattgaagatgctctatttttggaatttgtcaaaggattagtgacaaattttgataaattttttgaattacctagagaatattctaagggtttgatgcaaaaatataaaggcaaccttgacgttttgtatttaatgcgtgagaattggcactgtgaaaaaattggtaaggaatttaaagaaaacgaaatgacagaatgccaaaaatatcggaattatgtgaacatttatatgaatatttattccggctttatgttgaaggtttgttgagttttacatagtaaagcgggaccgggatgagaattcccggtcctccgaggtcccggttcccggtcccagattttgcaaagcccatgtcctggccccggtagggtcggcccaaccgggaaaaacatgcactggtaagaatgtgagtctgagcaaaaaatcaatgagcgaaattggggaaaaggaaaatttttgataaaaataatttaataatatttattaaagttatattttcaaatgcacaaatggtctagtggttaattaaaaaagcagccttttttgttgcaaatttgttaaaaaattgtactcaaattttcaaaattttcccgacggcaccttttggcaccgccggacccacttctttcccaaaagttttttggaaaaagcgtgccgaaataaatgatgtagaaaaccaaaaaaaaaaggttgtcgattagggcggtggtatcccctcaaaaaaaaaaaaattctgggatcgcccctgacctctggaccacaacatcttccctaattataaaaaacgattcaaatcccaaagtttggcgaaatttggaataatttctgtcaacaaatatattaaaacttcaaagattttttacggaagtgccgacaggcactgcatccctcgcctacatagcattattgaaaaataccgaactttctgaagttttcaggaaatttttttcgattttgcaaatcagggttggcagatgaaaattttcaaaagcctcattttgagtcaaaaagcctcatttttacaaaatttattcaaaacacgcttaatatgttcaaatgattgtccaaaattttcagtaaatttttttgaaattttaagcaattttcttaatttttacagtcaatattaaaatggtatattagatccttctcctgacatggacttattccaataaaagaggaaacatttatttttataaaaatgaattttttttaatttgttgatttgatttgttaaacttatttaatattaaattttttgcccataaatattttaaaatttgtcactttttctcaaaaaaaaagttttaatgtttttggtattaattaacccacaaaattctgcacagatt

SEQ ID NO: 7655 - DNA, 2596 bp, Heterodera glycines
  misc_feature (25)..(25): n is a, c, g, or t
  misc_feature (118)..(118): n is a, c, g, or t
  misc_feature (150)..(150): n is a, c, g, or t
  misc_feature (158)..(158): n is a, c, g, or t
ttttttacacctttattttaatcanctaattaaatttgaaaggcggtacacgtccaccattctggcataccggttgtaaaccgtgggttcgaaatttttcgagcaaaccgacactgtnttcttcgtaaaattggtttgtgatcacatttntaggactntaatatttatatttttagatcgaaattgctctggatttcgaattggcttgcgcaaaaaggaacctccctggtggagagctcttcattcagttcagcttcaaagatgaccaactgctggatcctcaatacttcaccgactttgtgcactacttgtgctttgggcgctcgggcacaattacaacgacgagaatcatcacatttgcggcagtaagcgtggataatttaatcataaaaaattgttattgctatttaagtcagctcaaatcggtgagcttttcggcattctgctcaattatgcattgagtagcgcaaatccgctgaccatgaagaagcgaactgcgggaggttatctgtctcgtcagcattttccaccgatcctcaagctcactgccactgagatggcatcgcggggagctggactgttggtgcgcaccgacggaatggaaatgtatcgattgatgaacccctaccaccaaaatgatgttggctatctgattgtcattgaaagatctaggcaccctggctcgttttatttcaatttttcagttgagtaattctcgtacaaatgttaacaatttattattttgcgtaataaaatatcacgtacatatcggggcttgcacaattattaagcacgttaagaaagtgggtaaacgagtctccttgggacatgtggtaaatgaaaacaatgcaatgtgcggcacacgtagacactaaaggggactggaatgggcaagaattcttccttaatccttcggggaatttggtcaaaaaagatgatgtaatggctggcgggatggactgagcaagactatcataatagagcactggcgcacccaattccttcgcgtaaatagcgcaccaatgagagccctccctgtggtgggggtctcggttcacatcgagtgctgcggggtcctctagtggggagtagtcccgacaactggtctctgattgcagcagcatcagaaatacaaactctgtctagtctggagtaagtgatgatctacatggcatcaatgcttagtatgaatcaacatattatgaacaccgcgccggagaatcatggagtacgtattttgatacatataaagccttattttgtaaaaacaatttttcaaaaatgtttgaatttcgggttagggatccggaaattcgtcaaatagagttcatattcatgattagcggccccggaaacccctggaaacagcttttttatcattaaaaacaagattttatgtgggtcaaactgtataagtaccgcaatctgaggcgccgagcatgaatccggccttattttgactcagtttcgaaccataaacccggactcgaacattcttcgaaaattaattttttttttttttaattttagaaaattgtttttaggggcaatctgaggcgccgagcatgaatccggccttattttgactcagtttcgaaccataaacccggcggactcgaacatttttcgaaaattaaatttttttttttttttttttgcaaatattgctaaggcgttgattgaattgtgcaacaatatgagttaacttaagggacccaaatgtgcatcacgcattcacaaggtaaaaatgggaagtctgatcgatactgttgtcgaatgcagccaatgtctttttcccattgaactgtctccacatgtattcatcgcaataaataggcaataagttctacaattcaatcatgcccttacttagcaatatctgcaaaaaatatttttttaattttcgaaaaatgccgtatccgggttcggggttcgaaactgagtgaaaaacaaggccggattcgtgctcggcgcctcagattactcctaaaaacaattttctcaaatttttgtaaaaacaaattttcgggaccaattgccgaggatttctagttttttaactattttttctgcagctttatttagatgggaaatcacgaaaaacacatttttagctcggcaattcttcgttttaatgccactattcatcactaggaatcactattttggagctttgccactaaaaaaaattattttggaagttggccactaaaataattttttgccactattatggcgttttgtcattatttttgccactattttggcattttttggaaatttaccaaaaaaaatgcaataaaaaacgaaagatacacccaagaatcgacctaaaaaattcaaaaaaacacccctaagaattggaaaaatttcacaaaaattcttcccccaaattttttttcttgttcaatatttgctaagaaaatattttgtaactgcaatcagtgaataaaatggtttgccttaattttaaattattttcaaattaaaaaacagctgtttaaaaaattacacccctaaatttagaactttttcgccactatttttgccactattttggcatttttttctcactatttagttaattattttgggg

SEQ ID NO: 7656 - DNA, 3771 bp, Heterodera glycines
aattcggagtttaaaatctgagtaaccgccgaccatgcttccttttgcattcggcctgcgtcagcatggcgtgagcccgggaaaagttggtcttttcgagcttggataagctcaagcaaacgggcattcatttcggaagaaaacactatttgggaattgataaaaagacgtgaaaacattagcatgaatatgacaaattttgacaaatttcttattcgaacagaaatccgaaatttattttattttttcggttttcgcctttgttaaaatttagattatggactcggaattgggttaaataggtgtcagatttttgatcaatgatcacaaaaactctcgggaatgttatttatcacaaaaacccctctatgttttgttttttcggggtgtcccaaaaatgtcggttggtcccccgccctgcaaaaaaaaaattgttcccctcgaattttttcttctgttacggactgcatttgctgttgctcgttcgccgcttcctgtgacgctaaaagcagcaaaacatattaataaatataacgaaacaatgaacaaaagggcgacagtaaaaatcaattatgtaaaaataaaaaatttgtttaaatttggaaaaaacatttcattcttgagcacttagtttgagcgctttattaaaacatttttaatttcactaaacgatttttgtggaaaatttttttttttgtaattttgaaaaaaggccattaatacaagggggcattcatgactttttgaaaaatgcccaaatatgcaaataaaatatagatttaagtgctgctgaggacggactcccattttggcacaaacactggccaaaaataaaaatggattaatgaactcaccgactgttcaacgttcagtggcgactggtacgcgccaaaaaggtttaaattccctgttgagttcaactaaaagaatttgtgatgaaacgttgaagaaggctcatgaatttctgtcacccaccaagtgccgtgtgaaaatgggagaacagaagcggcacttcgttcaaaatggcatgtttggtaattaaaacaaaaataagctggtgttggaaaataataattgtactgatcatgaaaggcttggtcttagaaattcactcattttactctgttttggtatacacagaataacaaaatggttatttttaccaaaacttttttataaaatggtccattttggtgctaaataaattcaattttttttttgccaaacaaaatgcatttttatctaaaaaattttctcttcgtacccaaataacaattctgtaaatgtccttgtcctccctctccttgatcggtgtgatgtaacatcccctctccacgtcatgacaaacattgcacagccggcaaaacatatcaccacattcatgcagcttcttcgggttatgcagataggttttgctgcatataacacatcgcctccacagtttgcaagtttggtgtccctgatggtaatcgaagcattgccggttatagaagaagcggtggcaatggggacactcaagcttcactccaacatctttcacacacggcactcccccaactttgttgcaataataacaccgggctctgcactcgtacgtatgtttgcttcccgtccaataaaaacactcgcagtccacgcaaaactttctcccccggttgaagaagctcacgtagttcttcagcccatcccagtgctttccctccaaaaatatcggtaccaccttctcccgggccatcgggcccttccacagcacgcgaatcgatttcttcggatccgcagatttctcaaatgccacaatcctgtactttcccggattcaaatcgtcctaaaattacttttatttttctcatcatttctccaaaactaacccaatgagcctgaaccatcaccaaatgctcaagtccatagccactttcattcctctgcactcccgaatttagcaaaagttcaaacgctgcctccctctgcctcgaaatattctttataaaacgttgaaaagcgaatcgatccatcatcagataattcttcgccaccaccagcgcatagaataagcaaaatttgtcattgttctctatcctcaattttttaatttttttattttgttttttttcttttattgattaaaatttatctatgcaacttaatccgctgtttctccttgaaaccaaaatcaaatttgtgcacatttcgcggtccctctccagctggcagcgctacacaggtaaccttcatctttattgattccgaaagcagaattgttcttttgtcctcctccccttcttctcctccgctctgccccaatttattgatttcctccatgacaacatccgcgttgttttgggggaagggtcggtacggcagccaaattgggtgtccaagtccagcagtcaatgccacgccaaacattttcactttgcgccccattgtctcctccgtcttcgatatggaattctttatcatcatatcgatcgcttctcgcagtgtttcatcggggcgctccacatccgggttgatcacaaattccgttatgtttttcgcattttgtagtttggtggtcaataagtttaaagggctccatcgggaaattatttctaaaacggattagctatttatatgttattgcttattaaacttacccaattgagcggaagtcccattttttggccattggcacggcggtgggttgggcagagttcacgcgtttaaaagacatttttaaaaaccaaaacgcgaaattgaagaagagtaatagaaaagagcagagagatttaaagaaaatagacggcagaaaaataatagtagattggaaataaaatgtagaaaaaatagagcggagtaaaataaattagagcgcaaagagagtttaatgaaatccaactatttagttgaatgatttacgatttgggccgggtgtacgaattgggggaaaggggaggggtctagtcacgtgactgtctgggtctaccttaatttagagggtcatcaatcattttagtagacaactgtcacattttattcaaaaactgcaaaaaaatcgtctggatattctttatttcgaaagtcgtcaatcattttttttgtgacagttgacccaaataatgcgcatattgtgaaatagttggtccaaaaactaaaagtcacgtgcacattacaaaataaagggtggaaattgcgaaataaggaaccaatcaatcattttttattgacagttttattcaaaacggtgcaaaaaaaatcgcctggcgaaattttttatgcataatttaatgccttatttcttgagtcatcaatcattttttttttgacagctttgaccatttattttaaatgggcaaaaaaaaagagtcatgcaaaaaaatatttcgcaatcgtcaaaacaaaaagaattacgaaattgttaggtaaaattcttttattatgaccttataacatgtacttaaattacattccaaatgcactactaaaaattcggtagttttcactcacaaacatttgaccttcacgcgggggaggggttggggagggggggtaaatatgtttataaatatttaaatttcctatattaattgcatatttaaaattgtttttaaatttataaatttttcacaagtttccttctatttgtcttttttttaattttaattatgcgtcattaacatgtaacgattaatgaccatcgcgcggggcgacggaacgggcggcgggagggagagatgggagggacgggggagagacgtaaaaatacacttaaaatatttaaatttgtcataa

SEQ ID NO: 7657 - DNA, 2480 bp, Heterodera glycines
tcgcccggtgggactcgaacccacgaccccagcaatccgtgccgtgctctaaccaactgagctacgggcgctacttttagaggttctctcaggtcctttatcccactttctaccacactccgttccttctggcatcacattccgcctccctcggaagaccggtccctcgggctctccttggcacttcaccgacggacttggactctccttggtccagtggtcccggcagtgtggaggggatccgcccaggagcgccatgtagaacataaaaggtaactcgcccggtgggactcgaacccacgaccccagcaatccgtgccgtgctctaaccaactgagctacgggcgctaattttagaggttctctcaggtcctttatccactttctcccatactccgttccttctggcatcacacttgctcttgtccatggcatactctaccccttggtagagtattatgttttcggtgagaaatgtcacttcctacaaattgtaatttaaaatgtcaccccctccccatgttttaaagcagcagcagatggtcaagctcggggcaagcacggagaagcagcagaagaggagggcagagaagcaggggggacagccacagcagaggaggagggcagaggagaagcagcagaagaaaaaaattgttaaatttgtattgaattctcatcaaaaaaaaacattaattttgaaaaatgaaaagaaaaataaatacttgggggggggtaacttttccattgcaaaaataatgaacagaaccaagaacccaacccactgtaccaacgcatatgttaaccaaattgaacaaaaaagaacctaaaatttatataatataagtttaccaagagccaattattagaggtgtaaaaaagtcttggtctcgcgtctcgaaagtctcaaataccgagaccgagaatgaaaacccgaggagactcgagaccgagaccaaaaaaaccagagacttttctcaagtcgagactcgagaccgagagtcttgaacagcaatattaattacattcacttatttaaccaatggagctgaccagagtcgtaaaaaacagatagcgttgtcagggcgactttaataatgttgttgttgcacagcacacggcaaagcacaacagcccaaagcaaacataaaacacaatgccgaagaaaaattatcgtttaatttcaaattaaaataggcgaggacaatcaatattgctgacgacagcataaactaactactactaacaaaatcacaaacaaaaatgacattaaatttaaacaacaaaatgccaaacatattttaaatcaacaatgatatcacatcctcgccctctaagaagcgatgtcctcagcgctttgggctcattttccatcggttttgcgtcctttcacttcgtcggtgctactcattgagcctttactttttcaaattcgtccacactttgacttttgcttcgacactgcaccggcgaacaaaactaacgtagcaacaattgaatttaaaaacaattcggaattttcggtcgggttttcctcattctttcctccttttacataacatgacgacgacgaaatgtgcggtcgattggacactttcaatttagttccagcttccgtgttcgttcgttgtgccggtggttgattagacaacttaaaatcattcggtttcttctcgccttctgaatttttcgaaaatcggcgcctttttcacaaaattttgatgttgtggcggattttgtggacagtcgaaatgcttcggtccaaagtaaattcaacaattgcgagatatatgcccagctttgttgcagttgtagcaaactatcggcttcgtccttggcattaggaaatttcgcggctgaaaagtcgttttctgcctaaaattcggccggcgctcatttccagactcggccgacttagtggccttttgcactacctctgctcgaactgcgagagcgacgaaactgtcgaagctcatgcctggacggagagctatttccaatccaaccgaaatttcctgatttcccatcgcacgaattaagtgctttatcgcaaaatcgctgacaaagctcggcggcaaacctgggtaagcgcgttcaacaatcccataaagtcgttccgcaaattcgtccaacgcttccgctcttcgcttcactccttcccacaattcattgaatgcctggatttcggtacaatcccattcgctcaaaatatcttccattccgcggcaaaattcgttgaaattttccgggcagtgtttcatggcggcgtcaaaagcacgctctgcttttccactgattttgctttccaacgctgaaatgcggcgactttccggcaattcttctgttgccgacgaaaattttttgaagaatttttgtattttgttcggtccttcgttccattcagctcagggagtcgttccattgtgagcacaaattccaacgtgccaacatgctgtccttgtttttgctgctgttccatacaa

SEQ ID NO: 7658 - DNA, 881 bp, Heterodera glycines
gggggggggtgatggaggagggcatggaagcagatgtgatgaagggggggtgacagatgagaatgggggcagatgttaaaaatgggagtgggggggggggcttttcatcatatgcttacagacattccatcaaactgacatttcgcctacacacccccaaattgacaaattgccaaaaaatttatttaaaacaaattacaaaaaatgtttttttttcttatgaaccccggggtctttaataatttcatctgttccccatttcatattcaaccatgcacaacagcgtccaattcttgtattggcacatccaacacgcctacagatgaagacgcggccaccagaccccggcaaattgggatggggagggcgggacttgtgtaggcatactctaccccttggtagagtattatgttttcggtgagaaatatcacttcctacaaattgtaatttaaaatgtcaccccctccccatgttttaaagcagcagcagatggtcaagctcggggcaagcacggagaagcagcagcagcagggtttggaggagcagcaacgggagaggggggtcgggaagcagcagcatgctcgccgtcgtcctcggctttttgttgtactgcttgaacttgttggcagtttttttgcggtttgctggtgtcggcccccactactcaccgtcaacatcatcagtgcttaactctgcccaaaaaatgattatataaaagttgaaagggattgccgacgagaaaggaaaatttttcaaacatacaaaactgtttggatttaattaccccaagttgggagcttttttctatatgcttaatgaatgtcgtggcgcaaatgccgattcgtatattataaaattattaaacaatgtatttgaaattt

SEQ ID NO: 7659 - DNA, 2612 bp, Heterodera glycines
  misc_feature (28)..(28): n is a, c, g, or t
agaagactttatttttttcttacaattntgggaaaaaatcatgtgaaatcaaatgattggaaaatgcttatcagcagagtggttccgcaagccaaaaaagaattgccggaatgcggaattttcggtgccaaaaagtcggttacgtcactggcaaatacctataaattttaggacctaagtaaatttttctccgaaatttttgttccatccttttcaatgtttgggccattctctgttggaagcaaatgcacaaattggcgtttaattagccgaaaaatgttgtgtgttccccccccccccaaagtgcaggtgcccaaattaattttcgcgcacaattcctcccccccccgcccgaggggccacaattgtgccaattcaaatgccccggaaatccattacggtgtggagggaggggggggggaattggcaacggcacatgcccctggggggaggggaaaatttggaacaaattaattattatgaaaataaacaaacattttcttaaaaattagcattttagctttgctatttattttatgttttgtttcgggtcatttaaatgatttttgaatttattaattttatttttcattttttgtattcgttattttaattccttttaaaattttttgagtattttcactttttctagataaatttcggtgtttatccaattccccgctcacttaattgtaattaattttgtatatttatttgcaatttatttgttgcaatttccaaaatgacatgaaaagtgatgatgcaaaaagtgccgatgccgtcgctcggatggcatttcgaattccgtcgcctttcgccgtcgccgcgttgcaaaagtcgccgaagcaccagcaggtggactcctcgacggagctgaactcgtccagacagaccaacgcgcgttgcgtgtgtttgcattcagtgttgaaggcgacggacgacgaactgtcggaggagggagtggggccaccaacggacgaatcgaacatctgaaaagatcagggggagtgaatttcatcgagaatagaaaaggaaaaaagccgagatagagaaatgagaggggacgagacaccccaagaaaaagccgagacagagaaatgagaggggacgagacaccccaagaaaaagccgagacagagaaatgagagaagccgagacagagaaatgagagaagccgagacagagaaatgagacgaattcgaatttctcgactcgagaatctcgtacatcccttatcaaatttggcctaacaaaaagcattgtcccgccgaccaatgcttttcgcaattccttccgccgccgtttcgctttccccgtgccattcgatgctcacccgttcgtagcatcctctgatggtggcgtatgaaaggacgcccgaattgttcagcgtctgctgccatttgaagcaagcgccctgacattcgatggcacttttttcccgaattacccacgtgtccgagtcgcacatcgaatcgaacagacgcggctcgcgcacgcgccccgggggtccgcggctgcgcgtgaggaaattctggggacaaaaagcggaggagtaatgagaaggacggctaacaatggtgcggcttttcgaaattttttttccatttaattaatttgaaaggtttaaaacagagaaaagcggcaattaaggacaaagggacggtaattaccgttttcatgtgctaacataagtcaaaaggctagcaaatgagcaccaagaaccagaacctatcaagcatagttttagtatttatatttgtctttttcttttaaatattatttttaaacaataaattcaaaacattaatatacaaacatatttaaaaatgatttctgggattgcccacgggcggttaggggggcttatatacattaattaattagcttcaaagttcgagtttttgaagcctcaaaatacccccccccccggctaaactcacttctttcatattgtccgatgcgcaactgtagcagcgatctgaggtgaaaatccctttctttgcctttcccttaaaaagtttcactgacttttggccgggacaaactgtgcgaatgtcgcagaaagtgagaaaagtgcggagagaatgaaaatcataggaatattaagcgaatggaactgttccaagtgttgcgtttttgaaggacacatttcgtcgtcccccaaaaggcactttcagaagaagaaaattttagtgagaagagagataatgggatttggaacagccaaaattaaataataaattgcattttaacatttcccgattataaaatatgtagaccaaatatttttggagagaagaataaaaatggtatttaatgctctcattctgcgaattttttctggtcacgggcctatacatatttgtggtcttattaaatgaatattttatacctaaaacctttaaattttttaaatttcccctactgacgtaataaattaattatagaaattttgatgaattcggtccaaaaccgacacccccccccccgaccggcgggggaaaagtggttgctattctgaacaactgacaaaaaaaactgaagggaaggggggggggggggggggccgcctccttccccctgggggaaaacgggaaaaaaaaaataaaaag

SEQ ID NO: 7660 - DNA, 4537 bp, Heterodera glycines
cccccccccccgaccggcgggggaaaagtggttgctattctgaacaactgacaacaaaaaactgagggggaaggggggggggggtggtcgtctccatccactgggtaaacgggagaaaagagtaaaaggacagaggcgggagggaaggaacgattgatggagaaataagtgatgagaaagtggggcgggggaggggggccaaacactgcggcagctaacgcaagcaaaacggaggagatttgcacctcccccgcctttgtttaccatcgtatcagtccattcactctctcattccttagagccaagggaaagagtcgccggaggggaaagggacggaaagaaaacgaagggacgacgatcaatgtgttttgtgccttcggcggatcgccttccattgtatagaaagcgtctctgctgctcgattgtagaacttaagcgatacgaacgacggcaatactctccaaaaaattgataatgcatttatagaaattccatcaaacaccctttggtcgaaaattatagtcggtaatcatgtaaatttcggcaattgatcaattccacgggacggtcgttcgcggtcagcagacccgctcaaaaagcaaggcaattccctggccacctccgatgcacgcggagccaatggcatagcgagcattgcgacgcctaaacaaaatgggaaaaataagttgaaaaacacaaattattttgggcgaaaacggagaatttaaaaaataaataaaaaaaataataataaaggtgctatttacttgagctcgtgtgtcaaatgggccgtgattcgagcgccagacgcgccgagggggtggccaagcgcaatggcaccgccatgaacattcagacgatccgattccaagcccaattccttctgaaacgaattttaaaaccattgaaaagataaaatataaaaatttacaaatgttttaaagctaaatgtatgaaataagatgtatttttaatttgacctgaacggcgagcacttgcggagcaaaagcctcgttgacctgaaaatggtttataaaaatctattacaacttttctaccccctcaacctcgacaatgtccactttgtccaacgcaatgcccgtctttttgcatagtcctcggattgcctccaccggcccaatgcccataattgtggggtcacagccgaccgcgtgccaccccaacaaacgcaccaacgggtccaaatggtacttggacacactttcctcgtccgccacaacgacagcagccgcaccgtcgcaaacgccctaaaaaccgaaagattacgactttctatactaggcaccgaaggccactttactgaaaattacaataataatgaaaatatcaaataataaccgaccgacgcattgcccgcgttgacgaggccgtccttcttgaagacgggcttcagcttggccatttgctcggcggtgctttcccgcgggtgttcgtccacatcgaacagtttctcctcgccgcgtttgccctgcaatttgaccggcacaatttcggacttgaaatagccggcattgtttgctgaaatgaaaggacaaatattttaagcttcaaaagaatcggaaatatcaggcaaaatacgaatgagtttgaagaaattgacgtaagtcaaatgcttaccgagtctccagcggttttgcgaccgaatggcataagcgtcggcctcctctcgtgtcacattgtatttggcacccaaattctctgcagtgattcccatcggcatgttcgcgtgcgcgtcggtaagtccttgccaaagcacgtcttcgaactgaaatcgatattgaattgaaaaaacccttccccaaagctggacctcaatcttggcaccgagctgtgtgccgaagcgagcgccgcgcactgcgaacggcgcctgactcatcgactcagttccacccgccaaaacaacctaaaaacgaaaaacaaagtaacagcccacgtctccacaaaattttttgtttttattttgccaacctttgagtcacccgcgaggatttgctgaaaaacaaagcgaaaataacttttttccatttggtcgctcctacttggcctccctgcgcaatcgcctcgaagcccgagccgcaaagcctgttaacagtaacggcagggacatggacgggaacgccaactcggaggccgatgtgacgggccaaataagccgcgtccttcgacgattggatgacattgcctgaaggtaatagttaagccatagtcagctgatgttagagtaaaaaatggaaccgaaaataacgtgatcgatgtgctcagccgcgattgaggacgatttaagcgccgcagcggccgcaatttcgcccaaatcggtggctgtgtgatttttcagtgagccgccaaaggcaccgaaagcgcagcgctttgcactcacaatgaaaattccttgaatttgttgcaaaataaaaatttctcagttttgtggataaaaacctgctttagtggccatagcggcgattttttcaagttgcaaaagaaatttgtagtaattgaattacctaaatatttattgttttcacttaaaaataaagaaaaaatgagtaataattagggaagtaataataggtactaagtgcttgtttcgacagtgtgatatttcgaccaattctaaatccttgaattcgaacaaaaagtcgaaaattcaagcttttcgattttcgaattctcgatctaaaaatactctaaatgaaaattttttaaagcaatgatgactttcactttattttcgtgcacttgaacaaagtttgaaccaaaatatgaaatttcgaacatttgattttttggctttttgttcgaattagggttaggggttcggaattgaccaaaaatcaggccggattcgtactcagcgccccaaaggagccctagaaacatgtttttagaattttcagaaaagtttcaaaaaaaatttttggggaccagtaaaacatatgattgcctttgatttcgacagcaaatgaattccacaataattattgatttcgattatccaaaatccaataaaaggttttatgtacaatttaaattcctatctatcgaatacataataaataccaatttattatcttattatcgacagaagtgagtgaggtcattaaccagcagaggttgacgcgttacgcgataaataacgagatttggataagagcgccgatgctgcccccccccctgccccccccccctttttagaaaaaatttcaaaacatgctacagctagggatatgcggatttttaaccttagcattgtgaatatgaacatgagaggccaaaattgaaacggtgtgttcaagatagaagtttcaaccccaattaaaaactcgtttttcgttcgtacatattaggccgtacattcttaggggtggaactttcgcattttgcgccaaaaagcgaaatgcgaaacgccaaaaaatgcgaaaggcgaaatgcgaaacctaggcccatccctggttcacacgaccataaaaaaaagacacgaccataaaattttggcaactttaatgcaacataactttttcaagaagcatccaaattaaacattcttagtatcattcgatagccctaagcgtttagcatgcaaaatctcaaaaaaaaattttgggtttcaaaaaagttatggccaaaaatacttataaaaccggattttggttaaaaatcggcttaaatgtaaggaaaacagaaaagtaattaatagggctggcaaaaatatgcacatgcatatttttttcctggactgtgggaggcctgaaacgcacgaaaaccatgtttttagcttgttttgaagcttctaggatgactttccatatgcatattttgcatatttgtgcatatttcgcgatttatgtgcatatttgcatatttgtgcatattttggcatttcgtgcatattttatgtgcatattttggcgtttttccaaaaaacctctaatagatcggcccccaacagacaaattgacctttttgacctcaaaaaccggaaaattttccaaaaaaataatttttttagcaaaattttcacgaaaaatattaaataaataaattttctcaaaaaatggttaatttatgtcaaaaataagcaaaattttgcttttcaggttgattttcgctaaaatgagtaaattttaagctgtatcgtgtttttttctcctaaaatgctttttaataccacatttagccatttttgaagattttactttatgtttaacaaatttgaagaaattttgagaaattacaccctcaattggaaaattttatgtgcatatttcacgatttttggtgcatattttatgcgcatattttgcgattttatgtgcatatttttgcaaaccctagttattaatgcttaaataaaaactcctaaaccgaatttttagaccaaatgcgaaaaattgaattttcggcgctatactaaaagtgggcctttttgaaacaaaaggggggacccttttgttttgcaaaatttttttaagataaaaaaccatgataattttttatcccggggttttaaaggtcgcta

SEQ ID NO: 7661 - DNA, 1936 bp, Heterodera glycines
atttgatttgatttgattctctcattttatggaaaacaaaataaaggtgctaattaccgcgcactgtacgcttttttagtataaaaatgcccttgtttcttcttttccccctcattccataactctcaatcgccgccccattttttccggtcattttgttcctgcaaatgtcttcaacaggaattctgtacgtttatatgtacatattttccttttttctgatttttatcttttgctcaatttttgacaagcagaattgggagataaaaatttgtaaacaaattttgaaagtttagcttaatcgtcctaaaaaagttcaagaaatgctaaaaaaaattccctttggattccctcattttgatgcttttcccttcccttcccattcattcattcattttccaattcattttcagttggtgtgccgtgacttttgtgttggtcggttgtgccaccattctttggttcttttttgaccatttcaaaaaacgatggcgccctcacaaaaaagaaatgttaaataaattaaacagaaaattttgaaaaatttccaatttttcagctttatctgcagcgattgttggcttttggtgttcgattttcttgcgccttctcagcttggcctcgaaattgcactgattagccgccgctttgacatttacgtggatgaacacttcaagacgcgcaaatggacgttgggcgaaattcgaatttgctacaaaattgaagaaaatggcaccaagcaaatgcatattcacgatgccgatgcaaatccattgccaatcccgcaaaatccgttgccgaacaaaatcatcggattccgaggcattaagatcgtgtaagaaaccgatcatccagattgttttgatttaggacactgactaacattttcagctacatcgatcaaaatgtcgtcgcatttctccgccgttttcaccgttttttctccatttgttcaacggaattgggcattatcacgtgcaatgatcacattttggaatttgttttgctcaacatttggccaatgctgcacgactccattcgtgcgatgtattttaacaccatcacttttcgttgtttgcgtcaattggccccggcactgctcagcgattctccatcacttcgctttgtctctttcaatgatgccattctccctgttcttccgcctgatgaaagtgccaatgcgacggatggccaagcggtggcaaaatggctgttcacgccccattcggatggtatgcccaagtggttcagctgctctgttaattcacttgatcaatggtcttcgacactggaacagttcaaaacggtggatcattcccccctatttaattgggttttttgtcccttttttaggcattttccaatgcttcttcttcagttacttttcgcattaactttctgctgtcttctccgattgactctgcagttgtgccatttgatctgatcaacgaagtgactgtggagaaattgacactgcaacaagaagacgaagatgtttggctcacgcgttgtccaattggatgggatgagatgaaatggggaaatgtgcaggatgaattattgaatgacgatccactgaatgcaattctatttttgatcagagaggacagattcgacgacgggtgaacgattttaaaaattcaaattgaattgattttaatgatgcaaaaatgcggttaataaacattgaacagtatatgatagatacaaaaaaaacaaaataattaggatgttagttggttgactcataaaatgccattggccccataaaaattgaatgctcttaaagtgtaattaaatcatcatcgttttttcaggcttctcgacgcagcttcccaagggccgagtgatcactgatcaacagcagaaatgaatgaattaattattaattgatgcgattatgatgacccaaatgatatgttggcactgtgccatt

SEQ ID NO: 7662 - DNA, 1931 bp, Heterodera glycines
caactgctggccaagctttgaccaaatggttacacactccgagcaaagatggacaaccgaagcgattgcatcgcaataatttgttggtccacagaatctcgaatcggtcaacaacttcaaagaggtgtgtttggtcagattctcataaaatttggctaatacttataaatggtattccctttttcgaaaaatattttaaatgagtcaatatttcaaagagatggccactttttcattaaacgactgactaattggttgatttttttggtattttaggcaacattttcaaacttattttttctttataaatcttcaaaatatgtaaaaaaaaatgaaaatgtgtacaaaaatatttgccgaaattttggattttttttgcggatttccaaaaatttccttaaaaaatactcaaaatatgtaaaaaaatgaaaatatatatgaaaaaaatccaaaatatgtacaaatatgtaagaaaatcccgaaatatgtaaaaatatttaaataaaagtcccaacttttgttcacaaacacaaaaaagaaagtgcttttcctactattaaaagcatggagaatccaggaaaaaatatgtatttacacaaaattggcagccctatttatgggtatataaagaggccaaaaagactttttgaatgcataatatcacaaaatgaatcgacggtaagaaaaattttttaattacaaattttcatttacccatacatttttaacgcatttcagttggatttgtggcgacgtttggatggacattctcccatcgtttgaccatgcccaacttggcctcaaaatggcattgctttccgaccgtttcgatgttttggtggacgcgcatttcgacagaaaaagcgaattgacaatttggaaagcaatcgaaattcgcaaggacaaaggacgaaatgcaaacgaaaatggaccaacaccgaaatttgttgtacggatcggtgacaatgacatttctttggaagaattgcctattggaccgtggggtgacaatgttatgaagtttccggttgtacttgtccatggcaattttgtgcaattttcgatgccgaatcgtccgttgcacaacaaaattcgttttcattacctttatatcgagtaatttgaaccttttgatataccacttacctattaaagcattttaatatttcttcagctacattgactactctgtgctcgcatttctccgttccaacaagccaatttgggacagaatgggcaccaaattgacattgtggccatacagaaccgagaaagatcagtcaatttgggatgtttttgttcgcgaaatttggccaatttttgcgccaaacattcgtcatttgggctttcacgatggcgattatttggacaaattgcgtagtcacacttcaccaacaattctcactgatcttgatcaattgaatgcaattgattccggttttctattcccagaaggaattgctgattttgatgtgctgaatccaactgctgcccaagcgttgaccaaatggttgcacactccgagcaaaaatggtcaaccgaagaatttgtattactttaattctccacggaatctcggatgggtcaacagcttcaaagaggtcgtctcgccagaattttcattaatttgtttttgttttaccaatttttgtgtttaggcattccgtcgtgccaccacttctatcagttacaaaattcgatttaatttatatttggaaccaatgccaattgaaccatttgaattggtgaacaaacggacgaaagaaaagctgacacctgacgaaggagatcgacgaattcgacgtaaatgtgtgtaattggctgttgaacggtgcccattggggagacggcgacggtgccagcaattaaatggaaagacagcgtaaatccgagtgccaatttgaaaaatgtcatttttgatctggggagtt

SEQ ID NO: 7663 - DNA, 1511 bp, Heterodera glycines
  misc_feature (19)..(19): n is a, c, g, or t
  misc_feature (39)..(39): n is a, c, g, or t
  misc_feature (72)..(72): n is a, c, g, or t
aatgggtcaacaacttcanagaggtgtctcgccatgttntcgtcaaattgtttttttaccaatttttgtgtntagaaatttctccgtgccaccacttcagtcagttacaaaattaaacttttcatttatatgacgccaacaatgccaactgaacaatttgaattggtgaatggacggaccaatgagaagctgacactgaaacagagcaaggaatgcaatttggttatttggctgttgcaacggtacccaattggggagacgtcgacggcgccagttaaatgggaagacagcgtaaatccgagtgccaatttgaacagtatcagatttgatctgtggagtttcgataaatccattgggtgagcagcagcaatagcatttgaattttatcgaaaaataaaatatttaattaattttaggccattgtcgccaccaacggaagaagaaaaagcggatcaaatcaatgaaaatgtcgtctgattaagtgtacggaaatgaataattgaataattctatttgagaaatgatcgatctcaatttgttgtgcttattttctctcagaaatgcttttttaattgtttcgttccaattatataaaaatatgcttttttgttgagcaatttattaataattagggtttgtaatcgagaccggataagagggtcggtcgaacggtttcggttaaaaaaccgaaccgaaaaaaaccgaagaaaaattttcggtttcggtttttttgaatttttttatcttttcccaaaaaaaaacaataaaccatttttatcaatagaaaaagcgaaagatcacctctgagtaaaattgtagagctattgaaactctattgaatggtgtactacagggatggagttccgaggcactaaaaattttcggaagtcggaagtcgggattccgaggccccaaaaattttcggaagtcggaatttttcaaaaaaaatatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacacccttttttgcaacagccaattacacacatttacgtcgaattcgtcgatctccttcgtcagtgtcagcttttctttcgtccgtttgtcatgtttgggtctcggttttaaagtctcgggattttatagaggcaagaaaagaacaaataccaagcattcataaaaaaattacaatgagaaaacacgaaattcaactttgttttccgagtgtatttgcgaattattttttccaatagccttaggtaaaaattaaaaaaaaacaattcttagactttaagcttatcaattggtaccactaaattctcacttgaaaaagaagcaaataaatttacataaattttgtatattcgaatgaaaaaaaaaaataaaaaattgctatttctgctcaccaaataca

SEQ ID NO: 7664 - DNA, 1488 bp, Heterodera glycines
cattgcatcgaattgcttgcatacaaatcaaaaatgacttcaagaagtgccaaaagaagtttgaagaaaagtgatggcttgtccggaaaagagtccgtctcaaaagcacagcaaattgagcaattttttggcattgacgaggcaaaatgtgaaactgccgaggtaagaaattatcagcaaaaagtgagaattttgaaaatttcaaattttcgactttgttcgaattcgtgctttttttatggtcgtgtgaactgcaatagagccaaaaattgcccgaccgacatcggaattatccgtaaattacattcacactttgccattttcagcgaacgtcgaagtcgccgagtgccaagcgaagccgaagctcaacaaacacggcagtgcaattgctgaaaaagatggcgaagcacaaaaaggaattgaacagcagcaaagaaacgcgacgagaagaggacgagagggaaatggagaacattccggacacattggacgaactgaacagtcgggggacggaggacgaaaggggcaaagggtgcgaactttggcaaagtgccgaaaaagacaaattaaaattagacaaagcaaaaaatgacagaataaacacaaccaactttaggtgttctagaaaagtttcatttctcttcaaattctgcctttattttcggcagccaaaatccgaacttttacattcaaaaaatgcatttgtgctaccaatcccggaaaatgccacttgaatttggggattacaaattcatttttctgaattgtcagaatggatttctgctcttcatcgaccattctgttctttaagaactgaaagtgtgcagacggtgaacgaattggacgaattgctcgactcggagacggccaaacgcattcaatcggaaagcgaagtgaccatccgattttgctgtccgctgctcgccaatgtcggctccgttgggcaatgtctgtgttttgttttactttttcccattttattttttgtttttctttgtcagtgttttccatcgacgacttttcccccctcaaaactctctcgtcgtcttccaatctttccgtccctccctttctctgtccgttcgttttccttttcctctctcgccctcactcgcgccttcgctgcactctcttcgaccgctttcgccaaagggccgtcgccgccggcggagcgatcgccgtcccttacgacacttttgtgttcgccgtttgctacgcatttcaggcattttttggccaaaaagatggccatttgtcaattttattcttatttaggtctctcccattgctttgcatttttccgatgtgtcttcggacgtttcatttgagcagcaattggacaaattcgctgctcttttcgtctcctcaaaagttcgatgtgcccagcggaggcggtgccttttctatgcgaatgttagcaaaactttattttttgctaacgtcccaggggggggggggggggggacatcatcctattcaatttttcag

SEQ ID NO: 7665 - DNA, 3113 bp, Heterodera glycines
aaaaaaaaggtcgtcgcccgaggggaggtaccccaccccaagctgaaatcctgggaccgtccctgtaacgtccctttccctttttcagactgaacttttgctgaatgtatggcactttctccgctttgaccatttgtcggatttgcaagtcgtcgccctttgccgcgctttggcccgcctttttttggacatcggcgcccgcgaatttcgtgcccaactcagtcacgcatttcaaatggtaaccaaagagagaggcggacggaccgttaatattaggcgccatcaactaagcaccaaaatacaaaactgtccagctgaatgctctttttgccgaattggcattggtccgtaattttggatttttaaaattttatgataaataaacttatgatgtaaatttaaaacatttttggtcattaaacttatccaagtttaattccccccatcgagggggaggggttgtctaaatttttagattccttagttttttcatccatcccccccccctcagattttccgccattttacatccgttcatcgtcgctctgtcctctcccattttctcacttcttccttcttttcttccgccgaccattccgtccacgcggccttcgtcctttcccaaatgttcagccaattcgaccaaagccttcgtttgttggccatccaaagtgttctcaaatcgatcattttggagaatgatgcaaaagagcgctcaaaggtgggaatagggaaggaaagtgtgcaatgattaaatgccatggcaaaaaaggcaaacggagtcaaaaaattctgacgaaaatactgaaaatataaaaatgtttgggttcttgtcgatatgaaaagcgcaaaattgaacaaatgggaagcataagtccaaaaaagtccaaattacttcattttttgttgggttttttgcgtcaaaattttgtcgtacatttaaaaataaaattgattcgcaaaatgttgcttaaaatagcacagtttcaccaaattaatagtattttaaactgtcttttcagctccctccgtcgattccctcctccatcactttgggcgatgcgttcgatggtttgtccgaggccatttcggtggtgcgccgccgttgggcgactgaggacgaactcacaacggaccatctatcggtaacttcattttaatgacctagtaattttagtctaaattctaaaatcgagacttacaattagtgaacacctcgataatctgtaaaaatttccccagtgtcacatgcattggtcattccctgggccactttttgtcggccaaatgccatccaattaattgtactgtttgttgtccctcatttcagtcctcctcctccctcactgtgttgtatttgttgtgcaaccgttggttggattctctcacggcggacgagcgactgctcatcgaccgcagcgaaagtgaagcgtcgctggaaaaggcgctgcaaaacattcgacaggcaaacgaacaattggtcagtggtggcgaatagcaattggtcatcaccaaatgagcaatgcattcaaacaaattgtcagcaatttttattggtacctaataatcaaatcgatggacattcaattggagacgattttcagtactttcaattgaatttttcgtaaaatcatgctatgtaaatcatagaactataaggccttccaatttttttcgggaactttaattcattttttgtccgttttcccggctttaacgatgctttcaactctcaacagaatcggcggaacatcaacgataaaatgatccacacgtgggcccagtccgaacatcgcatccgcgccgcattgctccgtcgacagaagggccaactgcggatgagtcaagcggtgggaaacacagcgaaaagcaaagagagcagtagcagcaaaaggcaaacttttgttggatcatcctcagaagacgacggagattaaaaaatttattttcatttgatttcaatttgttagaaaatcgttttcacccatcacaatcactcccagactgaattctaattctgatttcgttttcacaattctcattaacttgatcacttaatattttcctgctccaatttaaccgtgctttgctattatattccgaaaaaagtatttattggttttgaagtcaaagaataaagataccgaacgaaaatcagcgacacagactgtcgaaaataagaaacatttcgtaaatttggtcgaataatatagggagggaagaaatcatcaaaaaaacgcacactcacagatgaacacaaaaaacagcaatttgagcaaaaaaaatcataagggtttaagtaaggggagagaagaggaggaggaagtgagaatcggaagagaaagaaaaaagaggataggaggacggagagaccgtaattgagaagcgattttagagatatgagcacttttaacaggcaaaactgtgaaatttgaatggaattttgactcgaaaaatgattttgggtttttgtaaaaaaataagcgaaatagcgattctgaagaggaggagagattggaagaatgacattgaaacagaatgagaaagaaaataagaagagatgcagcaaccggagaaaaaatgtaagagaaagagggggaggaagagggagtttgaatgatcagacaaagaacgacatgacaagagaggagagaaatgatcagggggaggcgagagtgatttgggaaagcacaaacagaatcacatgcacacaaaacaaagaccaaatgggatgaaaaaaacaatgataattagataagagagagacaacagcaaagagccaaagcaacgaaagaatggggggggagagaagtgacacaaaaatagcacaactgacaacgagtgatgggatgagaaagagagaggaagggagagagcgcacacaaagtcaacccaaaacacagagagagtttaacagtgggaacgagagaaaacaacaaaacattgcgttaactaaataattgacagggatttcgacgctttaaatgggggggggggagagacaacgaacggcgagcgggaaaagtggcaaattttgagttaattcagacgcattgtcaaagcaaaaagtgaattctaaggaagttaaaataaaataaaaaatgaaaagaatg

SEQ ID NO: 7666 - DNA, 1495 bp, Heterodera glycines
  misc_feature (1408)..(1408): n is a, c, g, or t
ggaccggcgttccgagcgacgcttttctataaaaatcttttacgaacggctaacatctcgctagctccttcaccaatcggggttaaccgaatccaaattcagtgacaactccattaaaaatcacacgaaaacgtagctctcgaaaagtcgtgaatgtataaaatagtaatgtagtaaaaatgattatttcattagcgaaagtcgtgaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatgttagaatttatgttacttaattatgcattttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatgttagaatttatgttacttaattatgcattttcttttgtgaccgcgttccggcgacgctttctataaaaatcttttagaatgctaacattcacagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatgttagaatttatgttacttaattatgcatttttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagttgtaaaaaataatagatggtcaagagtaatanttctggggatctgacatgcttaatttaccgttttcagaaagttggacaaacctatttgacttttagctttcttttggttgagtaagc

SEQ ID NO: 7667 - DNA, 1582 bp, Heterodera glycines
ttagaatttatgttacttaattatgcattttcttttgtgaccacgttcctgcaacgctttctataaaaatcttttataatgctaacattcgcagctacttaccaatggggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgttcagttgtaaatttgacgtgatttacgtgggaatgttagaatttatgttacttaattatgcattttcttttgtgatcaagagtaatattctggggatcggacacgcttaatttaccgttttcagaaagttgcacaaacctatttgacttttagctttcttttggttgagtaagcagatagcgtttcagttgtaaatttgacgtgatttacgtgggaatgttagaatttatgttacttaattatgcattttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatgttagaatttatgttacttaattatgcattttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatcttagaatttatgttacttaattatgcattttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaaggggaatgtagtaaaaattgattatttcattagcgaa

SEQ ID NO: 7668 - DNA, 4029 bp, Heterodera glycines
  misc_feature (3997)..(3997): n is a, c, g, or t
  misc_feature (4003)..(4003): n is a, c, g, or t
gcccgccgggcccgggctttttcaaaatttgtgggattttgattaataaaataaaaaatggtagtcttatatttcagcttgtgattaggccaagccaagaacatttttgccattcacaatgctttttttttttttgcggtgcgctattcaaacagttttgaggaatgcgatttgttaacggattttgccgaaaaataaccaaatttggcacttttttactttagacaccccgaaaaatactgaaaattttattaaagtgctcataattttgtgattttaagccaatttcttaagagaaattttatagatttttacatacattttaatcaattttatcaaaaattgctatttatgcgaaatttttatttaggtggatttgtgatctttttaatgcaaatttttaaaaaatcccgaagttctaacttcaaaattttgagctaaagacatttcgccaaataattattagatttttcaaaatttgtggcagtttcactggtgaaatttaaacccgttttagcccggtcaaaaaaggtccattttaccgggcggcccggtcccggtggtttgtcaaaaaaaacgggaccgggacaaggccgcccggtaaaagcccgccggacacccggacccgttcggactctagttaatataatcttcaaattatgttcggtgtaaattttgaagtgagtaccgaaatttttcaaaattccaggttcttgatttttgacgaaattattagtttttttttgtggtttcgcttaaaatatgattcaaataaagtgagcagaaaattattatatattatcattattatttttgataataatttctattaatattattaaggtccgctggatttcgcaaaatgatttctatggtaagcaatcaatactgttcggcaaaacattttcaaaccccctttaattaaagttaatcaggcccaaaaattatttttttccaaatttatgttgaatattacatacagtatgcgacattccggattttggtcatattcggaagtctttaagtttaataaaatattgaaaataaaaaataatagtcttaagtagtaattaaattaattttttttttattaggtgttgggtttgacagtatggaaagtgatctggacaaaaacaatgtgtgccaattccaaacaacatttccattacatgattatctcaacaaaattaatcgggatttggaagttgagcaaaaatgtaagatttgtgaaaattaaaaaaaatattttataacgaaatttatataagtgtatttatatttctataaaaaatggttatttattctgtttttgtttgacctaacgtaaatccatttttaattgattattaaaatacctcctaacttaattatttatatacacaattttcggcaattaaattcgattaatttccaaatttattgaaaactgaaatgaaaatcttaataataaaattataattatctttatcttttgcacaaagtcaaacagttttttaataaactctttcttttaaaaacaattttattaaattaaataaatatcaaaaaaaataattaaataaattcatatgtaataataataataataattattattttttagttaaatcagagcgccagcttaaacgttttattaactttgccaaaacaaggagttctccaccaataaattctgatgtgcatccaatttccaaaatttcaatttcgatgaaaaattttccaattggcccgtatgaattattcgattttcagaacaagtcggaaagtgtaatgattgaaggtaaaaatatataatgtttcgtgtcccgacatttgcgcctttgtccaaaatcgggttcaaaataaagtttttttcaatccctgatcgcataaacagctttaaataagcgattgaaagtgattgtatccgatcatttgatcttcaaaaatttttaaaaaaatagtaaaatttttcaaacaacaaattattgaacataatgaaccaaaagaccgtgttttcttaattttattgctaattaggcgctatcagagtttgaaaaaactcaactttgagtccgattttggacataggcgcaaatgtcggggctgcaaatgtcggggctcctaatgtttagatgaaaaaatgtttttattctcatttgcaaaaatggaaaaaaaattctccgagatttttgaaaaagagccttggataaaaaagaatatatgctgtttctccattttatctgcatgaaaacgccgcccataaataataattccaacatttttatttaaatcgaattcaaaaaattaatataaaaaataaataaaataaatatattttcagctgtgcaacaagacgcaaatgaaactgatcaatcatcgggcattgcaaatatgattgagataattgatcctttgaaatgcagcgagctttgtggggttgccgatgaactttttattgaaaaagatgaacatcaaagctttcgtgtaagtaacaaatgtcacattggcgcgggtacttttggcgacttaaaatttaaagtgtcattaccaattgattagggtaattaaatttcatttaattatttgttcgatttgatggaataagtgttttctttcgcctggaaaatttaaaaagtttaattaagaaatttaaaaaaacattcattttagcgggggagtacgaaaaagaattaaatgaaagtaaaattaattcgaaatttaatattaaaattagctatatataattaaaactcattttgcacgataaaaaataatgataaaatgctttaaaatttaaaaataaaaaaacattataatttattaactagcggggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgttgcccgagagaaggccgtatacaattgaccgtgggaaaatacttccctttccagatcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcgtcgcacgtgtcaatggtgcggagcgagaatcaaacgattgagcagctccttgtcattgccaaggagttgttggaagttaggatagacatagtctatcagctcttccttgctcttaacgaggaactgcggaggaaatcagaagtgcttctccggttttctcgagccngatttngcgcacatttgcaagtacgcttgctg

SEQ ID NO: 7669 - DNA, 3456 bp, Heterodera glycines
ggaaaaaaattcctagcatatggtgaaacaggcacaaaatgctttaaaaattacctaaattggcttagaatcattttattatttttaaaattatttttgatatctcattttttgaaaaaaaaaaatagattttttagggataccttttcaaaaaaatttttaaatttttcacaaaaaattttctataatcggtcgaacggtttcggttaaaaaccgaaaaaaaccgaaatcaaaaaaaccgaagaaaaattttcggcttatttcgattttttttttgaatttgtttatttttttcccaaaaaagcaataaactatttctattaatagaaaaaacgaaaaatctcctccgagtaaaattgtagggctattgcaacctctattgaacggtgtactataggttgtgagaatgatttaaaaaggcagccaaaaaacatgtgtttgctccttgattctaaaaaccccaagattagttttggcgaactggtgcctttttggcgttttttccgaaaaattccattaaaaattcaagaaatcgggaaaataaacccctaagaaatgctctaaaaaaattttagaaaatataccattaagaattgaaaaattttctcaaaaattgttcgccaaaatttcatttttttttcttgataaaaattttaggtttataaacttccttattgaaaaacattataaaatattaatattcatttaaatgatcaaaattccggcggtgccgataggcgccgccgtgggaaaattttaagaatttttaatgaattttgttaaaaaatggccaactgatttttcataaaagtcggttgattgtttcggtttttcataaaagtcggtcgattgtttcggttttttgattatttcggtcaaacggtttcggttaaaaaccgaaaaaaaccgaaaaactcaaaaatttctcggtcggtttttttcggtcaaaaaccgaaaatcgaaaaataccgaaaaaaccgaaaaaaaaccgaccggtccgatctctactataaattctcaaaaatcctcaaaatatgcaaaaaaaaaaatgaaaatatttacgaaaaagtccaaaatatgcataaaaatatgtacatatcagggatgggccaaattgaaaataaaaagcgaaatgcgaaaagcgaaatttgcgaaactgaaaaatgcgaaatgaaaaaaaagcgaaatgcgaaaagctaaaatatgcgaaagcgaaattttttctacaactttttaatagttaaaatcataaagcaaaaatcatttttaaaaattttattccaaatttaaaaatcaataaaacgcttttttgaggcgcgctttttccaaaaaaactttcgggaaaatttttcaaaatttgattaaaatttgttgacagattttcactaaaaaatgatcaaattttgtgatttttatcattttctaatgagaaataagagttttggggcgccgctgagaatagtttttcatcaaattaccaaattttgcgattttgagccattttctaagaaaaaataggagttttggggcgcggcggtgccgataggcgccgccggggaaaaaattggaaattttgatcatttataaacaggttttcactgaaaattagccaatttatatgtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctggtacatatgtgggtggctggacatttcgacaatgaccgtttcgccaatttaaatataataaaatgaatataaaaaataataaattaattaaaaaaatatattgatgaaatttaaagagaaaaatttaattaggtagttatattttttaaatttaatgaatgcattatctatcgcctattatgtatgattattaatagtgaagaaagaagacaaaatgagacggacctataaccagtttttaggcgtttttgagggtgctaataacggatcttaactcgggtttgcccaattccgaactccggacccgaattcgaacaaaaaaaattgagtttttttaatcaagaatagttttttcagggtaaaagcttctaattcattatcaactatttaggtgtaaaacaatgtttcaatttttaattaaataaaaaataagcaatttgcgccgaaaattgacaaactaaagccattctcataatgctattttgaaaaaaaacgaaaaaaaaacttttttatattgatcccaaatccgcaccgtccatgtaattttgcagaaatttgaattttatttaaaaaatatatttaattttattgtcgaaacggtcattggcgaaaagtccgggagcccatatgtaatatgtagaaaaatccgaaaatatgtaaaaaaaagtccaacttttgtttgcaaacacaaaaaaaaagtgttttcctactaattaggctatggagaatccaggaaaaaatatgtatttacataaaaaaacaatgtctattaaaaaaaattttgtttttctctgtttgtgttgcttttggcactgtaccaccaaaagggagggaggaatcagaacgggccaactccgtcccgccaactccgtcccagccaagttttgagcggcataactttttatattgttgcccgaatgcaacaatcttgatatcattcgaatgctcttcaccggctctattagcctacaaataattacagataatatcgaactgtaaaaaaaaaagatagaaataaaaacttagaaaattttgcctttttttgcggttttcttgtgagaatgcttaaagttgtggggggggggggaaatacgtcatgcacaatttgcaaaatgtgtgctgatgaaaatgctcttttgctgtgtcccgtccggttgaaaatgccttttctaattacaaaattggatccccccccccttttttttgtttaattattattattttacataaaattggactggacacacaaattgggcccccctcccctcctcccccttttttttgttcccggaccgggtcgattgggcgccgaccagttggcaagcccgtagccaggaaaaattttcggggggggggggaaagggaggggtccggtccgaagacctttttttttttttttttttgcaaatttatccaataattttttttccctgctgggtaacaactggactttttcactaaaaatgaccaaattttggccgttttaaggcaaaaaacttgtaaaaatagtggaaaatgtaggtccggcggtgccgataggcgccgccggaaaaaatttttggaaatttgagtgctatttgttacgaaaattgtctataaaatttttaaattttcgtttgggggggggaattcgaaaaaattttccattatttgctggaaaatttttaaaaattttcatttcggggg

SEQ ID NO: 7670 - DNA, 1766 bp, Heterodera glycines
gcagtgttatttttaaagaaaatattcattattttttttatttttttcctttgactctaatttcatcactaatttttcacttcagacccccgttcttaccagtgcttgtttttcccggttcccggttgccctaccgggaccgggacctgagcttttcaaaattcgggaaccgggaccgggacctcggatgaccgggaattcccggcccggtcccggtcccgtggcactctaatttagacctattgaatgatattaaattcattcagttcggtcaactatgaaaggagttgtgcctcaaaaagcagggtgacgcccaactggtcggcgcccaactggtcggcgcccaactggtcggcgcccaatcgaccccacccccccctttttttgttccttccgtttcgtcattcccccccccccccctctgtgtcaagaatttcatttttttaaatttattggaaacaaaataattaaattttcaaaaatttcttgggcaaggcgctgatttaaaaagagaggtactgactgatgtgaatgtgtatcgaaagttagcatttttttcatttttatttttttcattttatcggcaatttaaatttaagcgcaaaggccctaataaaaaagagggtataaatttaatttttaatgaaaaatgatttttagggttttggttttttgattcttacatatttctcatttgaagaattttttaaattaatgtctcatcatttaaaaaaaatatgatgcaatttttagtgaaattttcactcttaaaaatagtcgatccatttaatgaaagaattaattttaaaaaaaatattgaattcaaattttaattaaatataataattcaaaattggatatttattattttaaagttttattttttaatatgtatgtaataagtaattttttttattattataataattttttcaaatacatatttatgttttcatttaacttttaaaatgattaaatttatttatttttcattgtttttcaacacttattttaataaataaatatttaattactttttttcaaatttatttatttccttctcctcccccattttcctctttttgctcccttcgcaacgcttttgctcgtccattggaaaaagtcatttcctttcaaatgcttttttgccatcgccaatttcgcgcacttaatcccttaattttgaagcttcaaagctcaaatttgatctttgacgcaattaatccccaattttttgcacttttttttggctcggccaaaatttgtgaggggccaaaaccgagagacaaacaaaaaaaaatgtccaggacaaaacactcgagattcgagaaagtttatgctcgaattaatgtgcgtctgtcacttttcaaaattccgagcccttagttttcgaaaattttccccggagactaagccgtgctgtttttccgggaaattccggaatttcgaagggaaaatggcaactttgccccccccccccgtcctcctgaatttttgtgtttgtctgaaaatctgatcggccgtctgttgatcgagaatcaggagccctatgggcccttttttcttaaaaatcaatgcatgtgagcttaaaaaacaggacacttagaattgttgctgatgctgcatcgagaattttgacctggaaaacggcccggcgacttttttttaatccaaagcccgagtcaccgacaaaaaaatcccggctttttgcccccccccagggggggctattttttgagttcgggaaactgttgggtggtggaggg

SEQ ID NO: 7671 - DNA, 4298 bp, Heterodera glycines
acacatttaaaaggacgaaagtttggggaaaacaacagactccctcaaaataaacactaaaagtaacattatgacaaatcgaatcaattcaatattcaattgaaaattgaaaatcggaaaaaattagcacaaacttagagatttatttgatcaatcacacaattcacaaaagtatttaatttgcgaaacatacttataaaaaaggcattgaataattaaaggaaaaaatttcatgccaattatgaaatcattttccgtttgatatgcaatgaatgccaaatttgtctggcaatgccatcggcaccctcccccctccctccccatcccttttcctccccctctcatcatccatcatctccgttctctctttataatccatcatttcccccactcactcattcgctgtcattcgttcggcatttctccccccccgccccaaatgaaatgcttcttcaaattggcctcctccccattttgtcctatgcttttcattattttcattatttggttgtagtaccacttccgtgccccatatttcgtccgcttcttctccgatgcggaagccttcgctgaaatgcgccgatgtgccttctcccacccaaagccgcgcttccgccgacggcacttacggccatccgtcaacgctgcgccaattgccgccggcaccgcccacacaaatgcggcgcaagtcgcttctgaaatgctcgctggcaccgccaagtacttccgtgccgcctgctgccgtcgctgcgcccccgaaacagtcgcagtcgccgcgcatgcgacgctttgcggaacgactggcagtcattcaaatttcgctggacccgcccagtccgcccgaatttgcgctgcaatcgccgcccgacgaaccgccgccgtctttccatcccttttggctgtctccggcctacgaaagtcacttccggcccattgaagattcgctgttgcttcaggtggtaatgatgccgtcatttgactttggaaaggcgcgtttgccgccccacaggtgccaaaagtgaacgattgcgaagatgcccccgacccttttcgccaatgttcgccgccgccccgtcgctgctcattcgcgtcaacgctcagcgaatcgtcgtccatctccctcaacacttcctaccaatcgcttctcttttcgccttccggcattgatcagacgccacacctcgcccagcgatgtccgtacggacactcgcggcgacggtcgaggtaattaaacggagggaagaccctaattgagccaatttaaacggctgatcgataattaattcggggtccggacaatctgtcagtgataatccctcagtggtcaatccgtcagtgaaggacaatccgtcagtaatggacaatccgtcagtggacaatccgtcactgtataatccgtcagtggacaattcatcagcaaatttttcttgaataatgatcaaaatcttgcgaaaatgattgataaatttaataaatataattttttatatattcttaaacatttctagttactttatatttcaattaatttaccatcttgagaaattaccatttaattctttaaaaaatgatcatttcataattgtttttaaataacacaaatcattaattcagatttttagcaacttaaattaattttcacattatttaaataaatctgggtgttttaaaaataaatttgcttatggattagttactgacgggattgtccactgacggattttccacttactgacggattattcactgatggaatgaccactgacggattgtccgggagccaattaattccaataccaaggtcaagcactcaatgttccgaaggggaggcggacactccgccgttgccgacgaatgaagcggaatttgtatatgggatgacgcggaacagcggcggaggcgacgcggcggggggcggcagcgtttgtaggcatcggatgggttcgcaatcacgcccgaggcgatcgcacagcaccgtggtaaataaaacaaaaacaaacagagcatgagagtgaacaaacagattttaattggcattggcaaagtgcaacacattcgaagggtcattaacgtaatgataggctaattaccgtaattcggctttgtggtcaattagcagtcgattggtcatttacaaaacgttcaaccgtatttgatatcactgcactattctcattgtgttatgacattacagctgctctctccccatttgtgcatccttccaaattgttttgtttgcccaccccccgggggatggctctgtttatcccccctccctctttttttttgcttttccgcctccgttggtcaaacccatggccaaatttactacccggaaaaaacaaggtgaacaaataaataataaatgaatattgcgccttgtttggccttcatagcaatggaaaataagaaaattttgtccgtaacaaaaagaaattgcgccgaaatgtgcgaattccgtcccatccatcggaggcggggattagtttttcacctcacatcgtagcagaacaaaacagagcacagagcagtctctccccccccccccccccattcattcgtcgttcgttcgtccgtccatttggactttcgcccgacttttgcgttggttggcggggcaatgaatgaatgcaatgattgatcggtcggtgtttgggcgcaccgccccattaaataatgtacggaaagcaaagcaaaataaaattacaaatttccttttctttgtttggccctgaccattttcccacttttttttcttccttcggccaaaaaatgcgaatgatttcgttgaaaatgccacttttacgtcacctctctttcatttgctccgtttttgccattctgcataaattgacggattttttgattggtcggagaggcggcgccactttttgccatttcaaataaatgtccgctaaaagactcttcgcaaatccccaaaaaatgatgtcccctggccaatgccaatactttccatttgccaaaatcccctgcagcgaaatgtcacttttttttataaaaacgccccagggaattgggagggaaaagcttaaaaatttatagaattttaacccatcacaccaaaaaatgagcctttcttttcctttcttaatatccatgccaaaatcccttctctgccgggcacaaaaacaaccaaaagggaggacaacgaagtgccatttaatgagagcgtttttctgaaaatccccggggaaaattaaacgaaatgaaaacaattacatggttttgagtgcttagtcccaattataataagctcatttttgttggattagtccatgaaatggccttttattttctcttttcccccggcattttcggcccatcggctgtaaaaatcaaagacataaaaccgtaataattttaaataattttaaataaattatcagcggcagaaaaagggccattggaattgataatgtcccaataaaagggaacttttctttgggaagttgcagcagattaattggctttttgaccaaattaacgggcggaaaaagcatgtgacacgacaattgcagcagaacgacgccccattttaatgcattttccaaaatgattttttatttccgacgaattcatttgaattcatttccctacccccagggcaggccaaatgatgaacacaatcattcgatattaaagaggaaaatcaaatgaaaaagcaaataaaaaattcaaaagcatttatttccccgttttattttattttgcacattctctgctgaatttaagttccaatgattaattaattgacaattaaatccaaaaggtgtgacaaaagccccccccccattcattcccatggacattaattaattgggcaccacaatgaatgccatttgaacgataaacggacggacgaatgaatggcattggcatcgacgcgtgccaataaataaatcgcccgccgcagaacaatggtttgtctgccgattgtgagaaaggctttcttccgtcgctgctcctccggcttgcaaccataacaacgcgcatttgcccaattttggtccattaatcgttttaattttaacccattcgtccgtcggcttttaagcctttcctccatttccatcctttttgggaatgccccaaatggaattaacccacgcaatggcgccccgacttcaccgattgattccctcatcctcctccgatcgccaagttgggcccgtgcccgtaacacaaccaccacaaatggccattttgccctccggtgttccgtccgcttctccccaccccgtctttctgtgtaggaaaatgaaaccaccgctaacatc

SEQ ID NO: 7672 - DNA, 1015 bp, Heterodera glycines
gtattttgccaatgcttttccctttgctctctgttttcaactgtcttcatctttttgcccccatcctaaatcactgcttcctttttccgtcggtcgatcgatcgcccccctccgatcattcccctgctgtgaatcccttttcgatcacttcccccaacactcacatccatcccaacaaaatgatttatggccacggcgaaacgaaaagaaaggaatgaaagaggaaaagcaaaatccgttcgaaagcaaaaagagcccaaagagagaaaaaggggggggagaagagaatatgagaaattttctgttcatgtgacttttattctcggaaagggaaacttttttttagaagcaaaagaatttgttgtatcattaaagttaattatcccattttaattacctcactttttgcctttcccttcccttttttgccaaaatgcaacaagattcattgataataagctattcattccagctggctctttttctctttaagcacaatgcgtaattgctaattatgcacggcttctccccccccccgcccctctgcgcctctgtcctcctctctggcctttttattcaattgatttccatttctctacattgtccaactcttcctatctcatctctctccctcccctctttcttttcttttctctcctctctctctctctcctctcattactttttcagttctctctcacttcctcccctcctttccttctcttctctcttccaaccctttgttcttttcattttgtctatgcttttttgctctttttgccttcggcaaaatttttccgttaagtcattggcacattaaatggctgtgccctgaagaacctaaagaaaatacgaaaattcgaccatgggaatttgttcggtttaattgcgaattttacatttttaaatggtcatttaggaaaggaaaacagattgataagcaaacagcagaaattattacggggatatgtttgtctgagaattggattttacacgcaaaataaattaattttca

SEQ ID NO: 7673 - DNA, 1884 bp, Heterodera glycines
  misc_feature (60)..(60): n is a, c, g, or t
gatcatttgctatacaatgaaatcatcattctcatagaattcgccgaattcggtagaaanaataatcgtttatggcgaataaggcaaaaaaaaaaaaggtttttatgaccatttggtaaacaataaaatatcattattatagaattcgccgaatttggtagaaaaaaccattttatggcgcagaagaaccaaaaaatcgtttttatgatcatttgctatacaatgaaatcatcattatcgtagaataaataaaaatttatggagaaaaagagccaaaaaacatttttatgatcatttgctatcaaaagttcttataaacacttataaaataattgaaaaaaatatcgattttataattaaaatttattttattattattttattaatcgtcatcttttagaatacatttattacaatgtttttttgagtaactgagaaatttcagcttatttttcactttttcgcattcaacccccatttaaattgactattaataaattaaaaaaattgtgacatagttcaccagttccttttttaagtggcatttacaaaagaatattattataattcattttttggcattttttggattatgcattaatttacgatcttttttttttttttacaaccatttattcaataatttcgtgcttttatttcatttctagcaacgtattgcgcgctaattacataataattatgttgccttggtttactttcattatttcatttttattggctttataaatccataattatgtattcttatgatttttttttagcctttgtacataacaaattgtgaccattataaagttatttttattgcgcattaataacttcattcatttattgccttttttgttgcgcattttcactttgttttcatggctttacatatatttcaataatcatagtaatttaacctttcattcaggcctttgaaccaccaaatttatttataatcgcggtcactaaccattcggccacgaataacccaacccgttattgcattaatttcatataaaaggttttattttctcctaacaaaaaaaataaaagggaaaaagccaatatttgttccattcatgttgacctttttcaaaaatttaacaaatttcaagtgaccaaaaaatgcgcatacatattcgtaatacaaaaaaaaatgccaaacaaggtaaaattttaacaaatttcaaccgactcttcaatttaaaatcgaattgaaaaaatatgcgcatacattttgtaatacaaaaataaacaatgaaacaatgaaattgcgaattaataaaaaaatgtattgatcatatttattggtccatttcacgatgacttttttcaaaaaatataacaaatttcttgtcgactcctattataaaatcaaattgccagaaatgtgtgcgtacatattcgtaatgcaaaaaatgccaaacaatgaaacaacaataaatgaattttaaattaaagaaattgcgaattaatcaattagttttgggatgaccattttttcaagaaaatgttaacaaatttcaaccgactcattcatttaaaatagaaatgctaaaaaaatgtgcgcatacatattgtaatacaaaaaaacataatgccaaacaaaaaacaacaataaatgaatttttaaattatttaaaagataatttttaattactgtaatcagaaaaaatgatatgatataaaatatttgtgaaataaacttattaagcaatgttttaaaaaaacaaaataatgatttaaaaaatacaaaattgtttgataatatgaataataaatattttttgacatatttaaattagagaaaaaattacagaaattcttcgcacaaatttatagcagcaatctccctcccccctactccccccgggg

SEQ ID NO: 7674 - DNA, 2949 bp, Heterodera glycines
ccttatacatattggacaacgctttcgacgtcggaaccattgctttgcacatttgaagtgaagccaatggtcacaaggtgtaactgtacagttcatcgatgcttgcacaaaaacaccttggcatattgcacatttgtcccccctaagttccgaatccacttcaagtctcggcaaatgactttgaatgacatcaaggggatacccttctccaagttcaaatagaggggtagggggaggctcgtactccacgtttgaagtggacttaagcgcagaaaaaatgtgttacaaaataagaaataaaaataaaaaacttataatggatggtaacgaaaattaaacatttatttcagttttttaaacaaatcctaaatttttttccatttaaaaaaattattcaaaaaattccattaatatttttaaaatataacatttttaaaaaatttgaaaccatccattataaatattaaaatttttttaattatttacaaccggctcatctccccctgttgtcgttcgtcctcgactttgtcctctccccccacggcgcgtagtgttgcgcttaaaaatatcgaaaaacattttttttcagtgaaatgcaaagtttcacacacttgtgttgttcgccgcgtggcacttgctgaggcactgctgggacctggtgcaccatcaccaccactggccgcactcgtagcggggtgcgcatcctttttttggaaattattattattattattattattattatataattgaatttacaatatcctcataaataaaaatttcgtctgccattggctgggggttgagttgataattttgtgcgttttgcagctgatggtaaacgggctgttgttgttgttgttgactttgaagccaagcagtgatttgttgttgttgttgttgttggtgttgcacagctacttcttgttgctgctgctgcgtaggatggtgttgcactgttcccggttgtatttgttgcggctgctgttgttgttgttgttgttgttgattggtcgaatccaatgcaaaggcttggtgtagttgttgatgataaaattgccatggcggaatggtttgcgccccccatggcccaaattcagcatgttgttgatgttgtggttgttgctgctcatagtagttgtgatcatgcagatgaactaactgacttgctgcaacaggcaaaggatggggcaacggtacaggcaaagtatggggcggcggtacaggcaaaggatggggcagcggtacaggcaaaggatggcgcggtggtacaggcaaaggataaggcggcggttctgccagatactgagaagggtattgaggccattgcatcagcattggccgggttggcaaagggattgggggacgccaagacggcctttggtgccgcgaaaaacggctctgagggtaatagggacgaaattttgggcgatccgaccaataccaaggcatttggccgaatttacccaaaagaaaaataaggaatttttggtttgagcgtccaatttaacaagaaaaaagccatcaatcactacctctttttttggtgaaaaagggccttacatttgccgaaaaaatgttccaaaaagccaacaaataagcctggattggcctgctaatggagggagagggcaaaaattcacgtgaatgcaatcgttagcaaaaatgattattaatcgttatgctaacgataaacaatttttttttggggaggggggggggataagcaccaaatgatgaagctgaaaaatcaacaaaacgaaaaacccaaaaaaagcaactttggagaagctgaagaagagaaaatgcaacaatggcgtgatcagtgactgagggaaaagtgcgagagaaaaaaaaagcatcaaaggcagtggacgagaagcagcaaaggcaatggatgagaagcagcaaaggcaatggacgagaagcacctggggcggcaggcagcaaaggcaggtgaaagaggaagtaacaaaaggtaacgaaagaggaagaagcaggggggggggcagctagagtgggaagcagcaaaggtggctggggcagctgagaaggacagagcaaaggcagaagacaaaaggcagctgagagaggagaagcaaaggcagctagctaagagatgattagcaaaaagggaggagggcttggccaaaagcagctaagaggggaagaagaaaggggggggcagctgagaaggacagagcaaacgcaggagacaaaaggcagctgagagaggaggagcaaaagcagctaagagataaagtgcaaaaagggaggagggcttggccaaaagcagctaagaggggaagaagaacgggagccgcaaaagaagcagagggggggggggatgaagaggaaaaaaagggaggagggtggggagagcagctaagaggggaagaagcaagtagagagagtgcagagaaaatatacaaaaggaaaattgaggacattttacaccttttctctgcacggttttacaacacatcataaattaggtgtctacggatggcacagaacaccgggttgcaggccaacaggtttgcgggcgtccggcacgcccaccccattacaggctttggacaacgcctaaaccttttggattggccggtaaaagtcgattgacttgatcggccaaaaaatcgataatttatgtatgaatattatctactccgatgcgcccagatttatggggagaccgaatccttcgggagtagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaagtttagcactctgatgctttagtatcaaaaaggaagatggagaaaaaattttttaaaaaatttttccattatatttt

SEQ ID NO: 7675 - DNA, 1595 bp, Heterodera glycines
  misc_feature (1552)..(1553): n is a, c, g, or t
ccaaggcaatgcagtagttgagcgatcttttaggacctttcaatatacttgcgaaatatatttcaagtgaagaaccagattttgatgaatttcttgaatgtgccaatttctgctataacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaaccgttcaaataggagatagggtcctattacgcaattacgcaggtaaagtcaaaacatccaagaaatttcaattaccctggaagggactttatcttgtcattgagattaatggtgtccttatcacaatcgtcagctgcacatctcctcaaacaaacccaagaattgtacacattaatcaaattaaaaagtattttgagtactcaggacccccttgcaccacgaaaaatcttcaaaaagatgaagaacaagcactaaaggaattagaatcaagagaacagaccaatgtacctggctattctcatgattcctatcaaaatatctctgataacacagtattaatagaaaacgcacctgcactcacccctaatccctcaccctcttcacagtccaataatcaggtaaaagaaaaagaactaaatagaaatctttgctcaaaacataatctccgtgaaaatcccaggaaaaagaagcattttggtaacttttctgaggactaatcacctgggatagccaaattcaatcatttttcttttcttttaatcatactgtattttaagtatgtggaccggtctcgagaagtcgtttcagcttgaaaatgccaacagaaattggacaggctttcgtaatttttaaatttgttagacaataagtcccgcgggactgtttattgcttatctctcttttatcagttctgaggaactcatcaatcattatctaataaatattataatcatactctcgaaactgatcacttatctcagtcctgtgtcagctcagatactatttttatggttaaaaaaaaaagtgaacatatttttctaattaatcggttcttttactaagcacaaatgtcatacgctgcggcgttcgctaattttgatctgggagatatgaagaagatttcgctaactgatggccattgcctaatggcatttcaaggatcgaacgatccatttagtaacttcttcttttcgccgttcgtttatgagggggaaagatactcctgtgttgagcaggcgtttgtcatgaagaaagttcgcacattcgaactccatggcgtggcggcggagttaatgcgatttatccacaaggacgacccaacaccaaacctccccgcggtggccagacggtcacccgcgtgaatttaaatggttcggacgcgaagccgaagagagagccactccccgcacannaagaaaatggtcggaaacaacacaagaagtttcatcgccttc

SEQ ID NO: 7676 - DNA, 2628 bp, Heterodera glycines
  misc_feature (2612)..(2612): n is a, c, g, or t
taaatagaaatctttgcttaaaacataatctccgtgaaaatcccaggaaaaagaagcattttggtaacttttctgaggactaatcacctgggatagccaaattcaatcatttttcttttcttttaatcatactgtattttaagtatgtggaccggtctcgagaagtcgtttcagcttgaaaatgccaacagaatttggacaggctttcgtaatttttaaatttgttaaacaataagtcccgcgggactgtttattgcttatctctcttttatcagttctgaggaactcatcaatcattatctaataaatattataatcatactcttgaaactgatcacttatctcagtcctgtgtcagctcagatactatttttatggttaaaaaaaaagtgaacatatttttctaattaatcgtttcttttactaagcacaaatgtcatacgctgcggcgttcgttaattttgatctgggagatatgaagaagatttcgctaactgatggccattgcctaatggcatttcaaggatcgaacgatccatttagtaacttcttcttttcgccgttcgtttatgagggggaaagatactcctgtgtggagcaggcgtttgtcatgaagaaagttcgcacattcgaactccatggcgtggcggcggagttaatgcgatttatccacaaggacgacccaacaccaaactccccgcggtggccagacggtcacccgcgtgaattaaaatggttcggacgcgaagccgaagagagagccactcccgccacaaaaagaaaatggtcggaaaacacacaaagaagtttcatcgccttccttgtggagcagaagtttcgccaaaatcggcacttggcagctcttttgctggcaacaaacgacatgtggattgcggaagcgtgtaaagatcgaaagtgggccgttggatactacaaagacgacccattcctgtgcaactacacaccagaaaatggcgcatttgggcgaaattggatgggcaatatcctcatgagcttgaggatgcgaatgctaaatgagcaacaaagtgttgctggtccttctaggcaaattggtaaatgggaggactcaatagcttataattaagaaaactctgaggagttaatataattttgaaactttggtctttatcttatctcttgtcacagaaccaccgtctgctcctgtctatctcatagcacaagagcttgccaatggactgataggagctaaaattgattttgacaacagctttccgcactttgttctgctcccaaatcgtttattgtcaagtggtcttggtctgggtgacttctttactcctggtaaattggaagccgacaacagatttaccatcctggcttcaaacgtcacggagatgacaaaggagaggaaactttggattaatccaaattcctcaattttggcggtccaagcgaccgtaattgacatcaaaagtaaatatctaagtctaagattctgaaaatttatatatattttaccatagaaatgtggcaatctgaacaaatcactgagattggcacaattgtcgaaatcaatgaacgctttacacccaccgaggtcattccaaaatatgtgatgactacttcgggatcagcgtcttgcccaacaaaggtcatacgacgtcaagcaaattttccgcttgaacacttcagaagagatcatcaagtcaatgttgttctcaaatgtgttcaactttcctccggaattaaaattcacccttcctttattttgcccggaaattcacctttccgatggcaccctgacatcattcgtcccaatggttcatttgttatttctcgcatttatatttgatattttaaaataagctctgcggagctactctacatatatattcacacaaatttgtctaagctctgcggagctgattaaattaaataaacacaaaaaacaaaaacacaacaagtgagaaatgataattaaagggaaaagttcaatacataaatttaaaaaaaaaaaaataataataatattaaaataaaataaatgaatggagtattggtatatgaatcccgtgggatttaagtttttggatcagggacgatccttagatatgaaggggaggtatagtcatacagtcacaccgggctatatcaaaaatctaaattttagtagattggaaataaaataaaataattattaaatttatataattttaaaagttaaaaatttcgtcagattttctcttggcttataatttgaaaagcaatgccaatttaattcaaatccaatgaatcagaatttcaaaaaaaaaattaattaaaaaaaaaaaaaaaacgcggatttattttggttcattggcagagcttctgtggattggttgaaggaatgagttcattcccatcgaggctcggcattttccatttttattttgagtaactaaacaaatatttaaattattttattttattttcagttttggcttaaaatcaaaacaaatttctcatcgtaaaacaaatgaaaagaaagaaaaagtctgaggacttcattcaaatttggaaattatttaaattttaacgaccagggacggtcttttggagggccggaggtgtaaggccgggaccggaaatgncctttacccttccccc

SEQ ID NO: 7677 - DNA, 1222 bp, Heterodera glycines
atgctgcgcggagcattccaacttccctttgctgcgtgaagacaatccgcgtgcttttagcgaccggtaaatctaaaagtgccaacaagttcccacggcgtgaccagaaaatgcgtcagtcgaaaagtcaaaattttagaaattagagtattttcttactaataaggttaaaacccggaaacatactgaaagccatcaatccttcaataaggaatcttttatatcagttcggccccacggttcggccccagcatgcttttccactataacttttttctatatcatccaaatccaatattgttggtatgatttaaagctcatcacatgctttattagccttacaaaaagcgaaaagattttcaagcatggaaaaaattttattaagaaaaaacttcaagatttcaactttttcgcaattttcatgtataacttttttgataattgtctaatcgcgaagcaataatatcttagtaaaagcttctaaacatgtcaagcgttcgagtgatatcaaaaatattggatttgaatgacaaggaaaaaagttatagaaagttatagtggaaaaacatgctggggccgaaccgtgggggccgaactgacgtagaccgtatattctcagggctcgtaagtgttcttttttctaagatttgtccttttttggagggccggatcttagaaagctaaaatgtccttttttctaagattgtcctttattttgaggcgtcaccaaactttttaaattttttgtgcttaatgatttatttcgctgataaaaattgtaccaaaattcctaattttaaaaaatttttcctggcggcgcctatcggcaccgccggacccccccccccccccccacccacccacgtcctctaagtttttataaaaacccccccgcaaaaaagagcatatggggtgaaatgaaaaatatggcggcggaaaaaaaatattcaattctttttacgctaattaaatgttcagacgaaaataaattttgatcttacttgccgataaatgtattaaatgttcatttccaatcaaactattggatatgatcggtggatgtgtaagtactttgaatgacacttttgaaaatattatttttcaatataaaagcgttgtaattgtgcaagtgcgtttattttaaaccaataatgctttttaactgattctacatggaaaaatgtcatttttcaaaaaatcttatttttggggtcaaaatctt

SEQ ID NO: 7678 - DNA, 2443 bp, Heterodera glycines
  misc_feature (2210)..(2210): n is a, c, g, or t
  misc_feature (2291)..(2291): n is a, c, g, or t
tggagcctaacaacagccgaaaaaacatgtttttcgtgcgtttcagaccatagagagctcagaaagtgggcccaagttgtgagtatcttttaatctttccgtcacaccgaaataaaatcattttcataagtgaattttgtccctttctcttttctgggttacgtttcatttgccttttttgtattttttattttgatcagccataactcgcttcattcccaactaaagtgaacaaatttggtatctaaaataagaatttgaaaagagaaatctttttctaagcgaatgctaagcaatttaagccatatgaaaaaagttgtgagagtttcaaatttttatcacgttataactcaagtcctaaactgctgatttcaaccaaaatgcgaaaactaatcattttctattgattctaagtgttcaaagtgattttgtagcctataaaccaaaattgttagaattagcgaatttgatgtttttcatgtgttagagacattaaaatagtacgccaaaatgagaggaaaagaaatgcaaaattttcatcattccttaactttaaaataggatagaaaattattataactttatagaacattctatgcagaatttttttctctatcgatatgcaaaatttaaagaaaatctgtaaggcgaaaaaaaagttgtatagagcgaagtaaatgttgttttttacataattaaaccgaggagatagtacgccaaagtgagagaaattacaaagaaaaagacgagatagtactaggcttttctctgctcagtggcgctgcccgtcatttcgtcccgcgtcgtttcgtcccgcgtcgtttcgtcccccaagccaaaattagtcgtttcgtccccaaattaaattctatttttaaaaggcattacattccgagttattagtgcctattttggcagtttttagagactaaaatccggtccataattaatgaattaataaaatactttattaattgagcaaataacataacataattgaaaaaacatagatcaaacaaattctaaggggcattcatcgaatcttccgtattttcatagtccttcaattttcctgcatatccttcgacctgcagaccaagagccgtcataacatcgtgaatttcggcatcattgtcgtatgtggcgtccgctaaaattcacatgatgactgcgtcttgcagaacgtagcgtttgtgcacgaagtttcgagccgatcttgttgcgtcaacttgtttgtcgatgcttcagttgacttcagaaatgaaatcggaaagggctgggtgatgacaaagacccttctaaaattgagtttttttgtgttttgttagtaaaaaaaatactgagaaatgaagatgggttgcttcgaggccattgttggtcctagcgagggcagaagccgcatgcgagtggaccggtagttttgaaacttctcctaatgtaataaacaaaaaccaaatagggattgatgggtgttgctatttctgtggaaaatcgtcttcggattatatgttggcatgctcttcatcaataccaatcgatgaatgcccattagaacaacaatattgcaagcgaaagtttgagcaaaatatcgattttaattggctttcggggttttaaacaattttcaagttacacaagtcgaacccagcatgcgttgttttgcatatactgctttcatgagcttgattaatgaagagaagaatgagggaattgaatggattagagacgaactgaagaagtactgtcggcttgtgccattttttagtgctgactgctattatttggtagcggatacaatgctggctgctattgtgagtaaaatctttgttatgttgaaattttagtaaatagggcgagaaactttcacttgataaacttaaaccgactgtcatctgtcaacaatatggtttgtgtagcgaagaacaaggtaactccacagccaaattgttacaagcaagcctgggcccactgtcggcaccgcgttctaattgcaaatacggtcttatgtcgtgattgccaaggtcaccaagctagccttgtaaaatatgcccaagcgccaaaaggattaattatattagatatttttaataaaaaaagttgaattttaagtggagatgcaattactgtagaacggcagggggtgccgaaatatccagccgaatgtctgttcggatcggttcgttctttgacgggacacatttatcgcttanacaagtgcttcgtgtgacttattggtggctcaacatcccaacagcaatatggaaactgtgatgcgagaaaatgaatatctngtggctcggacggcaaaggggggcttagccatggacaattgtatgtggctctttcgagagcaagagcttggaataggttgagaatagattagatgatggcaattagagagaaggtgaagatgtcgtgtacagagagttattagataacagtg

SEQ ID NO: 7679 - DNA, 2489 bp, Heterodera glycines
  misc_feature (44)..(45): n is a, c, g, or t
ctgactttggatatgagtaattcgagtattagtcgagatcaagnngctggcaagaattgaaagacacagattgttttatttgtgatgaagcgcctatgataaataagcgcgcaatgagaactttggatgagaaattgaaagagataatgaataatggaattgcatttggtggcaaagtcatgctttggacgggagactttcgtcaaacccttccaattcagaaacatgccacgagagctgagatggtcaatgcaactataaagagaagtgagtattggagattagctaaaagatacagattgacaaagaatatgagagctcttgcaacagagcaagaatttgcgaaagatttgttagagattggaagtggaaaatggaataatgagaatgatgagataattttgccagagatttgtataagcattggtgatttagcagaagagatttttggaaattgtattgtttctgagaattggaatgaaatggccaaaagtgccattttagcaccgaagaatgttgatgttagtgaaataaataatagagttttggaaatgttgcctggagaagaagttgtgtacacgagtatagacttggctcaagacgagaatagacaaagagcagatgaatatttggatgagtatttgaatgctttaaacccttcggggtttccacggcataagttgagacttaagaagaatgctattgttttgttaatgcggaatttgaatatcgaaatgggcctttgtaatggtgcgagaatgaacgttgagcaaatgcaaccgaatttgattgtgtgtaagattttgactggagacaaggcaggtcagactgtgtacattcctcggatcacgctttgctgttctgaagagtacccttttgatttgcatagtcaccaattcccgttggtgttagcttttgcaatgacaattaataaggcccaaggtcaaacccttgagcaagttggaattgatctgaggaaagatgtgtttagccatggacaattgtatgtggctctttcgagagcaagagcttggaataagttgagaattagattagatgatggcaatttagagagaaaggtgaagaatgtcgtgtacagagagttattagataacagtgattagataatgtgttagactagcattggatttagatttagtatagtattagaattgattttgtatagacaaatctgttgttctttgggttgctcaagacagtacgaacacaattcaaagtaagtcattctttttaatttcatactttatcctttctccaaaaataattgttcataacacattcgtactacctagcgggggatgcgccgaaggcgctgaccccgctagttttcttaaaaaattcatctcaaaaatttgtattgattttcttgacaatttaaaacaacttttttggcagtttttagcaactataaattatccctattcatcacttatataaatgagtacagaaatagattttccacgaggaggaacctcaaaagttttacaactcggattgcataataggtaatgaattggatctttcaacaaataattccttaattatgcaattttagaaaaggagcgaagagaatttctccttttagcagcgcaacagctaaggtccgttggcgtcgccattcacaaattttcatagctttagaaaaaaacgaagattgagggagatgacatcgttccttatgctggggtttttcgccaaaaattcacacgtgaaatcctcacacaaaatttgcgtggattggccatcattaaatttgtaactaataaatctcattttcttgtattgttttgttttttttttttttgctatttaggtcggtgaagttgagcttactcttgaatgtgccgaaggaattctcttaaaattgcctgctactcagatcagcagaattttttcgaagaatttggcgaataccgaggcaacattggacgagctgttcaccatgggccaagcattggcttttcgccctcttggaacaaaagaacggggtcggagggagttgcacattcgaagaggagcgatttgttaaaatatgcaaaatttaggcagaaaatcggtgccgactgtcactgtctgtccaaacgaggtcaacagtcatttgattccttctttgctaattgccaattccgtcttaaatggagccgttattagcactgaagagaaaggtgcgaaaaaatttgtgcctacatttagttttatttgttgtttttttaggtgccgtaatcgatttgggcttttcaacaagttctgtcaatgggttcgttcatagcgatgatctcccgccccatctctcactggacaaattacatgttggccaagtggcacttttccgagtgaaagagaagccgactccgttcacccgtgtgatcaaacttttcggctttaccgaaatgggctggctcatcggcgaaaaaggccaagatgttttagaattcacagcttttgattcccggttcaatccgttgaag

SEQ ID NO: 7680 - DNA, 256 bp, Heterodera glycines
ttgtgggggggctgagggcccccgtacgaggccgcgaagcggccgagccctccccaactgttcaacatcccaaggcacacaaaaagttaaaaatgctaaagaaatttgctgaggttgagtcccggtgattggaatgttggtgggttgagtcccagtgattgaaatgcagaagaattgagtcccagtgattgaatgctggagggttgagtcctgttgattggaatgttggtggattgagtccccagtgattgaaatg

SEQ ID NO: 7681 - DNA, 636 bp, Heterodera glycines
tttcatgcgcacgtttcttcagcgatgtcgtaagtgtttgaactttgatattttcggctccagacggacaagtgtgcatgccgattgcctaaaatttacatatctaacattaataattaaatatttaaacctccaaaacattgtcattcatatcagtgtgcaaacgacatttgcatttgatgtcctgggtccgaaaaattcacatttccaaaacttgacgtcaccccgtttgtttaatttttcgaagacatacagaaaaccatcgtgtaacaatttttttcttccacgctttgttagaatttgagtagccataatcgttgattggcagtgaacccaccctggcaccgaaacggctccgaaacggcgggcaccgaaacggcggcaccgaatcgtaccctaccgatattaagcataaaaaacgaattttccacttggtttgagctagccttcggaccccgtgtgcgggggtggcttttcggctctaatgcactttatgagtccaatcgacctttatgagtccaatcaattgacaatccccgggtttttatacaataactttgttcatgttagaacaaaccctatctttttggtatcattctaaagcacaaaatctaaacaaagctaaaatatataaaa

SEQ ID NO: 7682 - DNA, 3737 bp, Heterodera glycines
ttaaatttttaaccatgtaaaaggtaatttcaaactgttttttagtttatttctatattttttaaaaagatcaaaatattttaagtaattttacattattttggattttttttttgggaaagttacaccctttttttgcggcgcgctttatccaaagagaatttgagaaactgtggagaaggaagggtccggcggtgccgatatgcgccgccgggaaaaattttgtaatttttaatgtaaattgttaacaaattttgtccaaaaaatggaaaatttagcgattttgagcaaattttcaagaaaattaagtttttttttgagtccggcggtgccgataggtgccgtcggaaaaaaaattgaaaatttctatgcaatttattaacataaattgtacaaaaattgctaattttttgaaaaaaaactcaaaaaaattccgaaaaattccgacttttcatcaaaaatttcggaagtcggaattccgaggccccaaaaattttcggaagtcggaagtcggaattccgaccccaaaaatgtcggaagtcggaactcggaagtcggaattccgtgccatccctgttgtactacactgtgttgcattagaatagggacaccctattttttgggagtttgaccgcttcccatgaaccaatcgatctgaaattttaactgtacgtagcaattctgaaaatattaagattctaacaataagacgacgaaatgacgacggaaaaaaatactcagattttcgtattttttcacccgcaaaaattttgtgtttaatgccttttttatggcataaaacgaatacaaaatgcttaaaagatgtctgtacgttatcttagcgttgattgctgtcagtttgattcgttgggcaaatgttagaggcgatttaagccttttggcccttaatttctcctgaaaacttagaaaattcaacataactctccccaaaagacatatttctgtacgcaaaataaacagaaatgtgaaaaaagatttgttctttcttatttagcttgttttatcagtttcgttttagtagttgttgagatttttcttagttttccaaagtgtccctattctaatgcaacaccccaattttggaaaaaaattcgtaaaatttttttccgacatcctttcgtattctcatttttagaatcttaatattttcagaattgctccgtacagttaaaatttcagatcgattggttcatgggaagcggtcaaactcccaaaaaatagggtgtccttattctaatgcaacacagtgtagagcgcgccgtcatgttccaacttaactttgtttcgttttgttttaatttgttgctgctggttcatattgtaataatttaaagtcttaataaatttatcaaattcacttaattataaaataaattaaaactcgaaagaaaataaaagtcgaacaaattttggtaaaatatagtgtgtgtctgtgtgtgtgtgggggtaatgaattctcttttatatgcaaccacgcgaaaacggccacgcgaaaacgaccccgaccgttcgatgtatcgcctcgattcaattcttttttggtataattgcacagatattgtctaaaaatgaccaaatttaaggattataaattatgccagaatagtcaatttttatgggtgtttttgtctaaatccagggtttctatttcaaaattttcaaaataagaataaaggccaaaaaataagattttagggtcaaaaatacggccaggacgttttcgcgtggccgttaaaagtttgacctttttttcggtgattaacaaattgaaactcgtttggacccaagtaattgcttcgattaatcaccaaacagccgttagtttcttaaaaatatgaaaatttgcattataacattttttaatgagacaaattcttagtgttctgattcgggtttttcactccaatgaatcgacgtcgtacactttcctttttaagtcgtacctttttgtagcattttatgttaaagatatcactgaaagaaacaggtcagacacaccgccagcagaagggagcgggcgatcacgtaaaatgaatttatgcgacaccgatcgctgctctcctttgcctccaccgattttgatagatttttacttacaatcgctcaccactgactgtcttctccttttgacctatcccaatccccatttaagtcgttcaatcgatgtggttggtgatccaaggctacaagtgcttatgtatttagtttatcatctatatcaattggtgcccattccccgttgccactcatccaatccaaccatcttcccctcttcatccctccctctctcctttccttcgttccccctccacttcattcaaatccttccctcttcccccagtttctccttccttagcttgcatctacccttcctctcttttttctctcctcttccttcctttctctcttcacttccctttctcttctctcccttctctctttccctcccttcctcctcaccttcccttcttctcttcctctctcccttttctctttattccctcccttcccctccctctccctcttttccctccctctctccttcccctcctctcttcatccctccctccctcctctcccttcctctctttttcatcccctcttccttcctctctttttcctcggaacaggacaaaacacagtcgccgaaacactgtcgatacataacacagccggtaataaatttttaaaaattttttcaaatagaaatttttcaagaaaaaagtcagaaaaattttccttagaaaattcgatgaaaaaaaaattttcgaaaattttccagcgattttttcaaaatttactgatgaattactaagttttttcaaaaaaatttcaaaaaaaccccgactgtgtttcggccggttgtgttttggggtgtaccgttttttcctcccctctcccttcctccctttttccctctcttcctcctcaccctcccttcttcctctcgtcttctctcctttttctctttcttcactctcttcctccctccccccattcctccccatttccctttctgctttcctcttcttcctctcctcccgccccgcctctctcatatccggttcaactgttaacttgttccattgccatcactctgtgtcatcttcacaacgacacataaaatgattaagctgaaaggaaaagcttttgttcctgcgccgaatactgtggtggcatatccacccacattcttataaatacagagaagaatccctttggcgactgaccatccatccgctggacatgaactcgttcttcgcgcggtccatcccatcctcggctcgtcataacttctgaagagcggaaaggttcgcactggtgggaatgcctgggaaaccagaattgttgctgttggaagggaggggaccgagcacagtcgtcgttcatccgcgcccatctcccgccacgacgccatttccgaacgacgactttgtcgacaaaagctcatcggcggagcagcgccataaaaatttgcgagttgcccccagcactttcacttgccatccaataaaaacgagattgaagccgtgccgaggcctttcctccccaagtgttttcaaagcaaccgcagcgccttcaccgtcttcacaactcttctgtttccgagtcggccaaccaatgagtgacgagacaattttaaacgcaacggacagcgattggcccttcagcaaaagcgaaactcggaactcaacggttgctgtgctgccccaaaa

SEQ ID NO: 7683 - DNA, 3395 bp, Heterodera glycines
agggagcggaagagggtttaataatagtaaaacttatatttgtatatattgtacaaaaaaaactcccatacgcattttcaaattctgttcccatgccagcgtcaaaatgaagtaaatgacgagcaaatgtgtcacatttgaatgtagctagaaaaatgattatgattagaaaagtgaaagcttttttgaaattttgaaatacaatcgacacagaaatgtccaagggaattttgggggtcacactgatcaaaaatttgacattcattttatacagttttttccgctaaatgcaaaagcacagcattaatgcgacaattcgcgatggacgaaggacaattccgtgctgagacgatgcgaaaaaaactcagtgattgattggtcattttccggaagccgatcgcacccttttcggggcaccaaaagtgcctgatccggaatccggaccggcccggttaagaagaattatttgttcagtttttcaagggctatctcccaggtcgggttcggttcttgatccattcacttggagcctgtcatggctcgagcacttctgccggaggaccctcagcctcgcccccgaccctgtcgatggccaacccatgctaagcgtgcccgtaccagcggcttttttgtacagctcgatgagctctacaaaaggtgtcaatggcatcaggttatgtttactacaaatgtagaaaattgacgagaagtgatgcgaaaaattgaaaaattaaaaaaaaattgaaaatgacttgcgtcccgccgtacattagggttaaccggacggcgccgtgattttgtgaattgaattatttaatttatttattttttttcgcatcgacctagcaccggacaattcatttttggccaatttcgttttttgtgtctaaaagcgaaaatcgaggttgaatcgatgaatttttggcaatggtaaagaatattggtcccggaaaattttttaaaataatttttgagaaaattattttcaggggtaatccgaggtgcttagcatgaatctggccttctttaggctcaatttcgaacccgaactcggactcgaacatttttaaggaggacttgggcactttctctcttgctcattctcgatcaaacataaaaagttccgaccgattgtacgaataaggttacgggcttaatatcgatacgggctaaaaacaaccgtttctatcgaaaatcgggctatcaaaagggaaaaagcaaaattcaaagttaaaatatactttataaaagcattaaaaaattgggagctcagccgcttcatcgaccaaaggaaacgaccttttgttgttcacagaaggatcggacatttagttcagtgaattgtgctccatcctccaatggaaggccattaaagccgaccattcgacgcgtatttttgtgcccgcgtccctccataattatcaattaattgataattttgcctccaggcaccacgaggaacaagcggatcaagagggtccaagctttgtcttgaggtcatttgttctatttcacagtgattgatgactgtcccttcatccaatccctctgcaaacggtcgcacttcgctctctgcacgaatctcacggacgacacccaactcgtactaggccaactcgtactgccccaactcgtactgttttttgacaaataaatgggtcataacttttgtcaaagtcgaccaaattaaatattcgtggaaccatacaatagcccttaatgttctctatctatccaccaagactcacaaaacgtgattaaggtctgatcaaaaggtattgatattagaatgctattgtatgatataatgtacaataaatgctcgaaaatttggaatacaatttacaaagaatctatgtattatgcttgccagtgaaatgaagcaatatgtgatctcgaggcaccgatttgtcaagttaagatcaatggtagtataatgtaaatcgagaatgacatcagtaaaaataaaaaatttagctaaaaaaggagtcaacaataacatgataaaaatgagcaatttaaagaattattaaaagaaattcggaagaccaccttttctgcacaattgaatgtagaaaaattttataacataaatgttttaatagtttcttcttcttaactgataataaattttaaaaaatcatgatttaatccaatgcgctttttctttaaaaatgaaatgtaaaaatcttaaaaataaactaaattgctcaattaaattaattttaaaatagaaaaattctttatttaaacaagaatcaagtaaaaggcatttaatttatttaaaatcaaaaattttggtaatcacttttataatttgtttataatttggagatttaatacttattgaaattcattcgatcaaccgaaatccactaaaaaagattagtccgttgttagaaaatatgagtatattttttaaaattttattatcattttaatgcttaaatttgcatttaaaaaaataatccataagtatttaattacattttttatggtttaaatatttttcatataaatttttttatattttacttttattttctattcaatttataactattttggaaatgtttaaaatgtagtttattttattatgatgatattcattaaatttattcatttaaattaacttttattcttatggcaataaaaattattgttatttaaaattttaaaaattattgtttttcaacactgaacaaaattataaaaatttaatttgtttagaacaaaattattttgtcatgaattattaagttatggagaattttttgaaaacttaaattgctttttattgatgtaaactaaattatattacttttaatttatttaaaaacttaaaattttcaaaaaaataataaaaaataatattacctaagtcaataaatgattcaaaatgaaaattttaaaatactataaataaaataatttatcaacaaaaaataaaataaactaatacacttaattattaactctgcatgttaataagatacaaataaatacaaaacataagattgcataaattcatattttaacagtattataaaaattaaattgagatagatatgtaaactataatttatttaattttccttattttaacattaaagttctaattactaataataaaaaaatgcaaaattgattttagagtaaaaaaataaagaaaaatatttcattagtaaacaaattgattttttagaataggattactatctatttataatatagattataatatagttaaaagactaaacaaaattatattgcttaataatatttaaataaatttaaatttacaaataatatagaagaatatattaagtgcaaatcttcttcacatagacatgtaaggtataacaacataaaagcttgattcatttcttttctaa

SEQ ID NO: 7684 - DNA, 1859 bp, Heterodera glycines
cctgacccccccccccccacattccccagttttttggaaaaagcacaccgcgaaaaaaactattttgggattttcacctcaaaaaaacaagcagatattctgatcataaattaatcttaacaatttttagattggattttttaaatttaaaaattttttaaattaaaaaaaaattttgaaaattacggattacgtattacggattacgccaaattacggccttttttgacccccgtcatgacggattacggatggccgtaactgaaaaaatcgccgtaatgacggattacggatggccgtaactgaaaatcagttacgtccagccctgaatacgacgcaatggaaacggcgatggaacggcagccgatgagttaagagaaagtgccgtcattatcattgtgattattatgatattatattgtgatatattttgcgcaacatatcaaatcgagatttaaacaacatttttttatttgtgaattttgtagatttatagattaaatattaatcgaaaagctgattaaccaagcagataagcagcagcagcaatagttatgagaatagcaaattagggtatttaaataagtgattaattcttgaaaaatttctattttaataaataaaaaatattctataattaattttatttttttatcaaaatattaatccatcaatttttaagcttttaataaaacattatattttgttaatttgatttgataaaagtttttatgaattatgaattatgattataattatttttattgaatatttttaatttaaaaaaaataattgaatttaaatatttaataaaattaattgagataaatagacgatggaacggcggcagccaatgagttaagaaaagtgccgtcattatctttttaattttttatgctccacattttatgtaacgtgaattttgtatacaaaaaacaataaatgaaaaaataactaagccaatgacgaaaacaaaaatttagatttttcaaaaaagaaaagtgatgacttttttgttttgttttgtttttcatatcacttgtgacggcgccgccggggaaaatttggtggtttaatcccttgctcaatctgcgcttttgagaaaatttaaaacaatttggtttttataaatttgttaaaacttaccgcggtcaaaacgtcataaagatgaagcattaatccatcccaattaaccacagttcggtaaaatgtgataacggcaatgtcccattgctgaaatgtatacatattattgttaatgatgctaaatgaaccaattccgtaggaattccaattagtaataaattaagaataggccacgcttacaacttgcggtaactgacaaaacacaaatccacagctaaagcgtcgtccaatttgatcagttctctcctgcgtgaagggcgcccggaaaatgcgtcagtggaaaatgcgtcagtagaaaatgcgtcagtgaaaattttattgtcataaaaacaagttccttgcgttttcgggggcacttaccacgaatctggtatccatttcggccaattctgaaccccggacgcgaattcgaacaaaaagttgcaagtctaaattttcgaattaagctttttttgttcaaaaacggcataaatgatctcctattgcaggattgatgtatttcagtttttaaaccgatttgaagaaaaacactaatttcgaaaattttgactttcgattttttattcgagtttgggtccggggttcgcaattgagaatgattttcttatagaagtttacttctatattacaatactaatgccatagaattttattttaaaatatttgcatcactgacgcattttctactgccgcatactccactgatgtatttt

SEQ ID NO: 7685 - DNA, 703 bp, Heterodera glycines
atttttgccatttatttccatattttgagatttttgccattttatgtccatattttgcgatttttggtccatattttatggccaatatttcgcgattttatatccatatttttggactccctagtcatattcaacttccacggaaaagttttcctaacccgctagaaattttttttcgaatttactcagattttcgtatttttcacacgcaaaaattttgtgtttaatgacttttttctagcataaagtgaatagaaaatgcttataggatgtctgtacgttattttagtgctgattgcagttagtttgattcggtttgtcaaatgttagagaagatttaagccttttagcctttaatttctcctgaaaacttagaaaattcaacataactctgcctaaaagacatatttctgtccgcaaaataaacagaaatgtgaaaaaatatttattctttcttatttagctaattttatctgtttatttttggtagttgttgagatttttctcagtttagcaaagtgtctctattctaatgcaacacccctttttcggaaaaaaaattcgtaaatttttttccgtcatcatttcgtcttgtcacttgcagaatcttaatattttcagaattgctacgtacagttaaaatttcagatcgtttggttcatggaaagtgatcaaactcataaaaatagggtgtctttattct

SEQ ID NO: 7686 - DNA, 2401 bp, Heterodera glycines
ccctatcggcaccgccggaccataatttactcgattcctccttatttttttaaattttgactccaaaatggcaaaaattagtcttttttggctaaaaatagttacaattcctgtttttgctctccggcgctgaattttttaaaataatctaaacaaattttgaccaaaaaaattcttcggattccccccccccccgaaatttttttctgactattaaaatgttgaaataattatatacatacataaatccaagcagaaggaatgaaaaggaagaaaatagtatttcgtcggcaaagaaagaggagaagtgggagagaaagtgcactgtttgctccctctttcttctctccttttcaactcatcattaatttctctcttccttttccacttgttcccagccaatcccttcctttttcgagactgtacttctcaggatcatttctgtagtacggtttcccggtgggagttccaccttgctcgccaaagcacccgcgatgacgaaacgcggcgtcgtcccctgagcgtgaagctcgccgggggcgtcgctggaaagcatttttggtgatcgcacggcgttgaggaccgtcggctggccccccttggggggtcggccgcgggggcgacgctctctgagcggttttaaatgccggtaaaaaagcggatttacaaagtgatggaaagaaagcgaagcaatgattggggggtaataaaaagagatccattcgaaggggaatacctaactcacgagaattggttcttagaacgaagcaaataatggggggggggggacttttgcgcacattcaaacaaatattttattcacttttctctttttcattttctttttggatatgattctgcaacatttttttctgatccattatctgtctgctgttttcccttcattgtttttcccaatatttcgtttttcatccggaaaatatccccgaaaagagcatttggccctccccgcgtacaatcgtaaaataaaagtgtctgtcggcgacgaattcgatttttggccgtgtgaccagcgccgtccgtgtcatcatcaccacggcggtggccgcggccgcttcacttccctcctcattgttctgaaaatttgagtcttttttcctcttataaaaatttattccccgataatttttaaatttctccagccgtccccaacaaattttgtcggggaatttcctccccgagggtcggggcttaaccctaaatttttgggagggggggggagcgatgaataatcaattatcttcatatttgtatggaattttattaatgaattaatagtaaattagtgaaaattaattttgattaattagcattgagttttgatgatcaatgatcggctgttaatattattaattaattcattctttgaagcattccagtgaacagaaatttgttgccagcagatgtcaatgccactaagaaggggcggttagcaatgaaaagtgccggctcgggttcaattgggccactcgcttcagcttctccgattatcgcagtggcaattcaaaaaaaaactttccaaaatattctcgaagaaattcgataccaatttccactataaaagagattatttatctatgtttttttgtgccttagattgatgatagttttaaagtacatggcatttgaaaatgtattttaaatggttttttggttttaacttttggatttaatttttgttaagcttgcatatgaaattaagcaccggagggagtccaaaaatcgaaggccaaggcgggtaattggtaaaagttttcaatcagcaataacagcagctcggctaggcctcattgctcgctgtattgcccgagcgcaaggcaaaagaaccgagagaaagggagagggaacaggctaatggaataggctatttatgatgggttgaaaaagagagagaaagatagagaaaaacgcatcattctctccctccttttgaactctctttccctgtgttatttctcttcgtctattttttctttgcccttctcttccttcgcgcctcattctcttcctccattctttagaaaagtgagaaaaagaaaaaaaataaactcaagagacagatgagggaaaagaagacatagaaaaggaggaataaaagagaaaataaatgaatgtttcctctcttcccttcctcagtttagacccatcataattttgtttttatattcacaaatgtttgcccatttcggctgcgtcactgaccctcaaaggggggtcgttgtgctcaagggtaaaaccttaaatttttggactgcaccatctcttgggaaggtgcaaaaaatttaggacttaaaattatagtttggatagaaagaaagacctttttgaaaacttttcacgtctttgaaagaatggcaattcgttaaaacaaatgcagtca

SEQ ID NO: 7687 - DNA, 2876 bp, Heterodera glycines
tttttttcagttcacttttaaaattttgtgtgtttaccaattcaaaaaagtcggaaaatccgaaagaagcaaataaagaaatggaaaaagcgatgtgataatttgaatatgatttttatagtaatcttattgctttttcgttttcagcttcatctctgccgacggttggctcagtgttcaatttgttgccgccctctcagcttggactcggaattgcactgatcagcccccgatttgactatttcgttgacgaacatttcaaaacgcgcaaatggaattggacaaaatgaaaattcgaagcaaaattggacagaatggcgcaaaagaaatggaaattgtcaatttcaatggaaaagcattgccaatccctcaaaatccgttgccgaacaaagtcatcggattcaaaagcatttcgatcgagtaaaaattgaatttgtaaatgatttgtgcccatcaatcacactttgttttgtttttcagcttcatcgaccaaaatgtgctcatttttctccgccattttcaccgttttttctccgtttgtacaacgaaattttttcctgaatttccacccgatgacagtgccaatgcgtcggatggccaaagggctgttctcgcctcgtcccgacaatatgtcaaaggtgctgtgcattgagaaattagctgaggaacaatggtcgaaaaccgtcgaacaaatcaaagcggtgattatttgatttgtccaatttaattcgttttttaaatatttgtattttttagttattttccatcgctcttctcctgtcaatttcgtcatttgcgttgattttccatctttctcttcattttcttccgttgtgccatttgaactgaccaaccaattgactggggagaaattggactgtccaaagatgaagaagatgaagcagaagatgaaattggtgtgtgctcatgcgttgtcaaattggagcagacgatgagggaaaaatgggataaatgagacggaagaagcgattaatggacaaataaacaaaatcggggtttcgataggagactacggatttgacaaaagatgaacttttaaaaagcctcactcaatgctaatttctcttcttgcttctgctgaagtcttctcgacgcctcttcccccgggccgagtggtgatcagaagcagcaaaaatgaatttgttgattgatgcaattatttaacctttattatgtcggactttgctatttgtgtgtttttattagggttataaattgtatggatttacatatttttctgcgtatatgctataaggggctcaaaataaaatttcaacgttaaaatttttcatttggtgaagatttttagtccatataaatccatatttttggggttttcgggaataaatccatagttcgccatttttgcgtttttagttcatatctcggccatttataaaaagaatgaatggaatattgagaggggaaagggcatttttatactaaaatgcatattagcgcagcaccccaaattcgacatgggaaaagtcggagttggagtttgtcggatggcaaaaccttttaaggccattatttactctcaaaaaacattttttatgtgtcaaatttttgcatattttttttctcacattgaacaaataaaaaaaagcgaagttcagtttttttcaactattttcaacaataatttttcttctgttatttcttcaaattttctcaccatttttctctttttttcaaatttaacagaattccatttttcgtcctctttttttgccatgacttccaacaaaaataattctctgttgctctttcttctcctcatcgtcgctttgcttttcaacaatggcttctgtcatcagcaacaaaacgacaacaataacaacaacaacagcagcagcaggtgctgtgattttgatgaacagcaattttttgaatccaaaaatttaaaagcccacccaccatttagaaaaacgaaaattaaacactaaattctacggcatggatatggttgggacgcgaccgcaattcgtttatcgcggcggcttttacgcgcgtcgcatcattttttggtccggcacttgtccagagatatgcatcattttggaatcggaatccaacattttatggggtagcatatttgcaataccctacattttcccatttttatgaatatttccgaacatttgtcggtgtttgaataggaccaccttaattttcaaatttgctcatgataaatacttaattttcccctcatttttcagtgagattgagccaattcgtagtgaattcgacaacaagtcttctttgtgcgttttgcgctttttttttttggttttattcatcgcacatcctaaaacggataaatggcctctttctcaattaaatacatttctcatggcatcattcgatgaccgcgcaaattgattttcaaaaaaaaataatttgaattttaagttatgaattggaaattgcaaaaaaattttcggcaatagtgccgatggtagccccattgggtccggggttagcaattgggtcataatggatatcagaatcggatcctcctaccctgaaaacccctaaaatgactttatctcgagaaaaaaaattgaaattttttttgaaaaaggggggggggaggactaccatcggcactattactaaattttctgtttttggcacaataactccaaccaccaaatacactcatatacagcaattttctccattcattattttcagggcagcttttctgggcgtcaatgttctgatcattttgatttgctattgtgtcatctgctgtgttccgattttcatcatttgctcctgtgtgatgtcaaataatgcgcgcgagagacgattccttcgtcaaatgtcttcccacaggcgtggtggag

SEQ ID NO: 7688 - DNA, 1474 bp, Heterodera glycines
ctgcacaaaattcaatttgcggatcctgttgcaggattggaattcaaaaatgtttgcaggaccggatccggccggattaatcctgcaaatcctgcaaatcctgttttttccaaaaaatgcaggattgcggactgggatcctgcaaaatcctgcgcaggatccggtcctgcgccgggctctaatatttaataaattcaaaattatttaccataggtgcaatccgaacaaaggatccacagaatcccggtaaatgggcatttccgggcttaaatgattgacagggcttgggccactcgggttcaaattgcccattttaaattggtatatttagtttttgagaatttttaatataattttaaattttttcaaaatttcaaaaatgccgcaatcccgagcgggatcccgcaaattttaaatgctggatttgcggggttaattccgctggatccgttcccgcaaaaaatttgaattctaattacacagcgggatccgcaaatttgaaatttccagtctctaattacgaacatgctttcttccaattaattaattttccaaaatgacttcattcataataaactactaaaacaaaaggaaatgaatggtgagaaaactgtacaaatatttgtaaataatgaaatattggaaattgaacagctgacttttgcggtaattacgttaattagcgtcacttttaattgccaattgggcgcatataaaaaggcattaattaatccctgtcaatcatcaaattaattagcaaacatttaaaacaatttcatcaaaatgttgctaaaccctacacttttgcttgtgcttccgttcctttttgtgtcctccgatgctttttggatgtttccgttcggcggcggtggccaaaagccggcacaatggcaaatgctaaaatggccatggtatttgccggccgatgccaacagttcgtcgacttcgttgtcctccacgtccacttcatcgacttcaacttcaacctccttcagcagctcgtcctcctcgagttcgaccagttcgtcctcctcaacctcatcttccacagactcaacgccgtcttcaacaagttcgccttccactttttcttcatctaccacaactgttgctccaatatggctttttaagcttggtcttttcctttcgatcacattggtttagtcaataaaattgaatctgtccaaaagtgcttttcggcattatgtttgccgcgggacaagaaaattacttacaagggaacctcgcaaacagtgactcggaaaatacatatgggttatatacctttggatagagcagggtcgacttctattgtgaatttttaatattacgggctgatagcaagaaataaaaaagtatggggcctcaaaaatcgaaattttggccaaagagcccatttccagctttgtcaactttctattaattccccaacctttaaaattgactgctatttgcttattttcacaaaagaaaa

SEQ ID NO: 7689 - DNA, 5272 bp, Heterodera glycines
tgtccttatttgtaagatttgtccaagtcttatttttttggatttaaagagaaatttagattttaaatgataatttttgaaggaaatgttttttgaagcgaatgtatgcaaaatcttaacaatattcagttaaatattcaaatttttctctcggcggtacacttccatctagagctcggcctggaactgtatccaggcctggatttttcctggatccaggtccaagtctaggccatttttcggcaacctgggtttttcctagacctagattttcgccggcccctaaaaattcttattcttttaaaaaattggctcaaaatcgtgcaattttgtcatgtctttaattttgaccctaaaatcttattttgaccagcgatgtacttatttcgggaaattttcaagggtaaccctggttaaaatgccctttactttcattggcatttaccaaatttattattaaaaattaataaatttaattagtctggcactatacatcagaagaaagaaatacctaatagagcatttaattaaacttaccactggaatgtgctaaataacaggtgaaaagtcgaaaaagtgccaattagacattggcctcagttgaaaaatgaatttgaagtgtaggaaatctcaagagcatttaattaattgttggtttgggttttcatttctttgcatttttattaaattctctcattgaattttgccacttttttgataagataatattcttattaaattaactaatatatgaataacaacggtaattcatcattttcgtccgttaatgaatttttagagtccgaccaaatttacgtgtacaccgtttgggattaatgaataatataactaaataatttaattaaaaatgtcactcactggtgggactgtaattgcgttagcctacaaaggcggagttgcgatggccactgaccgtacagtttttgcatccggtgttcatcgttttcaggtctttgcctttgtagtaattatgtctttaaaatattttaatttcggcataaaggcaacattaatctttttttagacttaaaaaaatgtatggtatcttttctttagtgaaaataagcaaatggcagtcaattttaaaggttggagaattaatagaaagttgacaaagctggaaatgggctctttggccaaaatttcgatttttgaggccttataacttcttgtattcttgctatatgcccgtaatattaaaaattcagaatagaagtcgaccattctctatccaatggtatataacacatattcattttccgagtcacagttcgcgaggttcccttgttagctgccggggctcatttggcccctctctcatggatcttttcaaataacggcgttataaccgccggccaatgctttccattttttccaaatatggtccattagtaattttgcgaaatgcttattagcaaaacatggattcacctatttttgattttcttctttcagatatgcgttcgctggccgcgttaatccaacaattggtcagtgctctgaacacactgaacacagtcatgcaacaacagcagcagagataattaattaattggaagaaagcaaaaacattgtggagagaaagaagagataccgtatattctctaattaaggccctgtctccattaatcccgctgtctccaattatgtccccctttctgaggatgatgttgaaaaataatcccccgtctctatttatccccccgggggataaatggaattattattttttaaaaatcttatttttaataaaaattaattttaattaattctaatttgaaattcatttaaatgtttaataaacatgaaaaaataatacagaaaaatcacttactttactcaagtccgaacataggtaacccagcccggtgctatgtcgttattagagctcggtattttgaaaaaagcctggacctggacctggattccatgttcgacctggacctggatttcctggacaaaaatccaggaaaatacaggtccaggaaaaatccaggcctggatccaggtccaggccgagctctagtcgttataaaaaagccgtcaaaaagggggcaatcattaataattggtgtcccgacgaaaaaaagtgttaaaaatttgtcggatattttttctgattgtgagcttaaaaaaatgcgctgatcacgaatcgaagctcagattttgaaaatctttgatttcaaatgtttttttaggtacttgtaaagtttacaccccataaaaattttcagaaattgttttcgggtcatttcttaggatgtattttcccgattttttggcatttttagtggaatttttcggtaaaaaacgccaaaaaaggcaccaaaacggcaaaatgccgaaaattgctaaactttaaaaaaaataatttaaaatcgaaaaaaatcaagtagttgacaaaaaatattagataaaaatcaatgattttcaaaatctgagctcagattcgtgatcagctcatttttaagcctagaaaaaatacccgacaaatttttaacatttttttcgtcgggacaccaattattaatattgccaaaaagggcgctaaaaatatgcatacatttaaaaattcataaaaaaatattttttgcttttattttgaagaaaggagctcaaaaaagcatttctgcattgaaattttcgattctgaagtcactatgcgtcattaaaaatcagactttgacgcttctcaccaaaataattaaaaaattttggcgttatgtcactattttattaactatttcgagatttttcatcactaaaagtcgcggccctagtcattaaaaatctgttgaaaaataatccccctgtctccattaaaggccctgtctccaattatgtccccctttctgaagaggttgaaaataatcccccgaggccttaattagagaatatacggtaatcggtgattttttgtgctgataactgagcactctaataatcaatataatagagaaaaatctgggctatcgaaaaacaccaagaatataaaatagctaagatggctaatttacgaaactatccagcacaaatttaaaattggaaagttcggctagcacatcttatcgtcccccccccccccactgacggctttttttttgctcgtttattttattttgactgtcccttgggcttcgtttgcatgtgtttaaacagcagatttaaacaatgggaaaatcgcttcagatttcttctgaggatttatctaaaattttaatgtgtcggccgcccattgaaaatatttctgcaggtcgtcgttattccaaagtgatttggcgaagtttaaaacgacagaggccgtcggccgtgtgttttgacatggactcgacactaattaaagtcaaaattaatgataataaaaattatgaaactaaaatatttattttattttaaactaatttttcaagaaaatactgctcaaaaaagcacttttacacttctcaggaagaaacattggatgcgtatagcagctttttcggcttggatttgggcggaagtgccatcactgaaaaagcaatgggcggacaaattggctttaggttaagccagttttcaaatataagaatacgcatatttaaaaaatatattaaatttatgttaaaatatttttggattttgttaagaaaagcactggcccttcgcttggaaatgctaaggccaacaaaagcccaatacgaacgatttttgaacgaattcaccccaacattaagcgatggagtaataaattaaatttctggtattttccattcagtgccccaattccaaattaaaaaatccatcaaaaggccgcgaaaatcataaaatagcatgcgcaactctctttgttcttcaaagtgaataaatagttccttcttcttacaggaatcatgctgcagaaatttcatttgaaaatttttggaaagagcaatgaaatttaggggaattttaaagaaaataaataaaaatggggatgatgaaagagtaaagtggaatggaaagtaaaattcttttgccattggccaataatttatgcagaagaaatgggcggagtaaaaattgtcaatttcttaatttattcattggggaaggaaaaatgctatttgcgcgcccttttggtggctttttttcatttgaaatggcgctacagaaagggaaagtacaaaattcctaaataaatccgcttacctattttttagttatactttaattaggttgaacagttggttactgtactccgtgggtacggtgtcgacctttacattgtcaccggcggattcgtggaggtcgctaaaagggtggcacagcgtctgaacatccccaacaaaaatgtatttgcaaatcgaattctgttcagtgctgacgggtgttatgagggctttgacaaaaggcaaaaattacataaaaaatgaaaagaaaaaaataataataatttagtcaattgacgagtcaatcgggcgcttcgccaattggaaaagcgggcgtttgccaacttttgaaggagcggtgagaatttggcaaatgccattttgggcaactgatttaaattttgggtcaaataaaatgctaatttgtcaagaaattcctacaaattgcttgtgatggtcggcgacggaggcactgacatggaggcacggcccccggccgatttgttcgtcggttatggcggaaatcaggtcattaaatttaaacgctcaacggcattcttggttggcaggtgcgcgagaaggttcggctgggctccgattggtttgtgcgtgattttcgaacccttaccgacgcaatcgaagagaaatgagacaaatttttattttatttggtgcacctcatttaatgtttctttatgcaatagtaacgaatattttgcaattttgcccgccttttttgttttttaaaaaataaataaaaccgaaaaataccgtttagaattattaaaattaataaacaaaatcataaagatttcatgcgttttttgtctccaattcttttattttttggccgcacttcttcaacgctttgtacgcctcgaatttgcttttgtggaatgccaaaactttttctgtcctttgcggttcaattttgttgccaaaatgcctctgcgaattgaccatttgggcggatgcttcttcgatggtgctgaatttgccggaagcaacagagccgacaattgcggagccgaaaatgggaaatcgtttcaaaatttaattcgataaagaaaaattaggcaaaaaagaaccgaggagaacggactcttcacagtgcggcacgaaga

SEQ ID NO: 7690 - DNA, 4683 bp, Heterodera glycines
aataacgtaataagcaatcagctacaaaccaccccggccatatatcctatgagaaaaattgagatcaggagtcttttcatcccgcgtggcacttctgacctttcacacaatgtttttacaagcattgttccgagacgtttaatcgtcgggtttgtttcaaccggtgcgtataccggaaatcctaaagagtcacccttcgtctttgaacatgcaaaatgggattcaaaaaattttaaatgaggccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatggttgaggcttttgatcgggtgttcgaaaagtcgaaaattatcccgatgaaaatatatagtgacagcggactcgagtttcaggctggaaaaatgaaaaaatattttgaggaaaaatttattatcaaaaatgtgatgtatagtcctgacctttgggggccaagccagtatccgttacttttgaaaatgcccgttcgctctgggaaaaattatataaggagaaggaattcaaaatttcgaaaaagaaaaaatttaaaatcggtgatatcgttcgtattaccaaggaaaagggaaaattttcaaaggaataccgcccaaactttaccgaagaattgtttaaaatcgttgttgccaattcgacgacacccgattcatacaggattgaagatttggaaggaaatttaataaaaggcatattttataaccaagaattagtgaaaacggatggatgatttttacattgtactaccctcgaacacaccggggcaggagaacactacgtcaaaattcacagtacgtctccccgagactttggaattgggcacaaattggtcagtagctctctcatcaattatttacccctactcattcaccgctctcggtataaatggtcaagagtttattaaagtatgggaaaatgacagcagtgtccccattcaagtttatttaccggacatgaattttaaaaccgccgggggattaggaaataaaattaacgaggcattcacacatcattacaaaatcaaaaaacaacgtgggaagagagaagccaaggctgaagaaaccaaagactcaaaaattgatgtcgcaaagagggctgcagaacgcgccgggagagacgtagtaagacattttaatcagatcaacaatatctcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacacaacattagagcatgtggaaaagaatgacatgaaagaagcaaagaaatcagccgacgtcgcaaagggaatcgccagacaggcaaagaccaaatatacatcaactctcgagggatataatgataaatcggaaaagggttttaacgggatggtggttagacttaacgaggcgctcggtgagcattttaaacgtaaggaaattgaaaataaagaagttttagaagctgaaaaagggccgcaaaaaagagagagattagccaatgaggatgttcaatttaactacgacagtattgatcaaaaatttattgtctatctttcctctgccgtcacccacatagatttgtcaaaacacctcgcatatgttctggggtttaagaacacaaggctatttcacgcggaagaggcgacttatatgccagatttgacgggaggcgtaaggcagctatacatttatgcaccaaatttaatcgaaaacacaattatcggcaaccagatggccccactcttaagaatagttaacgtcgtcgatgacccaggatcaattagtgaagttatatatagcaccgagtattttcatcgtctacagtcgaaaagaatttcagaaattacaattgaaattcacacaccgtttggcgaattcgttaaatttcactggggaagttgtattctcacattacattttaagaaaagtatattttaaaaatgacacacgtatttttcgatcccgagtcggtcgattggtcatcttttatcactcctcaacatgggaggggacagaaacaatattttgtcggaagcaagtatcaacggggattcggtttcctcggtaatgtggcacgtttcttgacccctattgcgaggaatattgcctcgagtgcaggacatgaggggcttgccgctgggcagagagttctgagtgacatcgcccagggtcgtgatttaagggatgccgtcagggaacattcaagacaggggttgactaaccttactgataagttacaacaatgtgggaaaggaaaaaggtctctgatcactaataagaaccggaaacaagtatatgatcagttaagtttcatctaaaggtataaatggaataaataatacaaatagttaaaaatgacaactctcaagaaaatcgacacggcgagtgaggacggtctcgaggggggcctttcacttttcgacatccctccgacgaacgttgcaattaataaatccagtattcgggaattgctgccactttcagcaataaatcaatctggaccgtatatctttagacttttttcagataatcagttttgtgacctcaataaaacttttctctatttgtcaacttcaatagagagaaaagacaaaagcaattggattccaattaccaaggacagtgaagctgatcaacacgtcggtgtcattcaaaattttgggcacagctttgtcaaaacattaaaggtgtcaatttcaggtgtcgaatcttatgattccggtatttactatgcggttagggcatatatgatgactgaattgggattttcagaagatgtcaaaaagggtctatgtgaagcgtcctgctattacgtagatgatgtcgaccagaatgattatacaaacagtggctttaaaaacagagcgtcacgttttgctgatggggccaaatgtgaaacaatggtgaaacttaattttgatctcggccgtcagcccaatcttttgcttaataactctgacgtgatttttagcatacatcgtaataccgatgattttctaattatggcaccgccatatgtttccggaaatgcagtcatagcgaacccgcacacatatcgtattaacatacacgatattagaatttatgtaaaaacagtagatgttacccagtcattaaataacgtaataagcaatcagctacaaaccaccccggccaaatatcctatgagaaaaattgagatcaggagtcttttcatcccgcgtggcacttctgacctttcacacaatgtttttacaagcattgttccgagacgtttaatcgtcgggtttgtttcaaccggtgcgtataccggaaatcctaaagagtcacccttcgtctttgaacatgcaaaaatacgctctatcggtgtcgaagcgaatggaaacatattccccgggtcaccctattctcttaattttgatagaaacaaatacattcgagcatttgttgacatgtatacgggactcgggatggacgatggtgaaagaacaatgtcgatcaatatacaaaaatttgtaaacggttggtgcttctttgttatcccgatgacctctactctagaggacacccccggttttgaattgattcgaaacggaacgaccagcatcaaggtgcaatttaatgagcctataaaggacggcgggtatgagatgatcgttctgggggaatttgattcgattttatctattaatgctaatcgtgtgctcagtagcgacggaagcatatgatgaattcttatgagattgaaatatttctatccaaacatccgacaacccgaaaatattttatcggtgtttttgcttccgacaagatgcctaaattgaaggacagacattttccgtactgttttgtggcgaataccgaccgtgcgggcacgataggtgaacattgggtcgcttattttgtaaattcgtcgtccgtaattgaatattttgattcatttggcgattatcccaatgaagatttaagttcatatcttaacttattcgaacgaatcctcattaacgatcgtatagtccaacatcaattctcagatgcatgtgggcaattttgcatatatttcttaacacaacgatgctccggaatcccttattgtaaggtcattgacggtctatataaggttcacccaaaggccgatttattagttaagaattttgtcagtaatgtttaatttaattgttctcctaacgatagtcggcaatctccatggagaaagagttactattctttctgatacacaactttttgacgacaagtatcttactatgacaaagagttcggtcaatgaaaggcagttcggattcgatcgctcgagattatgtacgataaataggaatccgatttcagggtggagcctatcaatccaaaatataaattcaatagaaaag

SEQ ID NO: 7691 - DNA, 1840 bp, Heterodera glycines
attcaagaatagggatttttagtgtcaaacatccaaagtagggattcctagggacggataaaggcgttaaaccgaaaattttcgcgaatgtgctttcgtactttacaagacgaatgtcgccaaaagcgacacaaatttcttggaaattttcatttattttttgatccgtttcgttgatcaatttctcccttcgctcgctcctcttttttatgactcatctctttttccctcttaatttttgttatgagtcatcatttttgagggaattttttccctttgcttgtgcacatttcttcacgggcctggccccgcccccatcgattgtgagggtataaaagcccggcccattctccattttcttcactgatcaatttttgattaagtcagccggacagttttctgtccaagcaatttgcattaaattgtaattgtgtaaatttgaataaagattaagaaaaggtcttagtcttatcattgtctgtaaaagggacattcaggagccctttaatacagaccattaagccattgacccccgttgggtcagaaaaggcttatcaaaggaaaggagaggaatttctcctttaatttgtccctttggactctgtgagtttctgccttctggacagaaattcattctgcataaaagactccccccttctgccgggaagtgcaaatttttgtggcgttttgcccacaccgaagaaaaaaataaatagaaaccaagaatccgacccttatatgacaaaaatctcttttttttgtactgtattttgtgtgaatgaactactgtagtaaattaggatgattttttgtgtattgttttggaatactgtagctcgttttgatgcccacctgatgctgttgaagaatcgcatacagttgcttgtccttggtgcagcactgtacaatatagccaagattgttgaacataaaaagaccagctaaagtgaaaaatgttttccttattaaaaaagaatgaatttgcaatggaaggatttcagatttattttaataagcctccgaaaaaaagtgtgagaaagcaaaattccgtcgtcaaaaagctcagaaatgtggaattttaaataaaattgttgacgattccgctgggaaatttatggaaattccttattttgtcgaaatttcctttaaaattttccaggcaaaatatgtacggttttgaattattaatttaaataattagtaaaatcattgagtttgattttaccaaggtaaggatcagaataggcaacacatttttgctgcaaatttttctgtaggcccatcagaatttggatgaacaattttgaggccgacgatgccatcgttggtgttgttgccgttgttgtggcatttgtttggtcattaatgccaccaaccaacaattgttgttgcatttgttcatcagcaattgcccgctggaaaatttggaccaacaatttctgatgctgtaccaacagcttgaggaagttgacggttccactgctcaccggatggacctgtgggcgattaaaatctttttgaaaatttaaaattttaccatcggaacaccggaatttgcgggttcgatttttgggactcaaataagaaattatttattttttgtatcaataaaattccgtgtaaaattttggaaaaaggggtgaaatttaaaatcttcaaaatcgcatccaaaaagtacatacaactatttttaaaaatttgcgagggtttggtcaaatagataagtgcaagtcattttcccctggtcaggtcgtttttcctccgcgtcgttccctcccccgccgaaaaataaaaaatacacaggaatttttcaaaaaaaatattaaaaagaacatatatt

SEQ ID NO: 7692 - DNA, 5233 bp, Heterodera glycines
  misc_feature (26)..(26): n is a, c, g, or t
ctaatgatgtttaattgattgcatcntgggaaattaatcctaattaatcccagactctttaatatgaacttaagaaacttatttgtcaatttaatgaatttatttggtaaatttacacacattgccatcctcgggcacaaatcggccaccaatttgaccacttgacaagcgatcaatgtgcagtctgatcagttgaacgcatttgctgaagaggctggactgcagtgaattgtaaaggccgcgttggccaacattctgacaaaaactgacgacaattaaaacgatgcattttcgtcgtttagtaaattaaaaaattgtatggaaaaagaaattggctggcaactttaacaaaatgattcaacatgggttaaattaaaaatgattttcagtgttttgtattagtgcaggggactacattcgtaaaacaaaaaaaactgtcaccatgaacgtttcgtaatcttaaaaatttgttaactgtgttaggctgaaaaaaagtttaaaaatattttaaatgaaccggtaacccgaaagtcaaaatttttattattaacttttttgaaatctaattacatttcgaaaatttgatgacaaaattagcaaattcggatagatatgtaataggaaaaataggagagatatcatatatcacatagtgagaaattagccaagccaataaacgaaatcgacctctgacaaagcggcaaattgattggcatgacggacaagaaatttgatgagcggaagcaaagcagcgaaattgccttcgtatgcgtcaacaactttctgagttcacaaaaaaatgttagggataattaaaaatatttctaattaatttttatgtaaaaaagggtccgaataatgaaagatcaacggggagaaaaaaggatgacgattttgtaaaaaaagtcgattctctagtatgtatgaatcagtggtagatcagattgcggagttccgaagctatttaaaggaagagctattataaaaaaaattctacattttttttacttttttattaaaattttctaagtttttttttttaatttataactttgaaactttaaatgttattaagggttttctcgggagcagctagtccgcccccccccctattgattcacgcccgtatttttttttaattttgaaactaagaaatttttaaaaaaagcttaaaaacacgtgggaacgtaatgcacctgtttttaaaaaaatattattaatttgacttttttttcaattgtccacctgcgtttgggcaagcacacgcccaattgggtcgaacacaatttgacgcagcacttcaacttcaattttgacattttgaaacatggtggagcacaaattggtttctacctaaattaattataaaaattaataattaaaaaatttttaaaaatatttattcgatttaattcaaaatttttcatcttttttttcacttgaactaagatgagaatggtcgaacacatgaacaacaccacaacaattgcgttgtctctgtgcgcttggtcagctgtgtccgcaatgcgcgacgcgacttttttgagcgcactttaaaaaagaaataaatattcgaatttattttaaatttttatcaaaaaaagatatataatctatatttgcaagaaaaatatagatatgtttataatatattttttaattcccattttgaatacagttttttagtgcataaatagcctgaagggatactgttgttacagagatttccaaatatatagattatgtcaaagttaaaaactcctgcattttataggccctcctatttatttgttttatgagtcaataggttttttgtttccggaattcagatcccaaaaaagcccaagaacaaaaatcctaattaggcttcattaaaagtattttcaaaaagacacccccttttgcctaggttttttcataaaaatggattgccggcgaaaaatctttttatacatttaagtcaattatttacagatttaaaaaaatccagaatcccagtctcaaagttaaagtccaagaaagtcagcaataaactcataatcttattattttattcctctccattttttaatacagtaaagtttacaatatccggaatactgtagtagcaaattggtccttcttcactgcttcgcccttttcactatcatttttctctttttcttcaactatttcgtcacccgactgtttttgtctgccatcttttcccttctctccttttcgcattgtctctcttttatctggctgatcatttttctgatcaccgtcatcatttccttctttatccaattcctcaacaatattgcccaaatttttgcccctccatcgcattttcaccgccgctcgctgttggaccgtatttattggacggccgccataccgtaatgcatttgacaatttgttgccaccatttaatgagccattaattggaccaatttgatcgggcttttctcttcttttaagcaatttgataaagaaacttttactgtatagtggataagtgaaagaaacggttatcgatcgcaagaaaatccgatcaaaaagtatttggtcagccccagtcaattgatcgatcgattgattgatcccatatttagcaacactaagactttttatccgtagcctttttattttataggattatcaatcaactgacgcaactaatgtgattgatgctaagcgtaaccgtgaaaaatttaaaaaaaaaataattctaactttaccatattcccctcttaatttttccgattaagccggggttgattttttaattgatttaaagtattaaaataataaatattaatagtaatcccagtccaattttacgctttgatgaaggttgcttttggagagcgattgtttgcaccgatttgatcagcgattgttctcaggggtttctgaattttcaaaaaattatatataaatattaattatttttaatattattttacatcccgcctgaccatcatattttcggcacgatattgtgcatagaaatggagaaaattggtgcaaacggcatcatcatcgttgtccaacaaccaggaagccatcttcaaaaaagaaattgtgcctaatttattgggtcctctcatagaattaataagaattatttgcaccttttaaaaaataataacttttaagattcatagtttgtttgacatgtttaataaaatttaataactatcatatgtatctatttttcatagcgaatttattattttttgcagattttttcaatttttggctaattttaaaattaattttttcgggtccaaatttggcacagacttagaagcaaaagttaaattggacagcttcaagagaagtggaccactatgctcaataaaaaatgtaaaatacatcgataaataaataaaagttggcataattttttagtgggtgcaaattatgagacgacccaatatatgaaaaatatttaaaaaaagataaacgataattttgccttgtgaattcgttgagtgtctctgagtgtgacgaaggaggataagcggaaggaaggcatttcttgaaattttaaaaatggttacaataatccccattcattatatttattcctaccgtaatcatcgcccaaatactcgaacactttggtcgggtcgaccggcacgcaacttgtccggaccaaattgccgaactcagactcaatgttggcacaaccaatttcgtaaatttgtttctaaaatgcaagcacatcagctccctaagtcctagcaataaagcgaaaaaatgtgttcaaaaacaataaaattcccataaattatattttcaaatactgatttaatttttggaccctaacaatttttaatcctaaatttcaagtttcgaatcctcccacccatcgcgtttaagaaatactctaccgtatttattactctaccgtatttatatgttttctaccgtacaatgtgctcgtggtttctgtagactggatgggtggcaaaaaaggcgattgcctccttcaggttgcgcatcttttccaaatagtcgtcaatgttcaacagcacattgcccccgtcccgaatggtgttctccagcaccgtcgttttcccatggaattgaatggtcgcgtccacggtggacaacagttttcgaatgtctttgaaatttgaaaaatggcaaaggttcaaaaaatcattaaaaaatggctggccgaaaaatgggctcccggtaaattggacactatcgtataaaaataaataaataaaaaataaataaaacaaaattttggtttggctaaatgattttattttattctgcacatacttatgttttttataagcgtaataaaacggaaataaataatgtttttattaacataaaacttcagcaaaagaaaacaaccataacatccaaaagaaaaaagttttcttttggataggattcccatcttttgtgcaattttagcacattgaccaatcttcaccctttttcgtgcattttttttggcacattgatcaatcatcttgcatgttgaatgcttgattctaagtgccttaattattaatccatttaccctacccaaatttatttttcaactcaattcctgggtttattttaggatggtgtccagttttcccgtgtccagtttcctatttggagtccagaatccgaacaaaaggagaaaattaatttttctctcaagaatgtgatgcgagcgcccccagaaaaccccccgagtattactccgaaatgcataaaaacaactttttaatcttttttttatgggaccaataaaatacaggattacccttaatatccatgaatctcgattttttattatattcccgtctatttgaatcagttttggtcaataaatgtgaattttggtgactttcaatgaaaaaatcttcagcgagtcggatgggtcaccttttatgaaattacaacaatgaaatagcatcgttttgtaatccaagaataattaaaagaataacacggggacaaaacgacaaaagtgcccctctattcgtccatttccctgtgtgcttcttcttcaactgaacgaatatgcgcccgcgtggcgtctttccccaaaaaggtaaaaggttgtcccaatccgatgatcgcaatagacgtgttctaaatggaagttttcggggtcgctgattaagaatatggcactggcaccaattcgagaaagattccaaatccctaacgagaatttgaacaacaaaaagttgtaatttattttagaatttggtattggtct

SEQ ID NO: 7693 - DNA, 1289 bp, Heterodera glycines
cttttcaaatcagtcatatttacactggtcaggtgtctttttttgcctatatttcataacatattcccgttgtttttctgtcaaatctttttggccattttgaattgacgcaaaaaaaccacagatgcaattgtctgctctgcaaaaaaaaattgatgccattataatgtcattgttaccatttttagaaccaaaggccctttgccatgtcggacttgcgtcccgttcagctgccgaaattgaagcgacgatgcggcacattcggcaagtggatggggtggaaagggagattcggtggattagtgaacttgaacaatcagggcctaccgtatcattgcaaatttttgaaaatttcaatcaaacagagtttaaaggaatttttcaatgtatttgccatatctgaccaatttttcatcagaccgtaccatggtctgctgttcctggacgagtccatcccaaacccggactcgaaccccttcgtgcgccgtttcattgatgaatacgagccgagcagaaggttggccaactgtaacaaatttgaaagcattttgctccctacacaaattcataactcattttctgtctcctttttagcttcgaagagttggcccatctgagcggccttcccattgaccaagtgttgcaaatcgtccgccactatttgctgtgggcccgtgccatgctcatctacccaatttgcaccacaaatgtgtacgccaacgcaccgcaacagccgcacaatttcagaacgtacttcggaaccaattaattagccactattattatttataatcgaggataatttttgtcgaaatttgacccaataatctcggacatttttgttctcgaccattttgagaatttctcgagacgtttttaggtttttggtaaatttattacaaacatcaccaacatagaatattttattgatttcatttagtacagttttgacgccatttttagtttggaggcacagtttggtgaccgtttcggctccgattgctgtcccatggccgatgtgttggaggcgttttcgcccccgtgctcgcttggctcctttcttcaggacatgaccatctacgcgggacgtccctctctgcacatgtgtaattaaaacccgataattcgacatgtcgcaaaattattgctttttaaaactcattgcactcaaaaaattgtcaaatttcactgggggtttccactaattttccaatttcagctttaatggggtttctgctgcgcaaatcagtgctggtccactgcacaccttcttcttcctgctgcccctt

SEQ ID NO: 7694 - DNA, 1443 bp, Heterodera glycines
tttaaattttgaaatggaagtaaggttcaacaaattttatcgccaccaaataacaaaacaagccgcacaaagagagtgtggttcggggatgtcctcgggtcactcagaattcgccacgtgccaattgccgtcgctgcttcttcttcgactctttcttcactttgaccaatgcgccggccggcttcgcaacgacgtcctttttctcggtcagaatcacttcgatgtgacacggctaaatgaatgggaatgttaatggtaatgggatagtgcacaatcagtcagaaattaggaatgctttgaacaaaatttggcgaattttgaaatttcaagccgcaaaagttaaagtaatccaagacaatttggacatggatgatgggtttggaaaatccgctaaattgtgaaaaaatgtttccaactctgaagaaaacgcaccgaactcatgtacggattgatgcgcccgtgcgcgcggtaagtgcgccgacgcattttggcggccgcttgcacgacgatgtggtcaatgaccaaatggtcgacgtccaggcccttcacctcggcattactctccgcatttctgtgcaaaaatgacgatacaaaatgcaaacacttaacatttggtcaagtttgtttattatgaattttcttgtgggtaggctaggatatacggaaaccaaaatggaattccaaataaaatgtttttagggtcccaaacagaacggccttttacctgagaagttggagaaggaactcggcggactttttcggccaacgtccctgtgttgtgcctaacaataaacaaaagtgtaaaggaacatcattagtctaaagagctatgtcaaaacccatcccatcccggatttttaccactttaggcgtccaatcaatgaccatcctcagtttcattgactataattttttcttaattggtcaaagcatacattcttggtatcaaacaaaagcttagtctcgggaatttacaaacacaaagaaaaacagcaaatactgatttcacatattctaccggtaccgagaatgtaaagtttgaccctagttagaaagaagttatggcctaaggatagtcattgatcggacgcctaacgcgcaatacacccccccccccctacggtttaccccacgcttgcgcctgcgctttgcgtcccacgccgccgttgaagtggcggaacggcacaatctccttcttctcccgtacattctccagaaagcggatggcacgcttcaacggcatatgtttgatggcacgcgccgtctcatgtgtgttctaaaaacaatgaaaatgggcataaaagaaaacgaaactatacttgtctctacgctcattgtaaatataagaaccaaactccttgttccgtttatcataaatctcaattcgtggccatattctccaatggccaaaattttggctgctaatacaggagctacttaaaa

SEQ ID NO: 7695 - DNA, 3668 bp, Heterodera glycines
  misc_feature (1386)..(1386): n is a, c, g, or t
  misc_feature (1606)..(1606): n is a, c, g, or t
  misc_feature (2680)..(2681): n is a, c, g, or t
  misc_feature (3646)..(3646): n is a, c, g, or t
aaaaattcccagttggtcccggttcccgatcccgaaaaaaaccgaggtcccggtcccggcttctcaggtcccggcaagtcccggtcccggttttgcccaaaattcccggtcccgctgctctctagtgcaaatttattaaaaaattttattccttataaattttatcggttgtttttgcaattgctaatcaaaaatttctcaagattttcggcaatgaaactcactgttgatccactcgcgcatccattcaaatttggatttaatttaggcataatcaaaaattttttcctaagagatattcaaatcggaaaatatttgaagaaaaatggcaaaatatgaaaaaaatctgaaaatatgtacaaaaaatggcaaaatatgcaaataaaagtcaagatttttatacgcaaagacaaaagagaaagtgttttcctactatttagagcatggagaagccaggaaaaaaatgaatttgcatattttttgcagccctgccaatcaattggttcgactcaccaatcattgcaatgccatccattaaaacatcagtagcattagcactacggttccgctttatttcaaaggatgtgcgatgtttggtgctcacgcttcgggccaaacttgaaccagttgaactgcccagtgaaagatttcggataaatgtgccggaaccggcgggaaagagaaaaagtgccaatgtcaatgataattgatcagatccttgaaaaggccaaggatgacctttcgaaagtccaaaaaagtggcgccgaatattaaaagtggtaaaaaggtgacattcaatttttcacataaatttttgcacgaaatccatttcaacatcgcacaatttgactaaaatagattttgtttttcaaaaagctcgagccagatcgatagccggatgtatacacccagcttaggccgggtccggcttcatcaacagctgaattaaccaaaatcggaattccacttgccaaaactaattgagttcattgagcagctcaaaaaacggtgccaaaaaaggatcctgggttagctaccaagccaaaactaattaaaaaaatgaaataaaaaaataggtaaaaagtcttttcggaattttttcatttttttcactgttcaaaaaacaaactgcaccgagcagaagagcttcgatgactcatggaccgagaagatttgcgattatttgaacctaagtacaaaatttttaaaattagctgattgacactggttaattattgtaaaacggatttaaaacttttcaatttctcaaaattcaaaaaaaatcattaaaaaattcgaaaaattaaaacggttcttatgtactaaaggctattttttcctgagctccccgtggcctgaaacgtacgaaaaacatgtttttttggngcgccggacttttcgacagaaggacctttcgacagcaaaggacatttcgacagaaatatttaaaatttgaggaggggacttttcgacagtagagtaattaaattcctaaattagaggtgtaaaatcgtaaaattttatcgaaaaagcaacaaaattaagccagatcagtattgagataaattatttttaaaatcaaaaattattaccaagagaataaatnagtaaattttggtgattcatttttgagaaaatttttcattcttcttagagttatatttttgaaaactttaggggccgattcttaagggtgtgttttctgaaatttttcattgtaaaaaatgtaaaaatcgtatccctagtaataatgatttaacaatacattttagtatgtaaataaatttagtaaaactggcaagcaatataattcattttaataagaattagttgtttttatgtttactgtcgaaaagtccattattttttgtgtttctgtcgaaaagtccgggagtcttcaaaagaattaattttattgtacattaaaacattttctcccaattaataccgtaaattacagtacctattcaaaagtattttctgtccggttgaaaaatcactgctggacttcctcattaaacaagcagatgagcatttataaattcacacatatcgttttattttaattgaacagaaaatctctcataaagagtaaaacagtgccttccccccccccccctttttcgtccattttccctttttcatccgtccaattcgtccagtgccaacttcggcccgcggcggcgtcgctgcggcggctcctcgtcgccgtcgcggcaatgatttgttgactctaaagcatcaataggaaattgattggtttaagcagcatttgggcagcaattgctcttccaaaatgggcaaattccacagatataataagttttgtcccggacagtccgtttgtaattacggcacatcaaaaaatgccgttgtttgcgcatttaatgatttgtccctgtcttgccactgcgccttccttgcccacaataacaattagacctgtttacctgttcctccatcgtctgtcattatagtcgccatttcgctgtttccgacgccgcctctgccgatggtcagcgggggcaactgccgggcaccggcgcgtggcaatgccatggggggcgaaagagggtggacgcccatctgccaaattgccacccattagtgccaataattgtcatcaatttcccatccactaatttgtgtactttttggcggctgttcaataaagtgatgnnggagagcatgattggcagcagcaaatggcaccgaatttgttgtagaattatttccactgttcctttcttttggagaaatggtggtcatggcatttgccaaagaattggcattgccactggaatttggtggcatggaattgggcatggcattgatgacattgtttgccattgtcgtcgttgaatttgttgccgctgctgcagcaccaactgatggcggcaccatcagactcttcgggctcactttgttgttggcgcttccgttgcctttggcaacaccatttggcgacaacggatggcacaatcgcaaacggcacaccgtcctgataaactttctttggatattattcaaatttttgattggtaaagtgtcaatgtttcggcctcgagccattaacactaccaaattaattaatgaattgcttaattactgtaattaattaataattgcgctagtgaatgaacggactgaccacagcaaatggccgatggcgaaccaccagagattgtagccgaaggaggccagcaatttgtacacgtccatttccttggaagaggacagttcggtgaccaaaaaggagtcgaaagagacggacagtcgcgacacaaagtcctaattaattgccttttaattggcctatttaatgggttttgttgccgtccacctctgtattttggtactcgggcggcaattcgcgctctttgctccgggcggggaatttctcgtggcggcaaactctcggcgaacccctggggcaaataattcgagatattttttttaaatcacggaaatatttgaaatttttaaaccccctaaatacagaaaatgataattaaagtgaaaaaatcaagtttttgcataagactaactaaaaaaactcgaaaattctttcccgagaaaagcaaattttaaaattttttcatttacgattaaattttttgtttttttcaccattttttgtccactntataaaaatttttttttaatat

SEQ ID NO: 7696 - DNA, 1922 bp, Heterodera glycines
  misc_feature (1913)..(1913): n is a, c, g, or t
aatgagcggaaaaattttatttttaaaattatttgttatatagattcctatattgtaatcactttttaaaaataacacaccgaatgtattaagtaagctgttcctttgcagaaacaagggcccatcgtcgtggtgagcttgcccagcacaccctcagttgcgtcatttctccaagaaacttcagggtctttttggtgaaaaggcttggtcttatgccttaaatatagtaaaactttaatatgactcaaataggcgaaacatttaagcaaattttgaaaaagccgaaaaattattgtttttaattaaccacaaaaaagttaaaccagcaggctttttaaaaaatgaaattcatgggaaaagctttaaattaattccaagcgataaattttgtatttttcagaaaaattatcaacgatcccagataggacttatcatatgtagattttgaaaattagaattctaagctgcctatgaatttaaaaatgattggaacatacggagttcccaaaagtgtgtcgattatgtcaattgcttggcggaagccattgcgtgcagtctttaactggctgatgatttcttcgttgccctctgaacggacgagcttgattttgtcggcagcgtggatggcgtcgtattctgaatgtttaagttgtatgttaggtaaataatatttggaatcaaaaatatttaattattggacacttctcaaacaacaaatttgaggggcggtgttgactgccttccccccttccaaatatttgccattttcgtctgaaattagcgattgtcgttggtttcaatcacaataacaaacgacttattttgcgacagatttggctttagtcgttcgtaattgtgattggcccgggttaaaaatgttaaaatatatcttaatcaattaccctaattttcgcatttttctatttattttcaaaaaatttttagtcaacatctactaaaaagtgttaaatgaattcataaaaaaattacccgcggccccttaggcaccgcttctatcccagagcttagctgtgatgacccttacttacattgaaaaatcttactacacacacacacacaaaaaaaatattattttttattaacctttaattaaatcgacggggattaatttattttcagttgttggaacgccaattaatgccacagaaaaaataattggaaacatcagaaaatacagtgccatttttgaatactttatgaaaatgattgtgaacgtttcgagataaaatgaatggaaatgcacagccaaaaggtcatttataataatgggttttgtgaatgccaacgcataaaagggaggcacccaaaaggtcatacatccatttgtgcagagcaccataaaaatttaaatatcagatggaaaaggttatgtaatgagtaatatttttggggcaaaaaaaaggcaaatacaaaaattgttacacataaatttagattttttattttgtttcttaaaaattattttttaaagaattgatgaattatagaaattttggtttagtcatatgtttagactcactttttaatcctataatgttcataaaagcaaaaatgtaataaaaaagaattaaaaaaaaagatttaatttgaacaattggttaaatatttcaattttccctgctctttaatcaaaaaaaaaattatcttctggggatatgggtcaaaaattaatgaaaacaattattcaaaaatgggattgtgcgcgctgcactgacccgacggcagatggtacttcaggtagtgcatgcacatggtcatcgaacatttggacgactcgaccggcccgaccagcagcatcgacttgcccaccgagcggatctggtcgcacagaatgcgcgacacgggcaatttggaggcgcaaattgcgtcgatgatggtgtccatgggtcacnctggaaaaa

SEQ ID NO: 7697 - DNA, 5891 bp, Heterodera glycines
  misc_feature (1945)..(1945): n is a, c, g, or t
cattttgttaaaaaatttatccccctatggagcggaagaacaggtcgcgcccctccaagaaattgaaatttaccaaaacctaagaatttttcaagacaccgaatttaaaaaaaaaaaaactttttaaaactcgaaaaagttgtgaatcccggagtttttaagaattttcctagtttaacaatttatgagaactgtttttttatttttcgagtttagattaaaattattacaattagaaaaaaaatttctagatttttggcgaaaaatttggtgtttcgggcagttagccgcaatttaaaacaaaaattaaaattaaatattgtaattaccaattgacgtggctgcaattgcaccgacagcagtgccttagagaaaaggaaaacaaaaattattattatcaaatgagtcacaaattgtttttaattatataaacagcaatttatttattttttgttttttgtttacccggctccgccgttgctcgacatattcgcattgcacaaatgtccaaaaattggcgcatttggccaagactgaaatttaaaaacgtatttttcgtttttttgaaataaaaaaatttttatatgtaattcaaaaaaaaatttttaaatgtctgatttcaaaaaaaaaattaaaccaatttttcagtttctgggatttaaaaaaaatgcggggagagggcaaatgaaattcacccctaacaaaatggcaccaccaacaccacctgaaccccgtggcattcaaaagggcccttcgccgggcggcgatcggctcgcagtcgcggcaacgcgtggaatggccgcctctggaacgagttctgtcaccaaaatgcaaaattaataaattaaagttgtttctgtttttttgctcacgtcggtgacccaatgccaatgtgccgttggcattggcccggcacagagtgcagaagacgcaaattggctttgaacagatcagcgaagaatctgtgaaggaaaattggaatagaaaaatttaagtcattcaggagatttaaatttaaatggaatggcactgaaaatctcaaattttttaagatttaattaaacaaagaaaaattcgaaataattttttgtataccaaacaaaaacgcaaacagttcgagtcttattgttaattaaacagttttataaagctttacaattgtaaaaaacaaaatattttcggacagaaaaacagacggagaggcgggtgaattgaattatttgcaagtctttcaaggacaatgactttcgcttccattcggcgcccgaaaaccggtttttaggccccatttttgttcgaaaaaatatcggccgaacattgacacgtttgtccgatgtcatagcgctatattttcatacccatttatacagtttaatactttttatatatgttcccacttcaacaattcgtctccgaattgggccgtgatccgtgggagatgttgcagttgtttttgccgcggttttctctgctcattgtccgccgcaacaccaccagtgtgctcattccgttgttgttgctgttgtactccttcgccctctccgacactttgttgccactttttccgtgccgccgaccattccgtgccgatgccctcccgctcgatgaccacaacgtccatgcgttgcacaatttcggcacggatggcctccgcaaggttggcggcggatgcagtggcgtcactggtggtgccaagcaggtcgtacacgacgccatcggcggtgccggtgggatccatgggcctattaaaaaattcggaaggccttttgacaaattttaacagtggaaatcaataactaatcaaaaaaatcttttgaaagactaaaaaatgtttaaaattactaaaatgcattacaaatttctgtaaaacctttaaaaaattagggaaaaatggcaaaaagaaagcgttttttgataaaaatgtaatccaaattttatttttttnttagaaatcggggaccggacgggtcgaaaaatctgtctaatcaaaaaccggaccatttctgattgattcgattcaagcaaataaattttcattggtcaatatctgtttttatgatcagtagaattggaattaaaatttcataaaatggttttatctttctgtataattgaaaagatttgagaatcagtagagagaaattatatatacaaattgatgataatttttgaatgaatgcctcttttgccaaaatctaagcgctttttgagaatatttaaataattattttataatttaacacaataaaattgtcaaaaatgaaattatgcttatttttatccgttttaattgcatttttaattgtgctaattgaaattggagcagaaaagaaaaaattggaacaatcatttgaagaaatatttggagaaaaatgggaagaaaaagaagaagaaaatttagaagaagaaaataaccaaaatgaaaatgatcagaaaaaacgagaaattattgagaaattttacaaaattaaagaaaaaattaaacaaaacgaaaaaatatataccagaaaagaatggaataaaattgaacagaaaatagggaaaaaattggggacaaatcgccaatacatttacaaatggatcaaagaattaaatcttcaaaaatataaatgccacaaatcaaaaacggatgaacaaaaaattgaaattattcaaaaatttaattcaatgaaaaatgagtataaacaaaaaggaagaaaatattcaaaaaaagaatggaagaaaaatttgcagaaatttataagaaaattggaattaacgaaagaagaattaacaaatggaagaaacaatttggaatgaaaggaaaaataacggaaaagaaaagatagaaaaaataaaaatttattggcaaatgaaaaatgaaaatccaaaatgagtgatggaaaaattgcaaaaatattgaaaattaatcgaaagaacattttcgaatggaagaaacattttagagaagaaaatgttcaagcataaaaatggatgaattgagtttttcaagaaccaatgacccaaaattcaattattttacagagaactctttttttatgtttgatgtataaactgttttaatgactgcaaatttaaattgtttacgtaggctcttttttttaattgattcattaaaaaaaaatttatgacacttgaaaattgacagtgccaaaatgtaccgaatttttcatgaaaaaaaataattttttttttgcgaggcagtacatcaccctttcgccgcccacctggtgttgttggtgttccgcacttgggccaacatgtgttggaagtccaacgggcggccgtccttcgcctccatgtacgccgggtcgaggccgtcgtcgccaaacgtgaactggaccacctcgttggtggaggtgcgcaccgtgttgccatagttgacagccaaatcctggcacaattgaagcgagtagaaataataatacgataggctaattgtaaatcatttttaatgttagaaaataattttttggggaaaaaaattttggtttaaaattcaagggttgaaggcctttgtaaaaaaaaattatatcaatttttaaattaatcaaaaattgctaaacaaatttttaattcccccgaaatttattatcccctccaaaaaagccataaaacaaatggagtagtaaaaaatacagtactttcaagcaataaaaaaatccgctcaacccaggggcagaaatttttgcgctcaaagtgcggcagggagcggttctgcgaatcaaaaattaaaaatttccaagaaaaaatttcccagcggcgccattggcaacgccgaactgtattgtaccattattttttgaaaattagaccccaaaatggcaaaatttgggcatggttgatgtcgtctgtttttaattaagatggaaggagacgatttaatttttgatccaatacaacggaactaccaaaaaccaaccgacctcaaatccgtcagaaggccgtttgccggagatggactgttggccgaccagggcgatcatctgcgcaatgttgatgaaggatcccttggaaccgcactgggccatcgtcaacggcgccttctttcgactaaaaaattgcgtaaaatttgggcagttttagacggcctttttcggaagttttatatgattttacaataattgggcctcgattaattgggtccttgggcctgttttttacggcacacccacctcaggtactgcttgcacgccttgcccgcctggtcacggatgctggacagctccttcaaaattttggactccaactcctccaccaggcccaagtccggcttgtccttctggcgctccaagcgcatgcttttgttcagatggtcacaaattttgtagccggtgttcagcagcacacttttctcttgcaacaggttgacattgggcttcacatcgccaatgcctgaagatggagaaaaaaaaacaaaattattctgggagtatggcaggcgtcgtggcaaaataagaatttttgggtgcactccaaaatttcccctgtaaattaaaaaaaatcgttaaaaaattccaatttttttttcaaaattttggcggtaaaattttgtcccggcgtaatttaggccagcaaaagtatcaattttcaacatctttttttggttagccgacttttgcggaccactatttcagggttgaactgtctaaaaaaacaaaaaataattatttccaaaaattgcgttacctaattatttttaattttgatttttccaacttgaacatcgcgcttaaagatgttctgatcaatagggctgtcatttatatgaaaatccatatatttttttcctggagtgttggaggcctgaaacgtataaaaaatgtttatagcttggtttcaagcttctaggatggatttctatatccatatttatccattttcgcgatttatttcatatattttggcatttatgcccatattttgcgattttataagcatatttttgacatccctactgatcaccttaagcaataaacatcgaaagtaataaaacaattttatttttaagaagttaagtttccattgataaatatagtatatagttgctcgttcttaatttcggattcatagttttataacagcaaattacggacaatgttagggaaaaggtagaactattttgagtttttttttaaatttaattgtttgtcatgcctgataaaaatttaagctctaggctaaccaaagcaatttttttttaatttttttttctttattacacagttcaactgagaatagcggccgaaaaagtcggtccgcaaatgtctcactacgcttttttttaacgacattttcaaaaaagtattctaagtttttttttgtaaaatttatgtctggaagggtggggatggaagtcaggctcaagctgaaaactgaccgattgagaagccccggttggaaaaatagacggcggaaatgcgtgccaaccgccacatcgcctcgatggcatggccctcgccccaatcgcacaacaaacggtagaaaattgaacatttgctttcagagccgagcaatgctttgtcaagcgaaccgcacagcaactgattatttcggatgatcacaaaggtgtcctgattgtgagtgataattgaaacaaagaaatttttaatttttaaagagtttttgcagaatcgttttaagtcgttggaaaaaattttaaaaaatcctttttctttagaaaataagaaactcatgaaaatatttacaaattgttaaaaaaactcgttagaaattgaaaaaatttttggttttccggcgaggtataatcccgctgcgaatttgaccacgccatttttcaaaaagtccgtaacacttatgggcaaaatttttaaaactcggttttgtaaatgtgttaaggacaggacgggaaaaattgtcaatttgcgatt

SEQ ID NO: 7698 - DNA, 1865 bp, Heterodera glycines
tttaacagattttcaatgaaaaatcattatttttaccaaaaaaaatcaattcttaccagtgcatttttactcccgttttcgggtaaaaatttccgggagcgggatcgggagttcaaaattttccgggacgggagtcccgaacgggaatcccgtaaaaatcccgctcccgttaaaaatcccgttcaccgaaaaaagcgggagtcgggagcgggactcccgtaaaatcccgcgggagtcccgatcccgccgggctctacttataaccaaaattattttttctctatcaatatgcaaaatttggtgcaaattgtatgagtagaaaaaaaagttataccgtatttgctctttttatataccatggtatattatttttcaaccttctcagaagggggtatataattggagactggcagactaatggagaccaggagattatttttcggttgatttatttagtggaaaattttttgaatatgttgaacatgtcgccaaaaaatgtcatctcgtcaaaaaaaaaattttttctattgaattttttgttaaagaacttctgaaaatgaccccaaaatggcaaaaatatgtaattttcttgcttccggtatgcataaaaaattggaatttttaatgaaaagttaagaaaatatggaatcgttttggtctttaaaaaaaaaaaaattgtgcgccagcactaagttgaaggggtgacccccctttagcccctggccaggaaggggtctcaaaaagttagactcgggcgggtgtgctttagcgaaatgttagctcaggcgctattgtatattattgtagagctcacctagtcacatttaaaaaaaaattttggacccctagctcaaagttaagtaggtcatttgtccgaaaaactggtcaaaaagggaatttttccgaatttttttagagttgcatctttttttgcgcccgtagcggcttttaagttgccgtgggtaatgggcgaggtggtttttggttagagcattttgaggcggttcttttaaaaaatttgagtccctagcccaaagttgagttggtcatttgtctaaaaatttggtcaaaaaagtcgacttttcgcagtgagtgggggattttgggggtaattgagtgcgtagagcttgatatttgtttttaaatgggttaaacaatgttttgacaggtctaacaatgtttgggagtagtggaacaaagtgtcgacaagtcggtcaaaatgtcgaaatttttaacgtgatcaaaatgaagttttttttgtaattttttatgttttgaggcatagaaacagccttctgggcttttttgcgcgagtttagggcaactgaaacggttaaagatggacgaaacgatcacgaagaagccggccaaataaattattaaaaaattctatttatcccccccccggcacataaatggagactgggagattatttttcaacctagttcaaagggggtatataattggagaccggcagattaatggagactggcatataaaaagagcaaatacggtaattccatgtaattttaatcagaaacgagcgaaatttcgggttcggtttcggcagttccgagaagttcgacccgattttgataaatttttaattctttcgggtttccggttgttggaaaaattcgcccgtttctgctgatcagagaacacaacaaacattaacatagctggcattgatgtagtgggagtcgtcgatgcccggcctcagttccaacaccacgcggttatggtctgaaaaaggccaaaacatttaatagataaaaattcgaattaaattttaataaagcaaaataaaaagggagggatttaaaaaaataatttgaattttttatgtaaattttgtgcaatt

SEQ ID NO: 7699 - DNA, 3088 bp, Heterodera glycines
aaatcgtttgttgctgttttcaggaaagcaaactgaaaggaccttcacttttttccgcaatgccattgcatgggaacttcaaagatattgtggcagaagtgaaatttacaaatcgcattgaaatggtgtggatttgcagcaacacgaaaaaaaagatgttggcttacaggtatttgttattaaaacccaaaaaatatttcccaaagccaagactttgttttctttttcaacggatatttagtatttaatgcttgagcagcttattcgaaattttaccattctttttaaatttttggaccccaaaccgggattcaaacattaagtccaaacctcaaattttcgaatttagcactttttgaattttacttttgttcgaattcgggtacagagatacgaaattggtcgaaatggattgtcatattcgtgatcaacgatccaaaaaccgtcctaaagtaaatatttttaaaagtacataatttaagcacatttattagcattaaaaagtggattgtatctgatgcctaaactacaaaagtatctatttttatgactgcctattttttttttttttttgttctctccgacgacatttattaacagcatttgtatgaaaaataaacgagggttactattttgagtcaattttttttagaagatgaaggggtttttgtccgccggcgttgccattagggctacccggggattttttatttttatttttaatgaatttgctaacaataaaaagtataatacatttttggaaagccttttttccttcgcacttaccttcctgtcgtcctatgcaattcttcgaaaatgttcctgcatatttttgttactactgttttcgtatttatttgctaaccaataatacaattttcagttacgaagttccattccaaaatgcatccaagctgatcatggacaaactcatgcggtggtaccacagcgaaaaccccgacaaacagttttcgcttgttccgcttccatttgaaaatgttggacggatgagagaagcgctgaacaaagagttggatgcgaactacgacggttgtcgggatttcgtaggtataaatattatcgttgtgctctttaattgaattatttataaatttgctaattgttatacccttttattagcaaaagggggtaaaatttgttaacctttttagcaattgcaatattttaaatgggtgcacaaaaaatcgctgaaaatttcttgagacatttttttcttaaaattttctttaaaaaactctaagatttaaaatttgctaattgtaagttttgaaacagctaataaattattgacatccttaaccaaaccatcgcgctggttgaactttcagcagaatttttggctctaaagtttgcacgaccataaaaaatttacgcaacccttaaataaaatgatctttttaacgctttaaaaaaaattgtggagggatcatgcaaaaaaaaaaaaccaaattgaaactttttgaaatttttacagactaatagataatcatagagctactgatattacaattagcatggacaattcaaaagcatttccctttctaatttaacgcattttttaggcggtgttcatttctccaaagtgaacacctccaaactgacagctgcgctgcactataccattctgatgccaagcagcaacaaacaattcaggtaaaaattggccggaccatgcaaaacagcaattttacaaatactcaacaaagtttactcaaaattttggggctatattcaactcggacaactatgaaaagatttatgcccaaaaaacaggtgttgcctgcccagttgggcatcgcccaattgtttccgtcgagggaccctttctcccccgagtatgatccccgccccccccccccttcaactatgttttatatgtgtgtgcaaaaatttcatctaaattattccatcataaagacacaccaaaatctttgttttcttatttctgaaatgagccagacccttggcttcgggaggcggggctgaattcaaaaatcgatttttggggtgtattttttgttttttttaatctcgaattaggatgggtgtgttttactggcttttatagtagtttttcgccaaaaatgagtatttttgccattttggactatgtttcaaaaatatggcaaaatatgatgtggtccggcagtgctaacaatgagacaccgccgggtttgttaagagttgcttaaaatattcaaaaagttacccaatttctcccatcggcggattgtttccaacgaaattttttttttaattccatatatttttcggacatggttgaaaactaatgatatttagagggtttaattaaaaactgattcatttcaaattgtccattgtttagttgggacatggaactcattaaccaattctggcgcgatgatagcgaaaagcagtttgaagactaccaaattcccgaatctccgccctattggtccagcggtttcctgtcgattcagtacgcaattgacaaggcgttcatcgaattggtccgttttaatatatatatttttgaaaatggacttattgttagtttgtcgtttttcacagtgtgcccaattaaaaaaatatatagagatttcacttttttacgtgcttttaaggccaaaggtgacgatgctttggcaaatgtttcgctccgtctccaccgtttgcccattccgtcgtacatgaacaagcaaatggccaccataacggtgcccctttttctgaccatgcttttgtttgtgttcgccttttccatgctgaaggacattgcggtggaaagggagtccggcatcatggtaaggatgtccaaatgggctgtactaaaaccttctgaaaatacaccgaaaagacaaaaaaaaaaattaatgaaacgaaatgtttttttgaaaattgtgcaaaagtttaaaaaaatttactttcaaaactatggcccaccacatttttaaaattcaaatacttttaaaacttttaatcacttgttttaaaagaaatattgtcagctcgttttaagtaacattatttactattttgatctcacttttctattttggctagttgcaagactgaaaactttttg

SEQ ID NO: 7700 - DNA, 3842 bp, Heterodera glycines
ttattctatggtacaatttttgcatttcaattaggacttttaatgaatcattatgggaatggcgagaaaattgttcaacaaattagaaaatcacagataaaaaataaaagaacaacataggtaattagaaaaaaaaagaaattttattttttcccatcttttaagaggataatgaggattttcaacaattgatcaatttgaaattttatttatttgttatttttttccatcttttaagaggataatgaggattttcaacaattgaccaatttctttgtcacttttaaagagggattttctttctttatttataataaatattcattttggtcattttttcttcattagaatatcgttttctacttaaaataataaaaaaattttctttttccagtacttagctgttaaaccatcaaaagaaaattttcagcaaaaaattacccataactttgttcaaactcaactaaaattttaattcatgatatcatatggtagccctaacaattctctattagcctgtaaaatttcaaagaattttgtcaatattgaataatttaatgccaacaattgggtatcgaatttaatttaagatgtatcactaaaaaccacggagcaggacaaaaaatcgtctgccgaaacgtcacggacgaatttttggaccataacttttttttctttctcaaccaaattaagcattcttgctattattcgtaagcatttgaaaaacgctattaaactgcaaattttcaataatttatattcatgcacaaaaaaatcagtgcaaaaaaaggttcaaaatactagctttttgagttccttctggccataacttttttgaaacttaaccaaaatttttgaaattttgcaataataaacacacagagctatcgaacaataccaacaatgcttaatttgattgacagtgaacaaagttatggttcaaaaagtcttccgacgacgtttcggcctttttcgatttttgaccgaaacggcattgtttttttttgcatattttattttacgtggtgcgaggcggcaggaagtcggaacagttggttgaacaccgtctcgatgatcacataattcaacggcacagtgtccttgcggtggtattgcagcagcgaatgggcacacaatttccagtccaaataattgttgtcgatgatccagtgcaggtcctcctcaaccagaaagcgttcaatggcgtttggaattggcaacacaacgtcctgaacaggaaagcggtgggaagggggcaattttaaaaaatcgtaaaatttaaaaaaaatgaaaattcaaagcaaaagggcgtggaaaccccgtaaaagccccaaaaatcaaatacgcattgttgccgagagcgcactctccaacgcctaatttgaaaaacttttttttaaaacctcaaaaaaaaaaattttttttttaaagaaaaaccgaaaaaaaggaaattttcgaagtatcctaaaattttaaattcaataacaaaaattttctggaatttggctattcatatgaaagtttttcaaacattgtgatgaaaagcgaacaagggaaattttttttcgaaaaatgagatttaaaaagtgaatttattagctttaaatactcaattccgaagctttttctccaaataaaaaatgttcttacgctttccatgacgtcatctttgccgaagagacggaaaacaatgtgcggcattggatgctttttgcttgtcatcaaaacgtgttggtctaacctgaattttttttttcaaaaatttaccttcaaatgatgggccattttttactcgggcaattgatgggcccccgaggcgacgagaacgtcctcaaaaaaggcataagtacgcaaaatgtgccgctccatccaatcgttttggcacaaattttggagctgggaccacagactgtccaggtagtcttcctgcttgggatagtcagtggcagaccaaattttcaacatctgaaaatgccaaaagcatcgaaaattagccaattttgaatttttacgaccaaaaaaatggcatgaaaaattttgaaatttcaattctcacatcaaagtgtggcttcgtccgcttgccaatgtagagtgaaatgcgcgccatgatgtcattcaatttggcgggcaatttggcgtacagttcagtgccaacccatggcaatgtgtgcaggacgaggtacacgaagaagttggacttaatctgaaaacggaaaaatgattctagaagaaaaataatgctattgggtgttaaagttaggttttttttcttccaatttttttgttgaaatttttcaagaccaaaaatactacattttcttccgtggccaagtcaacaaaattctccatgaatgaaacaatggattccggcgtcacaactcgcgcattgcaaagatcgcaaaggaaggtggccttaaattagtaaaaatgaaataatttattgtaaattttcaaaaaataattacgattcgaattgaaatgtcgtattctccgctggtgaatgtgtgatgaaattcgtccatgaatttcttcaacaatcgctcaccaaaatcggcggaccgaacattcagaagaccgacgagtgtggagaaaattgtgatcttctcgggcaaataagcggcactaaatttgaaaaaaaatttacaaaaaaaatttcttcacatactgatataggtaatctaatttcggagggtatagtttttttgtggaaagttgcaataagagtcagttagttatcttttaggccagttttgaaaaaaaatatattaaaatcaaagcgtgacggagacattttttaggataatttaagtcgatatttcggcttctatagtatataagtttaagttgggaattcttagttggtaaaaattggtgtcagtatgcgatcagcgtaacccccgaaaacccattagagcagattttctcgtcttttatggctaaaaattttacaaaccaaagcacccatctaattttctaaattcgtcaattttcatttacatcggcattttcgtttttttcaaacggaattcaaccatgtcacacagttagtctgacattcagttgaatgaatcatacaatagacatagactcgatttctaaataaaatcgacttccgagcgtttttcggtgcctcgactgatgcaaatgcaacaaacactgaccattcgtagagaatgtggatgatctgtccctcgtacgggtccaaattgtcctccaaaacgttggccaacgattcaattgccgactcaatggacgcaccgtgcaattggtcgtccaactttttgatcatgttcaccaattttggtcctatgtcttcgccggccggcattcgctttttcttcatttcaacaccgtccgcatcgatgtccatttctatgcaaaatttatgggaattttgatggaatttatttaggataaataccatccatcatagtttcgtcacccggatcccgacgcttttttggcatcgaatacataatgcaatgaatagataaaaagcaaaataggtatattttctgaaaattgaactttttaattgcaattaagagattctacttttttatgaatggtaagtttagagaaaatggaccaaataaaaatttttgttaaatggtctacatagtgataggattatacagagttgaaaaccggaatttcctgtttttcttttacaatttgaaatggacgttgtgtattagaaccaaaattaccggtctacctcagttcggccccgtatggttcggccccagccgattttttgactataacttttttctttgccaaccaaatccaatatagttaaatcattcgaaagtttaatatgcttagaagctttttctaag

SEQ ID NO: 7701 - DNA, 3591 bp, Heterodera glycines
  misc_feature (3524)..(3524): n is a, c, g, or t
  misc_feature (3581)..(3581): n is a, c, g, or t
tccaggtccaggtcattttttggcaacctggatttttcctggacctggattttcctggatttttgtccaggaaatccaggtccaacatggaatccaggtccaggcttttttcaaaatatctagttctagtttgatggtgttggacggtttctattaaatttgcatcgtcacatgtttttctcatttttcgtgcctattttgtcttaaaaattttgctgtgctacccctaaaacagcagggaagtaccgaaaagattcattttttttctcatgccttagttattgagccactcaattttggcggttttcaacaaaatttaacgcttcagcgacacaaaaaaaaaatttttttttcaggggctaatgacataattaaattcccctaattcattgtcacagcgcttcaacagctcgccaacagtcagcaccaccgcgacttccccgtcccgtacacaagcggaatgttcggttattcgcgcgaaacaatccaacaaatgaactcggatgaggggctgaagaagctgcgaatttttgttgaaggcgaacaaaagccgtcaacattgaaaaattggatcaatttatttcgtgggaaaaaattatgaacaacgacgaacatattctatttcaatttctatgtagaagattaaaaaagagtaatacaatgatgtacaataataatttcttgtttctccatcaaatttagaatttttttggttttctgcgccgtataatataaatactaaatgtttggtaatactgccgatggtcccccccccccccattttttggtgaagttttttctgttctaaaaagccgtgaaaacacattttatgggttttaagggtcgctcgctgatcacgaattctgacattcattttaaccaatttcgaattccggattcgaacaaaaagactcaaaattgtttcttttgttcctaaattgataaaataagctaaatttagtcaaaaaccgtcacaacatcaaaaaaggtcattctatacagattcgaacataaaagtgaattttgatcgacttgtttgtttgaattcgggtccgggattcgaaattggtcattaagctatttaacactataaaaatacaaaatccgtaggaggggagggaaggacgacggaagaatgacgagggatggcggaggggggggggggatttggaagtgatcggatcggaaagaattaaaagaccggatggggcggggacggactcctttgggtgtccatgtgacagatagaatgaaaggggaggggggtaagcaaaagggatcattcttttcggcgttttttgtgcaatcattggcatttttattgcccatttcgatttgaatttgctccgtttttcctccccattcgcattttaaattatcttattcttctcctataagtgggatcaaaatacctatggcctatggctatattttcgagaaaatgaacttgaggaaacatacaaaatgtctgtcctttatttcgtcaaaagccatatgtacaaacacagttatgcaacaacaatttcaatcaatacatatgtcaacaatacaatacatgtgtatatcggggatggcagcatggacacaaaataatacatacaatacagtaatagtggtcatatgatcaattctgcacggtgacgcttcttggcgattcttctgctgctgctgctgctgcacggctcatcagttgaagtagctgtctcctccccctcctcctccgccgcctccagcgcccggtgccgcgttgcgcttgcccgtctcccagtcgtaggggaattcctggacgccggcgttgctgaggctgctgcgcaatgtcgcgatgatccagtcgtagtcgggcttgtcggtgtacttcatgtcgtcatgcaaaatttaatttgttagtttttaattttggaaaaacgaagtgcgcgggcggtgttgctggccctgaaaaaggaaagggaacaaaattatttttgtttttttcaaagcgcttcattcaaactcacgtcgtccctgatgttcgtttgattccggacgtccgatggtcgagttgctcgacttgatgttgcagtggaggtagccgactgtgtggagtcctctgagagcggcgtgcagagaatttgtgtattcattgttcaatgtgtgtaataaacctggttaataaatgtggcaaacattgaatacaggcaaccacaaaatgtacatttaagcatactagagaccagggttaccctttgtccttattttgagggtccaaatcttagaaattttaaatgtccttatttgtaagatttgtccttatttaagctctttgtccttattttcgtcttattttttggatttagggagaaatttagtttttaatggtaatttttgaaagaaatgttttttgaagcgaattaatatgcaaaatcttaacaagattcagttaatattcaaatttttctctcggcggtttcttattctctctaaaaaattggctcaaaatcgtaattttgtcattttttgaacaaaatcgttaagaattcgtattaaaaattacaaaaatttttccggcggcgcctattagagcaggggtgtatctgttcttatttctaagaaatgttctgatttggggtagtgccttattttcatttaaaagaggaaatttctgaaaaatttggctaattcctaacaaaattcattaaaattcttaaaattttcccccagcggcgcctatcggcaccgccggccccccaaaactcctatttttttcttaaaattagcccaagatcgcaaattttggtcattttttggacagaacttgttaaaaaattgcattaaattttcaaaaaatttccctgcggcgcctatcgacaccgccggactcttccctcacctatacccaaaaaatttaaaaaaataaaattgattttcggaaatgtataaatttctcatttctaagccggacttgcgcagaaaaatagttggcggtgagtaatgcttggttttgttgaataaaaatagcgggaatcccgtaaaatcgcgcagaagtctcggtcccgctggtcaattatcgggagcaggaaaaggatggacttcaattgttatttggataaaaatgcgcaatttgcgccaaaatttgaccgcttttaacttatggcactttgttaagaacattccatcaaattcaaagtactgctcaaaagcttaattttccattttgatgtaatcaaaccaagacacaatttgtaatcacatcaaatcagttttattgcacatggaaatgattacaacattggtgagcaaataattatgtgtacatattacaggcaattttgatcactggaatatgtatgtacaatgatgagcaattggtgatcaaatggggccactcacaaaatatgtacaatgatgagcaattggggatcaaatgggctccgccgctcacaaaaaaaaatatatatataagcacaatggtgagcaattggtgatcagaatggtgccgttcccgctgcgctcacttcttcttggacggcttcttcctctcttccgangtgctcttcctcttcttctgcggcgcttggctcttcttcttcttttcttcctccgangtgctcttcc

SEQ ID NO: 7702 - DNA, 2757 bp, Heterodera glycines
agtccgtttcatataattagctaaaaattttcagaaatttttcggacaacatcttctccaaaaaacacctcccgaagaaaacgaagaaattacaagtgagttggttgattatatatgtagtaattcatgcagtcctgatggagaaggagagtagatgagagagagagaagaggaaagaaataaagcgatggagagaaaagagagaggaagagcaaaaagagcaaacaaaaagaagagagagacagagggaggagagagagagaagagagttacaggcctgtaaccagaaaaaaacggtagctgcacccgaaggcctttttaaattgggatccggcggttccattaggcacggcctgggaagtagaaaagttagggcctaatttgttagaaaattaagtgaatattaaaaaattactcatttttctgaaaaattttagttttcattttagatgtggttacgggcctgctgacgattttaatttgtccatttatatatttgaggggggggggggggggggggagaaacattaaaaataaaaaaattatacatatttgtcctttttagtctacatttattcaacaatttaaaaaatgggttcattcggagcctgtggtcgacatggcctgcgacgtggccagcaaaaacgcaaagctccttagtggaagagtcttgcagaaaagtaatgggccgccaaaaacattatgtgacaatgtcttgtcatccgttccgattccgacggtcagtgcggttttaatcaaagaaagatttttatgagaccctcactcatcctgttggattgcaaattatccattaacaattttaatggttttgcgttgagttcacataggaataaaattttcggtcctaattatttagtggaaatgagcttgaataataacgcatttttgacatttaatcaatttctcaggaggtatggaatcaactcgtcgacgtcactttggactttggcataggttctgccgttaaacgcgtaaaacgacgcaaggaaaaggaggcaaataaattggcgcttaaaaacattaataaataaactgcccacatttgaaagatttattaattatttgatgaaatgtctttaggcccgggacgcccgctaaatgggatttttttgaccgggtagctcgagcctggttaatactcctaacaataaacccggggccggcattttcaaaattccggtctctagttgattaattattcagtgcaataaggaattaaccaaattaataatatcataaaagaatttgcacttattttgcattattatttattttatttttttaaatattttttgaattatttggtttttgtcgaacacataaattatttgtgggttaatcctaacaaaaagagatagaatttatttggcattatttttatttgctcaaaatttcagaaacttgttgacccgttggcctatgtcggaatgctcgcaaaacgcgcgcttggtagtgccttgaaaataagcgaaaccccaacaaagtgcggtggcagaccaagcgatggtctcttctgttcatcattttgggaagatttcttttcttcggttaagacggtcagtgcttttgttggttttacaaagcaataaatcgcatttttaaagtaatgctggtcgagacccaaaatttcctgagactcgagactgagatcagcagaaaaacatgactttaaaaaagtttaaattgtacacttgaaacccgattaaaacttaattaatttaaataattcttttttattgaaatttcaaacaaattttgccgttgcgaattttggttcaattacaatttatcaatcaatcgttattttaaaaataaataaaataagtggttgatcaagttaatttctcttgcctgggctatttttacaaaattaaaaaaggaggtttcgtcgtagagaattgagggaatgccaaaggtggaatagaaaaaaaaacaataaaatttggaagcctcttttttctcttcgcaaattcaatcggattttgtcctttaaaggctcccagacatttggaccggcggagtggacaattggacattaattactacagtgaaagaaatatttttttattggttttagcattgtaaatattttggattctaagaaaaatgaaaaaaaaattaatttcattgctagtcttttttaagagtaaaaaattaattcactgccgttatgtcctctgttcaattgtccgttactttccaaatgacttcctcttaatgtccattggccaaatgtccggtcacacctaaatgcccattttttgaatttttgggttgaagcccggcgccgggaactttaaaactttgaggaggagttcaatcgccaatcgcaaggcccttttctgacccccctcttgcacagctaagaaattagctaaaaattcgttgacatttaaaattactcaatttattaggaggcatggaatcaattcgtcgacttcgcagtggacaaaggcacaaattatgcaattaaatgtgcgatcgaaactacggaaaagaaggcaaatgaatttatgattaaaaacccctatttttgtttacaaatttcagaaggaatttttatggattattaaaatgcaaaaaattaattaagcaaattaatattataactttcagaaaaataagcccaaaaatgctaaaaaatcagctggcggcaattcccccaaagaaggaacatttccaaatgtaagtcgtgaatgaattgtattatgaattcttaatttttcatttccattc

SEQ ID NO: 7703 - DNA, 2820 bp, Heterodera glycines
tcatcatttgggaagatttcttttcttcggttaagacggtcagtgcttttgtggttttacaatgcaataaatcgcattttaaaagtaatgctggtcgagaccaaaattttcctgagactcgagactgagatcagcagaaaaacatgactttaaaaaagtttaaattgtacacttgaaacccgattaaaacttaattaatttaaataattcttttttattgaaatttcaaacaaattttgccgttgcgaattttggttcaattacatatttatcaatcaatcgtattttaaaaataaataaaataagtggttgatcaagttaatttctcttgcctgggctatttttacaaaattaaaaaaggagtttcgtcgtagagaattgagggaatgccaaaggtggaatagaaaaaaacaataaaatttggaagcctcttttttctcttcgcaaattcaatcggattttgtcctttaaaggctcccagacatttggagcggcggagtggacaattggacattaattactacagtgaaagaaatatttttttattggttttagcattgtaaatattttggattctaagaaaaatgaaaaaaaaaaaattaatttcattgctagtcttttttaagagtaaaaaattaattcactgccgttatgtcctctgttcaattgtccgttactttccaaatgacttcctcttaatgtccattggccaaatgtccggtcacacctaaatgcccattttttgaatttttgggttgaagcccggcgccgggaactttaaaactttgaggaggagttcaatcgccaatcgcaaggcccttttctgacccccctcttgcacagctaagaaatcaataataaaatagctaaaaatttgttgactttaaaattactcaatttattaggaggcatggaatcaatccgtcgacttcacagtggacaaaggcacaaattatgcaattaaatgtgccaaaaaatggagcgaaactacggaaaagaaggcaaatgaatttatgattaaaaaaccctatttttgtttacaaatttcagaaggaatttttatggattattaaaatgcaaaaaattaattaagcaaattaatattataactttcagaaaaataagcccaaaaatgctaaaaaatcagctggcggcaattcccccaaagaaggaacatttccaaatgtaagtcgtgaatgaattgtattatgaattcttaatttttcatttccattcaacggcaacacaccgtcgtcggcacatttggaccaatcagcagccgcggaagaagtgggacttcccccttttatcatatgagaaaataaaaaaataacaatgcggaatatggattcggttcttgcaattttgccataaacttttaaaaaaatcctctaaatttttattaaatttattttctttacaattgaagacaattaattgtgattttttgaattactttcgtttaatttttataattttttgggccagaaaaatgtgccaaaaaagggatgggggagaacatagtaaaatgaaagtgaatcgtcttaataaagaaaaaattattaaaatttcagaaaaaacctgaagacgcacattttcttcttcttccaccttctgattttggcgtcggcaaacatgacaatgaaagtgcaaagaaaaataagatggacaaagaaaggatggataacagggccaagacatttgccaaagaacagaagccgaaaaatacaaaaaaacgtgccaatgaatgggacgcggaaaaagcaaacaaagctaccaacaagctaatgaggaaaatggcagaggaaaaaacaaaaatggcaaatgcaatgctttaccctacgaaaggcaagaaggatgccatgtacaggtgaagagcggggggggagggggggaagcaaattgcaacatttggccatgaatttgtccggaatttcggattgcaaataatttgattcaaaatggcttactctatggtcaaatgaaaatttttcgaaaataaaatatgtgagacgtattatccaagtaactaatgcttcaaccatccttaaagattacttggggggcttgagacgaagttactcaaatcggctaatggcaacaccgaatcggcatcggctaacggcaacaccgaatcggcatcggctaacggcaacaccgaatcggcatcggctaacggcaacaccgaatcggcatcggctaacggcaacaccgaatcggcatcggctaacggcaacaccgaatcggcatcggctaatggtaacaccgggtcggcatcggctaacggcaacaccgggtcggcatcggctaacggcaacaccgagtcggcatcggctaacggcaacaccgagtcggcatcggctaacggcaacaccgagtcggcatcggctaacggcaacaccgagtcggcatcggctaacggcaacaccgagtcggcatcggctaacggcaaaaccgggtcggcatcggctaatggcaacaccgagtcggcatcggctaacggtaacaccgagtcggcatcggctaacggcaaaaccgagtcggcatcggctaacggcaacaccgagtcggcatcagctaacggtaacaccgagtcggcatcggctaacggcaaaaccgagtcggcatcggctaacggcaacaccgagtcggcatcggctaacggcaacaccgagtcggcatcggctaacggcaacaccgagtcggcatcggctagcggcaacaccgagtcggcatcagctaacggtaacaccgagtcggcatcggctaacggcaaaaccgagtcggcatcggctaacggcacaccgagtcggcatcggc

SEQ ID NO: 7704 - DNA, 2531 bp, Heterodera glycines
ttcgacacaatcttttcaatgggtttgatgtccaaatatgtctgcttcaatgccaattttacttcctccaattttggcgatgtgccagtttcaaatttttcaaacaccggtgacaggccatgtttacaactctcttggtgctgtttaatactttttcttggcatattgttacgactaaatgcagcatctaattgctcatacactttgcccgatttgctgatgattcgctccaattccatggtgtgctgcatagtgatttgttgtttttctataattttgaaaaaaacatattaccgtaatcctataatatagctctcccccctgaaataaagccccccccctttgaggggggttgtaaaatagagcccccggggctctattataggaaatacggtaattttttggggtgttagggcttttcgtcaaactgccaatgttacagaatttacaagaaaaattcaccgtaattctttcttaaattagcactttacgaaacgccaatgttggcagtttttacaaaactactcagcatgttttttgggtagttacgggtggtttgtggactaaaaatttcttatacaaaagataggaaaaccggaaaaattggctgaaaggcattttttcgaccgggtaccccagaagttccgaaaatcctaaattaatgggaacgtcgctgccgtaaaagcccactcgtaaccaaaaaaaaaattcctaggggggaggaaccctatgtctttttttaaatttaaataaacgtagcccataggatcgcccgggtaatttttttttttttttggctaatttaattttaaaaaaactgattaataaaattaataccaaatttcaaaaaatgcgaaacctttttgagaggcctcccctaaagaatggatgttattagcatttctcaattgttttgtcttttcatcaaattttgacggcgtatttgctctttttgtgtttggtttggaggtgcgtaattgctttgtcggtgcttttaataattttattacattcgccgcattgtatctgattagcatcattttttctgtaaagaccaatttgccaaataatgttttccggcggctctaaaagaaatgcactttttttaatttagatgagacgattttttaaaaaaattttcaatttctcatttcacgactttcgcaaacaaaaaatttttttgttcgaaggttggaatgggagggggacggaaaatcttgtccctataaagttttttttacaaaaattattgaccaggttttctgtaaatatactgggttaattcctagaaatttttctttcagaatttaccatggcttctcaaatttttttaactacaaaaattcaataagataaaatgggtcggggtcgttttcgcgtgggccgttttcgcgtggggcgagtttttgaactataacttttttctttgtcaaccaaatccaataatcttggtatcattcgatagccctaagtgttttctattagccaacaaaatttggaaaaatttcgttaaggttcaaaaaagttatggtcagaagagttcaacaaaccaaattttccaactttttttggctcgaactctttttatactgaacgaaattttttggaattttgcatgctaatagtgcatatgaagggctttcgaatgataccaagaatgttggatttggttggcaaagaaaaagttatagtccaaaaactccgccccacgcgaaaacggcctggcccgtagaatacatttccataaaaaaataaatttaaagtcatttaaaatggtgagggctgacaaataggcatttctgaaattagagtctttatagttttaatttatttttggtgtgttttccaaattcttttattaatctatcctaataatactcaaaattggctgttttggtgaaattttttaataagcctaaaattatcaagtgtataatattggtcctctttccgtactgccttaatttgcgaagttttagtggaatatgtcttcttttcagttgtgaagtggagtgatctccagcattttgctgctctgagtgcgacaacgagtgcccatgcaaaaggaaagaaataacatttgaaattcgatcaaatcattttgccttttctttttaatttcaattattttacgtttcccccccccccttcattttttttgttttgttttgctggcgtgcggaccgcctaattaccacccgctttagcaaaattaaaccatttttggacatcagcagcagggctccaaacaggggaccttttacctcaaacggtcctctttggggccttgagagagaagaacacaacaacaacaacaacatgtggtggtgtggccatgccgctcgtcaatgctttcccaaatccattacaactcactcactcctccccatcatattttcattttttgatcgccacttggcaatttttacacattcgttgtttctttttgttggttttttaatatatttatttattcgatttttttttggatatcgaggttattttatgcctcaatatttcgttaaatgtta

SEQ ID NO: 7705 - DNA, 2252 bp, Heterodera glycines
ggaattttttttgattttttttttcaaaaaattagcaatttttatacaattttctgttaataaattgccttgaaatttttaaaaatttcccggcggcgcctatcggcaccgccggacctaaaaatccttaattttcttgaaaatatgctagaaatcgctaaatttggccattttcgtggacaaatctgttaacaaatcgcattaaaaatcactaaaatttttccagcggcgcctatcggcaccaccggacccctccccctattacccaaattttctaattttctttggaaatgcgcgccgcaaaaaagggtgtaactgtcccaaaaaaaaaatcaaaaattgtataattacataaaaatattttgaaaatcattaaaaaaatttaaattaatatagaaatatactaaacagtttgatatcaccttttacatggttaagaattttaaaatttagcctattaaatatttaaaattttttttattatatttttgaaaaattccgacttccgagttccgacatttttgaggtcggaattccgacttccaagttccgaaattttttggtgcctcggaattccatccctgataagtacgcaaattagccgtagttttttttacgattctgccttgcaattggattaacggggccgctgatcacgaatctgacatcagatttgtcatatgactttatctaacctatgcttttcatcaagtctaagattttcatcaggtaattttttcacttttttaaaaattatattattgggtttttgaggtcaactggtcacgaatatgacatccatttcggccaattcctaaacccggaccagaattcgaacaaaaatcgaaagttcacgttttaacgcattttgaatttttcgtctaaaaggctatgatcttttattgcaggaatgatggctttcagtttgtttccgtgcattcaacctttttcaaaacataaatccaagtttcgtaaatttgaactttcgattttttgttcgaattcgggtccgggtttaggaattggtcgaaatggatgtcatattcgtaatcagcggccccgataaccaccgagtggaacgaaaaatcgtaaaaaaacaccgcctttttaatcgaaagattgcccatttatttgtatttttcatcgtttttcttttttcctggcattttctagggcttaaattatatgaacaaaaaagccctaaacatggactaaaatgcttaaaatggccaaatatggaccaaaatatgtactaaaagttgccaaattataagtttcaggtcctcgaaaatacaaaaaaaaaatgtatataatattcaatatttgcttaaaaatatatactaaactaccaaaaatggatttaaaatagagctgagcgggacgggactggtactgaaaaacacgtacaactgagtaccgaagtcccggttttttttgtgatttttcttagtgtttaaacattttttaattaaaaatttttccacaaatattaactttctcggggtcttggttttccgctcggttctcaaattaagaatggtgaagtaattttgaattaaaaaaatccaaaaatagcgatgaattaattctacctaaagaaataaatcattcacaaattcaaattctatttgatcaaaattatttttttttcgttttgattttcagtttttatgttcccttttcttgttaaaaagttttatttgttatttttggcggtgcaaattgatgccgagaaattaaaatttttgtcggattttcttaattagttttatccaaaaacttaattttgtgaaaatttttgagtaaaggcgcacttcacttttaaaaattcatcagcaatgtttcaaaatatcaattatttattttccaattccgggacacacgttttttgtgaaatttttgtttaaaatctaatgaaaaattgattatattgcttagatttaagtgaaaatttatagttgtcaaagatttgttaaagaaatgcctgttttcaaaagtttttttaatatataatacatattttcaataaaaaatattatattttacaaataaacgcttaacattcatttggcaaaaaataaatcattttgagtaaattgctacactttccttttaatttattttttccataaaataaattattttataaattattattttttgcaataattatatcttaaaaaatctgagtaaaaaattgatttccatcttaaatggaattacgtcgtgaatcacatattaatttttaaaat

SEQ ID NO: 7706 - DNA, 3954 bp, Heterodera glycines
cgaacaaagaatgtttatgaatgttatttcaccttttgattgtatcatcgctacagtaaagctccaactgtccaggcatgtcaattataaggtaaaaccctcggaacttttcgatgcgttcttgcaacctatcgcaaaaggaagttaagtcattgggaaaaaaagcaagaaacgaaaatgactgtcacttaccacgacaaatttgagaccaaagtttgcatgcaataacgcaacgcaccgttaggaccaagttgaaacttttccatcacgtcttcaattgtaattaattcccggatgtcgatatgagtatctaaattttgatacttaagctgtttagggtttcatgaggccattaaccgaatggcaatccatcatttgccgggtctaaattgatcacaatatgaggccgctttatcccgcggaaaatctgctgaagaccagaacaataagtgctcttgccagctcctggagccccaattaccaattgtccataaaaatcggccataattttcaaagataatttcaatacagattctaaaaatatgacttctttacagttatagcggtacacaacgcttgttaaaatgagagctgaagaaatttttcattaccaagcaagcggtcagggtcgttttcataccgccgttttcgtacgggggacattttcttacgagttcttgtacaagcgtcagattcaaatagaaaaacttaagaactaataaaaccaaaatttatcatttttcgtttcccattcataaaattttgtagaaaattcatctttataataataacaaaatccgggacaaactaggtcgcatctcatttttcggaaaataccagcgagaaaattgttaaggttttcgggattgacattggcattggcataattgtgatcattttgagggcaatattgttattgatatcgttatagcgttggacgagacgaagaatccgtgcgtcggcatcgcgatacttctttttctgtgcacccatcatgcaccaatttatcattatttagttttgttttaattacttgctgctggttcattttgtagttaataaaagcttaactgtcaaaacattaaaagtaattaaaaaaattaacaaattatttgaatgcaatttttttttgcatatccactcgtacgaaaacgtcctggcccgataaaagcatagttgaacaacacgttaattgcataaaaacttttgttttcgttaataaattattctttaaaattgatgcaattttgtacaaattcgcaaaaaagaaattaaaaattttatatatttttttactagaaaatattaaaaaaaaattgtttgccccaaaatgtctgtggttcggcaatttccgtcttcatttggacattcatttttataaacagctttaacaaaaattattttataatatttttcattaatttccatcaattaatcgatgggtagaattgcgtaatatttaatattatagaaaattgtcaaaattacacacgtaaatgcgcctcttcaaatcgagaaattggcaatataacatttttttaagttgcaattgattctttataataattaaatataaaaaataactattcaaattaaaaatctacaataataataataataataataaatgtataatttacatatgtcttaaagcataaaattatgcttaaaaactttttttttgaggggaaattcccaatatttcataccctcccctttcaaatatgtatctgtaaaatttttttaaatacattaaaaatttattataattataaataaattcataaaaaattttatgtgaatttatttaactgttttttaattaatatatatttatctagcttgatctgcctaattaaaaaatggtctcgaaaattcaaaacccccaaaaactttgtgagggaattcgaattgcgattttttgaaaagttcacctaaaaatctaagcttttacatattaaaaaaaaaaaaaattaatttatacacagaaatgaaaattcttattgcaatcggcaaaactattttccatatttaggtcctaaaatataccgtacccccgtcattattcggtgctaaaatgcattccaattttgcttttttcgttatttttgccaccatttttttgctgtttttgctcaacgagactttggcaggcggtacttcatccaaacacaaatcgagaaaatcaggtcaaataattcacattatgttgatcagcaattttccgtccgggattttctctgtttgaacggcacacactctattaaaggcaccaagaaaatttggctgattcatttttaattaagcaattaacactcaattttttaaatttttttaaatttcttgggctttcagcaggcggtgaaaagtcacgtcccctgactattttaaattttaaggagctaaacgggggttcgacgtgggaaaacaacgcgtaactttggcttcacattttaatcgttcaaaaaacggtaaaataaaaaataaattgaaaaaagagaaatagccaattaagaacgcagccaaatgaatcgccaaacgaatcacgggcagcagccatggcaaattgcaatgggtgggcatttattagagttagatattttgaaaaaagcctgacctgaattaatttgagataaaacatggtcactcgaaataacaaattcgaaaatattattcaagaaatccaggttttttgtgcctaacctggacctggccctggatttttttccatttttgacttggtcttgttgatttgttattttcataaaaccaatgctttttcacaaatttattccatttttattaatttttgttattgtttcagcctttttatttttcaaaaaacttctgaaacgatatttatcatttttatttttaatatataaaactttttatatatattaataaaccgggtcccttctaataattttcatttttgaaggtgtgcttcaaggtccgcatgatgtaattgtcaaagcaactaaggaaggtaaataagaaaaatgcaagccttaattaattaactaattaatgaattatgtgttgtcatcgcgatcatcatccgtatagattactgtaatttagcatatcaaggaccgaacttcggctcacagtcatcacagtggcaaacacaacatgatatctatgatcataaagacaatggatcaacaagaagggcaaaaggtcgaagaggcggcacctccaaaaactgtacaatacagtaggaagggacaattttcaaacgctttttcgattttgacggtcacggtaaagaaaaattttcgttttgaattgttgaaattgcgtaatgcacaaccgaatattttttcttcgctctgctgcaaccgaattcgccaaatcagacacacaattaggctaatcactttaattgagaaacaaaacaacaaattagaataaagctcggaacaacaaaataacaatccaaacaaacgtcagaggcgagaagacttatttttaagcacaatcaaaatatcaaaaatgcagaagatttttggagaccggagacgaataatcaaaaaatccaaagacgtaaaaatgggaagaaaattgagaaaacaaaacgccaaataaaataatttaaaatgagaacaaagtataattaatatttaacacattcccgcacaaagtcaaaaggcgtccctgccgattaaaaacattcttaggctgttggaaggaggcgattcgtccgggtgagctcactgccagcggtgccaacgagaaaagcgacgacctccagcaacagaagacatcaaaccacgtccaaatccacgatacggatgcatgcgcaactgctgaccggacacagggtggtcatctcgacccatccccgatcgagctgtgattgaacgcaatggtggacggtcacctggacccgagtccccacttcgattttgacggacaacatgaacggcggagcgaacggtgcggatgccc

SEQ ID NO: 7707 - DNA, 4239 bp, Heterodera glycines
  misc_feature (19)..(20): n is a, c, g, or t
gttacattttttttcacanntcttttgtcatcacaaattcattcttggcccttctcgcacaagaccaacaattagggaagaggagcatttcatcgatgtgcacggggaggagggggtacaaaagattttttggtgggatcacttttactttcaaaagtccatcatagggtacgtcgtcgggtgctgtccaattcacattaaaattcctgctcactacaattttcgggactccaacggggtatggggtgtcttaagcgaaaggaaactaacaaaaaagcaagcagatttttaccataattaacaaagggtacaaactaatgatgtcgaacattgatatctcaatttcttcggtagtctttgcgtacaaacaaaatggcatcgttcttcccccggcataagcatccctcggattgatcggtcccttgtccggcacactttcaaagaactttttcatctccttatttttcttcaattcctctttcacgtcacactcctataaaccaaaaaataaaaatatttctaaatgttttattctacccaaacttctccgattgaaaaatttttgcacttttccctcaaaatttccatgcgaatttcggttctactttgattctcttccattgtccgtccgtttggcgctatagtccaaggtaaaaaacatctcggacacccgtgaaatgcacaccccttaagtattgtttaaaaagaaaatattttttcttttacctgaaactcaattatttttttctctgccccaatcacacagtccacattcagaccaccaaattccacttctcctccgttacacgcatgccgcacttttactccctttttttgggctaaccactcaaaatatttcaccgctattttgctctggttctctgctctctcataccctacctcaggcatgatcggaatatgcctgtccttcaaaaattttgccctatatatcttcatcacaacaccagcgattgtcacgctgtccttcatcacatccaaatctcctgttatccccaaaaataaccgccggaacttcaaaattgattccatcaaaatttcaacatcattttcgcaatacgtcttgagttgttccccttaaattttattttcaaagaaaaaatgctattttccctacctagttcaaattccttttgaaaattctcattgtgccatgcttccaattttacggcttcttcctccttcatattgtccgggcaatagtcttccaaaggtggcaggttggataatctcttcccaaaattctcattcttattgtatttgtgtggaaaatacaatttagctgcagtttttaagcccaaggtttttggaaggtccgccaatttattctgactaagcatccaaaaatcccgaaagtacactcttcccgcctttatttgataaattttcaaatcagccatcatcagttccgtcgcgatttccttctttgttagctctgacaagacaaagtgggaatcgaatctcccagcataatgagcaaaagcaatcgtttcaaatcgttgaaaacccattatccaaacgacaaactcgctcattgggtcaaaaccatccgctactgaccatgtgattttactggggccttcacaaatctcacattcccgctcttctcccgcacaaatgttacaagtacgtgcagcactaacaagattaggccggtgttctcccccatctacagtcgtctccagatcgtaggccacaattctgtaggctttctgcggtcgcacttgaatttttttgatgaaacattgccgccctgggtggcaaactttgcacagtttgcaaaatttttccccgcacacgtgtttcgaacgtgtttggtaaacttctccgcatttgtcacactttttgtactcattacaagccgccttcttatgtgcttcaaaacattccgggttgtagaacttaagattgcattcaccgcagtgaatctcatcgcagacatccgtacatggaaacccgaaccccatccgacaacattttttgcagcgttccttacactccattctgtgtctttcaggtcgatcgtacgtcacttcacagctgacacagaagtatcgaacaccaaaaaaccaagaagccgatttgatcccatcccaatggtctccttctcttatcacacccacttcatttttacgaacaccctctcccttgaaaattggcctaagcccggtcttctaaaaatatgtaactttatatttttcaagcgaattttgttaccatttcaaaagccacaatgcgaaacatatccgggaattccctgtcccagtatttttgtacagcctcaaggtgttgggtaccaaaagttttgtcatctgtgcttatccctgccttttccatcaattccatggccatttccctttgtttcttctccgtcttcatcagataacggaatttgttttccgttatacttttccctatgagttggtaggttcgagcaatttccaaagcgtaaaaaagacctaaaacgaatatcaaaattcttttttaatttgataggtttggaactcactaaatttcccctttggtgtgttaagccgacccgattcattgatttgggcgagggggcaaaagcgagacattttatgaagggagtaaaaaaaagccgatgagttgctactgcgagaaaggtcttttttgaaaaatacaatttgtttaattatcaaaaaatattgatcgaaattaatcaaataaaaaataaaaaattataattttatttaaatgttattattggtagagtggaaaataaatagggggagtaagaacatcgaaaaagaaataaattccagttcttcgggccattggtattgatatatgctctgggcgaaacaatcttctcatcatggaataaaaccgacatttaacaaagtatgccaaaacaaaatttacgtgcaaaagccgatgtgtttttggaggggggagagcgtcaattatttccttgatcagttccgcgggaagtgggcagggcatggggacgtgaaatgttttaaaatgaagagaaaaaaccaattaattcattcggcaatatcttactaacaccaaaataatgcacatgaaaaaaaatccatagataataaaaagaaggaacattccaaaaatttcgtcatttcttttcattttttcataatctttgtcaaaggttaggtttagcatctaatttcttaaaattttaataattttcaaacaatttaggtaacgggatttaacccttatcaattcaacaaattaaaacaacaaattttatcaaaatccaaattccattcattcattgaggcggacgtcttgggtcccttggtcttcctctccactcgcccagccgtcggatcacttccagcactctcggggggttgggatgcatttgcttaagaaaagatgtttcggtgttaggtaaaagacagggtctgaaattacctgtccgtttggcagcgggtggtcgaatagtggcacgtctctcagctggcgcggtcgttgccgtggttgcactggctgaaaaacatccggaaatatgagaaacaagacccaacattaccggaacgttttctggtggatgatacggcacgtttggcggcggatgagcaaattgcggtacggcgtattcccgttgaatttgtcgaacatgaattccctgaagaaacacccagagactgagaaaaagcaaccacaatttgatccaaattgaagtcacatttcgcggtgaatggtgaatttgcggcatgtctctcaacggcaacggttgaggcatcggttggacatgaattatctgaaaaaatgcattcgggatcttgaaaaaaagtaacaaaagcgagccaaaattaccggcacatttggtggtgggttgacaaatagcggcacgtctctcaatggtatcggttgttgaattggttggacacgaacggcctgaaaaaacattcgggaattaaaaaaagcaacaaaaaaacgagccaaaattaccggcacatttggtggaggttgggcgaattgtggcaacgctcttagtggtagtggttgttgcccatcatgaattggtcccacaccaatttcctgaaaaacaatgcactcgggattttgaaaaaacaaccgaaaacgagactcaagattaccggagcatttggcggagggtggaggaattgtggcacggctctcattggtacgggttgctgcattggttgaacacgaattgcctgaaaaatgcactcgggaatgagaaaaagcaatcgaaagaaa

SEQ ID NO: 7708 - DNA, 1794 bp, Heterodera glycines
  misc_feature (1561)..(1561): n is a, c, g, or t
gcaatctaattagttattatactccatgacatttcatttcacaattggaaaattaatgcgtttctttaaaattatgcatgttaattagttatttaaagtgactattatttatatttcaattagaaatatattctaaggtgtaattcttgaattcaatgaaaaatatagttgtttgttattttatttcactttaatcatctgatttcgttagcgccagtaagagtgagtcaagctggcctttaaacttggggcctccatttgttcttatttataagaatgttctgattttggggtagcaatttttcatcaacccaatattttctatcgatcgccccatttttgactaattattctaagtcaaagaatattgtaatcaaaaaaatactgttgtcggtcgccccgcccccccccccctcttctgatagcccccccaccccaatttcacttctttcccccccgctccctttcgcctcgtactcgtattcttccatcccttcggcgaatgaatgctttggagatgattgagaaatgaaacgcaaatttttttatccaaaaatggggtggccttgaaaaaggggcaaaacaaaaattgaatttgacgaagaaatgacgcagaaatcggttgaaaaaagcaccggcgatcaaatgacggagaaaaacgccgtgggggacaaactttgatcagaaaagagcgaaagggaaggaaaaaagtagttaaaatggcgtaattttggctaaattaggcaaaaaaacgaaaggaaaaaaacgaagggcaaatggccaaatggaagaaattttcaaaaaccaaaaaacattactttttctggccctaaattttcagcctttgttttttgcctttgttaagagttgcgacgggacggaaatccgataatcccgtgaaaaaggcacttgaataaattcttccagatgagaaggggccaccaattccattgcctcgctttgcccctttctcatggggaaacattcgcccggccgatcgcccccggggggacaacgcccggcaaatgcaaaagtaaaggcaaaagcaaaggcaaacgcagtgccaaacaatggacgactcttccgcctcacagcgaatgtggcaacggatgcacgaagtgtatgtgaggacgaagaaggtgggccatgcaattaattaacgcaggtaatgcatgaaaagcatgtgacgaacacgtggtgaaaggggggggggaagttgagccaattgaattgggggggggggggaacgaaatgccaaggaaggaaaacgccccaggagggggggggggtgccaaggaaaagggggacggaatgccaagagaaacccgagaaaaagtctgaggtggcagccacaaaaatcagcgggcgagggaatcatatgccggcaaaagagagttcaaaaagtgtgtcgggaacagaaagacggagcagcatgctgctcagagatgaatggacagttgtttcctccgccggtgatcaaagatcgttctctgatcagcacaaaaagggaaaaaaggaaagccctcgggggatgaaagggaagggccgccgtacggggggnggggggaacgccagcggcacacaaattgcccccgccccgtccaacttttctccgtttgcttctgatgagcggctgttccgccatttgcccccgacgggggacccaaaaacctttccaacccaacgcccctcaggcgatataaagcgaagaaagcgccctcaaacatttttaatggcctcggtgatctctctttctctctctttctctcatccgccaaagccaaggccaacaaa

SEQ ID NO: 7709 - DNA, 5338 bp, Heterodera glycines
ggggacattttgcattggcactttattatttgtcattttaatccgacccccccccccgcgcccggcacagagtcattttccgcattttccgctccaacgaattttcggcatttttcgcgcgtcagcgaatgaattggcaaatgttttcgaataatcataagcagtcggaggaatttgctgctccctttgctaatgtttcacttccgccgtttgtcccttttctgctgctgatttttgtttgcctttcccaaaatttctcaaaatgttttatttttaagttttttaagtgtccccccttttcccctctttttttcctttgaatttccctccaaaatatcatttctttctttcttttttgtgtaaattagtcaaatttccgcccgtttttcagctgtacgacaccgccatggcactgacttctcagcctccgaccagctcatcactgatggcattttcggaagagattatcaaacaggtgataatatacggtgggtggggagcatacggtgggactgactgaagaatacggtaaaagggggcgggcaattgaaaagagagaaaagtgccgacaaatatttgtttatttgttgtgtttagctaactccagaggaaattgacgagttcagagaagcatttatgatgttcgacaaagacggcaacggcaccatttcgacaaaagtacggaccgatcagtgatcagagtaaaatggcatccaaaaaaccacaggaattgggcgtagcgatgcgttcgttgggccaaaatccgacggagcaagaaatactggaaatgatcaacgaagtggacattgacgggaacggacagatcgaattccccgagttctgcgtgatgatgaagcggatgatgaaggagacggactcggaagtgagaagccaaggggaggaggggaattaccaattaattagggggaacaaaacaaacaattagaggggaaattaagggacaaataggcgacaaataaggaccaattaggaggaggtaagtggaccaagaactaattaggtgagggactaattaagggaagcaaattgaccgccaattaattaataacaaataattaatgaaaacaaaaggaccacaatcatggattaatttattttgcatggacattgttcagatgatcagagaagcgtttcgagtgttcgacaaggacggcaacggagtgatcacagcgcaagagtttcgctattttatggtgcacatgggaatgcaattcagtgagcaggaagtggacgaaatggttggaatttgaacggaatttaaatttataactttggctttgcgttgaacagatccacgaagttgacgtggacggagacggagagatcaattacgaggaatttgtgaagatgatgagcgatcggtgaagaatgacaaaacagcagacccaagcggaggaaaaagaagaagaaacatatcgccaaaagcgccaacggtggaaaaacgaaaaatgaaacggacggaaagaaagcgccggtcgaaaaatttaaattttataaaaattttatcaaaatacatattactacctaattgattgatggtggtgttaagcatgaaaatttgaaagcaaattactaatttaaaggaaagaacatccgtttttcattgttacaattaaacaccacaattaattaattgatcaattaattaattaatgtttctcccatttttgtctgttttttcacattccatttaaatgaattatcaaaaaaataatttgataaataaattatgcaaataaatgcgagaattttcatgtaatttaaaaagaaaaaacaaagcgaagttcgaaatgagaatataaatttggcacttaacaaatgccgggacagtgcgaacagcacaacttttcattccaaaaaattgtacagtaacggcgcaaatgcgtaagccgagtttccatttgagagacctgaaaaaggggtacggtatgaggatgaaatgaaagaagggacattggatacggtaataaaagcaaaaagaaaagagtatacggtttggagaaggaaagagcatacggtaaaatgggactgaaaaaaataattaatcttttaaacttaattacacagagcgtgctcagctccttcggctggcgtgccctttgttcgtctccgattacatttaaccgcggcggtgccgcgcttcgttggctcgaagacgcgctaatgaaagcaattaaaaaatatttattcatttttaattatcgcactcattagcgctaattgtcgctggcgagggtggcgcagtgcccggggcatcctgatcagggtaattgttttcactgaaagaggcggggcattagcaaaacgccgaagtttaatttaccgtagaaacatttggacttcgtccctccgcgtggtcattctgtagttgaattccaccgtataacaggcaactattcttgccgaattgtgaaggcactgctgcgcataagctgatttgcagtcttcgacattgcagtagaggaaagaaagcacagaacggcaatttgggtccctgggggagagaatggcaatttgggtccctgggggagagaatgacaatttgggtccctggaggagagaatggcaatttgggtccctgggggagagaatggcaatttgggtccctgggggagagaatggcaatttgggggagaatgacaatttgtggcattttgggtccctgggggagagaatggcaatttaggggagaatgacaatttgtggcattttggttcctgggggagagaatggcaatttgtggcactttggatccttgggggagagaatggcaatttaggggagaatggcaatttgtggcactttgggtccctaggggtgatcggtagggtcgattgattatcggcagtcattcactgatcagtcatcctagcttagattatctcacttgtcgcggccgcagcagcggcattgttcggagccgtcgaaccacgccttttgagtgatcggcggctgatcagcactgatcagattcagaaacacttggaaacggcctcgctaaacaaattttcggggccaataatcgtattggtcacaatttgatattcacccctgggcaagtttcctgttctctctctctcgttcccctctttctcttccttcgtcctctcttccccaagcatccctagtcgctctctttctcttccaccctcttcttcccctgcttccctcgtcactctctttctctctcatcatcttcttcccatgcctccctcgtcgctctctttctctgccaccctcctctcaatcaacactccctctctattctcacccctttgttcagtctcttccgaatttctgcgtccactccgctgattttctgccgtgctttttgttccaactcgcgccttcccggtaaatttattgtccgacgaaattcgtaagtgcgtgcgtcgatcttttcgcaccgcggtgagaatggcgcctcttcgcccgccgccaaagccggcaaaaatcggtgaccgtccgaatcagtgcgggttaatcgattctcaatttgatcagtcagtccgcacaagtcgcagtaacggcttaatggaagaaagtggaactgacaaatgagagtcttttcattttcaattataaaaaatggcaatttttggattttcccccgttccattggcattggcattttcactgaccaatactgccgtttgtcgcgctccacaatgccactgaattcgtcacattgctggttcaaaagacccgtttccggaaccattgtgtacggaacatcaaaccgaatgccttttgggggaaaaatgccaatttcgaaggggaatgccaaaacagaaattgactgaccggcgggcccttcgaggattggcacttgcaaagtgatgcccaactctccgctcagatgggcctattttatggccatttttaattttcaataaatttgaaactttgacatcacccaccaaattgttgagcacattgatacgtttgaagctaattgagtaattgccaggtgctcttatgaaataaacctttgaatgattgcaaaggttaattaatcactgccgcacaatcaattaattaattactcggtaattaattaattaccttattgcctttttcattgacaatttgcacgtcctaaaagcattaaaatatttgctaaatttgacaacgaaatggacggcgcacctcttcagtcaatttcagctcattcttcactaaatttgtcaatcagaatttccaggataaatattttctgatcgtttttttgagtctcaaaaagtgattgatcactgaccgcctcggcaggagaaaacactgatctgaacgtgaaaaagttatgcgaatgtaaatgattaattgaccagtcagtcagatggtcaaataattaagtagttttgacataatcattctaattactcgattaccacctaattaatttcaatgttttctctccccaatcattccaattactctaattgcccaccccctaattaatttaagtattctctctccccaatcactatgaactatctctcgtgagcagtgtagggtgcgaagatcgatacgtcccgccgaatggtcaccatctctgcgtccttttcacaacggtacatgaaccttgagcagctgctgaagtgtccgtagtggtgagctcacgagcgaatgactgaggcggagcagacgcgcaagcacggagaatcgcgaatgagagcggaagcaaaaagaatcgtcgccgtttctgatgaaacagagaatgacaatggaaagcgcaaggtggacggccatgagggcatatgacaaatgggaagaaatgggaacggtaatgcatttgaatgcctaaacggacagcttagctctgtttggtcgcataatgatctacctatccctgcctaaaagcgaacgaaggaggcatccatttcaagtcaatcggagggaggaaaaacaacgaacgatcaccggaggaaagcaaaaggagcagcgaatccacgctcgaagaagggaaaggaaagcgatgagattgatcgataggaatcggaggatacatggaggagaggaggcgcagctcccgcaatgattgaggggggggggaggagagggaggggaaagtgatcaaatgggcagacggacttgggaaaagaaggggggggaagagaggggtaaaaatggaagaaaaaggaagtggggaaaggaaaaggaagagaaggaaaggagaaaaaggaagtagaggaaaggatggagaaaaagaggaaaggataaggggaaaaaagaggacgatgggaagatgagaaaaagaagaaaacgaggaacggagaggggaaaatggaaagaaagtgaggaaaagaaaaaagggggg

SEQ ID NO: 7710 - DNA, 3828 bp, Heterodera glycines
aggacaattaattggactaaaaataataagtataattagtaaatgaatgtggcattaattaagcaataaataacactacacttgaagactaatttcaaattaaaaacatatcttattcacctttcttgtgttggcgactttttgagaaaaatgagcacatttcccgacggtgttggatcgacgaattgaccattttcacaggctttaaaccattaattaattaagatagattttcatagttccaaatgttcttgcttcgttggaacactgctcgaactcccgcgtcgcctaatgacccgttaatggcacggaaaaagaattgaatgcgcggcgaattggtcaccagcagagacggggccgaattggcggaagaaaagttttgggcaaattggacggaatgggcatcgtcgaatagaacaaggtcgaaccaatcaccgggagaaagtcgaaagagaggaaactggggggggggggggcaagtggaaaagcaattaggcgcttaattgatgaccccaaattcgttaattgtgatgctaatagcattagtatgtaatccaaccttaacgagaataaaacctcggtttcggttttcaatggtccattggcattgcattggagtcctaatttatgtaagtttgtttttgttttctttaatttattttccttttccacctgtaacggcccgtatccggcacattcattggaacggcaaaagagccgttctaattggttaattaagcattttaaagagttcttaagaaaagatggacaaacccacgactcaaaggtacgaacgcaaacattggcatctgaatggattctcagttaaggtcaaaaacattaaacttaaactgaaatttcatcagtcctatgctttcgttaagaatctgagctcagttcccaatttgccctttttggtattttattttcatacggtaattaccgtttttcatttttccctttttttgggttggcttgtcctactgtatctattccttctgtttaccgtccacttcgtagtgcaaatggaacccccgccgtcgtctcctcccccctctgtccttctcatcctcctcaatttgctctccatttttttgtatttgttcgtacaaaattaacagccgatttgccgccaaaattgacggagttttgtcgtcgttttgtgaaatttgaaagtgttcgcctttttccaaatcgattagtgatagccgatcgtttgagccgagtttaagcgcgagaaactgttcaaacattatgtaattgtcgaatcaaaaccaaattgttacgtccagctttatcctcgcccccggcttctgctcaattgtccatttttctcggttcggcaaacattcgctgcctttggattttgttgcggcgattcgccaccgaattggcgaaatgtctcccgtagaatcgctttatttatatttttttgcatttttatttttcgacaaattcaccttaattcagtaaatatttcttcagtgtcctcgcatttctgtgtcccattatttgttttgtcgcagttctgtgcccattcgtcgtcccccgattcgcagtccgaaacgccgtcgcatagtgcgcgatgcgaaacgcacgcgccgttgtcggcacaacggtgctgcggaaggccaatgccatctgaaaagggcaggaaaatggaaatatttgaatgttggttgatacccaaatagcaagcgaatgtttggcaaatgaccggcaattggtcagaacaattgcgaaggtgccaaccaaactaaatttgaatttgaatgaaatggaatggaatgtcattataaatttgtgttttaaacgtttgtctcgtccaataacgcggcaccccacgaaaggcaccagcggcccggctcagagttggccaaatgaggctccagcgaagcccaggcgggactgaagagggtttgttgggattaaagcatatgtaaatggaaaagcaacttaaaaatgctggtgttctgtgccgatccaaaccgatggattatttcgggcaattctttgcttcgcacttcaacgtacctttgaagacaaacaattgattaattataaatgaattatttcggcttaaattaccagtccatttatgctaatggtcattttagctctctcttctttttttcaattatttattttctcaccacgccgtccaaaattcattttgtccgttcggcgcgcgttgcaaaagaaatttgcggctcaaatccctgtgaagaagccaattgtccaagtgaagcgcatcactgcgattattcctttaatttgaccccaatttattttgggtttatccgttaataataaattttaaaaaaacaaatttaatataaaaaagtgaatttacatttcgaggccacaaaaaatgtttgcttctgtccaattcattcgcagatcaatcggctccattttaaaacaatttgtgccgattgaaagccaattatctaattgggagaaaaaatgaaagcccaattctttagccattttttaccttttggctcagggcaaaatatgtgtaagtcaccaatactataagggaattcttcggccaaaatgccaaagcgggacaaaaaatggcataaaaccaatggcaaataatataatttgttttggaacataataatttatttagaaacaattaactcctttgaaaggaaatggataattaagcgaatttgagaaggaaaaaaacaatgaatttgacttaaaaattatttaactaaatccaaaaataaaaaagagaaattaaattgcatttaaattctgttttagtgtctttctttaaatgttttctgcgcgatttccgaccatcgatttgcggtgcatttccaatcactgcaaaatgacgtaaatgccccgccactttcacattcaattaaacgggttgttcttcttcttttcttccgttcttctctttgggtttctcttcaacgattagttaacaatgaaaaggcaaatgaatcaaaacgaatttaaatttgccacatttttaaatcacatttttagttgcataaaatgaaaagaaaaagcaaaaaaaaaggacaaaatgccatttggcagaagaataaaagtgactggcttcctcagctgttttttaaatatttgtccacattttcttcttttttgttcattttccgcctttgtattgggacgagcgatagtcggggatggcacaatgagtgaatttgttggtgaaagagcagtggcagcagcccttgaaggtgcagctgtggcatcctccgcagcacgtcactccgtccggcgtgccgtcgccggtgcacacgccgctggggtcgcaatggatctgatgagcggcgattaattaattaattattggaatgttaattaattaaagccgaacaaatcaattaaactcgccaatgccattccgatgccggaccgggtgaacaaacacagcaaaacaaggcacaacttcgccattgaacagaaaatgcaaccaaaaatagaaattgatctgaggattataaactattaatattataataaaaataattattttataaaatttgaaattaaaattttcgatgaaatttctgccaaaaggccatttaaatatttaatttggaattaacttatttgttagtcacttattaagctattacaattaacttttattcttcttcattttttttattgtattttaaaaattatataaaattattcatcccattcggtttgtgtcgcatattggacggtgccaaacgtaaaacgaaatggtatgaaaaaatcaacctccctgaatttgccaagaagtcgtataaaataaaatttgcaacaaataaaagagaccatttttttttt

SEQ ID NO: 7711 - DNA, 2316 bp, Heterodera glycines
  misc_feature (67)..(67): n is a, c, g, or t
  misc_feature (77)..(77): n is a, c, g, or t
  misc_feature (2242)..(2242): n is a, c, g, or t
tagtgatttttatataaggtattaatcaccaaaaatgtctgttatttgggaaattgctagaacaacncaactatctnggggagctcaattttcactcactatcaccctggaggagtgatctgatcaaaatggtgcaatttagttgtttgatctgcatcgaatgttctcatttatgaatgattcagattttatcaagtgcacgaaaaaatttttttgaagtttgatcaataattctgttatagtatgacaaattttgggaaaatacataaaaaataattgttttgtgtggttcttcttttgataatttttccaattgggtagttcacatcatttgcgtttttatttttggcctgtctataattcctacaggcaattaccgtccttgatgatagagggtaaatttctcccattgtgaatgaaaggtgtggggaaatagaattgcatgaaagaaattataaccaaaatgttccagattgaatgaaaacaaaaaatgtgatgaaggatgggaaatttgagattctttgcctctagggaggggtggacagcagatagcgaacagtaaatttgatgaacgataatttagaataattttgataaaatgtatcggacattatcgccttcttctgacactgcaagggcgaatacggattcgatccaatgttgccgtgcgcttgggcccgatcgcaaatgcgagcaacctacgtcagaatatggcaacatgccgccccaatcgaaggaaaggcaccatgaagtcaacatcgatgatgccaacgttcatcggaaatacatgctgatgcgcggaacgggacactataaccttttttactacaactgcaagcactgggctgaagaatttgtgataaatagtgagtttaattgaaaacattttaaaaattgaaaagtctattaattttttgaataaattcagttttggccaagactcggaataaggacgaaaaatgtggctgtctgcagtttcacttccgggcaaaatcaattgaaggtgaggaaacaatataaaattgaaagtcgtcaaatcttagggcaatttttcgaattgaaacaaaaatgaaaagcacattttgtgttcagaaaaattaaggaaattaaaattaattctatttaaatgtaaaatttcttgcaaattttcagctcatcgaaattcccgtgattatgtcaaccttgtgcgatttgagtgcaccaactgtcggcgcgagaatatgatcatcagcatactttatacagaagtcggaaaaggaactcggtaagtaaagcacattttactttctctctcactctcttcttttctcctttgactctctctctctctctttattcttttatctctcccactctttctccctctcttctcattcatgctggtatgcacaatgtttctctctcccccttctcttcctctctcgttccactccgaaacgtgccaactccgtctgagccaactttgagtcaactttttaaattgttgactctttgatatcattggaaagctcttgacaggctctattagcctaccaataattacagagaatgtcgaactgtaaaaaattctcctcttcttttcttccctctatttttattttctgctcccttattgtctcccgctccctttctctcctgtcccttttatcccggcaaaattttatatttatttatttttttgatggggctgttatgtcgatcgttatgccggacaaaggcaccattatattgacatgccttttaacgaccttcgagctgtttatgatgcgatgccggaccgggagtcgtatgctaagcatcactacgatacttttcattgggcgagagccttttacaagaaaagtaattattttgaatttgtagcgcgtccctacattttcggcccgacttttacggctgtacatttttgacctgttggaaatcgaaaattaacgccccacgccaaaatcggattttttctgccaacggaaaaaggatgataatttggcattctgttggtcgcgaaaatcagattttggcttgggccgcaaatgtcggggccgcctccgattggcgtgcataatcaattttcatttaaaatcgattatttaatgtttagttacggggttctggtgatgatacaagccgagctttggggcccaatttcaaattcgaattggccagtcgctgatgaaggacatttgatcatgttatgttttctttgattttttcttttcattattaaatgtactttttattatanttctcatttaaccgatttcatcattttattgcattttttttatattctcgacttgaacataaattttacttttt

SEQ ID NO: 7712 - DNA, 916 bp, Heterodera glycines
ttattgatcagacagcgccgatgtaataaatataggaaaaataaataacatatatcggacaaagggcagcagattttgaaaaggagtgggagttaagtcaaatgaattgccattttgtgcatttgaaccgttttgcccataagtgtgcatatggcagaaaatgaattttaatttgttcggattcggcttcgggtttgaaattgatcgaaactgcgcctgcttcgtgatacagtggcatggtgcaatttgaatttatgaacagtggcaatcaaattttacgcgtccaatcaaatttttatgagtatacccgatcaactttttaagtctactttcattgcatctacaacaatattgcgttatgtttgactagtctaatccgattttttcatttgaaccaagtaaatgtcggagaaaggtctttaatgcgccccaagttgcctgatcaatgcttgcgtatgtgcacttgccggtattgtgggtctacagaagaaaaagtggttaaccaagggtgattctcaaaaacaatgcgcataccatctaaacgctcttgcgctttgctaatagtgtatttttttaatggatttattttaacgaaaaatttaattggacgcataaaagtctattggacgcataaactggactagaggaaaaaaaactctgtgtcccaaacttcggaagaagcgtttttccaccgaaaaattgttgcttcctaatttgtcaatttaattttttttttcgagtacaaaatccctccctttcacgaaatgcctttgccaattccccccctcccccctccctcccattttggcacacattttacggaagaaatgcaaaaatgaatttttgtgatggtcacacacacacacaatgaaaaagtatttataaaaaatgtgtggtggtagtggtttgagcccgt

SEQ ID NO: 7713 - DNA, 1370 bp, Heterodera glycines
acgagcttattcatccagaataaacaccgaaatatgtatgaaatatgtacaaagacccagaaatatgtaccaaaatatgaaaataaaacgtacaatggttattttttggaaaaaatcttcctaaagggtgaaataggcaatgaaaaaatgccataaaatgacctaaataggcttagaataaatcaaattttttagcttggtggggtaactttaagaaaatttttagaaattaaatgaatttccatataattttcgccctactcatcagctctgacctaaatatttgacacatttctcaagacacagcactcttctcactgtacagcagcaacgataaatctctcgatacaaatctcgccggatttcttcttcgatgatccctccctactcaaaaacatttttcaaattcctgggtttaatgggtggaattgttgcactttgtgttaaatttagatgaactgcgagattttagaaagcccattcaaatatttgaaaagatctttcatttcattttatccgtataaaaaatcctcattttaaaaggctctagtaaatccgatactaaataaaaaatttttaaaaagaactcatgagaatttcgaaattaatttttaacttattggtaaaataaaattgggaaaattgaatataaatctataattttaatttaataagttctaaattgattttaaaatagcttggagcaataaaaaatcattttgctgaattttatttaattcgaattctcaaaaattatttttaaacatttaaatttaatgtcagattttccggctcccttttaaaatgttccgggtcggcttggtctaattcccagaataccttatctatattcggatatgataagaaaactgaaaaaaatctgggagagagagaaatcttttcggctgcactttttctctctctacgaaaaagcgattaaaaaaatatttcattcatttcggaagaaaatattacacacactttcagcagcatgcacatggtttctctactgctcatcagcaccataccaatgctgcttctcatcgtgttcacagctgtaattggggcgcgtgtaatcgacggaaccaccgccatggatttgttggctggcgatagcgaattgaaacaatcgcagtcaaaacaatttgcagtcagtgcgccgtattaataaataccgtagaggggggggggggctctatttttcaaacctcctcaaaaggcctccttctattagagggggtcttcttttagagggaggtcttctattagaggaaaaacggtagtcgaaatcatagtgaagtattgggattctaaacaaatggatgttaattgaaaacatagccattaaaaacaaatcgtaaataagaaat

SEQ ID NO: 7714 - DNA, 1951 bp, Heterodera glycines
  misc_feature (235)..(235): n is a, c, g, or t
  misc_feature (246)..(246): n is a, c, g, or t
  misc_feature (286)..(286): n is a, c, g, or t
  misc_feature (381)..(381): n is a, c, g, or t
  misc_feature (406)..(406): n is a, c, g, or t
  misc_feature (417)..(417): n is a, c, g, or t
  misc_feature (419)..(419): n is a, c, g, or t
  misc_feature (434)..(434): n is a, c, g, or t
  misc_feature (436)..(436): n is a, c, g, or t
  misc_feature (445)..(445): n is a, c, g, or t
  misc_feature (454)..(454): n is a, c, g, or t
  misc_feature (470)..(470): n is a, c, g, or t
  misc_feature (489)..(489): n is a, c, g, or t
ccatttaataaataaattttattttaaataattttttttcccaattatttcgtttcttttattttcccctttttttttttttccccctttttttcttcttttcctaacaaaccctccttctccccccatcatttttacttccttaaaaaaaacattctttttttttcttattttacattaaaaaaatcccacaaattttactatatttttacattttaaatatcttaaaaatctnaacaaacattnactttaatttaccaatttcccatttcattttataaatttntcaaatacccaattttttacacaattctaaaaaaaaaactatttttcctttactatttaaataaatcttcttatacttaaatatttaaccatttntacttaactttcataaaacataaanctcttcaattnancaaataattcctcancnaacaatttnttctttcantccattctttcctctntaattcaatttctaaaaantctcaaattgggccaaaatgctttttggcctttaaactcagtcagtctcattcaatctccaaatcccttttttccgcaatgcttttgcctaaaatattttcttaattcgaagccattgtaaatccatcaatttaaaatttatatttaaaattgttgtttttttcactttgaaatgatttgttccattctatcggataaatgcaattaatacaaaaacaatggctaataataattaagaattcaattaataattattattaaaatatttgtcttttgattgcaatttttcctttttactcggtcatttattcagctcataaatttatctctaaaaatagttgggaaaattcccaaatggaattcctatctttttaatgatcataattatactttaattagatattctttttgttttttatgtccgtaactgatcaatgcaccgcacctccacacatccatcgcatcattagcacagaagagagacacattcatcacattatcatatcatcatcatcatcatcatcatcatcatcatcacatcatcattcatcccccctccctcttcctcctccctctcattattccgtcgcggttccttttttccaatttataaaagtgattgtcaagtgatcagtcatttattagcccaccccaacaaaatgtgggggaggcacagactgaggaacgaatcagtgaatggaaggagtaaacagcaaattaactaattaataattaattaatgagtgtacaaaattactaaataagcaaatgacaattgcccttttaatgcattcgttgctcattttgttttccatttttagcagaatcttttcccggaattgttgcttatgggctaattgctgttgagtttcaattttatttgccactttatacctttttgtgattaaatcagcttacaaattaatatggtggcgcataataacaataataataaccataataatgacaatgaaaagaaaagttctggtgttacggtaataagtaacaacattacggtaaatgctgcaacttcggctgagcattcgtcgattgaagacgaaattgagagcatcagcaataaaagccgcaactcgaccttctcagcaaatggagaacgcaaaaacggactttcgtatgggcaaaatgtcaaaacgaaaattgattgaaacgaatcactcattttaagctacgcggagattctgatcaattttctgaagggaatgatcgggccgggctgtctttcgctgccattggccttcagacaagccggactatgggcaagtgacggcgcaaaaaagggaacgaataagccgaaactgtccttttcagactggacttgcgctggtggttgtgctcggctttttgaattggcattgcatgcacaaattggtgaaatgttcgcagagactttccaaagagttcatttccttttttatcataattttaatttatcactaatttt

SEQ ID NO: 7715 - DNA, 3263 bp, Heterodera glycines
acagattggaatttgcagtgttttttacgttttttgtgcaaatcacataaaagaagtgagtaaccattcactgatcacccatcgaattggtcgactcaaatggccaattgtttaatcactgctgatcatccaaaagtgacagtggaaaaccactgatcatccactcccaaaatgtccaaataatcagtcactgattaccccaaaaatgacaaagtgatcggtaattggtcgtccaaaagtggccaaataatcgggcactgatcacttttcaagaaagtgtgaatttttaagtttgtcgactttgaattcccttccttcacttatccgaaatacatctggatgttctccatctttgtgcccatggttctgatcacttttgtccgttctcttcgtgccattgccgtgctcagttccattggcaatgtcttttgtattgccgcgctcacttttattttccaggcaaactcttcaaattatatatatatatatatatttatatgtaaatattaaatattctttctttagtatctcttccgagcaaaacaccaaaatttgtccgactttccctcaaatacaaattttgacggcgtaatggccgcgtgcggtgccgttttatattcgtacgaaggacaagcgatggtaaacagagaattgaaaaacatgaaaatcatttttaatcaaaataaacaattaaaaacactcacttttatatgttttttaggttcttccgcttgaaaatcgtttgaaaaaaccgtcacaaatggtcggtttctttggcattctgtccgttggcatgaccgtagtcactgccgtatattccgcctccggcgttctcggttacatcacttacggctctcaagtgaaggggagcattacgcaaaatctgccacaaaatgaaatgttcgaccaaatgccaaattggcgaaatgtgcttattaattctaaatgatttagccaatttgtgatcgtccgcttgcttttcactttggtcatgtttttcggttttgctattcaaatgtacgtcgtggtggaaatgctgtggcccgaatttgtcaaatttctgcgcaatttatgtccaaattttggggttaataatgagaatgatcacaaaaatatggtcggcattgaattgctcttccgtgccgcgctcgtcaccgtctccagtgagtggtgccattgtcttccttttaattgcctttaattgctcgttcaattaattaccccctccttacttccaagtgctaattggcctcgctgtgcctgaattagagaatatcattccgttggttggtgccaccgctggaatgcttttggcactgattttccccgctcttctcgaccttctcgtttttctgcccattcatttacaacggcacagaattcgtcaaactttttggcttctccttgacaattggacacttgtcaccattggagtctttggtttaattgccggactgagggcgaatttgcggaacatttttacaccggcagaaaatattgttgcataataaaacggaattaaatatttttaaaataactagtaaaaagagaatatatgtacatatataataaacttaagtttcataataaaatgcataatattgttgattatggtcaattaattacttacttatcgctgccattctctcattttttgtttcttcggcagatttgtgttgaattccattttaaaatatatgaataaacttttgctcagtgtccttttatttatttgtgcattctccgttagttattaattaccctaatttccgtaaccttttaaattaaattttcctccctttaattttaaaatgtttcattgcttttgctgtgtcatttgtgtcactgacaaagcttcatacactttggatggaatggcagacaaaaattgaactctgctgctacatgaaataccgaatgatcgatgaattttgatttcgatggtcattggtcaaataacactaataaatgattcaacaattgatttttattaagcgttgcccgaaatttcattgaaattctctccggaggactcgtaaaaggcattccaccgaatgtaccataatcggcacggattggtgaacttcgccttggcaaaagatgtttttggcccgcttttaggtgatgatcgaccgaataagaagctgtagttatgataatcagataacaccttttattttgaaattcttttaatcaaagtttaatttgaaactgaaattttcggtcaacaactttctgattatttaattgttttttccgaattatgttttcactgtgttttggcacatttgctgtgaaatgaaaccctggcctaatttgaccaccattaggacattgtgacaaaaatgcggtggtggggtggccaagggggggggggcgtattttgcggggtttcgcgaattttcgtcgttttaaacccctaaaaaggacatccctttcttttcaaatcgccccgcaatcattcacatcaaattctcttctctcctctgtttgaaaaccagtcccccgccaaaacactttcatccccggccaaaagagacacaacggacggacggacacccgcggggattggggcgacgtaaacgaagggaccgaccaaaaaaggggggaccacgagaattatacgaataattgtagaccttcggcatgagggttttcttatcttagtgagtggatcaagtaaatcggatttgccgataaataaggaaggtaatataaaattaaaaattatttcaggactaaatatgtgcccctgtaatagttgatgtttagaacttatttaaaagaaaaggataatggatattatattttattataattaagacattaaattatttggccgtattagcttcgagagaaggtgacaataatgtgtcaaataggcactaatgttcaatatccgtgaaaaacaatatagaaaaggttttaaaaattccaatcacaataacttttaaatattaattagcaacaaaaagtattaagaattagaaaatagttcgaggaaatactataaaaataaatattcaaaagaaaaatgagtgaaattagagaaacataagtcttcaaaaaaatgatatggaattctgaaattaattaaacgaaataataaaattaaaacatttcgcaaataattgtgaaacagaatccatgtgttaattaaatacaaataaagagtattgttttttatatttaaaaaaatagagttgaagttttctaaaaatagtgaaatatatgtctagatagtggctaaaaagctgataaat

SEQ ID NO: 7716 - DNA, 1786 bp, Heterodera glycines
aaagaataataatattcgattcaccagcagaaatgccctcctaagattcacagttattatttttattaattcggttttttccttttcttttctgtgtctcctttgcatttaacagagaaagtgagcaaattttttaattaaattaaacattaaaatatttcaagtaaaaaattaacaaaaatatttataattaaaatgaaaattcaaattgcaatgcgttaacaaataagcttaccaaactccgcccgaatgtgatgttaacgacccgctcagctgtagccaacaaaaacacgaggtgaatgatcaatcggaatgatttgcccattaattatttaatgaattgttcttctgatagttaatagtccatttttgatttggtcattagtcattagaaaatgggttttcttccgggaaccgttttcttgaccaattcgactcattaaactgtttttcttgcccttttcggtgtgtttgtttctgagcggcgcttacaaatgcgcgtgtccgcaagggtacggccgactgccggacgggcgatgtttggtgatcaacgaatgccaagacgcaaaactcaacgaatgttcgccggatgcccaatgcattgatcaggcacagaaggggccaaaatgggccaagaaaagggacaaaacatgtttaggccgagggatattcttgccgatgtaagccgggatttgccgatgtgtcgccccaaaacggaaggcccggcacagtgtgccgaaggcagcagaacgaatgcggcagcccaagcacatacggtggggaagggagcagcagaggaggggcaaatgagcagacaaacgaaggggcaaaaggaacgaatgcttttcagccgtcgattgcgaccaaaacgcggcatgcgttgacactgccggtggttatgagtgccgatgccatccggggtatacggacatttccgagtcattcagtcagctgccgggacgaaaatgtgtggtggcggtgaacgagtgcgaagatcggtccaaaaatgactgttctgaaaatgccatttgtaccgatgccaaagaagggtcagtgaaaggggaagggcggaggaaatcactttgatcagtgtcaaattcactcttcagttacacatgcacttgtaatcccggctttgttgacgcgtcggccaatgttggcaaatacccgggccgaatttgcaacaaaccctttgaaaagttacaatttgacactccgacaaatcaatgcgacccgaatcaatcaaatccatgcccagcaggacaagtgaatggatcgaaattaaaccaataaaattacaaattttaagatttgcaagcaaaactctgccgggcattacaattgccaatgtggcgaaggggcgacatttgtggacggaaaatgccaaatagtcgcggcatgtcaggtgaatgagcagaattaattaggaccgacgaggcggggggaagtgaccgatcagtgagtgagcacattgtgaaagccaaacgatcaggtggacccggaatgtgacaagaatgccaactgcatcaacgtgctcggctcctactcgtgccaatgtaaacccggctttttcgacgtggacaaagtgacgccgggcagagagtgtaaacaatgtgagaaaaagggatgaaaatgccgaaaggacggcagtgatttgtttgtctgaagtgtcaaatgaatgtgccgatcggcacgactgttcgccgttcgccaaatgcgtggacaataaagacggattcgaatgcatttgcaatgccggatacaccgacgtttccttatgttttgg

SEQ ID NO: 7717 - DNA, 1583 bp, Heterodera glycines
tcgtccagcaatgcctttgcctgttccacacttctctgagctgaaaagcgccaaggaatgcgtcggtggtttcggcatttggcttttccaatttgcaggccttgaaaaaaacagggaaaatttcccaaaaccagggggttgggttggttatatggtatatcaaatgtattacggtcaaaaatgcgtttctgagcatttcattggcaaacacggcgccgtccgtcaggtgcgcaaaccgtgccaatgccaccaccaccggtggggcgttgtcggcgtcgacggcactggcgctgtgttggcccttggcggccaattggtcgcggaccgaaaaattgggaaataattttgagaatttatttatttttgagggattttctttaccagttgataaagtcggcacaacacggcagttttgccacagcctgattggccatggaattggacaaacagtccggcacttttttgccgaatttcgtctctgaaattttttttttatttttttttaaataatacaaaataatttaatcattaaaatttttattaaaagaatataaagcgattttaaattctttgaatattttaattaaattatttttgtattaaatttgaaaaagtgaaaaaataaaaattttctcaaatttttcgaaaatttctaaatagaaattaatttaaaaaaattattaaagaattaatcctaaaacatttgttcttaaaagaattataagtagttcatttttaattcattaaaatttttaaataaaaacaaaattaaattggcaattaaatttgaaaaataaacgaataaacgaataaataaaattattttaaaaaagcagcattaattattattaattattttaataatttgctgctgcggtatcaccacaccacacttgtcaaatatgcgtttcacaacagcgtccaatcgggcgtcaattgcgccccggggcacccaacgcgagggaatgcgcgactccaaatgggccaaatggatggcatgttcggcctaaagcaacaaataaaaaaaagtttaatattgtatatattttcaaaatgggtgtggtttttcatggcatttttacgggaatcaatggggggaggggcggcacgagacccgagaattggtccaaagcagggctgcacgcaattgcagattgcggattacggaaattgcggggtttttggagttacggattgcggattgcggatttttgggatttgtccgcaattttgatccgcaatttgacttttgaattattttttgagacgatttcgtgcaagattattttaataaaatgaatttttttttttctattttttatttaaagagaatgtatacatttctttaaattcttatttctttagcaattaaaaatgtcaaacttaaatcctggtaattggtggtattattttttgaccgtcaagggaaatcatctgctaaatgtaaagccaacggatgttcgtattcaaaaacattagatgcttctctcagtacaactgtgcttacttctcacctcaaaaatcagcactctgaacttgacaaacaacgtgaagacttcgttaaagaaaagcaaaaaacagaa

SEQ ID NO: 7718 - DNA, 2607 bp, Heterodera glycines
aaatgttgagactgatgacaaaaaaaaaggaaaaatatatttcgagccgagaatcaagaactaaaatctcgaacatcattagtccgtatttcctgtaatacagcccccccccaccctctgaattagagccccccccccctttgagggggttgaaaaaataaagtcccgtaggctccattacggtggtaaattggtggcaaagaattttttgaagtgttaaatttggcataaaaattatttattgattttcaaattaatttttttgaaaattattttatttcctgtttaatattgtataaatctgtgttcactgcttgtaattagtgttgttgttcacctgcaccgtggccatggcggcggtgcgcggctcgtgcagcggcggatgccgcgtctgctcaatgtttgggtgggctgccaaaatcagcgatttgagccgatccgtcaatttggtggccaattccaattcgtaagcagcggattcctttggggaaaattttgggtgaaaatttttaaaaatttcaaaaaatttatttacctttggacattttttccaccagctggacgggtcaatctcgattttttgctgaattttgggggaaaattttgccatttcactccgataacaacatttatttattcagtgatcaaatagggatcaataaatgtaattagtttggttaattagccccaatttgttaattcattagtgccaatgaaaagtaatttaggcgtcaacaaatggaaattgagaattttattgaaaagttaaataaattttcaacattttaaaagaaattttgtaaattttaagtgattctttaattattaattaattaattactccatggatattaattaattaattgattaatattttgttttaataaatgattttaaattgttgataattatttataattcacctgtaaccgcaaatccaataggaaggacaaaaggcgttgctgcgggtcgttgagtaaccgcgtgctgagcgcgttcttcagcgcgttcacacgctcagcgccttcactgcctgcagcatccatccaacgctctgttccgccatcgcgttgcacgccttagggggggggggggggggagaaaatttcataaaaaaatttcaaaaattttttaccgtgaaagcgccgtgtcaccagcaacgagcgtccgttcgcttctgcagcgtccgcgcaccactcaatgaacgacttgaacagttgcgcgtgccgtttcgccgcgtccggttgcagtgccaacgggccgtcaccgctgaacacgcgcttcgcaacacgctgcaagccttggcaaaggctttgggcacctgccgggtcccggcttgccctaggaggttaaagaaatttttttttaattagagaaaaataaaatttaaaatgctgccttagttggtattctgttggtcgttcagttgcacctccaccacctaaatttttcaatataaagtaagtcgtttttaattaaaaaattaatgtaattttatttcatatttttattaaataaatataccgtattccctaaagatagaagagacccccgtggcttcattattttttcagacccacccccctcaaaagggggctctatttgaggggggggggggctatttttcagcaaaaaattttttgtcaccattttttttgtacattttttgccactttcatggcttttttcaaatttttcgtgccggtgcctattttaaaaatattcgtgtctaaaagtccaattcccataattaacatttttatatttaatcttttttgtcttcattaaacagacaattattttaatttgaaatatttttttgttaaaaaaataataatttatttttaaattatttttttttacttacggtccaacacataaaattggcccagtaaaactgcaacatcatccttaatttaaagaatttaattttagataaaactcaaaaaaataaataaaatattttaattattattaacccaaaatttaatttattttttatattttttaaaaattttaatatttacccccgcctcaagcgccgcctcgcgcaacgcgtcaaactcctccgggtgcagctccagcggcagcagcgcctcgccatagcggtcaccgatgaacaccagcgcggtggcgtcacgatgcgcaagcagttcagccaacagcacgcgttcgtccacgttctttagcacgtcctccactgaacatcggcataagaaaatgtcacgcgcgtacgcgttcacgcgcgtgtagaaacaacaaactttcaaacagtgtgcagcactccaagtccaggtccagctcggcaaagtgctgctgcaggtcgaccagcacgttgtgcagcacctcccgctcgtgcacaaactcttgcagcgagggcagcacaatggcaagcatgtgcgagcgcggcagcacgtcgcccccgtcggcgtacgcagcagcagcagcgaggtcgcacgcactgcttgccttgggcgagccggtgccagatgcaattgaactgcctgaggaattttcaaaatttttttttagaattttactggaaaaccttaccccctcaccgaaaatttatgaatttttttaatttctggaagttttatcaaaatt

SEQ ID NO: 7719 - DNA, 1110 bp, Heterodera glycines
cgaattttattataatttgaaatggcattaatttaaaattaaaaatatttttaaattaaattagttaaaacattttaaaaaaactaaattcaaaatggttagccgacatttgcggaccgacttttgcggaccgacttttgcggaccgacatttgcggaccgacttttgcggaccgacttttgcggaccgacttttgcggaccgacttttgcggaccgacttttgcggaccgacttttgcggaccgacttttgcggaccgacttttgcggaccgacttttgcggaccgacttttgcggaccgacttttgcggaccgacttttgcggaccgacttttgcggaccgacatttgcggaccgacttttgcggaccgacttttgcggaccgacttttgcggaccgacatttgcggaccgacttttgcggaccgacttttgcggaccgacatttgcggaccgacttttgcggaccgacttttgcggaccgacatttgcggaccgacttttgcggaccgacttttgcggaccgacatttgcggaccgacttttgcggaccgacttttgcggaccgacatttgcggaccgacttttgcggaccgacttttgcggaccgacatttgcggaccgactttttgcggaccgacatttgcggaccgacttttgcggaccgacatttgcggaccgacttttgcggaccgacatttgcggaccgacttttgcggaccgacatttgcggaccgacatttgcggaccgacatttgcggaccgacttttgcggaccgacatttgcggaccgacttttgcggaccgacatttgcggaccgacttttgtgactaaattatcaaaaaaaaagagaaaaaaaatttaaaatgaattttcaaataaattttcgtaattaccaaattgaaataatgattgattaataaaatgctttatacaaaaatcatatcacaaaatatatagcacgcaaaatttttcgtgtttcacctactagccttagtctaaagagcttagattttgatcaagcatacctaacaaataaaagatataaaaatatattttatatctttaaaaagcaaaaattaaaatgaattactcaccattatcaatgac

SEQ ID NO: 7720 - DNA, 1098 bp, Heterodera glycines
  misc_feature (23)..(23): n is a, c, g, or t
ccagcctaatatgtagaacctcnggagtgaacaaacaaaggaatttggcttaaaatgtttttgagagttagtctctccccgccccctcccacttgggacaggcaaacatttctcgaccgacaaaatcgctgaagctgtaaacaaaatttagtcattcaattgagtctaaaatgaatttaattttatatttaatacatatttatgggcaattataaactgaagggaataaagaaaagaccatcatcccaagagaaggcggcagtcataaaatgagttatacgtaaggctttcaagaaaagccagtttgttcacttgcttaacatgtccaacataaccagcccaccccaaaaagcattaaatcatcaaaaacggttttgagaggtaaagaaaattgagaaggaaaaatggcaggaggggaagaaatgcgaatgtgaaaaagtacatactctgatcagtttaacattgatcagaaaggcccacaaatcttgggaatgttttcaactgaattggttacacattacaaataaatgtacttgggtggcggcgggatttttaagcacggaaagaacggaatgaacaaaaacatttggctggggaacgaagggacagaaaaccttttcatttgtaagtttcagaaggagggggaccacttttgctcggttggacttctccgattgccattcattgcctttctgtcttacccgcacttctccaagactgctggtccaacaaccctgaaattcgaccttccatcagaagggttcgtctgaacaccgaaaattacctgaaagtgaagaggggcggggggagggtggcgcccccagacacttgcgccgcccagccaaaatgacacttgcgccgccgacatttgcgccgcccccccccccctattttgacataagcgaaacaaacatatactaatttttaacaacgcaacaaaattaatattttcaacaatattctaatcccatcctttcgatcccttcatcccccccacggtattgcaatgaatggaatatgtcggatcaaatcatcgtcatttttttcttctttccccgcctaagcaaataaccaattgcctaataactgagtcttttt

SEQ ID NO: 7721 - DNA, 4796 bp, Heterodera glycines
  misc_feature (4742)..(4743): n is a, c, g, or t
gctctctgcttatttgttagaatagaaatctaaataaatattaaatataaaataagaatctgatagctcatcaaaaagcaatgttaatcaggtgttttttctatttttaaactaaaatttaaattatttttttaatgaaaaatagtataatattttttacgacggggactccaaaattgataggatggtaagtacaaaagggaaatgatggtgatggtggtggtcatgtttgtgattgtttgttcttatgccgacctccccccgcccttcccagcagacatcccaaattttttcacttttgaattgccaattgtcagtcaattatggggttgtggttgtgatgcgattcgtccttttcccgcgaaatgctgcgtcactttaattgtttcgtttcattgccctttgtacacagtcacatttaaagttcgcttttttcaaaaatataatttcagataaggcttcgttttctcatttttccgaatgtgccgtactgattgcccttgccctcctcttcctccgtcctcctcccctcctcccgccttttcttcctcggcccttcccttccgtcgttctcaaatgccctccccatcgtttgcaatgttttcagtctcttctcgctttgcactttttctgcccttcaaaagttccactttaaaatcgcttcattcatggtaaggataacaaacaatgcaaaaatcagtttctcttttcttttttttcaatgatctgctgttttttaaattattttttgtttcttttttctctgatttttgtctttttaggcttcccttctttctcttgcgaaagttttcccatcggttgctccatttggttatttcattgacttttattttgacaatttggcacttttggaattggcacgtcgaacggtggaccaatcgaacgacagttattatcgtaagtaattctgaggggcgtcttaccccctcccctttcgcttattaatttttgttttaatttgtttttgattacgcccactcataaacgacctgaacgtcttgcggacatgaccaggttctttttcccttttctctctgttttctcattttggttgggattttcagattttcgcaaactctgatgcatatttctgacctccattggtacaattttagccatcctaaaacgattttcatcgttttactcactccgctgttagggtcgtcatcgaagatgccaatgcgacttcggatgccgttcagcgtatcctcgtccgttccggtattcccttcacttacttctccaccaccacgaagcccggcttccccaaacgcggatggagccatcgcaacgtcgggttggacttcgtccgccaacactacgctctcttccctcacaatggggtcggtccgtctctccgttcgtccgttgcctctctttgcctttgaaattggtttttcttccgttcgcaggtcgtttattttgcggacgacgacaattcttatgacattcgtctctttgagcgctacatcaaaaaagtgagaacgattggcatttgggcagtcggtgagtcattttttgtgccttttaatttttgattttttttttcttaggcctcgccggttctgcgattgtcgaagcgccgcacgtggagaatggcaccatcacaaagtgagttgtcaattcccctcacatttgttccactttccctttcttcagatgggatgtcgtttatgctccaaaacggcgtttcgctgtcgacatggccggctttgccgtcaagtgaatgtgttgccttttcattttgccaattaccctttaatttgattcaattttcagtcttcggctgatcttaaacaaaaagtagtaactgtttccgtcccttcaatttctttctttctttttgcttccctttttagtgcctctttcaatttgggctgtgtccgcttttcgcctgagtcgtgttttcttgcgcaggtaatttaataaaattcaaaattaaatttatattgccacagtttggaattcctcgcgaaaaagttgagccatttggatggaatgacgagccaaaggaagtcagttaaaagcaaaaagataattttatttgtattttggtttagattttggtgtggcacacaaaaacaaaaaacattggcaccagagtaagcaaatcacggaaaatcaaattttccttttttgttttcgttagttttaatacataaaagcgtgaatttgcgcaaaatgaaaaggaatgattgtgagaaaaaccaaagaaagcagcaaatacggcttaatctgcttactttgtggacatattttaagactctaaaaccttaattattagtaaattttaaaagagaaacaatttcagggagagtcccatggatacgtcgtggagctttaattggtctgatttggctgcgggtcgccacaattacaaatttattgacacgggtgtaaaaaacatcgattgatgacggctaaccagcaaattgcccagcggagaaagacgggaaatcggaaaaattaaaacattggcaataatcgactgactaatgataatattgcaaaatatataatatttgaaatttattttcattcttttaattaatgttgctttgataatattttttaattttctctctgaaaatggactgtcaatcattctcctgcattttcaaaaaagcccaccgaccgacccatcgcccttttcaaatcagcagatgagccacctcacctgtcaaccattcgttaattagtgtcccatttaattaatttccccccccccccccataaaatttgtccgattttaaaatgccaattttatattctgccctttttcgtctgttcctccctttggttgtcccttctcttttttgggtcgctttggcttcgatggaatgcagcgaaagtgtgctcagagtgagcgatttaaccaaagccaaagaaagaggtacaattcggcattttgggcttgccttccatttcaaaaaacggcgattgtttaattttgaatttcgcctctccccctttaccgtaccctctcccatgtacagtacccttccgtttgctgaacctttccctcgcttctttggatgtgaatatgcgccccttttgcgactctgagggccattcggccgtccgattgcccggctttttgctcattttgtccggtattctttcgcccttccctttttctttttccaatgccttcgttttcggccaaattgtcctttcgcgccctttgcctccactgaatgcgtcgtcccttcgtttgtctctcactttggagcaaaactccgtttgggtgggccgaatttgtgacaaagggcgaagtcaaagtgcctttttgtccgacgatttttggtgaatttcgaaatgattcattcattcgttggattatttctctgccctttcagttctttttctctgtgctcccttctgccggacgcgtgcaattcgctggaggctttggcttccaaatatgctgagagtgatttccccctgcttttgccactgtccgatctgttcccgactgatcagccaattgctctcgtgccaatggccaatttcccattgctcgagggctattggaaggcgcaggcgcaaatccaagcggacgacggaaacgcaatggaggaggaggaggacgaacagaatgagcagcatattctgacacattttggcactgaaaattggcattttgtttcgttgggcaatgatttgcatgaagacctttaaaatgaattcatttgacattcgttttcatttaccgaatttatttattttttataaattatttatttggtataaagcgaagatgttcaaaagttgctgcttttcaaattaattatggtcaagtttctgtcgctttccacaaaatgtgcaatttgcagcccatcggcgcattgatcgggcggatggaagcggcggtgaccaccctccgccccccgaggggaaattgtggggctggcgaccaatcgtcggctttgcattggatccggtcgcctttcgctgttcatctcccaccaccgaattggcggttccttcagcagacttttcacttttggcttgcattggcttttgctctttgcctttcgtattttcccttcatttttcgcttttcccaacttcaaaatgccaatgcctttggttcggttggctttcccccgcagtgtctttttgttggccctcttttgccggttcgcctccgccgaattcaggccccatttcagccaatggctcgctcaacgctttggcgaagacgtgcgcaacaacttggagaggtgtgtcgtacgaatttgactcccatttggtgccgttttcagacgcgacctcggcatttggggctcttttggggggcgcaccgccgcggaggagccaatccgaaaccaaccggtggtgttcgtgcacggttgtctgttctgttactgttgcaattcaattggaatgccctcaaacttttgaaggtgtttcaaatcgcgcgtgcgacaaaatgaaacaatccgccgactttttcttgcaagtgccaaaattaacataatttggcaaattgttgttttaaactaaaaacaactacagtaaccacggctacactttttctgagctgtacggtacaacgtatgccaatggggaccaaggcaatccgctacagtaataaagcggcatttgccacaggcaaatgccacaaacaaatccctttaggtgggccgcctactcaatgaaatgccattatgtgaaattagtaagagaaatgtcggatcagttcttgaattggtcgnngatgatcaagggtgcttaaagtacgcgctttgatcgtcgcagtgcgtttatac

SEQ ID NO: 7722 - DNA, 1975 bp, Heterodera glycines
aatcgatgcatcatcgattttggcagtgtcgtcggcgcattcttttttttgaacggctgccaattctcatatatttgtcctgactgagcagctcacatgcagcagcgaggcagagagcagttcatgtttgtctcattccccctgctgttgcagcaattcctcggttcattatatgtatttacctactttttttttctggctccactgactgctcttgctatggccttccatttttagtaattgacacggaagataaactaagaagcgggggggaggggcaaagacacgggttctgctggaaattaaatatctatgggcccgcaggggaaggagggcgaggtggggggaggtgggtggacctcacgtgaactcgacaacgacgccgacggtactttgctgtacaaatctccaattcaactaaatgcccggggggagggcgctgttgggtctgctgctgacactctgacatgagccgaggaagtgcgtacatatgtaaaagcaaggtaacagaagaggaagaaggagaagcactcacggaggaggagaaggagtaggactcatccgcgccagtgcgcattaactttagcgcgtttgtacacatacaaatgtaggaattatacattgcgcgcccacactttgctattttatccccccgtgccctctccgggcccttttttgcccttctaatctaatgatgtgggcaaatctggcgccgcttccgctgctcatggaggtggaaggggagaaggtgtgtggatggactttgtgctctgtttgtgtgttttgttgccaatttttcccctccgcttgacccccccccccccaatggtttcatttattattatcctcctccattcatttctctttcttccgcctctttccatttctttttctgtccataatagcacatcgtatatttctatttaccataataaaaacacaggtaaatgaatttggacaaaatttcctcctcatttgatcagaaaggaggtagagatttagggtaaattaagtgcaacgcttcattaaatatgaaaatttgccaaaaaatcatttgactaattataattactacatacctatgtatgactgaggatgttttttgcgcaaaaatctgatgcaattctttctttctcactttatttatttttgttttgaatttcactgccatcggcggcagcgccaaaaactcgtcaatttactaattaatttgacagcaccaatcagcagcgctcattgactagcagctcttgcgttattcaaattaatgctttaacaaccaaatccgaagcaataaacaccaaaacaacaacaacaatcaaacaacaattttttgttgttcggtcattcaccaacaaatacataatttttttaattgcgtaaatccgtgcatcgcaaattgtgcaaaaaagaagaaaaatttgaggaccgaccacaattttgcgttttatcttgcggcctttgttagcaaaatgctgtcacctgaccaattgcctgacgaggtttgatcgggaactgtataaagatgggaaagattgacaaccctaaaaatggttgtttgtgatgccttatgaaaattacgaattaactgatgccctattaaatgcctgtaaaaagtcaataaagttttgaacgtgattctgacaaatgttaaaaactagagagctcacaaaacgcaacatcagttggcgattgtgcattacaagatagagggtctaaagagatgatatttttctttatgagtatcaggcattgatcaccttggacagaatggaaaacttttttcattgaattttttgattttaatttaggctttgagtacattactcgggaaaagatttgatcatcaactgcatttttttctgtgacctttgacgacaaaaacctacaaattgtaagctttaggaagattgcattcggtataattcttgccatcacttcagaatctgaacgcaatttctgagacacatccatg

SEQ ID NO: 7723 - DNA, 5865 bp, Heterodera glycines
  misc_feature (836)..(836): n is a, c, g, or t
tttttccgttgaactattgccacatatattcgtctaaataactgggcaacaattggcgcgttgtccctgtcatatttgatggaattgaatttttgtatttttaaaaaaattcgaatttccgttccggatttcgaaatgttcgaaaatgtggtcagattcgtattcagcagctttaatgagcatataaatgtgtttcccaaattttattaaaaaaaaaaaaaaaattcgggaccaatgaaccgaaagattgccatttattgtctgttacttttagcccagaatttagttaagcaaaaaatctataaaccaagttttcacttgataccataataaactgagattgtcattgtttgaacgcgtgaactcgaacattgtttaaaatgatcatttctctggaatttttcagttatatatttttgtttattaaagtctcgtaaaattgccaaaacaattcttttcatgtttaagtccattcttcgcaaccgaaacgaacggtcgccaattaacaacgaagaattgcagaaaatgtgcaaaagagatattgtggagtttcttcctactccgaaggaggtaccaacaatttaaagctattaggccttattttaattagattttgggtgatttcgttttcgagaggagcgccgggaacaacagagagaaaaggaagccgaggaaagggaggccaatgtcagcgtggaaaagtaggaaaatggacttgtcgagcagtgacgaggagagaatttaattcgcgaaatatttattgtatttgtttttgttatcacccattttgcaattatttttttcaaattgcctctttatactgaggtcgaaaaagngggttctagtcggttttacgcgtcccatgacactttacgcgtcccaacacattttacgcgtcccatgacattcgcgtcccataacaaaaaataaagggagaaaaattgaaatagaaaacttaaaaaaacaagctagaatcttctttttataatttttcttaatgatgtcaacagaaagttactagtataaaagaattttacaaaaaaaagcctaggtttaagccaaaagcttaggcgtagtctaagccattgttcgagttgcctgtgtatgagttgttattatactttatgtttaacaataaaattttagttaaaaaattactgaataccggacaaaaaaaaggtttcatcatagttattaggacggctaaaataccatagaccagggatagcacttaattccggtttccgaaaatttttgagcctcggaatgacatccctgccatggacacaaatgccatgggacgcgtaaagtgtcatgggacgcgtaaactgttgttgggacgcgtaaaatgccatgggacgcgtaaaaccgactagaacccaaatttttttattctttggtgactgtaaattttagtttaacaaaaaattcgtaaaattcaaatttttatttaacttttttgcaggtaatcgtaactgagtgggaggagttcggcaaaaaggttcggaaaaatacagaatggtcattaattattgcaaaatgattaagggcgagttggcggatgtgttgacatcgtttgaccacgaaattgaccaggcatcggtgcaccgagggaagcaaatgtacgcaatatttgggacatttgctttttttgggcattacaaactttttcatccggcgatgtcgacaggcgccgcagcggaaatttttaccgaattaaaaaaaactgcaatccggggcccatcccatctagatggtcctaaatggttttgaaatttgtcattaagaattgataaactgaccggcgccctgtaccttggcgagctgatccgacgcattcttgcccagctggtgatggaccgtctgctgttcagcggcacactcgtggaggcgttggaccggccggacactttccccaccaaatacatctccgaaatacttgggtatgttggtacaaatgctgatttttgataatgtaaggttttacaaaacctattttcgcaattaaaatattttaaatttaattcgaaattcgaattttccatccatattaccgaagaggagagtttaaccaggacagggagtattaaatccgtaattaaagaggccttcttcaattaacaaaaatgagtaactcgcaattgcggtgtacaaaaatgtaataaacatttgtgtaatcacatctaacccaggagtaaatgacacccgaaaaatttgaccagaaaaattatgcaatttgatgtactagtaacagatttcgttctacagttgacatttttaaaactttcttcggtgccgtccgtttttgccggcaccgccggactcctttttttgaacatttcgttcatcaattaattgattgttgtcgctcttttcatttcagcgacaacagcggggtgttcaaaaattgtcgtcgcatttgtgacgagttggaggtgccaagccacgggagcaacgactacctgatcatgcgcgaggtgtgccacgtggtctcattacgttcagcagccattgttgccgcaggtatcagagagtcgaatttttccaaaaatttgatgaattactaggtaagttttttcaaaaatttatccaaaaatcgctgaaattttttcttttttttttttttgaaaattttcataatttaaatttttcgggggggggaggaaggaacgccgagggaggaggagtggaaagtgcacacttcatgtcccctatttgtttgccatttccagcaatcaccgccctcctgcgccatgtcggcaaaaggaaggtgaaggtgggcgtcggcggtgcactcatccaattccatcccacataccacgagctgttggagtcgcagctgcactcgttggccccgctcaacattgaggcacaaaaattttcattttttaaaacaaattgccaattttctgaaaatttgcaccgtttacagtgggaattggtgcccgccgacgagggcagcgtcaaaggtgccgcactgattgcagcagttgcggaaaagttgaaactttgacaccatatggtgtcacgtcacgtgttggaccgagcgtgtggatgggagtgatggtgacgctaattaggaggcatttatttggctgatggctggatggcacactcactcttcgattatggcacattttggtgccaaaattttcacacgaaaatcataccttttacattttgcatttgtttgtgtctgtttttggtggtgcataaccatgcttccttcatctgctgcttctgttgtttttcaattttctgccctcctccattcttttttgttgttgtccaattttttggtccattttttatttttttaaatcaatttatatgattcctccaaattttgttttgcgcttggcgatgcactgcctttttccttctccttttgtttctctgatcagaccgttgatctgcggcatcaaattgtacacgacgaaaatggtcatttgtttggtccatttttgcgagtggcctcctccacgttgtgttgttaactcctcctcattctccgcctcctcccaccatatatttaattataattatcacaatcgtttttttatcacactcttaacatgttttttgtggttgaccagcaaataaatttttaatctgcgcaactccttttttaacatccattttttcggtactccttaagaattgcggtaccggcgtatctttaacttttttctgagctaatcactcttacatatgagcacttcagagaattcgagcaaaaaattgaaaatattaaatgtaaatatttgtgatcaaggaactgaaaaggctcattgtcaggagcaaaagagtacaacttaattaaagctctgaaaattaatgaatttccaaattctgagctcatttgtcagaatgaccccctaattagcctttttttttgtcccagaaaagtgattttttttcgccgagatcgcaattctaaagggattacggattgccatgtttgatgttttgattttgcccaaatcaatcggtttgatcattatgcattttcttctgtttcgcttcatccacaactttttaagctgccaattgatggagattcctctgctgcctaccgctcaaataaaataaaatgattaactgactaaaagacatcgccgcccgtgggcgcatgaatttcgcattttcataaattttatttcattttagacccattttcgtgatctgatctgactatttcgtccattcatttattcattctttttttatcacgttttcccccattttaaagtaatggatattaaaaaaatgtttggacatttttgtaattgcttcatttttggtcttaaaatcagataattccctcctggccaaatatcgatcgggttgcaaagtcggattgatcagatcactccatcggtcgcattgcttaccccaccctacccgtctcacattgtttttcaatcttatttatgaaatatttgactccatgaagccccaaaatttctttcctctaaaattaatctgatacaaaaactgacaacgagcaatcggatcaccattgatcgacaagcaaaataagtgtctctgttgtgtgatgttgtcagcgaatccgccgcctcctcgtctgagctctgattcgctgatcagtagcgattagggctgctcggggttttcggatggtcgtttgttagagaatcgttgaaactctatttaatttttatggttcataatcgttttgctggaattttttcgcatttgaaagcataaaatttacttacaagggaaccacccgaaataagtcggaaaaatgtgttacataccattggatagagaaaggtcgacttctattgtgaatttttaatattacgggcacatagcaagaaataaaaaagttatgaggcctctttaaaaatttatttgatgacaaattctaacataattttttcttttaatttattaaattctctcccaaaaattgcacgaaaataaaagttggaagaaaagaaacaaaaaaaatgttaaaaaagcaaatgcaacttttggcagaattttcccaacaacaaaaaagaacaaaaatggccttcgccaacggctgaggaaagcaaaaaaaatgcaaattaataatagtaatttcagaagacagaaaaatcggtgaaatgcgaaggaaaatggggacaatgaaaatgagaaacttgggaaaaagaacataatggtgagaacggatgcaaaaacagaaaaagggagagaaatttaattgtccaaaattaatttatggtattagaaacaaaaaaaggttgtaattaagtattaaatttattgcaatggtaaaaaattaaggcctctaattgttattttcggctcaaatcagtctccgggagttctcgagggtgttggtattattgtgaatttgtattgcccagctccgaacctcggatccaaattagaacaaaaagtcgaattccttcccaattattcccaaagagctgcatgcctccattaaaacaaagtcaaattagggacccgattgccaaattttaattattcctatttgaaccacaattatgaaaaaaataaaaggatgattttatccaataaatattttgatttacaattaattatgattttctttcattgttcttatttggaaccagcagtatcaccaatttttaaataattgatcaaatattttatttaataaaataacaaaagaaataatcccatttaaatgcttacaattaggctcaaaatgtccgggccattagggccacaaccggcgttttatggaactccacaattctggcaccaaaaagtccggggtcctaagctgaaccggagactccgtttgcacttctgctcaatattctgaaaattattctattcaaatagaaatgtcatttatta

SEQ ID NO: 7724 - DNA, 3244 bp, Heterodera glycines
tatttacacgttttttacagcgcgattttttcaacaattttttgggaacttggaggagggtacagcggtgccgataggcgccgccgggaaatttttaaaaatttcagttcaatttattattagaaattgtacaaaacttactagtttttaaaaaaaaaaattaaaaaatttacgacttttcatcaaaaatttcggaagtcggaattccgaccccaaaaatgtcggaaaccggaagtctttccgtgccatacctggtgcctatcgacatctgcgagaaatttaatgaaatttaatgcgatttgttaacagattttgtctaaaattgaccaaatgacgcagtttttgactcaatttctacaggactattaagtaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcacaaaaaatcaaatttgcggatcccgctgcgggattggaactcaaaattctttgcgggacgggatcccgcgagattaatcccgcaaatcccgcattttccaaaaaatgcgggattgcggactgggatcccgcaaaatcccgcgcgggatcccgtcccgcgccggtctctaatagagaacacttagggctttcgaatgataccaaaagttagatttggttgataaagaaaaagttatagtccaaaaactgggctggcgccgaatgtcagccctaacttattttagaaaataatttaaagaatttcgaggttgctgatcatgcactgactgacatccatttttttgtttaaaaactacaaatactcggaaacaaaaatgaaagccatcgatcctgcaataaaaaaattatataaactataaaatattgtgagcctcgacattataagtgaatttttgtctttttcgtccttttatacacaatttgtcgattgaaattgcgcattttttaggaggtttttcattgtttaaaatggctatttaaaagcgatttttcaattccgggaacggtccaccggcagtccgctccgtggtcaacggcacgcccggcagcgtccagcggcagcgaaatgtctcgcccaaaatcggattgtacggcttcttggcgacgacacttttgcgagccgggaagaaggagttcagatagtacttcaggacggcaaggaatctgtaaaagaattagggtgattttgtccagcgaaaagaaaagaaaacaccttttttcgggtgtgttttcgtaagccgcgctgaccaattcgtctggatgggctgaaaaatgggaagtgctcttcaaaattccaaaattcattctgttcaccgaaaaagtcggcgtacatttccagaagagagcgcctttccagaacgagattacgtctacttacatttcctagtttcacagtcgctctcccgatgttacggacgccaacggaagaaaggccggcgacgtacgactcggtgtaaattagggatttttcgattttcattccagctgaatttattatttttttggcaggagtgtgttccggtgatgcagcaggaggacaataagagccgaaaactgtggcgtcatctcactgccgcactgtacactaacaacacacagctggcgactcaaagtgcgttttgaaaaaagggtcaaattgcatggatggagtaattaagattttcccccgcttagttaaacagcacttccaacaacgccagcgggaggaggagacggagcgcgaacgacgggaccgtccagcgtggagaccgcgccactttgtcagagatgggtccggggcgccgacagatgcgtggaaataccgcgatgcgcagggataacgaatcggatgggccccaacagagctgaagaatgggcgagaggaaacgtcaaattagggcaaagatgtcagaagaaactcatttacttgtccgaaattgtctatattatgtattaatctgtatattatgtactaatatgtgtgtagatatgtacttgacggcccggagccaacaactcacaaaaccacttttataagatttaagtgcaaattgctaagtatttttacttcaattttaaagcatttttaataatttttgattccgctgaaaagcttaatcctggtagcatcccctcctgttgcaaatacgaatgaagtttaccgtccatttattgcgaaggattttctgtatttggacaaaatcgtataaaaataaaaaataagcaaaataaaaacaaataataaataattaattaaacgactttttcatattatctttgccgcctttctttcgtttgtttcaatgggaattcgaagccattttcgtttttcattgtttgatgttcgaaaagtgtgctaaatttgaaagggttattaatttgtcgtcgtccgttcgtctgactttttttccagcggcgatggcgtcgcacttctccccaacaatgggtccccacttggcgttgccggtccgcaataactgtacgcgcgtccgtccctccatccgaaaatggcgccatcgacacggcaacgcttcggagtcgcttcgcccgacacggacgactgtttgcgaaggacggacggcgcacgcagcgaagtgcgaggcgaacagggcgaagcattgggctgcgaggaggggcgcccgttgtgcaattggcccacggtcgtggccacggattgaacttcgccaaagtccgtatcgattgacgcggccgaggaatgatgagagttgagggaatagaaaaagcgcagcgattggagtgcgccgcgtcgcacggatcgcttgagcattccgctggcgggcgaaggatggccaatggtgccgccaacagactgctgctgatggtgcgacatggtggaccgtttacgccgttcggagcacgctcttcaaaatatatttgttaggtacaagcgacatgcgcctccgtccccgcggacggaacagggggttagactcacttcagaaaataactcattacccgcaagacttttacaaccacttattgccaatctaattacttgcagatttaaagctatccattgcctgccggttttcggcacagcaaagcactaatagggtgatggattcacttcaaaaaataattccttacccataagttttttacgaccacttatcgacaatctgattacttgcagattaaagcca

SEQ ID NO: 7725 - DNA, 1990 bp, Heterodera glycines
cacccaattgcctgccgaattgcaataagtaagccaattgacaacaaaagcagcccacgcagcccaattgtgctgtcggccgtccacaatgcgaaccgcaaaaatggcacgcacttggaaaaccctcaaatcggcatggaaaactgctgaaaagggggagaggtatacggtaggctgacacatcaaaggacaaggcattacggtaatcggatgagagaaaagacagaagacagtagggcagccagcagatcaaatggaaaacggcgatccttctgaaacagcgaaactttgtttcactttccattcgcttctttccctttcccttctccccaatttctgtgccctttaaatgccaaaatgccattctttcattgccttatcgtcgtggtcatttcgcgcatataatgagggtaacgcggttccatctgcaccaacagaagcgggggagaagcattctttgccgaacggccacaaacgcactgctgggcagcgccggagacggaagtgggcgacgcgcagttgggctggcgggaacatttctcggggactgaattggctaccgctgaaaggaaaagggtggtgagaaattgtggcaaaacattttgaaggcttaccacgtgcttttcgctgccaaaacttccgcttgacatggaaaacaatgcgtgcgtaattcgactcgatgacgcccaattggacgaaaaagccaacggctaaaacagtacgggcgaccgtttggccgacggacgattcagtccaatgggcccctttcgctgcgttgttttctgcgtctctttgtgtgcagttcattccgtcgtcagttgtgccgacgaaattaacgcacagccaaataatggcaccgccgcaaaagagcagagaaagcagcgcaaacagcggagtcagctgaactgccacttttctgacctaaagggcaaagggcgcaaatgagcagcgaaagggaggcgaaaaagcggactttgttgttgaacggcttgcgaacggtgatgaaccgttcaatgctaatgcaggcgagacaagtcaacgagcacagtttgagcgattggtcgacggcgaacgcccaacgacacgtgttgggggagaagtgccggtcggagaacagcaaatgccaaactcggaagcacaacgaaccgttgacggacaggtccagcagcgaaagcagccaaatgtacttgctgaaagagggggaacagccgtgaacaccgtcagaccgacccatgccaaacagaccgcaatctgtccgacggactcaaacttttgccagaggcaaaagtcgcctttttgccggtgcggaaaagggaggcgatcacccacgcgttgccaagcagtccgatcagaaaagtgaacagataaatgagggctgaagcagcgaaaatcgtctgtagccaccaaagcattgtaagaaacactgaaacaatttgagagagaatgaaaaacagtttggaaagaacaattgaggggagaagcataactaactgagtagaacaaatggaggtgaattggctttaataaggcattcgggaatgaccttgagaggaggggaaggacccgggaatggttttaagtgcgggagcttcggggggggggagggaaggggaaagttgagaatgagtccgcccattctttgccagtccttggaaagcaaacattaatctgtgcgttttgcaacgtctaaagtactgtactcccggggagggtctttttctacgcggattttgtcattatccgttcttttccctccgggtttttcgcattttgtactaatctctgattcagcgccgcccaaagggattcattccgttgcattaaagcgaaggagcaaaatgagtcagtcatttcgccggcggagggaaggagaaacatttgatggaccaacggaaaatggtaagtggcaatccattgtaggaactgagggtggaagacgaacagagacgaagccaaattaatgttagcctaattaagtaagcaattaagg

SEQ ID NO: 7726 - DNA, 2780 bp, Heterodera glycines
  misc_feature (25)..(25): n is a, c, g, or t
tataaaatttaaaaaaaatcccgcnccttttttttgcaaatctgctgctgtggcattttccgttgtaaataaacgcgggtttttctaaagtcattttattggtatttatttcgctcaattacaatctcattttttggaaacattcaaattcatttataatattttttgtatgtctttgtggcgttgtgccccttacatgggaagcatggccacagcgtccgtgtaatccagtccagctggcacaagcatttggtcgggtggtaattgtgcagttggctgtccacgccaaagctcaacgacacattgcccttgtaagcggcaaaacagcttaaaattgtgccattttagagtttttttttgggggggggggaggatgtgagtcagttttccgcccgaaacgcgaggtttttctcgtctcgaatcccgcaccactttttttttggtcgtcaatggtccgaattccggcccggccggcccgaactttttatggctgtcccgacccgagatttttctcgacccgattcatagctaatgtgagttatcaagatagatacatgtttcatatgatatcccacttgttcgagagtatccccgtgattaattccctcacagtcgagtcgcccccgcccccgaaaattcacaaaatcagaaaaaacaaagaatttttaataggtattttattttaaaaaatttcaaaaatttttggtcattccacggcctaactaactcgggatttcttagtgtgttcacggattactttttttttttttaaatttatgctgaccttccccgttttcgttctgccgaaaggcgtgacaattcgcaatagcattgtgctaaataaagattttttcaattgtattttttgattttcctccatttaccgtacacttgcaggtaccgtctctcgaaattttttgtctctcttgccttcttttgcaactgccttcttttccgacggacagctattatttttgttgttaatatttgaaataaaattcaaaaaaaaaaaatcctccccctcttccttgaaattttaaaatttcaaaaaatatctgtctctccccccttccccaaaaaacacctgttgaacttgcgattgccgctgcgacaccttcgcttcggccggtttcttcaagaatgttttggaatgcgttcatcttaattatgaaagagggtttattcacaagaacgacagacatatatacaaaaaaatctgataaatttttgaaaaatttctcaaaattcaacccctaaggggatggatgggtcatgaaatgacgcgttcctcgagagtaggctcgagaccgagatctcccaccaggaattccgagactcttcctaattcaaaaccaagtcgtcaagtagcgcattgattgccattcttaggctaattaccatacccgggcgcttttcatggggtgtgccaaaattgattaccgtagcctgtacagatgcgtctcggtcaatcaccgacgctttgtatggattcaaattgcacaccgtaacggaagggaatggcgcattttcaaatttgagcttaaatgtggtggggaaatttaattgggtttggcaccatcactcacatcgagatcaacggtttttgggtacccaaagaatttgatgatcagataaatcacttgaatgacgaggattaagaagcacacggcgaacacctttccaaaattataaaatggatgcccatttacaaattgatcacttttgaaattgacaagaaaattgggtattgattgatcagcctaaagcaaactgatcaaatgtttttctgattgctgttcattaatttgctttattttcattatcgagtttaccgggcagtgtggtttgtgcatgttaaattttcggcacccactgatcagataaaagcattatttctattatgtgctaatcagccacttctctcgctaccatagatcagttaatccatcaacatcttttgtctcactctcgttagctcttgaactaattaatgggttttataccccataacctattttctttcccaattgttgcgcctgatcaatcaattactaacgccttttgaattggttatgaatttgatctcgcgattatgattaatcagctctgatgttctttttgtttgttgtgttgtattgctttcgctaagtcattaccgctaaccaaaagcgcctccatcgtttgtttggcgccagcgatgcgtggcaaatgccgtggatggtcgaatgccgttcgaacttttccatgatctgcttcaccgagtccatgtgcatcctgtcacctgtgagtagtgatgattgatcattcattcagcggcttttcattaaaacaaaagcagccatttatttcatttcctctactgatcgaaagacaaataattcttgcttttcacattgattagctgtcatcaacatcaaagcattgtgtttttgtcattttttttttgatttttttttgacatttttactcgctcttttgaacggaaagtcggcacgcgagagacgtcggaatgcactcattgcgtgtggaccacctttctgaaacatggggggggggaatttaaaaaatatattaaaaactattctcggcaaattgtcaattctggggggtggcacatttttgtcaacattttcacccattaattaaccctaatcaacctaattatgctagaaattaacaattaccgacaagaatgacttaatctgcagagtgtggcatttttgccacaatcctaaattgctctaacgtgaagcccattatcctattgtattttaatgagt

SEQ ID NO: 7727 - DNA, 2031 bp, Heterodera glycines
cctgtcattaattagtctgatcagcaacaattgatccgttcattgatcagagcatcacttaattaagctttctgactgattgaccaccttgaacagcccgtccgggtgggaatgttcctccgcatttgccagcaacaccgccctgcgcagttccggccgcttgctgaccactgccgaccttgcagttcccctgctcccgctggattgcttggacaccttgcggtccggtgccgccgacgccgaatctcggcttgtcgttcgctgcgttggcggcggcctcggcctgccgcccgccacggctgctgctgttgaactgcttgaagacgattttggccctggtggtaccgccgccgctgctgttgagcttgtcgtcgacatctttggtagtagtgccggatttgccgaggttttcctgctattgccgttctcggcgccggcggcggcttttccccccggtgctgcccgcccagctgttggcggaggaggcgtcccctgttgcggcggctggtggtgttgttgttgttgttgttggccattgcttaaccatgttgaggacggtggatgacgatgttgtgatgcttgttgttgcggttttgccgtcgtcggcttcgttagcatcgcttggctagggtctaaaaaaatttaaaaattttagattatatattttttgtctcatatgctatataaaaaagtgtcatgactgaaaagatgaagtcgctctgcttgtaaaaagcagtctatccctacggggattgttggtgatgatgatgattgtgatgaaaaatgaaacctctcccccctcctttggatggatattttgcttgaggctgatcagtcaagaatgagactgactggaaaatggatgggaagcgtatgatcatcacttgttccccccatttttagggtttaaactaaatttgaaaatccaaaaaaaaaattcgcttttctcggcatttatttattaataagaggtaaaagccaaaaaaaatgatgacagctttttgttctcataaatgattgatgatgatgacgacgacggggaggaactactgatcagaaaaaacgaaacgagtgaattccccagtattttttctcatttccgatcatttaaaattttaaaaaaaaatttacgcggaattttaaattctgcgatttttttttgatgaaataacaaatggaaaaaatagcagccaagtgcacaaatgcttcttgggtgaaatatgataagcaatttgatacttatcggagacagaagagagagagtccatgcaaactgctgaaagaagagagaaatatgtgaacaaatcgtccaccgtaacaggggtgtgacttgtctcagaaaagacgagagcgagagtttggcgagaggcgagagtccccaaaaagacgagagcgagagtttggcgagaggcgagagtccccaaaaagacgagagcgagagtttggcgagaggcgagaggacgagaggcgagagtttttcaatttttttctgtagccttattttttaatttaaaaaacttcaaaatcgtatattaaattagggttacgggcctgggtatttgggcaaataccgggtcagggtattgggctctaggaaaatccgacaccggaaaatccgacactggaaaatccgacacaagcagaaaatccgacaccgctggaaaatccgacactagcggaaattccgacacttgaatttcgaaactaatttactaattttaaaaagcatttttgattgtttgagttagaattaaaatacatataatataagttacaatacttaattatttaaaataaatatttttattgttataaaatctatctaaagtatgcatatgatattcatgtttatttgtatgcccttttttgaccatctcaaaaaatttataaacaatcccgcaaatggaatcatggtaaagggcataaagcgtaagcaagtgtacgtggaacaagacatgaaagtcacagagatttttttgactcgcaacaataaacaactggagcattatttgcgagcaatatcccatcgaa

SEQ ID NO: 7728 - DNA, 1120 bp, Heterodera glycines
  misc_feature (313)..(313): n is a, c, g, or t
tcgggaatagcttccctatagtctgtactttaattctgcgttggatttttgctcccccataaatgtttgagtacctcaaacggacacttgaaaaaatcgatttttttgttttcggggcagtccccccgagcgcgatgcgcccagatttatggggagaccgaatccttccggaatagcttccctatagcctgtactataattctgcgttggatttttgctccccataactgtttgagtaccccaaacggacacttgaaaaaatcgatttatttttgttttcggggcagtccccccgaaccgatgcccccagatntatcgccgccgatttggcccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagacgagaggcgagagtaccaaaaatggcgagagttggcgagaggcgagagacgagaggcgagagttgtcccacccctgcaccgtaaggacggggatttgggagggatcccggctcaaaagctggcacaaaatctcgaccattcacaaaagctatggatgccttgggtggggataattccagggaggggggtacgtattcaagaccacctccatattcgcaaaatttttaagggaaaaatagtattttgtgataaaatttttgatttttcttattggtatcccccccccccctagacctccctcacccaaagttccaaaaaaatttcgctaaattcccaaaaatccgaaaaattaccaatttt

SEQ ID NO: 7729 - DNA, 3405 bp, Heterodera glycines
  misc_feature (3335)..(3335): n is a, c, g, or t
ttgagtagcttagagtacaaaaaattcgaaaattattgaaatcatgtttcccactcccttctcccaggggtattattttgtaaaaagtctttatttccccaataaacttttcatacccaatttttagcaccgtgaatgttatttttattgaattctgaaccggtttgagtagattagagtacaaaaaatttaaaatttcgaaatcatgtttcccactccctatctcccaggaggtattatttgtgtaaaaagtctttttttccccaataaacttttcataccccatttttcgcaccgtgaatgttatttttattgaattctgaaccggtttgagtagattagagtacaaaaaatttaaaatttcgaaaccatgtttcccactcccttctcccaggggtattattttgtaaaaagtcttttttttcccaataaacttttcataccccatttttcgcaccgtgaatgttatttttattgaattctaaaccgttttgagtagattagagtacaaaaaattgaaaatttcgaaatcatgtttcccactccctactcccaggggtattattttgtaaaaagtcttttttttcccaataaacttttcataccccatttttcgcaccgtgaatgttattttgattgaattctgaaccggtttgagtagattagagtacaaaaaatttaaaatttcgaaatcatgtttcccaatcttctaaacatctagggctttcgaatgataccatgattgtgaagtttggccaacaaagaaaaaagttatagctttttgaacattgctgagacggagttggccagacggagttgacccctaccgtactcaactcaacaccttttcaatcaatagaaattttatttttaaataaatattaaaattttttttaaataaaaaaaaaaatttttttttcaagacttccttgtcatttcccgcaatacaatcggaagcccagcagatgcccaactccgtcgctgctactccttgcgcccccaacccgttcaacaacaatcacttcccacaatcagatgcagaaaagtacaacaacaaacagtgttgaagtgcttcagaaaaatgagcgatgacaaaattttgctgtggttttgatggtcgacaaaaattccgaatgcttttttattttttaatttatttatttgatcggaataaaaacaaggtattgcaggaaaaataattttttttaatttaccagctaaataaagaataataatttgggctactccaaatgcttctttatattgaaaaaaattacacaaattgattgacaaaacgtcaagtacaatgaattgcgttaataattttcaaaaaatttcgacatcacccaattgcgatggtcttttcaatatttattactacaaaattttttcaattcctctcaacatacttaaaaatttatttgtaggagataaattatttattttaatttttatcaattaactgtgaaagtgatagaaaccctcatggattttaggatgaccgaaaaataatttttgaccaaaacaaaaatcatttgtgctttttcatgaaacagaaagaaatgcttaatcgttatattagaaacaaaatgaaaaagtgtaaaaaattttattcataattttgctaaaaaaactaaattcttaattcataatattatgacacggatacaacaacgaccggcggtttatgattatttgagcacagcaaaaatttgacacaaggaaattcatttttcattatttcatgatatttggagctaaataaatatatttatttttttagtttatttattttttttcattctttacctgaaaaacttgtgcaaaatcccgtaaaatgaattgtatttcacgtttttagtgaacatgtgcacgtaaaagtgcccaaaaatgaattgtaatttgtatttcacgttttcttgtgtacaagtgcacgtaaaggttaaatcgttttagacccacaaaattgtaatttcacgtttttagtgtacaaaaacacagaaaattacctaatcgcgacttcacgttttattgtgtaaaaaccaaaaaatgaattgtatttcacgtttttagtgtacatgtgcacttaaaagtgaaatgttcccaaaaatgaattgtaatttgtatttcacgttttcttgtgtagatgcacgtaaaagttaaatcgttttagacccacaaaattgtaatttcacgtttttagtgtacaaaaacacagaaaattacctaatcgcgacttcacgttttattgtgtaaaaaccaaaaaatgaattgtatttcacgtttttagtgtacatgtgcacttaaaagtgaaatgttcccaaaaatgaattgtaatttgtatttcacgttttcttgtgtagatgcacgtaaaagttaaatcgttttagacccacaaaattgtaatttcacgtttttagtgtacaaaaacacagaaaattacctaatcgcgacttcacgttttattgtgtaaaaaccaaaaaatgaattgtatttcacgtttttagtgtacatgtgcacttaaaagtgaaatgttcccaaaaatgaattgtaatttgtatttcacgttttcttgtgtagatgcacgtaaaagttaaatcgtgcgactgtcgcccggttggtcttccggcatgcaattaaatgccttaataatttttttcgcaaatgactttaataatatattttcgttttccgaatggcgcgtcctttcattggctttgcttttgatgccttcaaacggcgtttgggtgcccatgacttcccatttctccgtggtttcatccatggattcaattagtggggcttgcttaatttactgaattattccaaaatttatttaaatttttaattattttaaatgaatttaacacaatataatttcataatttttgttttcaagttatgatgcccaaagggtcaaagaaattggtgccgaaagggccgcggccgaatgggtcgtccgttgtgaggggaaagtgaagtgggaaatgccaaaatggccaattcaatgtttataaatattttgctttctcagatttgaccattccccccacattttctaaattgtcttaagttcgggctggagctgtcgccatttcgatgggctcagtcgcctccaaaatgttcaatttgtgcgctgcaaatcgctgacagttggcacttttgcgtttgactaagccaaaaatgccccaaaggacaatggcctccaaatgctcgccgattcgtccatctccgacactttgctaacacttcacatcgaaaagtgtccgaaagtgaccaattcaggcatcagacatttgcgcaaattgaagttgaatgggcaaatgttcctctanaaacatttgctcctcttttagagtgctgaattcgctgactttgcaaatttgaaaaatgtttggaagccgg

SEQ ID NO: 7730 - DNA, 2236 bp, Heterodera glycines
  misc_feature (45)..(45): n is a, c, g, or t
ccccccccccggggcttgccctttcactctcttcccttttccccngcccctcccctttgtgtaattcttttttattgtgttcgctccttcccccttcaggcgccaatgattgttctcgtcgtccccctctctcttcgccccttcggcgcggattgctgttgagcctggccctttcccatctttcaccccttggccattctttccgcaacattcccccaaagaatgccttctgccaaatgggtgtgccatccgtcgcttttctgttcacttttttgctgtcgatgattctgtctttggtgctaggccatgaagcgagcggagacgccaaaagcagaagaactgtttccggcactggcgctgcaatttcgccggagggtgccgagggcaaagaatgccccgcggggtgcacttgcgcggagctttcggtaattggcagcgatcttcttcctcggactttacccaaacatttgctgcagttggaatgcgccggtttcgacttagaaaccgtccccaacgagtggccctcccatttcgagcgggtcgttttgcgcaattggacaatgtccaccatcgacaaaaacgcattccgtcgcttccaatatttgcgcgaattgcacattttggactgtccacggctggatctgatcgaacggcacgcgttcaaacagttgaggaaattgaggtgagaagttgaggctggtcaaatgcagaataaatttcgaaagaatattccaacaatgtcaaaatgtggcactttgaaattttaaattatggaaattaaaaaaaacatggctctgaggggggggggggggaaggggaagtgtcggtttgtcacgggagaagggggaggaaaggcgttggaaaatgtttgtcggtcatacggcgacccattggccgggaaatgccattcttttgcttctttcaaaggctgcttgtgatccggggcaacaaaagtcttcgcgagctgcacaaagcctccttctcagccatcggaaatgagcagtcgctttccattcaaattgcggacaatgccatcgaacggattcgctcctttgctttcaagtgccattcctcttttatgtacaatttcgacataaatttgtatcataaatgctcaaaatctgcgcgaactgtcaattgaagagcgctgcttcgaattggaaggctgtgccctcggggctatttcgcgtttggactttgtcactttgcacggggtaaggcacggctttttcctttcccttcaatttgatttggtgccctgcttaatcaattattgttaagcttcttccatttgattttcctccttccccccttttcggtgtgttctttggaaccgttcgccttccaaaacagcacattgatccatcagctgaacatcgccgcctcttcgctgaacaaattgccacggaatggctttgctgaactcagttacatcagtcaggtgccgtacagcagaagtgtcactcgcagcaattatcacactcataatcagagtgatcagtctctattctctcaataatcatcattcttttgtctatctcatttgtcaatgccaatcagtctcagcactggtcagaatactcgctgatcagtcacttattcaattcgctgatcggattaaaggtcgtccatcccatttcaaacagaagcgtggcgtgtcaaatttcgtttcttcacccttttgccttttttttaaattccttcgatttttcctactcgaatttcactttttattacacaacaaagttgaaatatcaactttaaactgtccttttggcctttatccgattgctttccgttggcggggggacaaatgcctaaaatagggaatgccaattttgtttaattctgtccgaaatttcattttgcatttgcctttcagcttcaaattcgcgagtgccggattggccgcattgacgagggtgccctcgggggactgttcacggtcggctctgtccaacttcagtccaaccaaattgtgcgactgtcgcccggttggtcttccggcatggacaatgttggcaaattggtgttcacttacaacaccgtgcgtgagccgatggtgtcgccagaatgccttcggcacgacggcgcacagcgattcgaatttgcggacaatacgctgcactgctcatgcgcactccaatggatgatcaacgcaccggaggaggagcaggtgaatcggacggcaggagacggccaaaaatacaaattaattgccaattttggattattt

SEQ ID NO: 7731 - DNA, 2238 bp, Heterodera glycines
aaaagcgcgtccagaaatgagaaaaatgaaaagggaaaagcaaaagcgcgtggtcagtaattgtaaaaggaaaaagtgattagaaaattacttaagtgatcaatcgatcagaggtgaaaatgctgcggtaaacgattgattgccttacgccaatttgtacgcttcggttggtcaaaagtcctgcaaattgcctaattaaattaggcgtcggttgcgcactccttcccaattctgcccaagtttttgcactttcatcaaattcccaaatgttagtaaaatttcctcaaaatgcacttctttccatttttgctgctgttttgaccctctcccaaaatgctcctccaccgatcggtccctttttgattgactcacgcgaaaaggcccaaatgattggtctccaaatcgaaaaggcaaatggcaaaatctgcggggacaaaaaagtaaaaaatggttataaaatccggaaaattggcacaaagggaggggagagattccatttggcaaaagtggaggaaatgagcgacttaatcgaaccggacaaagtgagggcattttggccgcaattggaagtgatcggaatcgacaaggcattggtgtgtgacagaaagacgaggtgatcgaaggagggagggcactgatcaaaccaaagaaaaataaatgaacaattaatcggagatttggataatttagcgatttctccatggaaattccccttcttctgctggaggaaggcgtcggagttgaaaagggggaaaaagcaaaaacaaatttggcaaaccgaacaaatttaatggaaggaggtaaatgcggcaaaatgccagaagggaaggatttaagaatttcaatgcattaatttcatttgcattgctttcgtatgaaaatggcaagtatcttaggacatttctccggagggcagcgacaggcgaataaatcggccgaatcgcccaaaagcgcgccgattggcattgacattgaaacgctgagtgatgaggggaaacactcgttgagcagaatggtgtcgccggagggcgagaaggaattggatgggatgttggcacggatggaggcgatggcacaacggggaggcggtagggaaatagcgcatgaccagcagagagggggaggggcagcagagagatttgctaggaggggctaaaatccaagcagtccatgtgtttctgttggcctcagtgaagccgcttccgtcttccgtgttggagccaatcctcgaccgaggcaactacgacccgcgcagtgcgcccgcctttgtggaggggcgtccggtggaagtgcgcgttggcatccacgtgcaatcgattgccaactttcagctggccacaatggttgcctttttgtgtctttcccacttcaatccctcccccccggcttcaggattacgacatggacatgtggtaagtaagcatcaatcacttcaaaatgccattgatccttctgaggttgcgcatgagttggcgcgacccgcggttagcgcaaaatctgagcacgcccgttctaatcaatgacgagcttttccttcggtttgtccccacttttggtggcccttttttgcatttcgtcacatttccaagtcgaatttggcgtccggatgccttttttgtgaatgcccgtgacgcgcttttccatcgcgtgacgcgtttaaacttttacgcgtttgtttttccgactggcggcgaagtgttcatggaggcgcggctgtacttgaagccgaagagccaattggttctctgcaaatacccacacgacagtcagacactgcgactgcgcatcagttcaagtgggagggcgaagcaggggaaggcctactgattagagcaatggctgatcagcaggccattcgattgatagccaatcattgggcattttcatggtcggaaaatcatatttagtccttaattacctcaagttgcttccacctacggttcggtgcgctttcgttggttttccgccccttccaatgccatccgggtccatggacagctccaactgcccgacctgtacatcgacgggttgcaaagcggagagtgccgcagtgcgagaaaaaccggtgaaaagggagcggagaagcaaatggacaagcgaaactcattttgttgctgattaaggcaacttttcttgcttggaagcgcgttttttgatgaaaaggagcatcggataccatctttggcagacttatgtgccgacagcacgtgaatgagggggggggggggggggaaaaaa

SEQ ID NO: 7732 - DNA, 2076 bp, Heterodera glycines
  misc_feature (2039)..(2039): n is a, c, g, or t
  misc_feature (2070)..(2070): n is a, c, g, or t
ggggggggggggggaccgtaagggaagaaacaaaaggtatcaaatttgtttttgttcagagattgtcaaagacaaggacgggatcagtagaatcactgatagctactgcttttctttctccgttaattgcctctccccactctctttctgtctaattaccgttaattgcctctccccactctctttctgtctaattaccgttaattgcctcctcataccacggttaatccccgcttcctccctccctcctccataggcgttttgttctcttggatcagcgtttggctgcccgaagagttcgtcgaggggcgcgtgttcgtcgctctgaccgtctttttgacattgagcgctgagagcagctcggccaaagagacacttcccaaagtgtcctatgtgaaggccatcgacgtttggtttggcttcaccgccgtttttgtctttgtaagcgatgcgaaaaaagtgagcgaaatcatttcgagagagcaaaccaaacaaatcttctaaggacgggccgaaattcttaacaaaggtccctgcgcaattcggcacattttacagtcattttggccaccatttgaggaaaaaattaatcgttttacgattttactgcaaaatttcgtcgccgctaaaagccaattaatttgtaagcaaacgactctcatttcttcagttcacaatgctccaagcactgctcgtcatcggtttggaacacatgagcggtcgcgcggtgacaaaacaatgaaattcaaacgaaaaaaggttttaaaacagcgaaagactgtggtggaacaagcgggcgaactaagcgcgccgaaagcgatcattttgatgatggactgtcgccgttaccatcggatggcaaggagtttggacgactttttcaaggtgtatcagcaacaaacgatgtgcaacaatgaatgaaaaatgttgaataaggtgatgtacccggtgatattcgtcgtctttctcatcatttacattttcgtggtgatcgaaggagaagaacagaagtgtcttcagcaggaggaaaaggccaatggaaggcaatgagtgatggaaaaacatcggacggacaaaagaaatagtcgagagttaattagggacattctcgggaattggacaattgagaatggttcttttcctttacagtatccctttgtcttattgtatgtgctcttgtcaagtcattctcaacctttgcttatcgaattcccttttcaaaattgtaccgtttttttttctcaagcaaaagactttttttcaattatcatttgaatttgttatgcctttttattttgcccgtccttcgaatcgatttccgagggtcgaattgttcgattgtttgtcctaaagattttcggtcggtcttcgacaaatgtctaacaacaaatgaagcgatgaatatccagcggaaaaacggcaccatacctttgatttttacctaacaatttgagcgaatttactcaactgaaaaagggaaaaaatgaaaacaatgggagatcaccaacaacagagtaaagtgcggaaatggacaaatgaatgaattgaagaaaaaaaacgaatttaagaaaatatttccgttttcgctaccaaacacaaaaatttaatataggtatttgtataggctacccgacttttggggatccgacacttagggaacccgacttttggggatccgacacttagggaacccgacttttggggatttgcaacttggggacccgacttttggggatccgacacttagggaacccgacatttggggatccgacacttagggaacccgacttttggggatccgacacttagggaacccgacttttggggatttgcaacttggggacccgacttttggggatccgacacttagggaacccgacatttggggatcccgacatttggggacccgacttttggggacccgacgtttagggacccgacaattggggatcccgacatttggggacccgacttttggggatttgaaacttggggacccgacttttggggatccgacacttagggaacccgacatttgnggatcccgacatttggggacccgacttttgnggaccc

SEQ ID NO: 7733 - DNA, 1171 bp, Heterodera glycines
ccccctccccctccctctcttccgtcgtcccattcaattcgaatccttcggttggttatttttcacgtttctcgacaaatcgctgagctggagaatcaattgatggccaattttcaggggacatatttttgctaaatggccataaattgataattcagtgaatgaatgatggctgagtgaatgttcttcgcctgtttcctgaattggctatcgattttgtcctttttctgccatttgcttcttttgcggccacaaatcgcttttggtccgatcactctgtcccatcgattcgttttctcccccgagggaatatgcgtgggttttgagcttcgccccccgggcatttcatgcgatggaatccccgacaaatgttcgctccctcccattcggcctttgtccttctctttcccatttcctttgccatcccttcgattgttttggctttcccttttttgccaaattcgttcaaaaaatgcctttggtctttcccccccggcgtcgtttaataacattcattctttaaaatacgcataaaaatatatcattagtaggtcattccgaagaaggttaatccaccgtcggcagctgaagtgaaaaatggcggacgaagcgtcggaatacactgacgaagaatacacatacgaatacgaggcaaaatgggggggggaaatagggggacatggaaaagggactgttaattgatgttaattgagacaaatggaaagacaaatagagagtgacagacatgagtcaacacagatagagaaacaccgacacagccaaatgaccactcacacattaattaattattaattaaggatgaggaagaaccggaagccaacgagaacgctgctcccgcgccagttgaagagctcgtaagtcgagaaagaatgccaaaatgggcaattttaaattttggaaattgcagccaaaggacgaaccgaaaaaagcgggcgaagacgcagcagcgaagaaaaaggaaacatcaccaccaaagtcgctgaagaaggaggggtcgccgccaaagtcgcctaagaaagaggcgagtccgaagaaagaggcgagtccggacaaatcgccggtgggcaagcgaaaggcgagcgaattgggaaaacgaggcgagaagggaaataagtggcaaaattcagggacgaacgccacgccaatcgat

SEQ ID NO: 7734 - DNA, 971 bp, Heterodera glycines
cagtcgaccgaactgagacaaagagtccggagccggggtaccaaccgatgaccaagtcggtacagaagaaaatggcactttacgcaggtggaaagccgagcaaacacgacaaagcgtaagttggatgaggaggaagggatgtcgaaatgctccgaatcgatgcttaagcaagctaatgaagtccgagggcatcatccccatccaggccggcaccaacaaatacgcctcccaacgcggaatgaccggcttcggacggccacgtgacgtggtggacaaagtgaaaagtgagaatttggcagaaatcacagacgaagagaagttggcatcgctgaagggcaggtcggttgacagtttggccaaatgcgcttttttaaaaacattctccgtccttttcagtacttggcttcagtccggcaccaacaagttcgcctcccaaaagggaatgaccggtacggcaccacgccaattcacacatttaaacaacagttgatcgaataaaagataatggcactttaaggaattggaacaccgcgggacgttaattaccgcacgaaagggacgggaggggcgggcgaagtgccggaggacaaagcacgcttaacggacggtgacatggggaagggaggaaatggaaaggaacggaagccatttaaagggattgtgccgcttcagtcgggcaccaacaaattggcgtcgcaggccggcatgacggggatgggaatgccacggatcatcgacggttagagagatcggcgagggggaggggagggggggatttcaaattggcaccatgagaaaagtgccagtaatggttgcttaaaaaagtgtttacagtgcgaaagacggtggaccaggacagggaaagtcagggcttcattcacctccaaatgggcaccaatcgattcgccagtcagcagggaatgaccagaaagaggaaagcattgggaggaccaattgcgggagacacaacg

SEQ ID NO: 7735 - DNA, 1785 bp, Heterodera glycines
ttttgaaatgctcagaaggtgtggaagcgaatttatgaatcaccgcaaaaacgcaagaagccacgtttccgtaaagatgaatttgtacgcatgagcagagagaagggacagttcgagaaggggtatttgccaaactatggagacgaaatcttggaaattgacgaggtgctgaaggcggtgcgccccgtcagatacaagctccgggatgatcgtggtgaaaaattccggggcaccttttatgagcaggagttggcccgcgtgagaaaagatgccggcaccagttacagaattgaaaaagtgtacaggaagagacgaaaacaggatggatcaacagagatgctcgtaaagttcattgggtatcccgaacgagaatggattgacgagtctcagattgtataaaagcgctcatttatttttattttgttcataagttttaataaattcataatgtcaaatagtttcttcgtgtttttgccgagtaatgtgacggattatccggacaatcaaccaaacaagttccgggtcaggcttccaaaacctttgcatttcaacgggtcttgggtgtgtgggctgcacagtattagctacccatactcatggtcaacaattggtacattggatgagcagtggatagacatccacttcacggatattggggttcctgaagaagacaaacaccgcatcgtacgcgtgccggtaccgagatcgtcacacaatcgggttgaacagctgagagactttttgacgacaacgctgagaaaccatgccaatgctaaactaaagccgcttcctcgagaggaagaggcggaccgtaataggacaaaaccactatattctccaccgcctgctaaaagaagtataaaagatgtgaatgatttgtctttgtttccttcacccccgagagttgatgagccggaaaagccgcctaagtctcctccagcacatgtaccacctactgaaccggtaactcctcctccggcatcacccccgagagttgatgagccggaaaagccgcctaagtctcctccagcacatgtaccacctactgaaccggtaactcctcctccggcatcacccccgagagttgatgagcctgaagagttgcctctgccccttccagcacatgtaccacccactaaaccgataactgctcctccggatcataaactagaatcaccacctccaactgtaaaaccttcatcttccccacctgatacaacgctcccttcttcaactccagttgcaactcaacctccggcacccataccacagccaactcctcccaaaccttctgctcctccccctgcttcaacacctcccaaaccttcagctcctcctcctactccgacggctcccaaaccttcagctcctccccctgctgcaacacctcctaaaccagcatctcctcctccccctgttccgacacctcctaaaccagcatctcctcctccccctgtttcaacacctaaaacagcatctcctcaaaaacctcctaaaacgaagctagctcctcctccacctccagcacaaacacagccatctcctgtcaagaccacacccgcatctaaaatattgacggctaaaactattcctagaccccctcctcctaagcaaaaaacgtcgcctccagaaattcctacacgaccatcaatttctccaacactcgagtctccgcctcggattgatgagtcgaatagaacaatagtaaagccgtcagtaaaagaaacaactccaccacgctttgccaagacatttgatactaccgcaaaagaaggaagccgaccg

SEQ ID NO: 7736 - DNA, 3680 bp, Heterodera glycines
cttctcctcctcctccggctaaacggcttctcctcctcctccggctaaaacggcttctcctcctgccactactactaccactactaccaagccaaaaacaccgcctccgctggtcaaacatagtcctcctccaacagctgcaaaacagccttctcccgtaaagactacgcccgcgtctaagctaaagcccgcgaaaacggttccaaaaccaccgccacctcctcctaaacaaaaaacaccaccaaaaccttcaccgatacttgagtcaccgcctcggtatgaagaatcgaacagaacaattgtaaaaccactcgtcatacaaccatctccacctcgtcttgaagaagcgaacaaaacaattaccaaacaaatgacatttgatactaccgcaaaagaagtgatgccgacagagcctgttgcagctgctttaacacaactagcagatttaccagaaaacaccttcagctttcgaatcaatccgctcccagttgtgccccgctcagtatctattcaataccttgatgatgttgaacgttttaaagtctcattcaatgatcggttgatacgccatttgtcgttctcaccgcagttgggctatgtgctcgggtttgaaaacccgcagcatgtgatgtcgaatgaagtggcaaaatatccggtggatttgcgaggcggaatctcgagttttgccgtttactcaaaaggactaactgagaatatgattgttggaaattcgctgagttcactgctccgtgttgtgtcagtcagcggtgcaacacccggtgactacaatgagaaaatttacgattcgcccatttttgcgcgagtgctgcccagggagatcaacgaaattgagattgagctgcgcacaatggacaaaggcaggctggtcccattcgcctacggcacgacgctggtcgtgttattatttaagaaagtgataaatttctgaaaccactcattttttgtattcattcattcattgaacgtaaaaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgctttttcctcccaattctccgccgcgttggcaccacagtagggtcggaggcgctgagcacgggtcaacgagtgttggagcgagtcgggaacgacggaatgccacttaaggaggcactggtaagcgaaggaaagaaaggaattgataccgtactggagaagggaggtctaccaaagcagtttggtagtggtggaagaacgggtataaaaagaaggagaaaacacacaccaagtcaccatacaataattggccgaacaatcagtaaaccagcaagaaaacgtgttcgatccgacgcatttggactttactaaatggctttccacaaaattgacaatgacagtgtgaactccatcaccaatgccttggactttttccgcatcccaccaactaacgtcagcgtctcatcctccaaagtgtttgaactgctcccaagtaaccctctgacggacaccccctatcacttcaagcttcactccagtcaaaattatattgatctctccaaatgctatttgttatccgagtttcgaattcgcaaagaaaatgcaaatggtcaactggttgaccttgcagctgatgaggttgctccgattcaactgattggacacacattcatccgtaacatcaaaatgagcatcaatggccgtgaagtgttcaacgcaaattctctgatggcctacaaatcgtatttttcacacgaactctcctattcaacagcggccaaggactcgcatttgaatgctgccggttactaccgtgacactggtggtgtgcttgaggtgggagacggatgcactgcacgacgcaacctgtttgtaggcagcagaacagcacaattcatggccaaaattgacgccgatttgtttaaccagcctctctacttgatcaacttttgtgagttggacattgaaattttgcccaacgacaacgactttgtcctaatcacaccacccggtgttgctgcagccactcgctaccatttcgaagttgtcggtctgaaaatgtatgtgaagaaggtgtccctgatggacggattggcgttggacattgcacgaaaacttgagttgaaaccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcaccgtttcacgcagccccttcaactttcagccatttaatgtgcgtgaaatttccataattgccaatgggcgctcctaccctcaagcagcctacgacttggactacccaaacggaaagtatgtgcgccccttcaacgacatgaacgaagcggtgggattcgccaactcatcggaaagcaacgggattacactagcacaattcggcactacgcattgcatttacgtgttcaacttgacgagcagtggagacgaccaagcggcgctttttgatctgataaggaacgggaccacagcagtgagcatcaaatttaatcaggcggtgcccgctggaggaataatgttggtggtgatgggcgagtgcgactcgctggtgatgttggataagaatcgatcgatcagcactgacatcactatttaaggcacacttattttcattttttccataacgataaacatgtattccaaaaaagttggcgtcattttattccttcttcggatttctcttcccgtagtgtcatgccgagaggaaattcctgagtattctgaatatataagaagaaaggcaatgcttacatccacaaccacaacaacgattccgtctacaacaagcacatcaacaaccaccacctcctctcccccaaaaagtgacaagttaattgaagagcaagtgtcagctggtctcacgccactcatccaattgtgcaaagaccgaccagaagaggggaatttattccaacaagtcgtttgctgggcggtgtttgcattgtatttgatgcttattgtcagcctggttctccatcaactttgctctattttttggctgaagaatggacagcgtgcaaatcacatcaatcttgaacgaaaaccgggggaccgcgcgagtctttcggggctgcttcgccagtgatcaattaccgcctccggtcactctacagtatcccgcagcgctaattgttaaccgggacccacattacaagggagggtctcattggtgcgccatatatgcgaagggaatggaagaaccagtgatttattatgacagtctagcccaaaaaattccatctgtcattgtgtcatcattcctgaataagtttccgatgggcctaagaaaaaatattcgttcctatcaatcccaattagtgtcaacttgtgccccacactgtatagtttttgtgtatcatatgtcacaaggtcattcatttgaaaattttattgagaaattggaaaaatcgacaaattctgatctgtatgtaataataatgatgaataaaatggtcaaataaatgcttacaaaacgctaaagaaaaaat

SEQ ID NO: 7737 - DNA, 2147 bp, Heterodera glycines
aaaaaaaagttatggctctatcatttaaaagtgattttaaagcgatgatgagcagtgacaatttggaatgttcccttgtgagacgacccaaaatagtctcagtgtgaataaaaaattttaaatttatttatttcaaagtaaaaatatttaaatttaattattttaaagtaaaataaaaaatttcgggcagcgcgagatttcggcgcgagattttgtcacgtccccatttttagcaaataaaaagcccttaaaatgttttttttgattctggattgctactttttgaggcaatttttctcaaaaacataaattttgaattttagagatgcatttggcggagttatcaaatccattactattttttgaagaaaaaacattgaagaaaagttgaatagaaatatattaaagttatttgaaattattaatattattttttttaaatattgctttaaaatagttaaatttaaatattttaccttaaataattaaatttaaatatttttactttaaaataattaaatttaaatatttttattcacactgagactattttcggttcgactcaaatgataccaaaatttttttatttcattggttgttttccaagcaaagtactaaagcgtcgactgctgctaccaaaagtgccaacacaaataaacggcacgattctttaaacatgcccatggcattttgtgccacaaccaggcctaagttttagaacattttcctgatcactatagaatcgataatttggccaataaagtcgagagtgagagttggcccaaggttgaggtcgaacaacaataatggtaaagtcaatcccgttaatatcggcgttagaatctcgagcactgttctggccaatgatagtgcgtttcttaaaaacttccattcccccctcacttccgaaaatccatgaaaaattttaaacataaatgttttaagaaattttagagaaaattgacaaaaattggagttttaaatttttttttcagaaaaattcatttttaaaataggagtaaaaatttaggaaaaaagaattttcaaaaaggtgaatttctcaaatccaatttgttttttcaaaattcattaaaattccataaatttttttcaattgtttaaattactcaaaattttcttttcaaattattttaaaattccatcgattttttggagggatgtcagcttaaagaaaagcgccaccagcagtatgcctttgggcctaccggctcggcgtgtctcggcccacaacaaatgccttcttcccgctcgactgacgcacttcgcctcgccccgcgaacacccaagcatctaacagagacattatgccaaacattttgaatttaaattttacgcatttttttatttgcctggcgctctgtttgcctccaatgtaatgttgcggattgtcagcgttttatggttctccaccaaaatttcgccagtgcccgcactgtaatgttctccgatgattccacggttcgcttggtcggcatttcgaatgcagcagaatggcaccggtgccgttttgccaatgggaacggcggacaggaatttctaatggaaaattggagctaatttttcaaatttgtatttttttggcattctgtttattgctctgggaaaaattactactaacggatgctcggcggatttaagggattaaaatacctatttcctggctttttgtggccatgggtcctggaaattccggcaaaattccgaaacatccgggcccgaggcttaattttcaaattatttttaattttatttttggcattatgtttattgttttgagacaaatcaccagcaaaaaatgctcggcagatttggcttcgataattgatagaaaggattaaagtacatattcaactggctttttgtggccatgggtcctggaatttcggccaaatctcccgaactacccatgccaaatacgtacaataagtacacttggatgttcattaatttttcaagatttcattgaaaaagcctaaaatttcgctcccattttaaaaaaaataatttacttaaaagctataggtcccttttagcaattaataattgccgatttccattctttttcacattttaaacttaataataaattaaataaaaaatttgctcttttattttatctaaggaat

SEQ ID NO: 7738 - DNA, 2908 bp, Heterodera glycines
aaataaaaattgatcattaaaattgctaaaatattatcgagtaaatccaggtttttcatgcctaacctggacttggattttttcccatatttgacctggtgcatggattttctggacacaaatccagtaaaacctatgcgcctgattttaatttttttcgaatggcactctcacaaattaaaatggggaaatttttttttggcattttccacttttattcttttagctttgtctacgcccatttcattggtcgacgtaagaatcggctgcccgacatgccccattcgtccaccaccgcccggttttggaacgaattggcccagcaggaaggcggcagggcccagcatcaaagcggcaccatcggcggaggcaccgtcggtggcacaaaaactgttcgactcgggggcgaggcccggacattgctgggccggcataacgagtcgtccgactcgggagacgacactttttgatgagtgtgccgtgccgtggcagcgggggtgggggaccgaggggagggcccaaaaatgtgttttgcggaattttgggattcgaaatttggccccaaggatcactgaaatccggtctcccatccctgtgtgccgtgccattgaaagtgacgggatgtgccattgtatgtgattgtccactttactacttttccccccttcattttttggggctcgggagtctaggaaatgttcagtggtgttatccaagagactcttttggcttgaggacggaattaggtacattaactgactactttattggaaaatattttttaaatcgcctaaaaaatccatttttcgggagttggcaccaaaagacctatttcggcccttttgtacatatttccgtcgaaaaatttcttaaaaaatacaataaaagcaacaaattgtttcaccgacaacacatatttggcattgctcgacctccaaatttattgaatttttttaaaaattttaaacaaaaatttgaaaattttagcatttatttggggggagagggttagtgattttggcacttaattcacttttaggtttaactattttaagcacctaaaaatccaggtgctctaaaaatggaagagctcaaaaatatcgccattatttttttgtaatgccaaaatatttcgtaaaatttgtatgatatatatttaaatatatttattaaaataatttttttttatatttttcgcctaatttgtgccaaacaaacacaccatcgttttgccgttcactacgccaaactgtccaaaatcgttgatgcttttgccggccggtgccatcaccaccaatcgttgctgcggctcttcagccgtttcgctgatggcgcccaaatgctttttctttctgaataatgccgatgcccgaggggatagggaaataatttttttaaataaaaatgccaatatatggggggctttcatggccgctgatcacgaatccggcatcccatttagactgacaataagcgattctcataaatttggttttcaaccataaaataggaatttcgaaggaaaagaaaacttattgacttttgtttggtttcgggtgctgaattcgtgatcacttatcagcggctctcacagattggcattttaaattttcaatggaaaaaaaatgtggtgtgggcatgatttttgaactaactttagcttgataagaatgcataaaaatttgtaattttctggtgaaattcggcactcaagaaaatgccgaaatttgtcgacaaaaatctttaggcggctaagattttagatgaaatcttttaacaaaagatattatataattttattcagggggaggagtcaggaatttttgtttgcttcaatacagtaataattttgcaatttttagagtaggatatatttatgtaattaaaatttttaaaattaaacccaccccgacattggtgtcagtgcttcttcaccattatcatcagtgatcactttgtacagcgatttgactgcttcaatctttgcgtcaggcgaggcgaacgcgaacagagtttcatgctcttaaaatgagcaaaaaaattgtattcatgcaaaattttgttgaaaataagaagaaattttttaagggaaggtcctggcggtgccaaagatttttttttgctcaaaaaagtgccaattacaattattgtgttaaaatatgccaaatgttacacagcagggttggcacggaagtccgatttctgacattttttgggctagaaattccgatttttggcattttttgggatcgaaagtctgactgaattaagtcggcacgatttgccacattaaaaaaatcaaaaacgaagcgaagcaaaattttaggatgaaaaccaaaagtgccaaaaaattaaaggcaaatgaaaattgaaattttgtgaaaaatacatcccctaacccatctacactttgatttttgtccaatttgaaatcggtgatttgaatggcactggaattggccagccaaacattgccagaaattccaagagtgccgttgcgaagtgagcccaacggcacgccataatattcttcggcatttgttgtggcccacatagatgtaatggcttaaacgttgaaacattaaatgattgacgaccaaattttagttaatggataatttaccaatgattagcacagtgataagcaatggcaggtggaaagccatttcaaattgtttgtcaagtcagacaaagtccgaggcaacaaaaaaaaggtttaaaagaaagtgatcaaaaagaattttaaagagagagagaaggagagagtgagagtggaaagaggggagagagagaaaagaggggaaaatgagagagagacagagagagggggggggagggagagagttagagagagagagctagagagagagaggcggagagagagcatggggagagggcagagaggggg

SEQ ID NO: 7739 - DNA, 1306 bp, Heterodera glycines
aggcaattaagacattgtttaaaaaaagtgatcaaaaagaattttaaagagaggagaggagagagagagaaggagagagtggagaaaagaggggaaaatgagagagagacagagagaggggggggggagggagagagttagagagagagagctagagagagagagagagaggcggagagagagcatggggagagggtagagaggggggggggtccttgaaaaatgttacttattagaaaactaattaggcaattaagacattgtttaaaagaagtgatcaaaaagaattttaaagagagagagagagagagaaggagagagtgagagtggaaagaggggaaaatgagagagagacagagagagggggaagggagagagttagagagagagagagagagagagagaggcggagagagagcatggggagagggtagagagggggggggggtccttgaatacttattagaaaactaattaggcaattaagacattgtttaaaagaagtgatcaaaactaattaaggaatgaaaaatgcattaatcaactgagacaattttggtgcataaaaaacgctgatcaaaagagatgaccaatgtcagaaaaagcaccctgttgatcagtgggaaatggattggatttgcactgatcactttgtttgttcagtcagggttaagcgatcgctttctgctctgcttatcattcatttatccctttgcacattcattctctcgaataccttttgcacatcaatcatttgggcatttttctgggtcatttaaaaccgatcagaattgatggatatgagttgatcttttttttcgacactgatcagccatcattttcttctccgtttctgcacttttaatcagtatcaattcgaaagtgttacaaaaaaaaaataaaatagtaaaaacggaaaaaataattaaattagattcgaataaaaaatagttttttttttcaaaattttcttagtttgtaaaaataaaataaaatgaaatttgagactatgtattttcagtgccttccaaaagctaaatattttgtttttcaaaaaggagttctatcatcgaagtattacataacgcccttgaaacccgaaaaatgggcaaatttttgaatgtcaaataattcttttaccgttacaataggtattaaaattataaaaaatagttgccagcatcaaaaaaatgctcaaattttgcatttttggtgttgttgcacaaaaagccaacaatcggcgtagatgaaacggaagaaaaaggaaaacaataaaattttcaatttttttttccgtttttaacat

SEQ ID NO: 7740 - DNA, 3781 bp, Heterodera glycines
gcgtatgaagtgattagaaatgtgaatccgtttgctgaagcatatatgatgatgaaagaagaagaagatgaagaagttgatagagcaagaaatgagaacagagagccagccgagatcaagcttttgtttgagaccggaaggcaattggacagacgtttggggtacaatgtacctcgagcgaatgaagttgctgcagtttatgtacctggggctgacggtgaagtacttaatgccaagattgtggtgagagaacgtggaaaggaattgaagattttgaatagtacagattttatggtgactccaatgacttacccgctgttttatccgcgtggtacgcttggttggtaccctaaaatgaagcatagaaatagtaacagaagagtaacgagattgcaatatgtgtgctacacattagcaattagagaaagagagtttattccgattttgtacggtggaaggctctttcaacagtattgtgttgatgaatatgttaagattgacggagacagaatgaattggataaagagtaaacagaaaaatattttggctgatgcatataaaaatgttgataatatgttaatgagaagagcacaagaaagaggtttgccactgggaaggaaggtcattcttcctcaaagtatgacaaacagtcctagatacgttgagaagcatttccaagatgcgatggccgttgttagacggtttggtaaaccagatatgtttttgactatgacatgtaacccgcaatgggaagagatttcagagaatttgtttcatgaacaaaagtcaagtgatagaccagatttggttgtcagagtttttaatttaaaggttaaagctatatgaatgagatagtcaagaaaaaggtttttggcgacgtgattgcatggatgtatccggtagagaaccaaggacggggactaccgcacatccatttgcttttgacattggcggagcaagacaaattgattaatggtgaagatgttgaaaagaaaggaattagtgcgagaataccagacaaggaattagaacctgatatgtttgatttggtgaaaaggtttatgatccatggcccatgtggtaatttgaacccaaattgcccatgcatggaagagtttgttgacaagaatggtatgagcggaaggaaatgctctaagggatatcctaaagcatttcaagaagagacagttgttcttgaaaatggtttggctgggtatgcaagaccaaatgatggaagaatagttgaagtatttgcaaatggaagaagacatgtattagacaacagatgggttgttccgcataaccaatacctgttgaaaatgttcaagtgtcacattaatcttgaaaaggttaatagtgttagttcagtaaagtatttgcataagtatgtgcataaaccaccagacagagcaagacgggaactagaagagaaaaatgatcatgatgaagttaaagagttcattgatgcgcggtatgtttgcccgcaagaagcagtgtggagaatttttgaattgcctatgtatgatagaagccattgtattatgtccttgcctgtacacctacaaggtgaacatatttgttattttgacgagaatatggaagaagaagagattcgtgaaagaattgcgaatggttctgagttgatggcatattttgaattgaataagacaaatgttttggcaaaaactttgttttatcaccagatacctgaaaagttttgttttaagaaaggaaaatggacagagagaaagacatattttaacacaattggccgaatggtgaaggtgtcaccggctgagccggaacgataccaccttaggctgttgttgttaaatgtgaagggagcatgctcctatgatgatttgaaatcagtttttgatactaatggcaatgctaaagtttgtgaaactttttcagccgcatgtttagaaagaggtttgattagaaatgatgaagagtggaaaagagcattagaagaagcagagagttttgagatgccatggaaattgagagcgttttttgcattgattttagtccattgcaatccggccaaaccggaagcgctttggaatatgtttaaagactcattgtctgaagattttagcaggaattttagaaaagaagtagcttatgctaaagcttatagagaaattgcacttagcattatgaaggctggaaagacacttgccgattttccaaccatggaacagataaatgttgatgatgatgttgaacaagtgtttgacctagccgaagaattggatttgggacaaagaaattatgctttgatgtatgatgaacagaggaatgtttgtgatgccattttgcatagaatatggaatcctgtaaatgaacccgcgttctactttcttagtggaccgggtggaacaggaaagacacatgtgaacaagacaattgtacatatgctgagaggtcagaagaagaaagtttgtacaatggcttttactggcatcgcagcaactttgctgcctgctgggagaacattgcacaatagatttggattgactttggatatgagtaattcgagtattagtccgaggtcaaaggcatggcaagagttaaaagaaacagatttgtttgtttgtgatgaagcgcctatgataaataagcgcgcaatgagtactttggatgagaaattgaaagagataatgaataatggaatagcatttggtggcaaggttatgctttggacgggagactttcgtcaaacccttccaattcagaaacatgccacgagagctgagatggttagttcgaccataaagagaagtgcgtactggaggttggctaaaagatataaattgacgaagaatatgagagctcttgcaacggagcaagaatttgcgagagatttgttagagattggcagtggaaaatggaataatgaaaatgatgagataattttgcccgaggattgtattagcaatggtgatttagcagaagagatttttggtcaatgcattgtcttagaaaattggaatgaaatggcaaaaagtgccattttagcaccgaagaatattgatgttagtgaaatgaataataaagttttagaaatgttgcctggagaagaagttgtgtacacgagtatagacttagctcaagatgagaatagacaaagaccagatgattatttggatgagtatttgaatgctttaaacccttcggggtttccacggcataagttgagacttaagaaaaatgctattgttttgttaatgcgtaatttgaatatagaaatgggcctttgtaatggtgcgagaatgaaagttgagcaaatgcaaccgaatttgattgtgtgtgagattttgactggagataaggcaggtcagactgtgtacattcctcggatcacgctttgctgttctgaagattacccttttgaccttcacaggcaccaattcccgttggtgttagctttcgcaatgacaattaataaggcccaaggccaaacccttgagcaagttggcatagatttgagaaaagatgtgtttagccatggtcaattgtatgtggccctttcgagagcaagagcttggaataagttgagaattagattagatgatggcaatttagagagaaaggtgaagaatgttgtgtacagagagttattagataacagtgattaggtaatgtgttagactaggcttggatttagatttagtatagtattagaattggtttggtatagacaaaactgttggtcttttggttgctcaagacagtacgaacacaattcaaagtaagtcattattttgaattt

SEQ ID NO: 7741 - DNA, 2190 bp, Heterodera glycines
ggacggataatcccattagatacagacttaatacaataaataaggacaaaaaatgttaaaattggggtgcaaatgtttaatttaattttttatttttatggttccttcccgattctcaaggagagaaaaatcaggccgtcaaaatcagtgggaagatggtggaagaaaggtaaaaaatattggcacgtatcacccaccctcagcggagagtaaatttacaaaaaattgtaaatttactaataatttgattcatttttattttaaaatacaaataagaaataaatcaaaaaaaaaaattacttcaggtaaaatttttgttggcttcgattttttttttgattttaaaattctactgatgattttaattttttattttatatgttaaaatggattagttatttgctgattgcggaaacgcaataatttttatttacattttatgcgtgtatttcacatgttaaaatatatgcccgtgggggtcacattatatttgcgccccgagcatttgtgccaatgcccaaaatcgggttcaaactcaaatttttttcaatccaagatggtataaactgcttttaaaaaagcaataaaagtgattttgtatccaacaataagttcgtcagaaaattttgaaaaaataatagattatttaaatccgatctttgggcataggcgaaaatgtccgggtctcaaatgtctgagcacgcctgcgggtgcttaatgttaagaattataataattaaaaactttagaaatatgcaataaatggtggtgaaaaattgattaatagagaaagtagaaatattagaataaaagggctaaaaaatttggaaaaattaattattttcttttaataattttaaattttaattccaattattttatttctttttcgaaaaccttggaaccatatacatatttaagcaatttttcgataaaactttaggaaaatgcttttattcaatttaccgccaaaattgttgtttttctttgctatggcaatgcttttagcgaggaaaagcactcaaaaaatgccaaatgtgaccaaaacacatgcaaaaaatggtaattatttgattcagttaaaccagggctcccaaattaaaattttcaaggccggcgatgggaaaattttgtaatttttaatgagattcttaccaaattttgcgatttaaaccgatttaagaaataataataatttatacgcaaagcgtgacgccgccaaaataaaaacaacaataagataaagcaaaatggtcacatatgagagtggttcataaatgtgtaaaacgaaccaaatcaattgagtcaagaagtttagaaaaaacagttgaattttgtaacctaacttctttaggtaataacctatagaagcgagaagcacgaacaaaaaatgaatggtatctaatgaaaatatttgtcaatgacaaagaagcatgggaagatttgatcggatttgtatcaacagataaacaacaaatcattgacacaaaaatcatttttgaaaaaatcaaaaattctccaattctcagcaacgaaaatgaacaaaatcttgcgacaatgttcgtgcatttaaatgcgggaactgcgataattacgaaaataattaaatgtatgggtttggtatattttaaacacaatttaaatattttaaaaaaattttaattggggctcgacctagaccggatcgaggtctggatttttgttcaggaaatccaggtccaggcatttttcaaaatttatcgagctctaattttttaactattttcccattttaagcaaacagtttcaccaccgcaacaacgacactcatggcaacaaatagaagacgaaaacgtatggataataataataacaaccaaaataacaataatggatataacaatgtgtatgaaatgttgcgtcaagcacagctaatccatggccgaagacgggtggccgataatcagcctacacgtgttgattgtgttgttgtggtcattattttagttggttgtgcgttactccttgattccttgtcgcaatatgttgttttccaattctgaaccgcttttaccactgtaaccaggcccgtagccggaaaaaaaagaaattcggaggcggtaacccgaagattccttttttttttgtttgtagcggttttgcgccaaaaaaaggatttcaaaaagtatgctaaaaatgtaggggttgatg

SEQ ID NO: 7742 - DNA, 1005 bp, Heterodera glycines
ccaaaaaatggggtttaaaacttaaaaattacatattttttattgttgttcgttgtatcaaaaacaccttccaagtttgccaaattcgaaaaaaattctcattaaaaaaaaagaaatgtcgcaaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctacttatactgatcattttgtgatttagaggagcctatttttaaagaaaattaaagctttttgttagagaccgagatttccaaattctccggaccggaccggactggtattttaaaaaatgaccggatcccggatccggtctctcataatccggtcaatccggtaatccggtcaatccggattttcatattgccggatccggaaccggattccggattggtaaaaatttaaaatttcgcatcttaaattgggaaaaaacccgcaaaatgtcatcaattatatgtagaaattcggtgcaccagaaaatgtcgccgttgaaaagacaatttcgccaaaaaaatataatttttcaaattttcaagaaaaaattaaaaaaaaaaacaattttaaagtttttttatttttgaaaacctatgttttttgggtaatcctggagtaggtttaagctccgagccccccgacccgacccgagacgtttatggagtggagtccccgacccccgaatcatattgctaacaaaaatcat

SEQ ID NO: 7743 - DNA, 2497 bp, Heterodera glycines
  misc_feature (2452)..(2452): n is a, c, g, or t
  misc_feature (2462)..(2462): n is a, c, g, or t
gattcaaaagtaacaatgtattcttgcgaaaatttaattattaaaaatgaattgattacacagtaatcaatttacgacggaacgacagataattgcgcactcatccaaatgtttcagtctcacaaaaaatgagtgtttcctcgccttcttcgtcggaatcgttctgaacccatttgatccggtcgagtcccaactgctcattttcgccaatctcttcaaaaaactcttcttcgattccgtattggccctcattcatcacaaacgacggttcctgcaccgtttccgattgagtctgaagatgggagctcatgcaaattaattaaaattaaacgctttatgattagtcctcgcccacttaatttaaaacgatgccaacctcttcctcttgcgtctgtccacccatttgcgcttgtaattccctcttttgcatgcgctccttcaaaaactgcaaaggacccatttcttccgattgattgaatccatttgtacgacgcgaggggtaactaaaaaagatatagaatcttatgaaaaaggagttttctctaattgtctgacgtttaaagcctccaaaattgcttacatgcgcttcatactcaaaaaagtctgccgctccctttgaatgtgatcaattgtgaggagcaactccggcgttaaaatagcatggtaactgaatcaaaaacttttgtttgttttttatttattccgcgttgcacctgagaacgtttcccgtcgagtcaatttcgatgtactttttcatgtgttccgaatgtaagaaggcgttgaacgaattgaagccgaggtccaaggcccttctgtacgggtcgatgccaatgtcatcactgaatattggaaaatggttgttgataatttcactcttaattcatttatattataaccagggattcttttttatgtaagaaaatcgcgaaatatgtaaataaaatatgtatggaatatgtgtacaaaatccccaaatatgtactaaaatatgtaaatggttatttttggaaaaaaaaatcgtcgtaaaaagtaaaataggcaaaaaaatgccataaaaggaccaaaataggcttagaatcacattttagtactttaagaattaatttttggtatctgttttatgagaaaaaaattgctttttttaaagatatatttttccaaaatttttttttttattataagaaatttctattaattcttaaagtatgcaaaaaatgaaaatgtgtacaaaaaaaatgcgaaaaagtccaaaatatgtagaaaaatcccaaaatatgtaagtactataaaagtcccgatttttgttcgcaaacacaaaaaagaaaattttcctacaattaggctatagagaatccaggaaaaaaaacatgtattttcataaaaaagaatccctgattataaccagacccatgtttatttggatgccaacccgacaaaagaagggataactcactaaatattattcgcaatgtccgacgtgtaaaggtatccctcgggcgtgacgagcatcgccttatagacaattttacagaagtcgtcgatcatcgactcggtgacgactgtcgcccgctgtcgtcggcctctcccagcgcacaaattcagtccctccaattctttgcgcaaatcgtcgctcatttaatctaacaaatgaataattaacacatttacaaagatcattcggatttaaaagacaataaacattgatattcaacaataaatttgtaaaagtgaaagaattaaattcaaattcgttgtaaatacaatggataaatgagaaaaggtaaaaaaaacaattcagaaaaagtgcaaatgaaagcacggaaagaattaaaaggggatttggataaaaaaggataaatgaatgacaaaaaatacgaaaaagagatagtaaaagtttttacaaaatgttagaagcgttaaaaacgatgggaaatgactcatttgagcacgtaatacgtccgtttcacagtgaagtcgacctccacgtggagaaaatcggggacactgaacacgaaaccctctcgagggtcggacaacatctgaaaattggaatgaccaaataaccgaccaattaaacacttaaaaagtttctatcaaaagtgaaacgcccaaatcttttgtgtttaattgtcacaaaaataaaataaaaattcagttccttttcttttgcacgagttgcaaaggaccctacgaaaagtgacatgattccggtgacaaattcaaacaaatttcatattccgttgatataacaaaagaatgagtgtgaaacgtacctcaatgtaagccaaattgctgaatccgatcacagtgcgtgtgggaataacgcggttggaaaaaagagtgggcagcgatcgacggacgatgtgaccctttttgtcattgtttttgctttcctcagaatcgttcgaataatggcgcttcacacggaaaacccttaagagaggcgagttcnaaggacttgngttcagattaaattttacgatgataaagtttgctc

SEQ ID NO: 7744 - DNA, 2267 bp, Heterodera glycines
cgcaaagcccagcggaagcccgccaaactgacgggctccgagcaaacgataaattcattttttgcagccaattggacgaatccggggatagcaaaacaaattgatgcatttagtgctggaaattgatcatttttagcaactatagtaaagaaagagttaagaaagcacaccaacctgactgtgtcaatgttgtggtcttctgaattggcttcggcaaaggcgtgggaggagacaacccaacaatgactttctgttttgaaaacaatggcggcttctgtcgacgaccaatcggagaattaaacggtgaattgcgaaagcaattggaagttgctgttgcgcaagactctatgagcgaattgatctgccgtttcagttcgtcagtttccaccgattgagtagccaacttttgttccagtaattcgttgctccgtaacaaatcattgctgaacttttaaacattaaaatataaaaagttgactaagttaccgtgcagattcactccgttgaagttgaatgaccaaattctcattcttctttttcaaaaggacttcgttacgacgcacctccaataccataaacgagtacttctgactaaaattaaaatatcatcttaaaaaattcatatgctttaactcacatttcctgtcttaacgtcttaattttgtcaatgagttccgagatgttttgattttgaggctcatttcccatgtcgataattgaaattttaaaaaatagaaattttgaaaaatttacagtttcatgtgaaaaatctgagaaagatctgttaaagaaggaattaaattgaaacagaacatgcaatttgagaaagaaaattaaaaactgtgttaaatcaataaaggaaaagccattaaaattagagcccggacgggcctttagcgggccgccagggggctcttattccgtttagccccacattttttgcatttttcaaaaaaaaacagttaatagattttcggggttgctgctcgtttttttgggattaaaacatgtaatctaggccaaattgacgaaatttttgatattttggtacatgtaattcaattcaggaatacttaatttatgtcatcgaaacagaagattgaattttctaattttcctaattcaatttgacaaaaaatgaataatctatatattaattttgtgctgtaactaatacatttaaaagtaaacaatttatcgaaacgaattccttttggaaaatagttcagtctttttttcttttctgtttgttgtttacgtcttttttgtgttatgagcgagcacatatttcttcattattggaaaaatcgaaaacaacaaaacagccagaaaggctgacatacctataagatgtactcacgaatatttcgctaacaaataaggacttttgggtcacttatgcagttaattttcgtaatgtatgtcacaaagtaaacaaaaaatttaaataaagttttgacgcgattgtttttatttggatggaagaaatggtgaaaaaacagagataatagagataagttgtattgtaagaaagagtgaagaagagagagagatgaagacagttaggaacaaagagcggagagtaaaggagagagaaatgattagagaaacaggaaaaaagagagagaaagtatgggagtgaatgagacagagacaaataagagaaagagagagataaaaataagagaagcgagagagagggggtagagagaaagaaaaaaggagagagatagaaagaggagagagagagagaagaggagagaaaggaagagagaaaaagagaaaaagagaagagggaggaagaaagagaggagagaagggagagagagagaagaggagggagagaagaggagaggagagagatagaaaagaggagagagagacaaagaaaaaaggagagacaagaggagagagatagaaagaggagagagagagagaaaagaggagagagaggaagaggagagagatagaaaagaggaggaagagagagagagagaaaaagaggagagggagaaagaaaaagagggagagagagagagaaagaaaagaggaggcagagaagaggagagagatagaaagaggcgggagagaaagaaacagaggatagcagggagagaaaagaggagggagcgaagaggagagagacagaaagaggagagagagagaaacgaggagagagagggagagagacagatagaaagatgagagtgagaatgaaagagaggaggagagagagagaaaagaggagagagtgaagaggagagaga

SEQ ID NO: 7745 - DNA, 1606 bp, Heterodera glycines
atttattttagttttcttttctgcagattaagattggtattaatttccaatttttgatcagatttaatccatatgatcgcgctccgatgcgcactttgaaaattgccgacgaccaatcgaaggcaatgggtgtgtaaataaatgcattttccattattattgggtctttttatgttttaatacatttcagaggacactgtgcttttttacacggcctaccaacgctttgcccaattggccaatcattcggacaaccaagtgacgctcactcttcggcctggcactgtgcttttcatcgacaatttccgagtgatgcatggacgaaaagcatttcaagtgttttatagggaaagggaaaaacaatattaataaatatttgttttgtattctttgtcagggtgaacgagtgatgtgcggttgttatttgaatagagacgtgtttttggcaaaggcaaggccaaaactgtcgccagaattctaccgaaatgtgtgaagaattgggcggtgtgtgtttaatttaacttatatttactggcattgtaatatttttgttcaatttacataatttgtattgctcatgatcgaaacggttaacaatagacgaaatgtaatgaatgaatgacaaattgtgcttttttggctggaggtaggggcattcgtcgcctttctttcacctttcctctctctctctctctctctgatcagtctctccgatcggccactctctcatcactgaatactgctcggggctcccttcccgcggctgtgccttttcagcagaactttccgtccgttgttcgactgaccaaacgctccgtccgccgcgtacatttgtcgaccgattggtgaatgcctccatttgcatttgataatccgcaaataagtcatgcggaagcgcgcgttgcacagcgcgtaacagagcggatttatggtggaattgacataggaaagaactgaaaggcgaacaaattggccaagggacgacgtacggtacgtacagtaactaagtgtgaagagatatgatgggactgagttggggtagaaagcctcgaggcaaacgatcactgaaagggcaccgggggataaatcagcggagagagacgcaaaatgattaattagctaatgattaattactgattagtaatgaccattgtaaggggtccaagtgataatgaaggcgaacagaatggccgaaagtgttttggccgcttttccttcttgcttccgctcatttcgccgcctctctttttcacttctgcgcatctgtgaaaagtgaaatgcctttggcaatgccattcattcattctcaaattgtatcttctaattcaccgatctgtgccaattattttttgactttcagtggtactttaaatgcaaacattttcattcttttaattagtttattagtacccttccccctctctttcacctgttcctccctcaactgaaggatgtcgctcttcttcatcagctgttttgacatcgtcgttccgttctgttgcgtttgctgttctactaaattggtcacttcttcttgtgtttctacttcctctctcttcccccccccctctctccctctctctctctcgccctccctctctctctc

SEQ ID NO: 7746 - DNA, 3714 bp, Heterodera glycines
  misc_feature (3504)..(3504): n is a, c, g, or t
  misc_feature (3673)..(3673): n is a, c, g, or t
cttcaggttttgttgttttgcacaaattgggggaggtccgtaaataaatttgtacaggataccgaattcaaatttgtttctgttcaggaatgccagcgtctgtccggtgaccagctgctggactactacaccgagcagtggaccaaattccagttctcctccactgtggtgaatggcattttttcctacttgaaccgacattggatcagacggaacatcgacgaggcggtgcgtcccggaattttggaagtgtacaatgtgagtggtttgacggtcatacatgaattggggatgggtttcatttttaaattctcgaatttcagttggctgtttccatctggaagtcggtgatctttgacgaactgcaccacaacatcacgtccgctgcgctggcgctggtggagaaggaccgcaacggggaacgcatcaccacgcgactgatcagcggcgtggtcgcctcatacagttaagcttttacaaatttggaccccgaggcggggctggggagtcagggaatgggtctttcgttcggcgaccagattctgccgccactctttcgttcgaacacccgctaatttgcattccttgtttccagtcgaacttggcatcaacgagcacgacccggcggcggacgtcggaggaccagcaacagctgcggtcgcccaacaacagcagcagaattcggtggtgcatcgtccgagtgtcaaataccaagtgtaccgcaactactttgagcagcgctttcttgaggtacgcttggatgggttttgtgcattttgaaatttttacattttattttttcactccacgcaaacaggacactcgcaacttctacacaacggagtcgaacaagtttctgcagtcgaacagtgccaatgtgccggactatatgaaaaaggtgggtggtgaacaggggggagtctcgtttacgagcgcaactttcgtcatgtttttctctttttttcaggttgaacaacggcttagcgaagagcgggaccggtgccaaatttacctggacaacacaacaatggactcgctgatggaggcatgtgacacggcgttgatcaagcatcacctcgagctcttccacgacaaatttgaggtagcagaaagagaattgtccattttattatattacacttttttcagtcattgctcactcgtcaacagaatgaccatcttggacggatggtgagatttgcagaatgtcaccacttttctcacaatttttgcataatcgtttttttcagtacacactttgttcgcgtgtgcccaacgggttggccaagctcaaggagatcctgaaggcgtacatcgaacaggagggcaaggcggccattcagcaaattgcgcgtgaagcgtccaacaatccgaagcagtacatcgactgtatcctcaaaaagtgagtagcgggtgggtttttggaaatactgaaccattttaaaggcacaaactctacaatcgcttggtggtggactccttcaaaactgaccatggctttgtgcaatcaatggactgcgccttccgcaagttcatcaacaacaacgcagttacggagatggctcggaatgcgtccaaatcgtcgcagctgttggtcctctactgtgatcagcttttgcgcaaaagtgcacgcaacaaggaggacgagaagatggatgagtacctggaccaagtggtgggtttgtttggttctttaaagtttgaaattttccatagtttctgttttcttaaaaatgctaatataatattcgcattgtcacagatgaccgttttcaaatacatcgacgacaaggacatgttccacgcgtttttccacaagtttttgtgcaagcgcctcgtctacgacacgtcggccagcgaggagcaggagcggtgcatgatcgcaaagctgaagcacatgtgcgggttcgagtacacctcaaagttggagcgtctgctgactgatgtcgcgctgagcagggaccattccgagcagtacaagcaggtggctaacgaaatttaaattttcattgagacagttttaccccatttttagcagccgagaacatccaacgttgacttctccgtcattgtcgtcatgtcgaacgtgtggccactggggcagccggtccaattcgacatcccgcgtcctctcctcgactgcattgactgtacgtttggggaagacgggtggtggagagaggtacaccctgggaaagtgtcattacttttcagcatacacccagtactacaccaaccgcttcaatgggcgtaagctgacttgggcgttgcaaatgtgccgcggtgaattggtctcgacgagcaacactttcaaggacaaatactcatttttggtaagcaattccgacattaaaaattgggtttcctcgtaaaaataaataaatgtttttcttttccagtgcaacacgcaacaaattgccatcctcatgcagtacaacgaacgcaacacgtacacacttgacgagctgcacgtcgctcttggcaccgactttcccgctgatcagctgtgcgccgttgttcaatccttggtcaagacgaatctgctgaagctcaccagcgccgatgggacagctttgaccgagacgaaactcgatgacaaggagcagaaattcacctttaactcggaattcaagaggtgaatttgaaaatgaacgggggtaattaaattttaaaaaatttaaaaatgaatgtaaaataccgttaattctaattatttttcaatttcccgtcttttcagccgcaagctcaaagtcgacttggtccgtgccatgtcatccgccagggagacaaagaaggagagtgaggacgtgcagaagacggtggacgaggacaggaagttggtcatccaggtgagacaaattgacaaatcaattttaatgacccctttcttctccctcattaaggctgccattgtccgtattatgaaaatgcgcaaatcgttgaagcatcagctgttggtggccgaggtgctcaaccaattgacaacgcgtttccagccaaaggtgggggagaatgattttgggtgcaaatgaatgcctttcctttccttttaaggtgccgatcatcaagaagtgcatcgactcgctgattgagaaagaatatttgaagcgctcggaggaggatagcgatttgtatgaatatttggcatgatgacaccattaaatgtgtattgtattggatgttttgtcggagggtataattgtattgtattggatgttttgtcggaggttataattgtattgtattggatgtttgtccgcgttataattgtattattgtattgctcatctcgtattattgctctgaataaatgctaaataccaaaattgggagatcagaattgcaagcggctgattgcatttaaaattatgggtgttgcgagcttaaaaattcattttttcaacaaagtgtaaatgtttcaactcttttttgtcgcctccggcaatttctcaatttaattgcgccatagaaattcaaaaaaaaaaaaaatcaacattacgttgntctgtgggtcctttgtttagatattttgaatgggacaaactgattgtctccgcgtggccatgaaaatgaataagcgaattttgaagaaaatgtgagaatttattcgtttaagaatttgtgaattcatttttaagaccacttcaatatattttgaacatttcagttgcanttgcaatgatggtttggatggaccttttccctctttttgac

SEQ ID NO: 7747 - DNA, 2528 bp, Heterodera glycines
aaatttttttattgagtgcaatttgttaacagatttacaccaaaaaatgaccattttgcgactttgagctacttttttttaataaaatagaggatttttagggtccggcagtgccgattggcgccgccggtgaaaattttgaaatttaagtgacagatttattccaaaaatgaaaagattttgcgattttaatagttaaatttatattaaattttcgtcgaaaaaaggaataactttgaaaaattagaagaaaaacaaatacttggatgggaactgatccaaaggaacagaaacataatgaaaagagccaagagcaccactcgaccatgcgtgtgaacaaaaaaataaaaacaaaaaaataaataaatatatattaatttaagtttatcaaaagcccatcactaggggtcattttcacattgaaaactcaatctttaggggtgtatttttcccgaaacttcgggtaaaatagccgaagccgaagcacgaagttcgaagctcaaaaagcccgaagttttcgaagccgaagccgaagtttcgcccagccctggtcaagatggggttttttcatagctttttgtttaagaaataaaaattggtccgttcatagaatacaaaattgaatttaagcgtttgtctctcgaaagaattctctacggaaacgtgtccattcagtgagggtattttttgccgaggtgtgttttgcagcaaaagaaattcaattttaaataattaaaattaaggtttttctatcccaaggctacccagctaccgtatcggcagactgtagaaaaacaaatttgaatttaatgaaaattataccacaaaattcagagaaaacaataattcttttaaaatattcaatgttgctttcttaaataaaattgaaaggaattaaaaacataattaattaattatattttattcaaatatttttatttaaattattatttttcattctatttaataaaaagaatttctataataaatatttatataattaaatataatttaatttttttgcatcatctaattatttataaaatattttttattaaaaatatttggcaaataaacaattcattttaccaaaaatggaatgattaattgtactcactcaagactctcgagtttcgcctaatgtaaattaattagtcaatttcaaaaaccttctcagattgcaaacgatggcgactttttgccgacctgctcaacgatgcaagcttttttatagtaagtttctttgaattaaatttttaaaattgaagccaatttttttgacacgattaaaattatttccatttaattacgttttgtttatctgatattttcctatcatttgcaccttttgatcattttatcacaacttactgagtgagtgagcactttgtttatttttcttaaaccatcgaaacttttttggatcagatttcctttccgctcaatctaacatacctacctaattggtctgataacattttttatcaatcgtttcatctttcccagtgaaatctatcattgcttcataatctatggcttggtccctctccaatatctgatcatctagcactttccggtctgatcactcccattcccatcccattttttggtctgatcactttcgtcccattttatgatctgatcaatccccacttcccgtccgcctgtttcgcgccgtttgcctgtgtcgcctcattgctccgctccattgtcggcgtcgcgggcggtgccacgcggatggccatcatacggcatcaggtgagcgatcatcaaaagctaatcgggaggaatgaggaatttcgatctcgttactcgaggaaaagcccctcagaaattaaatctgccggataatcatttatccctaattagggtcacactcaaccccagctaaaactctcactttaaattccaatttctcgaaaaaagtttccaactttgagagtaaagacgaaaaattaaattaacaaattttcttagaaaaattcattaaaaattccaaaattttcccgacgatgtctgttggcaccaccggtccccctcctacccccttgttcccaaaaaattagtttgaaaaatctcgagcaaaaaacgcgggtttaagaacaaaaagcgtccttatacatgaccatacaacaccatgctttttcaaggcacgtcgcgacaatttggcggacgtggcggcaaaggacggctcccaggagacattagtcaatgtgaaaattgaaattttttcgaattttcgaaattcccaaatgcccccaggtgctttctctgctgtgttcgttggttctgttgcctcaggcggaggggcgtccgttcaccatttgggcactgttccttctgttcaccgctgtccatctgtttggtcagtcgtgtcgaaaatggaaattattaattttgtttaaattatcaaaaatttcgccagcgagcaatttcttaatttttcaaaaaattaacgcaaaaattcacaaaattggataattggtcatgttttggcgaataactgctaatattctttccacacccat

SEQ ID NO: 7748 - DNA, 1844 bp, Heterodera glycines
atattcgggtggagtttcgaaagatgggatgtcgataatgcctaaaaaacctgacattttccagctatattgagtgaaagacttaaaaatgggtgcagaaaattggaaatggatttcatttaatacacgaccaatatttttacgatttgaaatgttaaaattggggaaacagcggcggattttttcatgcatagtttttggttacgcgccgccccacaattttgtgctttcttttgaattccaaaatccaagtggcacaggccttaaattgggtggtcaacaaatattatgtcaatttcttaaccttaaaatcttggagtccaatttcccgggcttttaataagcccaaagtggctaggtctatgtcatgcatggcctcattacgactccttgcctcataaaatcgctcaaaaacgtgccgatcaatcacagatattttttcaggtttactccccccactggcaacatatttacgaattcttaaacaaagaatttagtaaatccaaaaattttaaaaacctcgcaatctcgttattgcttttaatttttctatagagatgtttaatttgattataagaagtcccttcgtccaaaagctgtacgatttttctttgcgtttcaatggggtatttttgttgtcggggatcacggttcggggattcaacaaacaactcctcgttgtcagaattggatgtagaatcgctgctgttttcggaatcaaaatccaagtattcaacggggggatcagtggggttttcggcgagaatggactcaagattttgcacaaagtgtgcaacttcagcattatttttatggcggttaagggtctgatttaaatcggatagaagggcgtccattgtgaaaataggacaaaatggccaaggaatggaacgggtgaggagagaagatatttcccaggtgcaacattaaaccaatagcttactttgcatttaacagcaattttttgcaggtgtgaaatcgtcaatttaaatttataataataaaaagagtattttgaaacggttataaataattgtaattactataattatttcgtgctttaaacttgtttttgaccactttttggtactttaaaatgattaataaaaacaataagaattgttgaacccacgcggagtcgaaccaccagtcaccatggcgccattctgcaccacttgaccaccagcactgaagggaaaacacaggggaaaattagggtttttgaggcctcataacttttttatttttcgctataggcacgtaaaattaaaaattcacaatagaagtcgaccctgctctatcgaatggtaccaaatttatacccattttccgagttacagttcgcgaggttccccttgttagacaaatttgttaacagagtttgaaccaaaaagggttaaaaaaaccgaattttgggtaataatggtttaaattttgaaaattggaattattctataaaaaaattataaaactttatttttatttaaaattttttaaagtttatgttctcaatgaaaaaattatatttatcaaactctgaattttttcctttctctcaacttttgatctcgaatttttatttttgctctcgcatcccgcttcaagatgtgatcaaaataattttatacgaattgtacacaatgtttgtttaaattaacgatgataattcttcgaccataaattctgaattgtatttttattttattttttttgcgcgccaaaactgaatagaatgctaattaagaaattaattaaatggcctttttaaaattttattgcctcttcgctagtttgggtttttttcaaaaaatgtttactaatcatcttttgggattgtctttctt

SEQ ID NO: 7749 - DNA, 2484 bp, Heterodera glycines
tttgagtttaggccagtcattctgaacatgccgccatccttttgtgggacacacgcaattggaaactgatgaacaccttgaaagcccatcaggtttgacacggtcaggcgccacccccccccccccttgaaatgaaaatttacaaatttttcaaaaaaaaattcaaaattttatgaaattttgcatattatcattttgtttttcgtcctggcgctcaaattttgcactaacaaaataggaaaaaattttggccaaaagagcaatacgcttcaaaagtttttttttcaattttttttgtattttttttactttaattttattttttacagttgactgtcacccgtttgtccttttcacacggtcattcattttctttgctcacttttatgtcactctttttgaaaatgtcttattttttcagatgaccaatttttgctcagtgtttcaaggtaatttgcttttattcggcttttgttattattacgattattggatttacaattttatccattttagggacagaaattgggcacttttccgtcgtccaaatgatgctccgtctccatttgcgtacacaatttttcaattgtcgggaaagggccaaggacacagccgaatcagtcagtttcaggaaaattacaaaaaattttcataacacattcaagaaagctattttttgaaaaacctttagaaaaattcatcaaaaatttgaaaatcactgaaaaattttattgaaatttcttaagaaaagaatttttttttgaaattaaaaatattcggcgggtgggggggggggtaaacccgtgcacctaattttgatagggcaaatcaaatacaacttttttttgctctttggtccctaaaattctttcggcaaaggcgttttgggaagattttgtggtccagtggtactgattaggggtggcatggaattccgaaattttttttggtccgaattccgttttccaaaaatttttggggcctcggaatgccatccatttctctggctggtgccaatgagcgcggccgcgaaatttttttttttttgcttactttttttgtttttagtttgggattgtgcctgggcctcggacgcccatttgtttgccacttgctcacgggacaaaacgctgaaagtgtggcgcatttgtgccgcggtggaacaccaacaacaacaacacgacgaagaattggaagaagtcaaacaaattgccaattttgtcgggcctgctccccaaacggcagttgacattgctccaaggaaaatccgagataggttagggggggggggagcattcaagaaatttcgacatttttttactttacccctccccctcgaaaaaaccataggggtatataattaaaccgagaagacataaatgattataggctctatgagaatcactgatcgatataagcactttgccattcttttgcgactgactgatcagaggtccaactccaccgcatgtttgattttgcgcagaaaagtgaccgcctctctgtcgtcgatcaggcgatggtcgtaagtgagtgcggtgtacatcatcagacgaatttcgacctaaaccaatgggttgtattggtggtacaaaacaaactgagttgtccgatctcgacaccctttctcgacgtgcctttgcatccaccgccacagtcagatcaaaaatgccgagaatggccgactgcggtgggctgatgttcggagtgccgagctagcgctacaatttgttttacaaggaatctgaattggggggggggggtctaaatctgaatccaaactcttaatggttgtgcattcgtacacctttctcgtacacgctccacttttcttcattttttgacggcaatgattcggctaaaaacaaaaacaatgttcatacaaaccccaaaaaatgaatgcccaatgttttaacttacgattggaattgtcagccgttaataacacacacataataagtgtacgttgtagatgttgcatttgtaatatgcatacttccaattccccccacaccgccgcaccgggcccccggctcgggcatctttttaatgcgttttcttagcgctacaatttgttttacaaggaatctgaattttgggggggtctaaatctgaattttagtgtttttgtcatggattttaaaaaaacaagggaacgctgccaaaaaaccaatgccccgacaaaacaaacctcaaacaccgagaccaaactcttaatggttgtgcattccaatcctttgcacataccaaacttgttggccttggagttttttgatccgactaaaaacaattaatgcaaatcccaaaagtgaatgcaaccaaacttacgttcggtactcgtaggcacagaaaaagactatttctttctctgcttgcagcgctggtgaatgcgtgcgtcagacaataaaaccaatgagaaaacagaacaaaccaaaaaatagagagagaaaacgtttgcatggttttaatgcgttttcttaaaaa

SEQ ID NO: 7750 - DNA, 1451 bp, Heterodera glycines
ccaaactcctaatggttgtgcattcgtacacctttctcgtacacgctccacttttcttcatttttgacggcaatgattcggctaaaaacaaaaacaatgttcatacaaaccaacttacgattggaattgtcagccgttaataacacacacataataagtgtacgttgtagatgttgcatttgtaatatgcatacttccaattccccccacaccgccgcaccgggcccccggctcgggcagcgttttcttagcgctacaatttgttttacaaggaatctgaattttggggggtctaaatctgaattttagtgtttttgtcatggattttaaaaaaacaagggaacgctgccaaaaaaccaatgccccgacaaaacaaacctcaaacgccgagaccaaactcttaatggttgtgcattccaatcctttgcacataccaaacttgttggccttggagttttttgatccgactaaaaacaattaatgcaaatcccaaaagtgaatgcaaccaaacttacgttcggtactcgtaggcacagaaaaagactatttctttctctgcttgcagcgctggtgaatgcgtgcgtcaacaataaaaccaatgagaaaacagaacaaaccaaaaaatagagcgaaaaaacgtttgcatggttttaatgcgttttcttaaaaaccaatccccccaacaaaacaaacctcaatgttcgtgcattccaattttttgaacatgccactctcttcttcgccttggattttttggatcctcctaaaaacaattaatgaaaaccccaaaagtgaatgcaaccaaacttacgttcggtactcgcagttggtacatttgtagtacgcatacttataattccccccgcaccgccgcatcgggccccccgctcgggcttcctccagcgcttgagcgtgtttaaaaaaggtaagcacattgttatcccacggtagcataaatctgtaaatgtgatgaattttgagcgcaggggtttcccaatttttgttgtgcgcgtttttttgattaatattttagcgtgagtgggggatgcggtagggtggggggggggggggggttagcgcgacaattttagtgcgctgcattcagtttaagggacgaattcacattgtgattatgaggaccgtagaaatacacatttacctacatatgcaccaaaaatgccattttcatgcaatttgcagagagtgaaatttcaacgatttcaacgcaacgattcctcgtttgttttgcaaaaaaaaattgttacataaaaatgtgaataggtaggtatattcccgggagttttcggtgttgttgatcactagggatgccaaaaatatgcacatgcatatttttttcctggaatgcgggaagcctgaaacgcacgaaaaacatgtttttaaacctgtaaaggcaaatgatgaaatttaactgaaattgattttcttattcg

SEQ ID NO: 7751 - DNA, 4287 bp, Heterodera glycines
atcaccattgtacctcttctaatcaccattgtacctcttctaatcaccattgtacctcttctaatcaccattgtacctcttctaatcaccattgtacctcttctcatcaccattgtacctcttctaatcaccattgtacctcttctaatcaccattgtacctcttctaatcaccattgtacctcttctcatcaccattgtacctcttctaatcaccattgtacctcttcaaatcatcgttgtacctcttccacccgtggtaaacggttgtgaagagcccgcacaagcttaacaaaatttaaaaaacgggcgcgaagctcccgtttgagttaaaaaaaatttaaaaacgggcgcgaagcgcccgttcgaggccgcgaagcggccgaaaatgccaaacaaaatttaaaaacgggcgcgaagcgcccgtttgagctcaacaaaatttgaaaaaacgggcgcgaagcgcacgtctggtcacaaccaaatttaaaaaacgggcgcgaagcgcccgttcgaggccgcgaagcggcctaaaaatcactgaaattctttaaaaattcaaaatctcttcacaaccagatagctaatctaggtagcgaagctcaagaagcgcgaagcgctttccccagcgccaccctcgcatgcaacacccgctagttataagtttataagacctttcattttaatgtaaataagtgatacattattttataagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattcttatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggacgactgagtcccggggaccgatttctcactttttcttgcagtttagggcctgtaactttttttctaaaacccgaatcaaaaagtgcccgctgtgagggcactccccacaactgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgtcaggggttgattttagcgaaaaattgtcttagaacatttttgtagagcattttaaatgctatcgaatggtttactacatgatgtaaaattttcaaaaattttcgagctaggccccctagaaattttcaaaaatttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacaacaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattttattttaaatttttatcacatttttaaaaaaagatataaaaataaaagtgattttgtgattcgggtccaaaggggggagcacatggtttttgagtggaaaaatttttctcacaaaaatcttccaaaaatatgtctttaggggttatttgggccgctgatcacgaatacgtgatcagattttacttttgacatcgtcaagacctcagaatccctgtgtgattggggattctgaggcatcattttgaggggggggggggcaggttcgaatccggacggtgtaacattattttttttgtgcatttttacgttattttcaatgaatttaattaatttaaaatattttgttgagttaataaataaaaaattatatttaatttaattttttttttgataaataaattttataagtttaaattaattgtttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataacaattatcttttaataaagaatttcatatttttttaattgaatttataaaaattaatttcatattaatttaaatattcaattattgtacatttcaaaattctctttttaattaataaaaggaataattaatttattttttaaaatttataataaattgcattcaatttttgtacctcttctaatcactgttgtacctcttctaatcacagttgtacctcttctaatcacagttgtacctcttctaatcacagttgtacctcttctaatcacagttgtacctcttctaatcacagttgtacctcttctaatcactgttgtacctcttctgatcacagttgtatctcttctaatcaaagttgtacctcttccatttacttttgtacctcttttaatcaccgttgtacctcttctgaccaatgttgtacctcttaaaatcacttttgtatctgttctaaaatttaaaaaacggccgcgaagcggccgaaaagaacaacaaaaattagaaacgggcgtgaagcgcccgtctgagtcgatcaaaatttaataacggccgcgaagcggccgtcaaagcccaacaaagtttaaaaacgggcgcgaagcgcccgtccaaggccaacaaaaattgaaaaacgggcgcgaagcgcctaacaagctaaaaaacgggcgctaagcgcccgtccaaggccaacaaaaattgaaaaacgggcgcgaagcgcctaacaagctaaaaaacgggcgctaagcgcccgtataagttcaacagatttagaaaacgggcgcgaatttgtacctctccaacaattattgtaccttttcgacagtggctacacctcttctaatcgctgctagacctcttctaatcactgatgtaccacttctaatcactgatgaacctcttcgaatcgctcttcaatcgctggtgtacctcttctaatcgctgttgtacctcttcctataccttttctaacaaatcacgcaaaattaaaaaacgggcgcaaagagcccgaaca

SEQ ID NO: 7752 - DNA, 2020 bp, Heterodera glycines
ggcgtcagcgtcggtgggcgtttttccaagctcgaacgccttggtacggctgtacttgacaccacacgaattccatgggtttctataaggggccaaaaatttttttagcaatttaacgattttttttcaaaaataaactgttctaaaactcctctagattcttgagcaaaattctaagatttctgcctaaaatttggctgttatttttggtattctttttccttctacagaggaaattttcgttttttacgcctcgaagcgtcatttttaagctttgtcttgaaattcgtacaataattttagcttcaatcgattaaagagccacgccgattagtctcaaactctaaagtatcgctttaagcatatcgggagtctggatttgatttcccgaaacattccattctcggcacttactcgcaacgtgccggatcaggtcggccttccacttgctggtacggttacagtacttgcacttgaagggctgcaaaaatgaaaaatgccgaaattttttgcgtgccggtgccaccaccaaccaaccctttccgcggtgtgcacccgcttgtgccggatcatctccgacacccatttgccctggtagccgcacactgagcacatgcgcgtgcacacgtccggatcagtttccatgcgctgaaatttcgggcaaaatttaaaaattttccagaaaaaatcccaggcttttcctcctcgccttagtctcctgctcgtcgtccggcaattcgatggcctccgtttcgctttggtagcgccgcttcatcggcgtcggcatttgctccgcccgcttggccaccagtccgtccaatgtgttgtccatgttggccaccgggcggcgccggcggcgcgacgaattttggcccaccggcgggtgggccaacgcggcggccaaagtttggcggttggtgggcgcagcggcgcaattcgccgcgggggacggcccatcggcggaagagacggaagaagaagaagaggaagaggaggaagaagaagaagaagtggaggatgagaaaagcatctgaagagaaaaggagaagaataattgtgaaaatgattaaatatattaaaattaaattaaacttaattaaaattaaattaaattttaattaatttttgaattttaattggagaaaaggagtccaatagcgaaaattatatcagaaatatattaaattaaatttgaatacataccgtatatactctttttatatgccatggtatattatttttcaacctcttcagaaaggggtatataattggaggccggcagattaatggagactgggagattatttttcagctgatttatttagtggaaaatttttgaaatttttttgatcatgtcgccaaaaatgtcatcgcgtcaaaaaaaaaatgatttctattgcatttctgttaaacaacttctgagaattgaccccaaaatggcaaaaatgtgtcattttcttgcttccaatatggataaaaattgaaatttttaatggtgaaagatggacgaaacgatcacgaagaagccttttttattattgtgcacagattttgttcgtaaaatgagtcaaaaaattagagccataaaaaattggtctcgagtctcgggaaattttcggtctcgatagtgaaaatttactatttcgacatttttaggaaattcctaaacaaaaatgcaataaaatcaaaaaatacacccctaagaaacgacctaaacattttggtaatactttggtttgtcccccctatttttcaaaaaaaataaaaaaattttaaaatcgcttaaaacatctctcctggggtttttggggccactgatcacgaatccggcatccgtttcgaatttcgaaccccggacccaaattcgaacaaaaatcgaaaatttatttttcaccaaaattcacactgcagcgactcgtggtcacaaaagacgttccaaatgaaagaccgatggactggacaacggccaatagattttgaatggagaatcgcacgactgccaacgaacgaccatttcgtg

SEQ ID NO: 7753 - DNA, 2899 bp, Heterodera glycines
tatataattggaggccggcagattaatggagactggcatataaaaagagtatatacggtattctttgcttgttttttttgttatgtttttactgaaaattgtatttttgactacttttggctcataattttgccattttttgtcaccttttcggatttttgtcaaactattttcgcgtattttcttcactgtttcgttaactatgctgagatttttggcttcaagaagctaattatatccaaaaatgatcatttttttcgttaccctaatgcggaatattggcttgacagccatgcacatgttataacctttttggtaattgcctaatcgcgaagcaataatttaaatacagcttctaaacaagataataaattgtgaatgtaattccgactacaaacctttcgaggaaatggtcatttataaatttagaaatagaaattctaattaaaaccttcatttagttccctggctattaggtcaatatttagtattaggttattcatttcaataaaattatagaaagtaatttcatcagtaaaaacataacaaaaaacaaacaaagaataatcgaggtttggcaaaatctttgaaatttgcttaatgtagaatattttttcgaaatttcgatttctccacttcggccatctccaattggaaatatttttagacgatttttttaaaaaagaaaaaataataatttccttaaaaaatttaaaaagaccgttttttagggttacctttttaatttttattactttaaaataattggtcagtagatgtaaaaaataatgaaaatcaattttcatgtgtatattcgtcgctcaacgaataaattgagttgctaaaatcaataaattggcgtaacgcactgtcatattgattattttatacaattcattggcactaaaaatttagttttagaaaaaaaattttcattgaaatcattattttgcaaaaatgaattattataattaacattttttaataatataatttataaatttttgcatttaattttttgagatttaattctttagataatgcagaaattagtctttccattagtgaatctttacaaggacaattgccttcaactgatgcacgaaaagctgaaaaaccaacaattggacacttgggcacaactgaaaaatgccattttgaaagaaaaggaagcgaggtaaaaaatgaagaaaaattattattataaaaattaactttaaagagagcaaaaaatgaaagaattaatgagccaaaaaacaaacaaaattagcacaaagaggccgaaggaaagggtaaacaaaaatatatacaaagtattagatgtagaccaaaccctaattgttcagggaatcgactaccattacttctatcggtttgatgccaatgcgatcagttgccgccactgtccgtaccgccgaccggcgcaaaagaacttgaagccgaccagcacgttgaagagccatctgaagacgcaccatttgactgtgttggagcagtacagaaggagcaacgacattttgaaggaggacagcggaaaagagcaaaaagaagaaggaggaggaaccatcaaaacagaagcaaaacaatgggagagcagcatcaaaacggaatctttaggctgacagagccctaaacaaatcaaatttttaaaaaatcattggaacgcaaaaaacgggtcggtgtcgtttcggtgcccatgttttggtgccaggcccaagtttttgaactacaaattttttcattgtcaatcaaatccaacaatttcggtatcattcgaagcttaacatatttcgaagctgtttataagctatttgcttctcgattagacaattaccaaaaagttcataacatgaaaattaaaaaaaacccttaaatttagaacttttttcttagtcacttttttacatactaaaaatctttttgcttttttaagactaattgagcatatgaaggctctcgaatgatatcaagattgtttgaattggctaaaatataaaaagttgtagtccaaaaacatgagctggcggcgtaaatgggcgccgaaacgaccctttccccaaaaaaacaactcactctttctgcatggaatttaaattctcttgtaattcaagcataatcatttaaaaaaagacagtcaacattttcatttaaattagggttcagccccgagccctcgggggcaaaaagtcgggggccggggacctcggagggcgacatgtcggggcggggaggagctcaatcatcgggggtcggggaccccgatcggggaatgaccaaattttattttaacccaaaaaaccaatttttctttttaaatgctcgtaaatcaacctttttttaactttaatcatctgatttcgttagcgccactaagagtgagtccaagctggactttaaaccaaggtttccatttgttcttatttatatgaatgttctgattttggggtagcgatgatttcttaaatatacttatagtaattttatggcataatgtcactatttttcaagaaattttatggtctgacgcaaatttttttgatcttttgattcagaatgctatgaaattttacaattttgcattttcctccccaaaattcttaaaattgataatgggagactaaaaatataaaatttgaaacatttttgatcaaataaattgtaaaaataactgatttgaaaaaatgttcttatttttgagcctaaaatcttatatttcggggttggtgttcatggtggaagccctggtttaaaatacatggaaagggggaggggggttaaccgaaatttttgcgaacccgtctcaacatcgaatttgaccaccattttttgcggcgctctttttcaaaaaaacttttggtgaacagaagaggggatgggcggcggtgccgataggcgccgc

SEQ ID NO: 7754 - DNA, 1331 bp, Heterodera glycines
ccccccccccccgctcaattaacctcaatttgtatttattaggccccaaatcatcgagcaaaaatgcgttttctatgttggcctggtggtttaacgatcagaagttcactttcggttactttggcttcaaattgtccaatttggccgttgtcctccttcagctccatctgttgaattcggtgaatttaatggaatttccatttcgaatgacctcatatttagtattttgggcccgacgatggccaattgtcgtccccttgggcgctgaatgccctagccaatctttcggccgggcgcgagtcgccgcattttccgagagtgattttatttgcccccccccccccccctccctcttctcatcattttatgggccaccggtaagaatggagggctaatttgtaagtgaaaaataagtgagtgaaattggagtaaaggaaaaaattaaaaaataataattgatatattactgccaattgttcaaatggcctagtggctaatctccttgactttctacttctttcccatggttcaattcctctacagaaatttaaatattttgatttttttttcatactcatttgtttactatctacaaaatatgattcctctattttttaattgtactagcggggtcagcgccttcggcgcatcccccgctaggtagtacgaatgtgttatgaacaattatttttggagaaaggataaagtgtgaaattaaaaagaatgacttacttttaattgtgttcgtactgtcttgagcaacccaaagaacaacagatttgtctatacaaaatcaattctaatactatactaaatctaaatccaaggttagtctaacacatatctaatcactgttatctaataactctctgtacacgacattcttcacctttctctctaaatttccatcatctaatctaattctcaacttattccaagcccttgctctcgaaagagccacatacaattgtccatggctaaacacatctttcctcagatcaattccaacttgctcaagggtttgaccttgggctttgttaattgtcattgcaaaagctaacaccaacgggaattggtgcctatgcaggtcaaaagggtaatcttcagaacagcaaagcgtgatccgaggaatgtacacagtctgacctgccttgtctccagtcaaaatcttacacacaatcaaattcggttgcatttgctcaactttcattctcgcaccattacaaaggcccatttctatattcaaattacgcattaacaaaacaattgaatttttcttcagtctcaacttatgccgcggaaaccctgaagggtttaaagcattcaaatac

SEQ ID NO: 7755 - DNA, 2276 bp, Heterodera glycines
  misc_feature (13)..(13): n is a, c, g, or t
ttcttaggttttncaaattttgttaaatatcattgaaatttaatgattcataaataattataaattataattttgtttatttatttaaaataaattttgaaaaattaaataattaaaatggtatttaatttaaaaatttaattgcaattgtactccctcaaaaaaaggtttttgtgtgttcgccgccggcgcttcactgatggcactgtcactgcttgtaccaatgttggcccaatgctgtggtggcacgcgcatggccgcgttcacttccggcgacaacagccccaacgagccgcccatccgcgtgtacccgtgcggtgccggcccgaccgggtcgcgcttccgcgttgtgcccgccaagttcaccggatcgcacaaaatttcgccgacaaagtaagtccttttcttgggcgggaagggttactaagaaaattaggtttttttatttttattttaaagtttagagtttttttgtatgagatgatcattcttagagttcgacttgggcctctggatccaagcctggataggtccatgacatttcggtaacttggattttttcctggacctagatttttctgaatttttgtccaggaaatacagaacccacgtggaatccaggtacacaaatccaggcttttttttcaaaatgtcgagctctaatgatcacaatgaaaaattcgcttgttatgacacttaactcatggcaaagtactgattctcaagggcgttcttgaaatcactaaaatctttacaaatgtattaccatttatatttgaaattcctcttaaacactgtctttttgatttgccaagatttatttatctaaattttgaatttaaatttagaaaaaaattcttaattttcgcataagacaatatcaggaagcaaccaatttcaccaaaaattatcaactaaataaaatttgtttttatattatttttaatattttatttgttttcaacttttatttaaaaattgatacttttcctaaaattattttaaaaacatattaaacataaaataaattttttttgttttcagtgccggccccgtgccggtgatggaggaaattgccaaggtgcagccgggctccaagaactccaaagcggtgtccccatcaattgatgaacaactgttgctggaccaactggtggactcgacggacgcaaagccattaatccgataaaggcgccaaaaattgaatttgaattttttttttcacggcggtggtgatgaggacgacgacgacgattggcattgggcacacaatttcccccccccaaaaaaaacaactaaaaatggcacaattccatactatttgttctgtgggcgagcgtgaataacaaaaacacagaccaacaacacatttaatcataatcaatcatccccaatatgtttgatgaatgaaaaatatgttttggcgttttgattaggtgttatttttgaatttcgaaatttgaaaatttaattatatggtaggggcacattgaatattcaaatgatcataaataagcctaccaacttttatagagggataatatgggccaaaaataaggtaaaagtcccaaaggatacgcagagataatgattttatatttttaatttttttgttattaattattttttaattcttttaacaaactttgatttctcataattattcgaaaatttctcactcgttattattaattattcgtattttaaggtttttatttttagcaaagttcaaaccctaataactttctgaatagtttgaaaacaaagagcataaaactcaaaaaaaacccaaaaaatttatcttcaaaaaagttaattattttcgtagatcactaaactcaaatgaacaaaaagttaattacacaaatttgcattttatcaacaaaaaaaagattttcgtgtctttttgcaatcataacagcatcatcaaatcacttaatcattcattcacattcatcttttactttaactttggtgactattagctgaatttgggtcaacataataaaattaatcgtctgctctcctgtccgatccggcacatcggcttttccggttcccttcagcggctgagtgggtcggatggaaaggattttgcgggaaaaattcgcgcaaaaaacgcaggcgccaccgtcgcccgagggcatggtgcgaccggaacaaaaagcctacgccgctttatccacggcattttccgagctttatccgtccgccattttttgcgccaacaagttaaattcagcgtagttacaaggcacatcatcaaattttcgggg

SEQ ID NO: 7756 - DNA, 1479 bp, Heterodera glycines
tcaatatgaaacggatgagctaattgcacgcaatttggccagtgcaattattgcctaattataaaataaaaataattaattaatttcagctcctccaagcagtgaaaagcaaaaaatgcgatctgaaacatatgggcacaattctgtactgtgcttcacaaaatcaggcattaaaaattttgtcatattattagcatttatttaaatttaaaaaaatggaaaattttgaattttattaaaaaccaaagaggggaccctttttggtttgatttaatatgaaaatttattccagggggttttgggggtccctgatcaccaatcgacacatattttatccaataaacgacttcctaacctaaacctaaacaaagaaaaaaatcataaaacaagaaattaagtcataaaacaagaaatttgaattttcgactttagttcaagttcgggtaagggattagatttggtcaaaatagatgtctgatttgtgattagaacaaattttcatacattattatcacaaaaattttgcaacccaaaagggtctctttagttttttaataaaattcaaaaatatccgcttttaaactagcgccaaaatttttattccaatttccaaataaaaatttcattttgcttaatgaaacgaaaatgtaaatttatattttacggctatcaatttgagttataaaataaaaaaatatatttaaaaaacattttaaaaattttatttcaaataataaatgtaaaataacgcatttaaaatgaaattgaattaaaaaaataatattttttttgccaggataaccgcaagtgttgctcgcatttgaatttgtcggatgcaaaattgggtgttggcgagcgctgcttgcgcttctgcgacccgggcggtgaggccggcatttcatccattgcccggtcggatgtcacgtgtctgttcaattggaatggtaaaaattaaaaataattaaaaaataaattgattttggcattaattaagaggccaattaattaattaaaagcaattaaattagtagagaaataattagtagataaaatcaaaaatattttttgactaaaaaactgaagaatttttgattacaaaaaattggttgttttttgtgcttttaatgagttcaattattttctaatcatttaacaaatcttgcaaattaattgcccctaattagcgctttgttaatttagtgctgatgtattgtcaccactcaggcattaaaatggtgtgaagtttgatgatcaattcaagagaggaaagaaatattgtaaatggtttaagccatcgaaaaatataaataaatttgatttaatttttttttttttttgtaattttatattttttctatgtccaattttacatctcattagttgtcagattttcaatgcattttatttaattgttataaatttgtgtaaattaattgcttccatattttattactatcttttttattatgtttattttat

SEQ ID NO: 7757 - DNA, 2271 bp, Heterodera glycines
cccaaaaaaggtgtgcatatttaatatttgcttaaataaacttaaaaagtacaataaacaaccaaaaaatggggtttaaaacttaaaaatgcatattttttattgttgttcgttgtatcaaaaacacctccaagtttgccaaatttcgaaaaaattctcattaaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagttataatcattagagcttataaatcaagcagaactttaaaaataaaaatttatcaattaaaatattaattattcagattgtttttttttgcttttatgaattatcaaattgaaaaataaaatttttttatatatctggcgaaagcctgaaataatgattaaacactgtcaaaaatataaattttcgggaatttcttgggttttcaattaatttttttaatggactagcaaagtaagaatttttttactttataatttttgatgaaaaaaaactcttagattgtatgattatttttttcacttaagaaattccattaagaaattccttcatctcacaactttttcttttaatatttaatatttaactatttaatttattcaattttttttcaacattacattttggcatactgtcgccaaaacaaaattcaaaatcaaaaataattaacattttatcaccaacacatcatctcatctgcttgtgtgcccctttccactattcattcattctttttcgttcctctcatcatcaatcagtacgatgacggcattcccgggatcacattctgcggcacaaaattgggcatgaggggcctacgcgttgggcgtggacgaggtcggtaagttgggaattttgtccaacgagttggacgagttgggaaaaagggaggaggcgtgcgccaacgcggcgttgccggctgcagcataatggcaccgcttcgatggttgggtcgtcctcctccgccgccgcccttgccatagtttccgttgccataccatggcttgtttccccatcccttgccgttgcttgatcccggccacggtctccccggcgggtattgcggtggcttggttggccactgtgttggctgccaaggcagtggtgttggcctttgggcccgcatttggttttgttcttcatcctgttccgaatttggcccaccatcatcattggcattggcaacaattacctcatccgaaagttgcccttgggcccgcatttcgttgtcctcctcctcctcctcctcgaaggcattggcaaaaggtggggggagaagaagaagcaaaaggagaggaagaagaagcaggcaaatgctgaatagcctcattttgcggggatttcgtagttgggattggatttggaatgaaagtgattggtggagggatttgtccactcttaaatactccaaaattgatctggggatggagagacttggccaattttttggattttatttcctttgcaataaaaaatttatggattcataagatgggccaatattcgtttaggcaatttttgaattttaataaagaaaagaagaaataaacatttagacaaaccatttgaattttatcatttgcccataaattgtttttggacaatgaaatttattgttttttaatatattcatttttgcatttttaataaaaattatttgctaaattcaacttccaaatttgacgccaaaatgtagctcatgaaaacaaatttttaaataaaattacgaattgacgggttatttgatataggtgtccagcccgtaacccctacccgtatgagtcattcgaaaaattttggattctaatattttgtaatattgtattataaaatttttaatttgctattatttagatttaaatccaagccattttgccgttccgcttgtttatttatcaatattatcaacagcattgcaacaacagatcagagtgattttgtgaccgatt

SEQ ID NO: 7758 - DNA, 5836 bp, Heterodera glycines
  misc_feature (712)..(712): n is a, c, g, or t
tttttacataattagttgaccatccctgattgcttcatccagtttcttaagacatttctatgtgttttcaacttttttgcaatttcattgtcagttattttggatttttcaattttaattcaaaataaattttaattttttcttctttttcttccttaattattttttttgcagcgaatttcaaattctttcttccaattcataattgattcataactcgtgccaattttcttgcaaatttcggcataattttggtcccattctttggttgaatattttcttttttgcttatattcatttgccattgaaatgagtttttgtaaaattacaattttttcttcatttgattttgttttgtaacttttttgtatttgttgattaagccgtaattctttaatccatttttgaatatatttatgatttgtgcccaaatttttgctatttttgtattaattttactccattctttcgctgaatatttttttcctttttgcttaattttttcctttattctataatatttttctattatttctctttttttagtcaatttcgttgtttttattctttttcttcccatttttttccaaatatttcaaaaaacctctattagaacggtcccccatcagctaaatttggattttgacccttaaagaccggaaaattttccgaaaaagtcattttttagtgtcacatggaaccaactcagaanctggcgcagtggcaggtcattccataggcaactcatccacaggcaactcatccacgtgcaactcatccacgtgcaactcatccacgtgcaactcatccacgtgcaactcatccacgggcaactcatccacgtgcaactcatccacgtgcaactcatccacgggcaactcatccacgtgcaactctctaggcattgagtctatataaattcttttatttaatcattctgatttttacaaatagcctctcatatgagtcgcaacacggagctgaaaaaaaaattggtctatgagggtcaattttactaggttagagaacacctaggagatacaatttattggagatgtgaccaatttccagcgttgaactgcccaaagtccgcaaaaactaatgtgtttaaggggtgctaggtcgtttcttaaaaactgccaagttggcgctacggtcattatgaactaataagaaaaccacaaaagataaattaattattttcatttttttctgataagcttattataattaatatttccctttgaaagttgcaaagaaatattgaagcacttattgtggcacttcattttttgacacatgctttgtagcaccagtaatatggttttgcaactttaaaaaggtttaaataaagtattttaaatttattatacatttttaaataatatagtcgatgattgctgttattaccatgatttatgctatataaacaaaatctaaaaaacgctacgattgcgacaaaagcttttgcaaatgtttgtatgaaagtgctgaatgttcattaacaaaagtctgttttatttgtattttaaatagtttattgtagagtgcccacgggaccgggacttggtttgcccaaaattcccggtcccgtggcactctagtttattttttagaatttgttatgcttgtcagttcatgtttttggtgaacactttaaagaataagaaattaaaaaagaaatacggatatataaaaacttatatcaataaaattttgataaaaatatttctctatagttgttttatatttgtagtttaattctcgcccacttggcaatttttaagaaacgccccagcacggctaaaattaatgcagaataattcaaatcttcctcaatgatgaatgggacttgaaaaaaaaagattcaaaatttggtgaaatattaatttaaaatttatgtgtgcaaagattactggcaaatgatgacattggattaaaaaataaataaaataattttttatgataaattgctcttcaactgtcaccaagttgtgccataattatttaaatatatatatatataattttaattttagctccaacttgtcgcactttggcgcgacattgccgttgtgtcaaggcctttccaacaaactgtgctgctcccattgggtacaaccaccgcttcaactgtgccaagacggaggctgaagccaactgctgacaatggtgcgcaactgcagctggcatcaaatggttttgtggcatgctggcgaacggaggagcgggtgccaactgatgtgcacgagacggcacaatttcggtatattttacggtaccgattcggcaaatgacataattccgacatattttatatcaatttcgggaatcggtacaatttcggtaatttttacggttccaattctcgggaattggcacaattttggtatatttggcgatacgaaattcacatgccttgggcttttaatttgtttggcaatgcattagctttactcctgctttgcttcctcaaggcttcgtcttttttccatcgctgatgacggcaccggcacactggttcgtgccctgcacaccaactccacctgccatttcttccggaatttgccggatcagcaccaacagttccagttgggcattgctgatgttggcacaagtgagacaacagtaacggcacaaattccaacgccgattacaacaacaccaatagcaacaacgacaccaacggtgcagagcagtacaacgggagcaacaacggatgtaatggtgctgaacagcaacaacaaaattacatttgacgaggatgaactggtgctgaacatcacgttgcagcaagttcatggtgttgaacaatttcattgggaaaaaaatagagaaagtcagcatggcattttgaaacagatggagcacccggcagaccaaatgccgatgcaatggtcactttgctgttctccgatggcaccggcttgtacatgttggacaagttggacgactttgtgatgctttccgagccgtccaaaatcgcatttgcgctgaacagctcccagtcgatcaccgcactggcctgtttgtccgagacagaattgttggttggcctatccgacggcgccatgttcaggctgaacatcggcgaatggttacggcattttattggtaaaaaaaattatttaaaattaaaataattttttttaaatttactgtcaaatttccgattcaataaataataaattatttatttcaataaaacaaaaattaaatctcattcaagtttctattcaacaaataatataattatttatttcatttgaaaaaataaacctaaaaatgttatatgcttttttaattgcaaatattaataaaaaaaaaaattacgattatcctattgtagtgatttgtagggatgggatttttaggctctaaaaactgccaaaataggtaggctttaggctctaaaaaaccccaaaataggcaccaaaaatcctcaaatttagggggtgtaaaatgacaaaattttattcaaaaaagtaaaaaaaaattaggccaaatcagtattgagataaataatttttaaagcacaaattcttgtcaagaacataaaaaataaattttggagatgaatttttgaaaagtttttcatttctgtatgggtgtatttttgaaaattttcgggtcgattcttagggggtgtatttttcgtttttattgcatttttgttaataattttgggcaaaacgccaaaatagccaaaaataggctctttcaaatttttttaggctttttaggcgctaaaaataaaagcctagaaaataggcactaataactcgaaaaatagcttaacaacagcccaaaaaaacatgtttttcgtgcgtttcggaccacggggagctcaggaaaaaaataggcttttgcctaaaaatcccatccctagtgatttgctataattttatgcaatgctaaatttttttttcaaatccttttaaaacaaaacttttggcattatgtgcatgtttttatctaggctccaacaatgtgaacccgtccaatgatcatcaccagcagcagttcatcaataatactatctcaccacaaaatgtggaacacattgttcatgttgaacggatcaaagcagcggacggagtgccaataacacaaattgttgtctcagagattacggtacttaataaaattttgaaaaaagaatactgtaaaaatttatttatttattttattatttaaggaacgaatttatgctgtccgcgacaaattgggcattatgcgatgccatttttacacctgcgaaaatgccacggttttaacgttgacaaattcgccaaacttcatttatcggctagccgaagatgcttggaatgggtagagaaataaatacaaaattaattaattatttgatctcggattcaattagaacaaataaaaaggcaattagcaacccaaaaaaaatgaatatttaattatctattttaatttaattggttttttagatttttatattatgccacaacggctggcgatgtgttcaccacaccgatgctgccgttggatgcgagccaaaattattcactgtccatcacgcgtcgggtcgaaaataattattaaatattttaaaattaattaattataaatttttacgtattttaagttagctgaattaccagctgtgaacagtttggaagtggatttggctgaacaaaagctgatcactgtcagccgcacaggacaactgatcagtgcgaattttttatttgtggaacataaattagggccagcaaaatcagtggaaaaaacaaattttattttaatacaggtcccattcttaccgatcacctattaaaaggctgttaatttttttagaaataattcaaaagcttttccaataaaaatttttgtatttccagtgtctttatcaatataggtttcaaaagggattacagtaactgagataccatatcctagcatattaagtacaaacataaattatgatgacaggtcgcgatctgatcaacggtacggtaagggacgagcgcgagagttggacactcagtgacgcataccgtaacgttgtacgcgcacaatcctaccgtaaccgactgttttggacgtcgtcaagctgcggtgactcacacccatgggaaagctgcttgttcagcgaggaatttgatcacgctaacaaggctgtacacctcagcaaatagtgcgtaatgagaaaatgataatttttatgttaaaattattaaaaatttaaattttattaattttgttaaatattttcaaatttttgttcgtaccacctgcagatttttgttaaatcatagatgaaaatcacttaattttgccaaaaaataaaccatacattaaaagcccaagaaaactaaaatttcactaccgaatattaaatgcttttttagttttttaaaactcaaaataaaaataaaaaacaataattttcgtaataaaattaaaaaattttcacgtatgattaattttccttaagcttcaaattttaaaaccaaaatatttttcattgttcgaaaatgttggctaaagtttgtatcgaactgttaagaatgagagtttttaattaaacatttctgatattttccgtaagcccgatgcgttttttaattattatttttgaaatttgtaaaatttaagtttatatcccgggccggtcaaggaatttgtgttgttgaagccattcagtgcgcctccatttatggtgccaccttcaaaagttggcttaataatgttgaccgattcggatgcattgttaagctggcgacctccaacatcattaccatttcaaggcaaatatttctttaatttttatcttataattaaattggcattaaaattcttt

SEQ ID NO: 7759 - DNA, 1400 bp, Heterodera glycines
ttcgggaagaatttgcgcaaacaatgaaaaacatgtatgaaaatacgaaagatatcgccaaagaagaaaaggtaaaattggataaagcaattgaaaatgcggcaaaagatgtaaaaagaaaatatatattgagaaaaaaatataatgacaaatttggcggttttatttcggcgccattttcataaagaattttggagtcataaaccgagctttttgcagatcatttctatttcctgtttttgcattctttttcttttaattttctttataaatttttttttaatttttaattttcgtttcgtgtttcgttttcatgaaaaataaatattttcgttttctttctatcggtaaaaggtaatgaaacttgcttatcatcaatggggagaagcaaaaaaaagtatcactgataaaaatttttattaattattatttaaattttatttactgaatgttaaaaaaatgttttaaaaaggaccaaaaattgcgaaatattcccaaaaagtcaacatatagagaaaaatgtccatatgtcaatgtaaaaaatcccaaaatgtgtaaaaatggataaataaagccaaaacttttttctcaaacgcaaaaaaagaaaaggttttcttctatttaggtcatatataatttagaaaaacatattcacttaactcttttattcgaaatattgtacaacaaaactgcgtcaacttatttaaattttaacacatttataaaaaatcagatatttggtttttgcgtttttttgcaaagctcccaaatttgcaccttttgtgaagtggccaaccacgagttatgcttatgaggggtctgtatcgttttggcgccgacattttggcgccagcccaagttttcggactataacttttttcattgtttagcgaatccaacaatcttggtatcattcgaaagcgcaacatgtttagaattatttcaagctattgcttcgcgattagattatacatgaaaattgcaaaaaagtcaaaatttttgaagttttttcttaataacttttttacaggctaaaattgaataagttatttaaatcctttgaatttatttgcatgaaaaaaacacttatttttaagactttcgccactattttacccttttgcgcgtctatttcgcctaaaattttttaagtctttctcacaaattgccatattttcgtgtttctcttcaacacgtgtacagcttcttcttgactcatagaaaactgcgatgtgtgtgcactgcacggcacaattttttaaatatgtgttggagaacatctaattaagtgagattttttgattcgttaatttatgtgcgactaaggaaaatgactctacaaatagcgaaagttgtatctttgttcctttttttaaataatcagtagggatgcgaaattt

SEQ ID NO: 7760 - DNA, 1565 bp, Heterodera glycines
taattggggacaaataaataatatttacgtaaggcctttttttgtgtgtttttcatcatcgtatgaagctcattaatatgtacgaaaagccaacaaaaattgccaatgacgcaaaaatattgtattatttggcattcctcacaaataaggaaggacactcatatattttcaacaaattttgatacaaattctcatattattattaatattcttgaatttaatttaaataattatgcgatgggtttttggatttattaagcaaatttttctttgaaaatttctttatacaataaaatatgaaaattagatttttatattttatattttccacttatagttaacttaacattttaaatatttttgtgaatttttaaaaaaatatttttttgtcatggaattagaaatttttttatctgtctgatgtttattgtatgtgactaattccactttaatatgagtaaaccaaatttagaaacatatttaaatgccggagaatttattaaatgatgaattattattatcaactgattttgtgagtgatatttattaaatttaattggcttacaaaatattttaccattaagttggctaattatttcaatcaaagtgtaaatgcatccattaaagtgccattattgatgactaatggcatcatttcattgttctgctttgttggcattttcctcaacgcatcgcttgtttatgtgaccacaaaaacaaagtatgaatttaatggtttttattttttataaaatgatttttcggaaattaataattacaatttataatttcaagagaacataaggagtgatttgcttaatcgatttaaaaaatcaaggacattatgtcaaaatgccgtttttcaggattcctaagggccgatttttaaaaattacccgggtcctgttctgttccgatctcttcaagttttacactataggcctatcaaaaggtaccaaaggccgaaaaaccctaaatcggaatccggaaaaaactttttttttttttgctgctttattttccattttttgaagagggccgacggtgtcttaagcacagtttgtatttttaaaaattatgagtaatttattaatttaaagaatttgaggaccaattttaaacaattctaaggcatcgcctcaaaaacgggttttgtataaaagctaaaatttcgttatgaaaatatttctcgtaagttttcaacaacaaaaagtcgagaatcgtaatccacaaatttcgctcattacttcggcaccacgcgccttttaaatttaattgcattatcaaaattgaacaattttgtttattttgcacactcattgtgcccttttgctggctttccattcgctcactgttatccccgtcctcctcggcatctctttcaaattcttgcttctcctctccggtgtttaccttgtgccattgctgcgctgttatcacattctgttggttggcttaatctgtgccggtttgtgcaccgctgcgcaattggccattggctacgatcgtttgctcagtattttggtcccaatatgggacagctttttcacagcgacgcatattta

SEQ ID NO: 7761 - DNA, 1753 bp, Heterodera glycines
aaaatttgcattttttgttcaaattccccttcttccaagtttccagcagtaatatttctactctttgttcccccccgtggttggccgatggacaaaaagtgaaaaaatttgctaaattttaaaagattttattaattttctcaaaagttatgacaattttccagtttttttggcttgaacttttgaaaaaattaataaaattttttgaaatttaccaagctaataacgcaaattaagggctatcgtatgattaaggtataagcagatgaacggcagcaaaagatcattgtgcattatgatcactttatgctttgtaaggacgggctatttaaatgccaattatttttttgcggtttcaatgaggccaaaaaagtaaattgacttacctaattaaagaataaataaaaccaactaattatatctttgtgtgttaggctggtcatgtgctgttttgacgacattgtgcagccggagattagtgcgtttatttaccgagaagggctgacaatttttgttgccgaatttgcgtgttatgcactgatttggctggtgattttatgccgaaaatcgcacggaaatttttttataaaattatttttaaacaccaaatcaaatgtttatttaggtaggaggacaacaaaaaaattggtgaagccgttgacatcgataatgtgcatcacctttttctgctacattcaggcaaaatataaaaaataacacagaaacaattgaatatttgttgaaaattaagtttttttttaaatttgttttggtgcttctagggacgtatttccatatgcgtatttgcatatttgtgcatacttcgcatagtgcatattttgtgcacatattttgcgatttattatatgtatatttttggtacacaccaattccttttaacgaaaataaattaattgtttttgtgtaaaaaaccactagaatttcaaatggctattaattaggtacggtactttttttaagaaaaatctttgacttttgaaaaatttgggcatttcagcatgaaaagacaagcattattttaataaaactttaaattttctaaattatattggtgaactttgaatttaaaataatttttcgccaaattaaaactattttaaaatgggccatttataattcaacacattttctttttcaaaatgatttatttatttccattttcttttaagggaaatctgtcacggattattttgccacacttaaattttgatctgcttggcattgagttctatgtgaagtttccgaccaaccttcttttcacgattgcttttagcagtaatgcgccatttctttatatgttcaggtattaaaaaaaattaaaattttaatttaatttatttattttattttattttatttgcagcactgaccatcaaaaggcattccgttcacaattcaaacggatctttggcaaaaacgaatcaaagcatttaattgttgcattcgctaattaatttcatcgaaatttttaaaggcgcttcaaaacaaaaacaaaaaattgactttcgattactaatttttttgataaaatttagcattaaaagctcttacctcaaaatcgaagctttgcgctgtctatagcataataattctgttggttttatcttcaatatttattctaagtaccagcttatttttattttaaaatagaaacagagggtgctatgacgttagtcaaaaaaccatcaaaataaaaaatattttgatataacttatctaaaaagcaacaaaa

SEQ ID NO: 7762 - DNA, 3778 bp, Heterodera glycines
tccttcccgcattttccttcactttcccatctctttatctccgttcaatcagtcattttcttatccatttcatttccatccttcgccatccgcgttatatccatcattcacttcattttcacatttcgttttattcaccaatacgtgtggtttaattacccaagtttgagatgggagaataaagtaattctggataatatttggtcgccaatgatcctgggagggcccgcccgtttcactatgccttcttcgccacacaattttaaagttgcaattgtcggcgctgggcccagcggtctcacagccgcaaggtcagcagaagagatttgcaaagattgggtcaatttcagacaagctctgctctacggctacaaagtgcgcatttttgaaaaggaacaaaatttcggcggcgtttggcgcctcgccatctcagaaaatgcgcaaagtgaattaattaattagataattaacaatcaatcaattaaattaataatagccaattaattaatgaattgattagctaactaatataataattccaaatgaaaggacggcccgtgcctttgcaaagtgtgatggactgctcaaaacagctgtgtgcctttagtgaactcgccgttgctgaacattttcccacttttcttcgcccttctgacgctgtcgcttatttggagtcgtacgtgcgaacattcgaattggcacggcacatgaaacttggcacggaagtgaggagaaaaaaatgggaaaagctcttccgttttgtgcgctttaggttaaaacgattcgccgatcggagtgttggcaaaagacagataattagcgggggattggcaattaaaccaatggattaattaattaatcccttttcaagccgatggattgtccaatgggcggacagtgaacagccgaacaacggcccatcggaaggacagcgactggtcgaggaactgttcgatgccgttctcatctgttcgggcgcccgcctaaggcggtggcgccccccggagtaccgtatggagagggcgttcaaagtcgaattcgaatttcctccgccaaactccgtcccctccctttgcttagggcacagttatccattcggaacagttcacacattcgtccgactttcgtggtcagactgtgtgcgttgtcggccttggtaactccgccgtggctatttccattgcattggcacacacagccaaacaggcactttatgagcttggctttttgtttccttatgcttcacattgcgtgagctgacctttcattttttgcttacattttcaggtgtttctgtgtactcgtcgtggtgaatggatattaccattgcttcaatccgacggacagaagccatgggattggcctttcagcagccgatggcatttttggggtcgccgatgggtgccgaaatgcctccgaaatttttgttgggaaatgagtgcccaatcagtatcaccagactgttcacaaaacaacggaattgggcgaccaatgcatcgattgctgaggtgacaccgctaaaagacttctgcggaatggcctggacaaaatgccaaagtttagtgccaatttgacatttggagctgaacagctctgcccactgcttgcttccggccgaattcgaattcgcccaaacattttgtcattgtccgactcgaatttggtcgaattcgccgacagaactgttgaacaacacgtggacgcgctggtcatctgcacgggtttcgaattcgactttaatttggtcgaacatggcaaacctttgcgagtgatgcacaacgatttccatttggtactgcggacaatcaaatccgattttcggatttgccattgccttcactttttcacagtataagcatatgtacgcgccggagttggcgccccaccacactttggccgttgtcggacatgtccaggcacctcttttcacacccttttaaacaattggattgcttaagccccgcgggggaagcatttggccaattgccgaactgcaggcgcggctgtttttccacgtgctcagcggacacacgcaactgccaactccctttttgatgaaggccgaattggagaaacgccgttgtgccgtgtccacggaaatgctaaagacacgaaggcacacacagacggtactcggcactgatcactttttccactcgacttctttcactgataattcattttccgcttaaggaagactttgtccaatttatgtctgaattagctgccatggtcggtgctcatccgccccctctcaggcgcctcttcggcaccgatccgtgcctgggactgtctttgatgttcgtctattcaattacttaaatatcccaaaatggcaaatgcttctctcccagggctggcccctgctgtagtgcccaattccgtttgaatggtgcccattctcggcacggttatgctcgtcaaacagtcatcgaggtgaattggcaaaaatgaaatgctcaaattggttgtactcctcgtcaggttgcccgtcagagcggccttttctctgttcggcattggcttaactttgcttccgtccacgagcttctgttcggctgtctggtggctcttttgttcgatctttttcttcgattccttcttctcttttttgcttgactgcttctcttctaaacttcggcacttttgatgggctatcttttgccaaatgtcccaatttgcttttgtccatctgttgcggtttctctcttttttcctttctctctctctctctttttctctttctctttcaacatattgtaaatcatttccattgtttttgattgaatgaaaattctcttaaattgtcgcccgttgggcttcaaaagcgaaagctttgagaatggaaaaggcgggggagggaccccattcagtgaacaacttcgatcagctgaatgaatgggcatgccgtcaaggtccggtcgatgtaagcattccttcgctcccccccccccccctccggcgatggctcattcgccgtgggaagggccgccacttacgaaaccattccatttgccgtccatcaaatgcggacacaaacggagtccgtccgcctttgttctgttgctcccggatcgtcttccccatgatgatgatcacttctcctaatgatgatgatgctgctcactttccctccccgcctcccattgtccctccctttcccctcattttcttaccgcccataatttgttttggcatttaattgcgccacaaaagcattaccaaatcaatcgccagccaaagtatcggccgaatgcctcccatacccaacactaaagttccattaatgctcatgtgccggtgtacggtactgttcctcggctactgtgttctgtgttacggtgccgacggctcaaaatacccaaatgaaataattgacacgccaattgtaagctgtgagcaggaaaatattgtggtcaaggtgggaaaatgggaaggaaattaaaatcaaattaaatgtaaatttaattagcgaaaaataaattaaattaattgcaattattaaagatacgaacttcgagtgccaatccttcgcatatttacgcgcaagactttcacgaaacggccaaatgcatgtgagaggaggggggggggggggggggagagaaggaattggaattgggaagagtttagggtccgaaatcagaacagaatcgcattcccacacaacgattgcggaatgaccagggaaagactggtgagaaaagggaaaatttgaatttaaaacggacaaaacgaacggggaaaacccggcaggaacaatgtatcgcatctgtct

SEQ ID NO: 7763 - DNA, 3377 bp, Heterodera glycines
aaagggtactgtggacggacccgaggtgagtgcagtacggtagcagagagtttaatgtttattgcgaaaataaattgatgaattgatactgcgaaagaataaaacacggcaatgttaccgcattatctacatattgtacatgcacggacggactgatttaagtacggtgtcaggtgcacgcggcggtggttggcgatacagtattccatgtgtggcaatgcaacaacgaaaacgtgggaattttagtgcagaattgccacgtggaagacttacagggcgacaaaattctgatcattgaccaaaacgggtgaaattggcacaaaacactgaaacgaattaatgaaatgaaatgttttgttcagatgcggcgtcgaccaatacctttttcgaacaccgcaatactcagatgatctgcacaccgcctttctggtaaatcggaaatgcaattcccaattggccattgcctcagcaatcgagcgtatttaaatttgtggacaaatcgatgacgcggttccgctgccaattgcgtttgtgtgtgaagaacagaggcaaaggctgcgaaaccattacggtaggagaacacaattacggtagaaggaaagagcagagaaagagagagattgagagagagatggaagagagagtgagagagagatggaagagagagagaaagagaagcccaactcggatgcttagccgccttccggttgtccatctgtggacgattcgtcctcatccaccgacgcgtcgccgtcgtccgccccttccgctgccgtcgtccattcgtccgtcgaacaacaaccgtaccgtccgcctccgccacagtcgtattctcttgacggagtcagtcccccttccggacgcattgaaccgccctcagatgccattgcgcacggcagaagcgtggtcagtgaattttccgaagtttaaatggttatcgaattgagctggctggactaaacgacttacttaaaattcaacataaattacatttgcttaggttagcggtggcactgaatcagcttcgacctcatcggaaccgcctaagcacgacgaagtcgaaccgccggtggggccgccatcgattcgaccgtatgggccgggcctctccggcaaatgggcacccggcccgcaaattgtgtccggaaaggcgtctgatcaggcggagaacagcgcgacacttccgtcgagcaggtccgtccgtccgacctaattaagccaaccggaaaacgtccccttcctccctctctctctctcatctcctcatttgtcagttatccttacctccaccgcgaaaggcgttcggccacattaatgatttacggcgtcgggccatcccaacggttggcacctccgccgttgggggcgcgtgccaaaagacattttggcaaactaagtggggacagcagtggcacggcggcaactttggtgaaaagggatgccatggtgcaggaattggacgtggtgggactgatccgcgtgttggacagcccggacgacatacagtacttcggtttgttgagcacagtatttattatgatgactcatagtctctgtctcgacttagaaaagtctgtgggttttgcggcttctcatattattaaaatttactcgccatttaaacttttggcttctattatcagccgatcaccaaagtggcgccgttgcacaacaaaagcctttaaacagcagcgaaatttcgccattttttgccggggacgacagattaaatgcgcagccgctgcagacggcgccaccgcaacgcattgtgccggtgccatcggttggcactgcgctgccccgacagattgtgcgatcggctgccattgagcagcgcctttctcagccaatgccacggacagcgggtaaagcattttttacatttcaatgattctttcattaatttattcactttccactccagcagaattgcggaattcaaatgaccaaagtgaacgcacttttccccccgaggggtcaatttgcgtgtcaattggggcttttcgtgagtttttgcgtcctttttgaaaaaggaaaaattctgccgaaggtgggctcgtgttcacgattggcactctcttcggcctccaattgtgcgccgttgcactggtgctaatcgattgctttttgatggacggaaaattcatacaccaacggttgcgaaaagtgttggacagcaaaggctaatgatcgaagcggtgatcagggctttatcaatcattgatcagatgcgactttgatcagtttttttatttattcttcattttttatgtctatttgttttttatcagagagaaaaaaacatcgaactgaaaatgaaaaatgaatgataaggacaaaaggtttaattgcttctttcccgaaaaatgccaataagccaatttatggatgaaagccaaagagaagtgagtgacgacgacggaagttctaattgattgattgagcggactaattgattaattgttagtggccgagcgattaagcggaaatggcagtcggtggaaaacaagtgaagcaaaagctaagctattgattcttaagcatttcagcgattgcccatccctacgacaaattaagtaataaacggagggagaccaatcaaacgattaaacaattgacgaatatatttgttttattcaaaaaaattgccaaatttgacaaatccatccatctgcttagattttttcgagagtacgacttttcttcggattgactcaaaccgaaatccaaatttccaatcccagcggttgctaggacgagggacggggccgaaagagagggggaaggaacgggagaggagtggggggggaggcatcgaatacgtggaggcgggggggggcgaggggaattcgcgatggatttatggtggcggcgtacttaaaagccgtgggttggcacaaaaggtaactaattgacgagccaaaaacatcggtggtatttgcaggcaaacttagcaacagagcatcaattgcatatgaaaatatgcaattaagctcaggtcaacacatgacaattaatattttcatgtcaaaatttaaggaattaattaatgagttttagagcaggcagaactctcatttttatgtgtataattaattttgtatgtaatataataaatttttgtattttaatttatatcattcaaaaataacagtttttggttttccattcctaaatattagagtgccacgggaccgggccgggaatcccggtcatccgaggtcccggattttgaaaagttcaggtcccggtcccggtagggcaaccgggaaccgggaaaacaagcactggtaagaatggaggtataagtgtgaaattagtgatgaaaattagagtcaaaggaaaaataaaaaataataattaatatattctttaac

SEQ ID NO: 7764 - DNA, 619 bp, Heterodera glycines
ttttttttgaagccataacattttttggcgaaatgttcaaaaaaaatttttcagtaaataatcggtcgaaaaataatccccccgtctccatttatcaccccgtatctaataatcccccccccctttctgaggaggttgaacaataatccccccggggcgataattagagcaaatacggtagttttgtggattttcatacactttctgcgaaaatttgaaattatgaatttaatttttttaaatattttaatttgcctttttaatttccttcgcttcattttcgtcgtctccgagtgcccaactcattgcttggaccttacgaattgcttcaacagtatgggcttctttgggatccggaaagaaacgctccaccatgtccggctttgtgaacacctatcaaaattgaaattgaattaatcctaattaaccattttaatttttttggccaaccgatctctcgtcacctcaatactttagcccccgtccccctccatcccacgaaaatgggatattaatagttattaccattttttgttaaacaattcacctgttgcattttctttgtatgagcaatagcaaatacatatggaggagtcttctaaaaatgcataattaaata

SEQ ID NO: 7765 - DNA, 4659 bp, Heterodera glycines
aaaagcataacagaaattatttctgtaagatttaatttggtggtaaatgctttcgagcaaagcatataaaccagggctgggtataactggattttcaattacagaatccgtaattatggcgattttctcagttacggaattccgtaatctgtaatcagtaattttcaaagatttagtttttttttaaaataatttcttaatttaatacatcctataaacagtgccgcgggaccgggaatcttgggcaaacccgggaccgggaccttttcgggttgaaaaaccgggaatttttggctgggaaaaccgggaaaaaaccgggactagtcccggtcccggtcaaaaccgaaaagattgcgccgggtctggcggtgcgggtatactccgcttaggaaaattttgaagatttgaatgtaatttgtaaaagattttggccaaaattattttttgtcagaatattaattttgaaaaaacttattttaacatttaggaaaatttattaacaaaaatgtaataaaaacgaaaaacacacccatacaaatcaaccgcaaaaatttcagaatatatcccaagaatcgaccctaaattttcaaaataggcctttatgaaagaaaaattttctcaaaaatttatctgcaaaatttattcatttatttatttgcgtaatccgtaattaagctcagtcctgatgtaaaccaaactattaaccctacctgcatacacgtttcctcggggctgcaaactttgccttgttttccttcactcttttcttgtttcaagtgtcggaaatatctaaatatgctttttacatattattcatattaataataaattttattttaatatatattcttataactactatatccatcaactttattttaaggaatttaacatcgctaataaaagaataaagaataaaattttaataatttttttaaaatttaaccaaataagatataaaagtcacaattttttggaataattgttaaattctgaaaaatttttatctgatatatatatatatatatatatatattacttttcaatgtcgtgaggcaatagaaaacccctctcaagtagttttttggcggccttaatatagtaaaattggataaatacttatataagttttttaattccggaggaaataaaagaaaatttcttttaatttttaaaattattcattattaaatttgaaccatttttattgcttcgatcacttcctttttgctcattgccagttttaccgcgcagaaacgatcatcgagtaaagattcaattttcttctttgtatcctcatccaaattatcttccgtataattcatgcgctttgctttgcgccaattggggtgtttttttaaggtgatctgtcaaaatgaaattttctaaataaatttacgctatatggttacatttttgcatagtttttacgctcttttttaattctgaatttttttaactaataaaggaacatcccaagctatcagtctggaaaatacatataaacgataaacattggatagaacatagtcattttctatcgtgaacttttaattttagcggtaaattttgcctgcttcaaaagttacagagcctcaaaaagtataggtttaagtgcttgagggcctttcccgactgcagagaagcgaaagagatagagcaaaatttgttggtaagttggttcatttgtatttttgggggtccgggttcaaatccaaagtgaaaatacataaatttgaattggatcttaaacaaattaattatgaaaaatacaattttatatataaattatagagtaaaaaaatatatatgttaaaagaaataaaaaccagtcattgataaatagagtaaattcgttataaagtgaaaaaaaattgaaaatgagcccataggccagggctgagcgtgcggaaattacggcctttttggaccccgtaattacggcttacgggttacggatttttgcgatttttccgtaatttagacccacaactggtactttggattatttttcgagacgagttcctgcaagatttttttataaaacaattttttcaatttttatttaaagggctaccgtatatttatttgttaacaattaagaatcagacttttctttataatttggttatttaagacaattgcctagaaaatagtgcaccccttttttcttcgcctctatttttccacatttacagattttggaaaattataacataaattcgactttaatgatccgtaattttcacataaaattaaccctgaaaattcaaaaagaattgatttttataccataaaaaatatataaattcgtctgaaaaaatacggaatccataattgagaaaagcgccgtaattacggattagggattttcgtaattgaaaatgcagttacgcccagcccttccatagacaccaaaattacaattttttaggctctgtaacttttgaaggaggcggaatgcagaatgcaccgctataattaaaaattcaatataaatggacctgcactatacaatcactatacaatgatatatcgtttatatgaattttccgagtgaccgatcggaatattggattcttcaaaatcattctctgctttagttccattattaatttttgcccccaaccgattcattcgccaaaatgtccagatgtacttacataggtcagcgccatactacgtgcctgcagcatatctgtgtagccgccttcagtaccaccgtgttgttgttgctcaaatattatcccagctgcaaaagtatgttatcaatattaatgtataaaacatataattattgtcatatttctctccattatagctgttatattccctatacaatctcttaccaatctttatatctatataatggatacactcctccaatgtaaattccgttgggtagcagtggaatgttgaacctcctggcggattggtgctgatggacatcttaataaattttattaattaagtggtcatttaattttccaggttgagctgaaacttattgaattaaaaaatgggtaacaaaatatagccctaagaaagagaccaagaatactgaaatataaataaaattgcaaattatgtatatgaatctttctatattttccaaaataataacttataatataaactttattgatttttaagtaaaaaggcctaccaagcagaatttttcatttcgctatttttaaactttttttacctagataaaatcattatttataaaataaaagaaaaattttaaattaaataccatattaaattcagttttgaatacaaaaattgctgtgctattttttatgatttttcataataaaatttttgctttttagaagcttgaaaaaatttcaagctgagcatttttagaataaatttaagagatattgtattttacaacatctttgcttattacttttataaaataaaagaaaaattttaaattaactaacatattaaattcagttttgcatataaaaattaatgcgctagttttttatgattttgcgcattaccaatcgacgaaaacaaacaagtttttgtgacatataataagcctttgcagaaaaataatgaatttgatatgaaacaccataaaagaaagaaaggaaattaataattcaatttattttacaatctgaaggattttttttggatttgcatcaaaatttgtcacagaatcatctgttaaaatgctaaagaaattgggtagaattgcaaaggcaaaattttaaaattgggcaaaaaagcaaaattaattaagaatttttatccttatttttcaattttaaaataaaacatctttcgtccatagtataatcccatcttttggacttttatccttatccgctttctttttatcatataaagtttaatattctctttaaacttacgtttaagaactgaaagtaaatctctccaatttcgttaatagccaagtgtgcacactcgtgctcggcaacttccaacagcccaattgcattcaattgatggtataggcaaagaatccaaatgaatctaaattttttcatagatatttaataaaataatgatttttgttttaaaatccgtcctgaatacgtatgaaattctcgcactctaatttcaaatttttaaaaaagttccaataccttcctttttctgaataagctttcttaactaaatataagcctcaccggaatattccacccattttgctgattttgtttgagaacgatccatctaaaaactaaaatgaaaaatcatttcaattacaataaatctctaagcttaataaagttatttatttagaaaatagaaatttcatatatcaaaacgacattttttaaatttttattagaattccaatattaaggattttaactaagttgttacctttactggctcttttgtacaaatgttcggttttgtgagcactgagataagaaaaaaagtgatatttaaaaatttgtatttttctaaaattaattattaaagcaagcgtataagtcgcagcagataaaccaagctgattctggtccggcgccagtctagtctaggtaatgaaaagaactcactacggtatagtagtgaaatgatctttctctttttaacgggattttatttttaaaaattaaccgaatttaactgtcagatttctcatttattagaaatttt

SEQ ID NO: 7766 - DNA, 907 bp, Heterodera glycines
  misc_feature (144)..(144): n is a, c, g, or t
aaaagaaaaatttaaaataaaatacaatataaaatcaggtttggaatacaaaaattgctgtgctattttttatgatttttcatattaaaatttttgcttttagaagctgaaaaaatttcaagctgagcattttagaaataaatntaagagatattgtattttacaacatctttgcttattacttttataaaataaaagaaaattttaaattaactaacatattaaattcagttttgcatataaaaattaatgcgctagttttttatgattttgcgcattaccaatcgacgaaaacaaacaagtttttgtgacatataataagcctttgcagaaaaataatgaatttgatatgaaacaccataaaagaaagaaaggaaattaataattcaatttattttacaatctgaaggattttttttggatttgcatcaaaatttgtcacagaatcatctgttaaaatgctaaagaaattgggtagaattgcaaaggcaaaatttttgcttgtaatagaagcttgaaaagaatttcaagctaagcatttttagaataaatttaagagatattgtattttacaacatctttgcttattacttttataaaataaaagaaaattttaaattaactaacatattaaattcagttttgcatataaaaattaatgcgctagttttttatgattttgcgcattaccaatcgacgaaaacaaacaagtttttgtgacatataataagcctttgcagaaaaataatgaatttgatatgaaacaccataaaagaaagaaaggaaattaataattcaatttattttacaatctgaaggattttttttggatttgcatcaaaatttgtcacagaatcatctgttaaaatgctaaagaaattgggttgaattgcaaaggcaaaatttt

SEQ ID NO: 7767 - DNA, 1455 bp, Heterodera glycines
  misc_feature (81)..(82): n is a, c, g, or t
  misc_feature (135)..(135): n is a, c, g, or t
aagcgtataagtcgcagcagataacccagctgattctgtccggcgccagtctagtctaggtaatgaaaagaactcactacnnggtatagtagtgaaatgatctttctctttttaacggattttattttaaaaatntaaccgaatttaactgtcagatttctcatttattagaatttttaaaataactattgcttagagttgagcgggaccgggaattttgggcttaaccgggaccgggaccttttctggttgaaaaaccgggactttttgcctgggaaaaccgggaaaaaaccgggactagtcccggtcccggtcaaaaccgggaccttggtactcagttgtactcagttgtccgtgtccaggtcccggtcccgctgcactctactattgctgaattaattcactggtgaaaggcacgaaatccccacaatattttttatttttctgtgaaataacagcaactctttttacataatattcgaataataactgattaaatttgtaagccataataaataaaatgaaaatgattacccacatttgcagtaatttttgtggctctaacatcaaaaataaaaaatcacaccagaaatgattcattaccgaagcatttgtgacagcccattaaactaccaatcactgactaatgcatatattaactggcgaattatccttaactgatgtatgtctactgacggaatgtccattgatcgattgtccattgatgggttaaccgtaaaaataaagttgattttcaaaacattctagttaaaataaattcataaattatcaaatagaattatctttacatttttatgaatgaatatttattccattatttttttataaaataaaacaaattaattaagttttttagcaatttaaagtcagtcaccatagttttaaaagctattttattttaaaaattttgctgacgtattgtcctctagacggattatcgattgacgtagtctttactgacggattattttctaaaggattgtccagatgagattttccaatggcggattgttagagagccgggaaatatcggattcgagcattatcaatcagtcggggttcggagttttcaatttccacctttaaacactcggttaaaaaaatcgactatatttaattaattgattaaattttaattagatgttttgaataatataaaatttattaagttaatttcggaaattgatcaaatattttcttttccatgcataatgatttaaaataataaaatgaaaattataaaattcagataaaaattgattaatcaacagatgaaaggcttgaaaaggtgttgtgaaaattgtaagaaaaattagggccaaaatttgcctcgacaatatcaccaggattttccaatgtcacagcagggtacaaatcatcagatggagcacggaagaattcgaagttactggaataaagattttatgatttaat

SEQ ID NO: 7768 - DNA, 5338 bp, Heterodera glycines
  misc_feature (909)..(909): n is a, c, g, or t
tttctgccgcacattttacaaatgtcaaattgaacctttccttttttgcttctccgaatatccgttttccgtgtatagttttgatttgtttagccaaggtatgtctaaaaaagtttaaaaattttatacaaaatttttaaatcaaaagcaaaacatcaaaaataattaattttttttaaattcttatgttattaatagggattcgttttttcggcacaaaaatcacgaaatagcacctaaaaaggcagaagtgaaaataactgaaaataggcacaaaaaccccgaaataggcaaaaaaaggcattataaaagtcatcgtaaacacaccaaaccaagcggaaaatgcatttttcgtgcttatctgtgcgtatcatgtgcgccaaattttacactttgcctaaaaatcatagcccttcaaattagaaacgataaaaataccaaattaaatttttgtttatactttaattttggcaactttggctcatagaaggaattttttttagcaaatataaattcatgcctggttatagaagatttaattcctatataatgacaattaattaaaataattaaaaaaaagtttacactttattaaaatatgttttaaaaagattaaatattaaaaatataatttaattagttttgaatttgctataaactcacccatttttcccttctccttgtaatcctcataaagatcgtccataaattcggcaaatgtttggacattgttagccaagttatccgagtcccattcgtaagacgaagtcccttcaaaaatggaaaaaccgatgaaaaatgcaaaaattatagcaaataaaaatttcggtttcatgtttctaaaattggaaatataagaaaacattgaagatattggggataactgcagaaaatttctccgcttttttnaaattgtccacttttttattgtcactattaatttttagtcacgttattttcaaaaattttgaaagggttcggccattagttgtaaggccccatatatttttattaggtattgcgtaaaatttcgaaaatttaaaataaagacggtatgtagagtttaatgaaaaaatttttcggcggctccaaggcaaagccggcgccaaagcaggtttattttatatttaatttaaaaaaaataattataaatttggttttatgtttaataataagaataaattttaaaaactaattaaaaaagaaatttctttcaaaatattaagtgagaggattgaaacttgtaaatttgaaaagtcaataaaattttaggaaataaaaaaacgttatttcatggcctaagtccagttgacccttgataaaaaggcaattagattttctctttggccttcttatcactttcttgagcattaaaatgaaatttttccagcaattagctggttttgagtttaatccctttttaattgatcaaggcatattgatgtcccaagctcccgctccaagtttgagaacgcgtaacgcccgcggagatactcgggaaggactggtcgtgaaccggagatcaggccgaaaagagtggggacggggaatcgggattggcttaattttaaaatggtggcttctgctcccgtcatgcccttgttttacgcagtccttctgtcattgtttgccattatgtccacgtggattataatgacaatgattgataaaaattgaagcccaaccaggcaaacgtgtgaatgaatgaatacaatttttgaatgcttataataataatgcattttttctttttcttatgctatttcttaaataaaaatgctctttttcttttccccattatatttcgcttatttaaaatactctttttctttagtgcctaataattatcatccttttgtgctatcctttctttttcttcattctttatgattgtttccatgtgatgtttgcactttcatatattagaattagggcttccttttttaggcaaatgcctaaaattttgcgcacttgatacgcaaagataaggacgaaaaacgcgttttccgcttggtttggggtgtctacgatgacttttataatgcctatttttgcttatttcgtggtttttgtgcctaaattgcctagtttaggctttttgaaaaaaatccataagaaaaatgcaataaaaacgaaaaacacaccccttagaaatgacccaaaaaaaatttcagaaaatataccattaagaattgaaaaaatttaaaaaaaaatgatcccaaaatttaatatatttttttcttaataaaaatttttggtttaaaattttgtccttattaataatttcatttgcaattgaaatatttaagtttttacttgtttaataccaaaaaagcgtaattaaaaattttttttgcctatttttgtacatattttaaggtttttgtgcctatttaatgcctatttcgcgattttttgtgcctaaaaaaggaagccctaattatcatcattgtgtgtatgaattaagaatgtccagcaggagaatatgaccataaatgttagtttcattttatttaaatttctgttttaattttattattttacctttattcattatttatatattataattaaacttattttcaaaaataaattcataattagggcagtcggtttctaaaaaaattaccaaatttcagactccaatattgcattattttcttttattctaataggaaaagttgatcatctgcccagaaacaaaataggaaattacccatttatctttatcagcagggattcttttttatgtaagaaaaatcgcaaaatatgtataaaaaatgctaaaatatgtatgaaatatgtacaaaaagaaccaaatatgtacttaaaatatgtaaataaaattttttaaatggtcttttttggaaaaaatcttcgtaaggggtgaaataactacaaaatgccctaaaaatgacctaaataggcttagaagcaccctttttactatctattttttgaaaaaaacgatttttaggggtatattttcaaaaaaaaatttaaatttttcatatgaaatttctatcacttctcaaaaatcctaaaaatatgtacaaaaaattgtgaaattttgggtttctttgggggacatttaatgaaaatttccttaaaaaatcctcaaaaatttcaaaatatgttcgaaaaaatgcgaaaaagtccaaaatatgtataaaaatatgtacatatgtaatatgtagaaaaatcccgaaatatgtaaaaatatgtaaataaaagtcccttgttcgcaaacacaaaaaagaaagtgttattcctactaattaggctattgagaatccagtaaaaaaacatgtatttacataaaaaaagaatccctgtttatcagtatacgttcagtcggtactatggaaattcaaaaattttccaaattattcttgaagaaattcgaaaccaataatatccactataattgagtttattcgtctttattttatgtatgactcaaaactttattttatactattttggcagtttttagcaactacaaattgcaccactattcataagttttttttacacatattttactggggtcacatttttgaaatttaatttattcgatcttttttttgtacggcattggcatttctgctaatggatttattgagactaatccaatcgatgcaatggaattgcggtggcattattagggcacgaggacacaaaaacaacaaatataaataatccacaaatgttccattcttcgcaagcaattttcagtgtacgtgtgcttttgccaaggcacgtcggccgcagattaaatccaaaaaagacactattattaattaaatggggggggggaagggattttcgccggcgaggcgataaaattttttgtattttttttctgtctttggcattcgtgacgaacgatggacgacgacggcacacttttcacctttctaatgaaccgatttatttctaggaagggagacaaagcttaggtttttgcataagaaaatttcaagaaaaatatattttttaaattttcagcgaatttatgggaaaaattattagtaatttatcataaattttcaaaaatccctaaaaaattgtttaaaaatttttttcatggtattttttttatgaaaaaatttactaaaattaaaaaaaatctcgaactgaaaatatttttaaaataaaatcggtaggtcatgaaaaaacacattccctggacctttcgggatcactaatcatccatcaatccggctaccgttcgttttcgctcaatcccgaaccccttaacccgaactcgaacaaaaaaacgaaaataaacattttcgtatttgtgctctagaggatttaatttatgtctaagttgatgccagaatctgattctacgacccggaaacccttaacacaattttctttgaaaataaaaaaaaatattagaaaatttgggaaatttttggggcattttaccaaaatatttaagcataaatttttatttttaaatgtttaatccattaaatttgtgcctaatgaatgtctgaatggaatgggctgtgccttcagtcacactgagcaaattttcatcattgaccaccggaacaacaacacattgcgaagggcaaaggcaaaaaccaacaacggcggtggcatgggaattttgggccatattcgccaaggtgtgccaacaaaattttgaattttgtattaggtttggtgtccgaattcgtttcaaaaaatccccaaatttttttttgtgaggggggggggctgagaattaataaattaaaaaacaataagtttggaggagtttggcaatgtttgggccaggataaccgaaacaaacccgagttccgtggcatttttcccagaatgtacagaccaggaacctctaaaagtttcctgaccctgttttgtccggtccctagtcacatcatgaggtgtcgatcgatcccatctctttgtcgggtcctaccgcgaaattccgatcaatccgatctcgattcctatttttttccattcccgagctaccccaaaatgcctaactatgtacatatgtattattctcctctaaaagcattggcccattcgccgcaagtgcacgtcaccgcgcattggctgttggcctccagcaaaagtgaaaatgacattgttttggtgggtgttagttactgtacttatttttttaaattgttggcgttttgattgtgccgtcaattcaattttttgcgacaggttggccatttgaaaagcaatgggctgcacaggcgacagcgaagaagcagcagcagcgatgtccgcttcattgagcatcgggcaaaagcgcgtgtgccgtcggtggatgagccaaaggacaattaggggtgggttt

SEQ ID NO: 7769 - DNA, 5453 bp, Heterodera glycines
tgttgtgtcataaggaaatgccacaagaaaataaaagagacaatgaaaatgccaataatgttgtgtcataaggaaatgccacaagaaacaagaagagatgatgaaaatgccaagaatgttgtgccataaggaaatgccaagaaacaagaagtgatgatgaaaatgccaagaatgttgtgccataaggaaatgccaataaacaagaagagatgatatgataagaaatgttgtgccataaggaaatgccacaagaaaatagaagagacaatgaaaatgccaagaatgttgtgccataaggaaatgccacaagaaataagaaaagacgaggaaaatgatagaaatgttgtgacataaaaaatgccaataagcaagaagagatgatgaaaatgccaagaatgttctgccataaagatggcttaggaaaattagcggcggatttcacagccgaacagatagacaatgttaattgtttatcgccaaattcaaattaaaaattaatacttggcggcacaaagcggcgctaaacgacgaatcattcattcatttcccgtgttggcacgatttttaaccgaggacaaatttaaaaaaaaaattaaatcaattcgttcacatatgggtacaaaatttacaaaacatgattagtgggtgtggtaaaaaaaagagaaaaaagtctgtgctctgatggaggtaattaaatttttgaaataatatataaagatagggatatctccttagccgggcggaggtggaaggcacgagaaagacgtagagagaaaaatgaaactgaagagaaaatgtgcgaaaacgagagggcagacagtcacagaaagaagagagaaacggagtttgccaaccaccttgctaattgggggtaattagcacattaaaatacatttaaatcataagtattatcctgttttaataatttctgtcttaataaatattattaatttaagaaatggaacaggaatttgacctaaattaaagctttagtcactttaaccagcatatttaaaagatgcttaatttggttaaacaaggaagttataaaataaattaaatttatgattcaaaaatgataaaaaacaaaatgaaaacctttaaaaaacttaaatcccaaaaacgaacaaaatgaaaagttttaaaataatttaaaattgtactttaacaaatgaagaatttaaaataaaataaaaaaatgtatgcaatatttttgtgaagtttgtctggatcattaaaaacatgctaataatggcaatatacgcaaaagcatatccccggggaaaatcgggaaataaattcttttttctttttctaatgaatgttctgccatttaaaaacgaatgtcaaacatatcacccagttcatctgggttaggccacttttacaacaacttgatcaggtcaatcactacttcatggtgaccggaacaccaaaatacattgaaactcgggaaaaatttcgaaaaaaattcccagggggttgtaaaaatttttctataaaatcagtaggccttatccgatttatccattcccattcaaagttcatctcccttcctcatcaaaattggttataagtgaaagaaattgattgatgaaaatctggctgaacactttatttggaaattgaaattaatttaatttcaaaaaaagtttttctttttgtttatttctcaaaattttggcgcatcaaatcgaagcgtaaatcctccggtcggcctcggcggcggctgttgttgagcacggcccccaccagcaccaacatctcttattggacgacggttctgctcacttttagctggccactaaataaaatatttaattaaaatatattaatttttgcataacctaaaaaagtgcgaaataaaataataattttcatataattattaaatttaaaataatattaaaacaaaattttaattaaaacacaaaaaaatattaatttaactttaacagaatagagaattttaattgtatttttagtgcaaaattcacagttggaaatgtggagggatgtgccggttttgggtcgttgttaaaccatttgctgaccaccgccgtctcggcgtccaatcgttttgacgggttcagcgtgagcagtcgaaaatgggggaaaaagcaattttttttcattaataaaaatgattttttaaaaatttttatataagaatatgcacttgttcagcagctcaaagccgtcatcatcaggcagctcggcggcaaatttcttcctcaactgattgtacggtgtgtccgcaaaaacgccggttttcatcccaggcaattccatacagccgggccaaatttgctcattgggtgtgccgacttcctttgaacaacaaaaaataagtgtaatttattttggtaaaatatattatttttgactaaaaaaattctaaaatgacagacaaatttaaaaaaaaaaattttttttatggatttaaaataaatttgataattttttcagtgtagaatttcattttccatcaaaatttgacaatatttaaacagataccttaaaaattttctgcatttgatcaatttcggtgcggcccggaaacagcggctcaagcttcagaaactcggcaaaaatgcaccccaccgaccacatgtcgacaggcgttgtataaagctgaataaattgaacaattaaaaactaattactagtaatataaagtaattttttccgttacaacgcttggacactcgtcaagaaaaaataataatctcttggcccaaaaaagccatacctttgtgcccagcagcagttcaggcgcacggtaccacagcgtgacaaccaccggcgtgtacggcttgatcggatcgccaaactcacgggccagcccaaagtcgccaatctaaaaaaaataattagattgttttcaaagtttcaataagaaaatttctgaaatatttgccctcttcttattttttagaaaaaaaaatccggaatatgtaaattatatttttgttttcagaaattttcatagtctattctgaaaaaagagcgatagagccaaccaacctttaatattccttgatgggacaacaacaggttggacgtcttcaagtcgcgatggatcacgtactggtcatgcatgtacaaaacgccggcaatcagctggcgaagaagcgttttgacttgcgctttaaacaaaaaaatttgtataaaatttttggtaaaatcttaccaatttttttttggaaaaaaaaaatcttaaaaaacgcacgaattgtccattttttgttccgcgatttcatcagctcaatcaatgccttcacatcgtgctccacaaaatccattaccaagtaaattttgtccatgctcgagccaaccacaacttcctgccgattttaggcgtaattattattttttttttttgcaaaaaatgtagaaagggtgctcacccgaacattgacaatgtttggatgcgctccacacttaagtaacatgtgaatttcgcgcagcgatgtgatcggaaagccctggtgctccttctccattttaagtcgattcaacgccacaatttcatctaaatttttttttttttttggttttgctacacgcctaagcgaggtgaaataccaaaaaattttaatgagtcatttaataattttaaaactcaacctattgaaaagttatataaacaaaaaattgatcccaggttttggtgtaaaattccctgacaaaagttagcaaagcaattgctcacgcccctgatttttttctctcgaaaaattgggcaaaaaacggactaaaaaataatgccctatttttagttatgaattttcatataaaatttaaaattgggacaccaaaaaaatatggtggtcatacccacccgtccgtttgttctgcgcccggtacacaacgccaaaagtgccttccgaaattttgttcaagcactcatactcggccacacttcggcacccggaaatgcccgggtaatagacgggcagcatggacaccaaacggcgctgatatttgtcctccttttggctgagcatttcaggggatagctgcaaaaagtaattttttattttgaaaatgaaatttcggtactttactgttttggagtcgcagggcaaaattttaaaaaaaatcaaaaaaatgccagcaaattcacaaagcacgggcagcattattttgggtacacaaagtcaaactgaattgtgtgaatttgcgcgcttttttttgttgatttttaaaaatctttgttgtgcgaacccaaaaagaaaagtaccggaatttctcatattttggtttcacatcaccgccatttttcacggcgatttatatatatatatataaaaaaaaataagtttttagattgggaagtgtgcacatcaagggtaaccagatttttagcttattttcgagttttaaaagcataaaaaatttgggcagaaattagtatatattaaaaaaaaattttttttaatatatgacaaggtctatcacaaacttcaacccatcaaactcttccaacaaccatttgccctttctcaccaatgccttctcctcctcggtcaactgttcaaactctttgttctcgatcagctcatcatctccaatgtccatgacatcatcctcctctccgtttgtgttcgccccgttcatttcggtgtccaccgtgccagcccgtgaccgaaaatggcgctcatccatgccaaaatctgaaaaattgtggcaaatcagtgtctgggccgcaaatattgggctatttgaatgggaaaaaaaaaattaatttaacgcaacatttcggaaaaaatcaaaaaattttaatggtaaaaatgccaaaatatagtcaatataaaaagttaatgtattggatatttgaaagtgacaaaacaatagaaaaatgtcataattgcatttaaaaaagattgaatgaagtctaaataaggaatttaggtgctaattgtaagactattcatttcgtgtgtattatttttcaaaattttttttatttttatatccgttattttgtattcgaatttcgtcgaaaaaaattttacattacttttttatgatttaaaaattaattttccaattaaaatggaacagcgcacacacacattcttccatgatcagctcctgtgggtcactgctcatcctggtcagtgctgcttggtgttgttgttggggcgattgtcctgttgctgctcctccttctcctcttcttccaccaactgctgctgttcgtttttgctccttttcaccccgttgctgctccttctcctcctcttcatccgacataaatgactcctcttcctcttcatcctcctcctcctccggactgctttcaaatttggaaaatttcttcctcttctccaccgttctcttcctttccttcttcttctcccctttcctttcctcatggtcttgcttcactttctctttgttgccctcattacttccgtctccgcccctccctttgtgactctaga

SEQ ID NO: 7770 - DNA, 3111 bp, Heterodera glycines
  misc_feature (3088)..(3088): n is a, c, g, or t
ttttatcccactaaaattgggccaaataccccacaaacaagaggaaaaaaaataaatttttataagaattttcctcaaaaatgcaagtggtcaaataacccgagatagataagaacatagttattatgtataattaacataaagtatcagtgaagcatattttcatattcaaaaagtataaattcaaagttattttttgaattttatgtttttttcttctttttcaatcatttttctgtttttctgtaaagatgttttgcttttgcatgcaaaaattctttttaataaatagaattttaataaatttaaaaattgtgttttcttagttacaaatgcaatgatttggcggcggcaaagcgcatattgccaaattgggcgctcgaattcaacaaagacatatcgcaaaagcattacacattcattagcgacaaatttgcatcagaaagcggcgacatcaaagcaaattattcaaaatggtttagcgccaacaaattagcagacgaatgcgaactgtcgcacgcatttcgtatggtcagcattggcggaaatgtccagcaaattaatgcggtcaaaacggtgtttgaccagtgtttgttaatgaacacacacgcatccatgttgtacggcgtatatccgcttcatacttctgctcgtaagcctttttcttctttttttctgacaaaaacccgaaaaattgtaaattttttgtcggtttgtccttctaaaaatacttttttattttaaaaaggaaaatctgcttgtaagcccttatcgattttttaccgtaaatcctgtaaatttatggtcgctctcctttttatgctttttaatgaagatttttttttgaaaaacagaaatttctagcaaaataaatattatattttaactcttttaatgatatttttttaattttaaaaataaaattaaatttcgctttttattgaaaaaaaagaaaattccaatctaaattccgttaaccttggattcacaatttcctatttcgggattttttatgggattttttttatggggatagcccaatgttcctttcctggatttctgagattttgtgcgattaaagcgaaaagttaagattaaggaaatcaagaaagtgctaactgaagtatttcaatttttagatatattaaatcagaaaattttttctatacttgtgacgggaatgttttcaacggaattgtccaaaagatcgcactcatctgaatcgttagaatatactttctttgtcatcaaaattttggcatttgtccatcaattgaaagataaaaaaagtgccaaaaataaaattgaaatatgttggaaagttttatccgactcgggagaaactatgacatcaaatgaatccattgatgtgcttaaaccaattttggcagaatttgaggatcaatttggtggcaccaacaaaatgccaaaaaattatcaaaatttgattcaatcatatggcaaatttttaatggaatttttacatttggatgaaaaatttcgaagtgaattttatgaaaggacagcagaacgtgaaaaattgatgaacatttttttgattgttgacaaggaaaaaacatttttggacaaccaattttggaaacattttgatggttggtaaattattaattattatttttatttaatttttattaaatttttaagttcattcaacagaaaataatgttgaagaaggcagcagcaatagcgaaataaaattcatgaaaaaatacaaagaatgtccaaatgtaaagcagcctaattttttggaaaattcagaaatagctaatgagggtaattttgaacataattgcttattaattaaaaaggcagattctgataatttttattctttgataaatgaataatttattggtttcaattttcattaataaaatttaattaaaaatttttaagacaaagaagcacatgccctgatgaaatcgtacattgatttaatgaaaaatgcacaaaatgtgcaaacaaatggacaaatgaacaaattgacagaaaatttggaaacgaatgccgccgtttgggttagcaaagagcaaataaacgaattgctaaaatttgacgaatcaataaatgacaaaagtgaagaatttattgaaaaaattagccaatacaaaatggagtggtacaaaatggcgacaaaaaatggacaaaatgtcgacaattacaaattgttattttcattttacaaatttttaaacacacttattgaggatgatgagttgaagttgaacaaaaattggaatttacatgtgaaaaatttgttgaaatggtcaacaaatttgtttgaaacggtcatattagaaaaatttatatatttaaaataattaaacattaaattagacattgttttgttccacgcatttgagaaattaaaaaaaatcaaaaacaattaaattaattataatgaaaattttaaaattaaaaagggttaatttttcatgaacattcaatgttttattaaaaaaatatatttattaagaaattaattcttcgggttcttccaatttgcgcaaaaaacacctgcgcattgtcagatgaaaaaatggcagccgagtttaagcaaaaaatgaaaaattcgcaaaattggaatgatcaaattcatttccatgcactgacccaattgatcaacaaatttgacgaatttacacatgttttgtgctatggaagtggagaaatttcaaacaatttgatgagggaacgacttagtttgattgtgccagaaaaagcattcggtgccattgaagcatttcatcctgaaataatgggttatcgtaagtaaaagaaagagaaaagtgttaaaaattcattttaatttgcattcttaatggttttaaaatttattatccaaatattcaaatatcatgattaaattataatttacttttttatcatttatattttgctaaaaatggctgagtatttaatttactaaaacattgataataaattttaaaatcttaaaaaatggaaaataaataattgaaaattcttaaaatttttatggtatttattgacatactttgaccaaaattggtaaaaaaaaaatgaaatttctggaaaaatcaattanaatttaatcaaaagatcaaaaat

SEQ ID NO: 7771 - DNA, 3916 bp, Heterodera glycines
ccaaaaattcggcaccattttattcaaaaaattgttgaaattaaaaacaaattttacgacggactccgagcagcagaaatagacgcatcaaaaatggcgcaaaatttatgtttgatcttccatttttacatttttcttacaaataacattgcatatgttgaaatgacagtggatgaaattgacgcatggaaagcaggaaagttcaattaaaattcattaattaattagttttttatgctttttaatgacggcgttgcgattaaatgtagcttagtaattatatatttttatataaaatagcggtttgaaaatcaaattggccactttactgattttcaaaggcctctaaccggggtgagtgagccatctttgggccaaatcactttattttcattctgcattgttcattgattgatctataaatattcgttctatttataaaaatcaattagcccctcacctatattagagctaaaatccaaaaatttaataaatttaaaattaatatttttaaataaaatttaactttgggattttagcatgtgacaatgaagatgaagtgaaatatgcatttgaacaacaacggatcattaccggagttactcatttggcatttttgcagcgtctgtttgaaccaaagcccgaaaatgaatgggttttggccaaaattttggccattcccggggccaggacgcgtctcctcaaaatggtcaatgttcagcaagaaaaacaagaccgcaaagaccaagaacagcatgaacaacgcatttccattcaaacggtgtcattatcatcatcatcatcatcatcatcagaattgaatgttatgaacgaaattatgaagttgtgggacaaatgttttgagaataatattggtaagtatgaaatagtgaaacataatcataattggtgtaataataaaccacaatagtctcactcgacaataatgattttgaaatttttcgatttttgaccattatttttaggaccattttttaaaacaaaattttcccctatccttatactcttagagtgatcaaaagtatatcaaattttatatgaattatattgaaggggggggggggtcagaaaaaaatggcccaaaatgataaaaaataacttttaatttttgatttttggtgttttaccctatttttagcaaattgttggaatttttttgagaataattttttgtacattttgacttttagacacgttcagcaatgtaaagttgttgtcattatataaaaatattttgttcggaggcgaaccaaatattgcattatgccaaattggcgaactgttaaaagcggatgtgatcgtttttgctcagtggatggacgacaaaattgggatggcacggcacacaattgccaacaaacggttggcaaaccaatggaaaaagcaaaaaagaactttatacgatgtttttgatatgatttcagacgaaagcgagctgattcatcggtatgaattaacaattataaaattagaggattaatcaaacgtattttaaaacgaaaactttaacaatttccgaattcatttgacagttcgggattattaaacaattcgaagtaaactctacgaaagtatgtgccaaacccaatccagacagcctggatctcttacaaatttatccctccccaggatcgagcacctaccgaattttaatttttaagatttaattaaacaatattatgaattttagataatgactcttgtatttgtttctttattgttcttagtctctttgcgtatattttctaaggcaaaaattcctttactactttcccagcagatgggctctattttaacgatccatcggggataggctaatgagggagggaggggtgaaccttaatagagtaattaattagttctattattaaaaattatcattattacattattttctaaaattaattatttattatttttttaaattttctcggcttagagtgaagcggtactcaattggccaatggttcctcagcatgaaaaagaattatattgagataaataaaaaaatgtccgatgatcgaaaatttgatttaaatgttgcggaaggatgggataacatttttccaaatttattgaacattgacgcgatgaatattaatcatgaaaagaagaatgagtacaaaaaatggattggccaattgcacaaaaatgcaatcatcaaactgagccgggaggacaatgtttttgcgcaacaattaagaaaaggtgacaaatttaattgatatttgaaatgagtttaatcttttcaaatttatggaagaaaaaaaattaaaattttaaattttatgcatatttaaaaaaaattgttttctttaaaacagagaatttatttttcaaattctttactgttttttctaacaatgagaaagtggaaatattctgaaattttatttatttatgttttatgaaaataatattttttatttattaaattttaaaaaattttaaatttagaatattcttcttctgaaaatgttttatttcgacggtttcttgttgatttggttggagaatcaaaaaatgatgaagaaatttggaaaacaattcaagttgataagtctgatgaaattgtcacagaaaataaattcaataatttaaatttaattgaaaacctttcgccaaaaaagggaaccaaagaaaaaattgtggaaaagtcaaaatgcaaaaataaaaaaccaaaaaagaaaaataaaaacacggagaatattaagaaaaatgaaaacacatccaaaattgaagacgcaattgaatgtgaaaatgaaattgaaccagaacaaattagcgaaattagaaataaagctaattcaaatgaagaaattgatcatattttctggggaaaatcacccaacaattctcaaacaaaatttgatggaataaaactggctaattttgaagatgaaaattttgtggccaaaattttcacacaaatttttgaaaattttcaaaagaatccaggtttatacagttcttttttattttattaatttatatttttaagataattttgtgggtttattttcgtctgctcaactgttacattttggcatttatgccaacgaaatttgtaaccgaataaaactgatcaatcagctgaaagaagcgctgcccgaaattggaattgatcacattgaaaacattgaaaatgaatgggatcaattgaaaagtgtcgatttgtcatcattaaaaaattgtaacaaattaattacgacactttttctgttattaaagcaaattgttgcaaaaatggacaaatttgaagtgccaaatgagcaaattgtaaattcaaatgaagaaaattttgttaaacatttgttaattaggcaaaaatttgccaaatttattgtcgaacagtatgagaagcacaattggtcaaatttaagccaagaaaataaaattggcataatgaaagcaatttttgtggatgaaaacattgatgatgaacttattgagaaatatttgctagaaagtatcaaaatgtttataatgaactatgaaaagtttaattcgcaaatcaaaatgggtaggacataattaaattaattaattatttttatatattttatatttaagataaaaatatttttgaaatatcaaaaccaaatcagtttatggagcaaaacgcaaaattatatttcgaaatttcaaagggatggcaagaaattgattatgatgagaaaacttctaaaactgtgaaaaaattcaataaggtataaaacaaaatttatttgtaaatttatattattttttagtttaaaaatgttatagagcaaaatggatacagtgatgatgatttaactgcaaaatttaagaaaacaattgaattaaagagcatgtttgaacaatgggtaattaacagaggatattttatatttaaaatttaggtttattcaaa

SEQ ID NO: 7772 - DNA, 5850 bp, Heterodera glycines
cgccgatcacctcaaaaatgatggtggaaaatagtgccggatcagtgcatgttccattaacggttgatgtgatcagactatgtgacattgacaatcacttaatgattaatgtgatcagaccgtggcattcattgactaccccatcaactaatttcaatgtgatcagacattgcgattcagccgggccctaattcacccgcggtgattggccaaagatgggtggccgattggctgaatgggcccagaggcgacgaatggacagcggcggaggagcagagaatgttcgaatgggagaaggatcggagaaacgatttgagaaatctgtggcaaaattgggagaagtaaaacaaaataattaggcaattattatttaaaaaatcattttaattcgctcaatttggccatgcttttgcattttgttttgattttgttcactttggcggctgtccatggaatgcccatttgtgcacattaaccggcgattcgccctccaaaatgcgttctgcgatcgattcacaaaagcactttaaaatggtaagtgttgcttaatgtttgcttgtgttttttgttccgacactgattcaatccgctaattacccaccgcttttgcgcacacaatgtttggccgtcctcgccggagcagtgcctgctgtccacgatcaaaatccagcgtcaatttcatcaattgccaaatcaattatgtttagttgctttcactaattagagggcattataatttttttttattaaaagttaattatgcgcaataaaacacaattagtttgttaatgggaaatgttttccaaatttggcggaatcgggcggccgtttaaatgagcaatcattgggaggggaggagaagatcatgcgcgagcgaatccataatcaaacacgcgaatcgactgatcaatcgatcaattaattagtgataattaattaaataattaatgaggctgaaatttaaacgcattaattacacaataataagaaaaagtgtcagatttatcagtttttccatgaaaaatacaataaaaaagttcaatagcattttgtttatcgtcgcaataattttggataattgtcatcactgatcagtcactcatcacaatgttttgggttcgttttccgccttttgtccgctcgccgccttctctttctttgcctttgccatttcctaatcaaaaaatatttatttatgttttttaattttggacattaaaaaagagcgaagtcaatcagagagtgaaatggaaatgccaatttctgggattatcaaaatccgcttaaatgccacagtatttaaatgcccggcacttttgttgaaattacggacaaggaattggcaaaaccaaggagggacaaatgccgtgccaattcctccgatttttcttaattaccttttgttatttttttgctcgtctctttcatcctcttgctcagatcgaacacgagcaatctttccaaaagtttgacctgatcctctggcaaatcaaacacgttttcgtacgcgttgttcgtgtaatacaattggctgaacgcttccaccttgttgttcattttgaagttcaaatcttccaaaaatttgtccgccatttccagcatttcctgtgccgtggtgttcttctgtgccatgtccgcatcctcactgtacagtttcatgtcgtccggtagactgagcaacgcattggtatctgcttgattgtagtggttgtcccacagcagtgactccaattttggcgaaaacaattcgggaagtgtgctgaggctttgcaactccacaatctccagcgcttcttcgccaaatgccaaagtgttgtcgaattttgcaggcgtttttttgccgtgtgccgcctcagtttgcgcctcatcttccgctcttatggccaccgcggaacgccgcgtcaccggtgggtcctccatcgtcattacatccttcaatgacttgtacacatgcccttggccattgtccacgctgttcgatctgctgctcatgctgaacctgcccgaattcgacctgcccgaattggacccggtcaacagcgccgcatgggtcttcatcaactcgtcgatggtgctactgttccttgccctcttctgacttggctccttcacatcgttctttccgccacttttgcttgcttcgttcactttgtccaatgtccccaaattgccctcatcagtttcatctcctgctgactcttccgtcgtttgtttcgcctttgtttgtgccgttttgtcgggactgcccaactttgatttttgcttattgtccgaatttggcatatccgaatttgttccgaagtccgtctgtttattggtgttcgtcttggcccatttatctgagtttggcatgtccaagtttggcatgtccgaattcgttcccaagtccgtctgtttgtccgttctgttcgtgttcgtctccattttgttgtccatttgtgttcccgtctccgttctcccccctcccgcgcttttgcctccgtttcgctcaagcattagcaaattaagcagcgtcgactgccaaaacgacttaaattgaaaatgagaattcaaatccaagttggctttttgcccacttttaagcggtagctgtcaaacacacattttgcaaatggtccgatgtactttgaaatgacctcgggaccactaaacttaattaacttaaataattggaattaaaaaaaaatttctttgctaaatttaatccaataaaaatgatttgaattattggcactctttataaagtttatattaattttttaaatcccctcgagcgaaacttttttgaccacttaaaattttaaactattaaaattttcccaattaattaattgccggtccaaaaaatgacgttttggcgaagagttcatttttcattttgtttttgaaatctttggcccttttgttctttttcatgttctcttcgtccgcgtgccacagtttcttcagcttttctattagcttttcctctgctttcgagcttttcgagcttttccattctttttcgcacttttccttctgttccttacagtaacccatcactttgcttatcgtattctgagggtataccgcaatcagcaggtcgatcttctccgatattgtgttcccttaaaagtgccaaaactatgtattaaacacacaaaaaaaatttttacccggccattctccaaaggttgaccgtgtgaaaaatgtggtcaaaattgtgaaagagccgaaaagtgccaacgagcgaagcgaaaattgtgccattttgaactttaagataactgaaactttggaatttttgccattttcaacggataaagtgaaatagtttggtgatgtgtggagttcgacccgttcctaggtccccagtattttttagtctttttcaaaatgtcttactccagattaggtaggtggtgtacatatataaaatgtaaatgctttcatcggttatcctattaaattactttaattggggagataaaattgtaaaatgatggcatcgctggtgaatctgcctataataaaagccttcccctcctcctccttctcttaattcatataattgcgccaatgccgaaaatggtgacgtgaaatgcgtgggatggcattggcatgaccaatcgagtgattgtaagggtggcgcatgattaagctgaaggcattgccattattaagccgaagccattggcatgattaggctgcaggcattggcatgaaaaactgaggctgctggcgttggcattggcattgctaaggctatgccaatggtgttggcattgatatttttatgtttttttatataatcttaaagcagggctggcatatatgctgcttgattacatttttctgcaaattgaaggggctgattattgtagctttttgggaaaagaaatagcaaaattgatttttattaaaaatttatttaatataatttttattttattttttatataagaaaaattgaaaatgaaaaaattattttaacaattttttatgatatgcaaagtgtgtgcaaataaaatgcaaacgaaaaactggaaaaggaggacaatcgaaaatggacattggaatgcttttgggctttgcttaagtcagtcaaaagtcgaatggaacgacggattttgactcaaaaagtgactcatgattcttaaagactgatcggctttctcaaaaagagtaacactgatcgactttctttctcgctgatcagtcagttgttctgtccattccattctcgagaggttgatttcaaattgatctcgacttatttagtcggcattttgtctattccaattccaatcttcgattgatgagcataattttacggtgcttttctctgattccccctcccctcttttgtccattctgatctcttctctctctcctgtcgtcttcctctctcttcttttatttctgtctctcactttttcttattttctctcgctctctctctctctctctcggtctttctgtctgtctctctctgatcatttctgatcaatttcgctcgttctggtcacttctttgtccgcatatccgcgcttgtccgcgtccgtctcagcgatgcgctgaccgcggaatggggcagccgtcgcgcggcagcaaagggggaagccgaatgcgttggcgaacggttggggctcggcgcgcccgcggacgcggaggcgccgggcggcaaacgccagcggacggagggcgcggaaggcgaaaaaatgggcgccgtggcggagccgggcggagtttgaagggactgctgaaagtgtaaattgaaatatattatttaaaacaattatttttccccctgtttttcaatttttagacccccccccccattttcacccattttgtcgctttgtcagtcgaagtgccggcacttccgctgcgccactgcactttggcactggtcatcttaaagcagcagggaaaagcattggatcagctgattaagcgagtgataataggtgatttttgccaaatgatcagacgtctagggccccccaatttttgccaaatattacgtcaatttttcgccttgcgaaatgcataaatttgtgtgctttccgacccgtttccgcgccgcggtgtccgtcacgtatttgagcagccgttgcctgcgtgggtcgaattcgcgttgaacgcgcgccttgtcgctgggcttggcatttcgccacaaatactggacaaacaggcgcttctgaaagtcaggcaatccgcgcggcgaccgcccgccaaaggcatcgccatgcgccacggacgacgtcggctccgaaccgccagtggccgctgaactggtcgaagctcgtgggtgcagctgctgctgactgggcgggcaccactgctcggctatgccggcgccgctgttgcgagcgcgggacggtgaccggcgctgatccgtcggcgccgccaccaccgcacctgagccctgaccgatcctctgtaatcagaggaaacggcgatttttttagcttttcatcttttcctaattaccgaaataaatattacagtatccgccaataaaattgactaaatcacctcaatcatcgttacaatgcggtggaatgaagtgcatgtgcgccaaaatgagtagaaacggaccacactgaagcacagtacggtaaagagggacccgcagtgcggtaattggctacagtgtgccaataatactgtaacttgccggtaaacatcgcccaaatcgaccgtttcgccccgctgcgcgtcgggcccaaaacggcgaagcatctgttgttgttgctgaaaatgtgatgcggaggacagcggaggggaagtggcagaatcggaggatgtgggaggcacctgggaggaatcacacctaattaattagctaattataattaccgggac

SEQ ID NO: 7773 - DNA, 992 bp, Heterodera glycines
  misc_feature (50)..(50): n is a, c, g, or t
tggggcagcaagttgttctcattagcattccttaatgagtttaattttcncactttaccatcactgccgccctcgaaattggtggcagtgtcggctgcgtgtggtgcgggtcttccaccacaagttcgagctgttcagccattttcggcaccggcaattcgggcaccggcgtcggctcgggcggcggtggactcggcgaaggcggcggccgaggcagcgaaagcggtggcaattcgacggcacgcaccaaaggcaccgccggaggaaacggaaaaacctaaaaaatggaaaataaaacaaaaaaaatatttggcaaaagggtaaagcgagcggacggacagaagcaaatgctaatgaataagcagaaaaaattgcaatttattttaaaaatagtttagttagtggagttaattgtcaataattaatataattaaaataattaaaattaaaaataataaaatgttaattttggtaattaaattaaagaaaacgaacgaacccatttatgttaaacagaagcggggcacgacttcacaatagcaactgaacaaaaggttaataccaattaggcgcacaacacaaacagacaaaggaaaacggtagtaaaatgggcgggttacggtacataaatattacagtaagttaaataaattgttggtattaatacaacacaaaagcgaattaatcaatgtttaaagcaattcttcaaaacaaaaaataacaaaaagtaaaaaaaataagatgatgtaaaggatttgaaagaaaataaataataaaaaacaaagcgaatattcataattaggcgacaaattgagccattaatattcttttgattgttccgactgattgccccaaaggccttctcattagcaaatgattatgctttggtttatggttttaattttagtgagcttatttttcctgtgctcttcctcctctcccattgcttcttctgctgcttatgcgcccgctttgcttttaggtcgtcactt

SEQ ID NO: 7774 - DNA, 4631 bp, Heterodera glycines
  misc_feature (4620)..(4620): n is a, c, g, or t
atcaaactgattccgaacataagcatatagttcagctgcttagggtaagaagaaatgaacatgtgaagtttgactgcgaatggaaatttcaggatgttcttatcagtaccaagatgtcagctgcagaattcagtgcaaagttgcgagaacttactgcttctaaggtataggttgtaccaaatcagtatgtgcttcctccatgcttgtgctttggtttccagtttagcgtgaattatttatgtttaggacagaggcacattgttgccttatctgtcttcggctctaccgttgttgcgtcagtctgtgtgcaatgatgaacaatcggagcttctacaattactttctttgaagtcagacgattgcgttagtccagttaagaaggccgcaaatgtaacaaagaaaacgtcgaaaagcttacaaatatattaaaattatagtcaactgatgttgagcggatgtcaaaagattttgaggaaatttgttcaattcgtgaaaaatgcaatgatggcaagaagcgtcgattgaaaatacgactaggacccgatgtgctagtcaaccgttctttgtacgagttagcagtggatccgcattctaggtgcacggaaatttcatggaccagtaaaacaaagcgttttagtagctacacaattccatccgacggagctagcagcaacttaattccatccgacggagttaagcttgccctttcagcacaggtgattacgaaatatgcttgattgcttttatgatgtttattgtttagcatctgctaaatgaatgttatcataaaatgagcaacatttggtggatcttgtttgtggattatgcagatttctcgcctaatgtgggggttggcttgtcatcccacggggtgggtcgcctgcaggaggaacttgctccggcccaccccacggggtggggcgcccagcgaccaacccctctgtccttggggctagaccacgcccacttggctgggcgacccctataaaagggcagccattttgtctcagtgatcattctcaacaattcatttttgttgtcatgtgggggttatgtgggggttggcttgtcatcccacggggtgggtcgcctgcaggaggaacttgctccggcccaccccacggggtgggtcgcctttcaagtgctccagtttctttaaattttttagattattaggtgatatgcgtatgcttaaagctattttaacagccaatataccaaattaattattgactttattcatctgtcttcattacaactgggttttcattgtagagaatttaccatccgaaggattttcctccgactgtatcatttccatccgacggacagacaactggtacaactattccatccgagggcagacaaacatgcaccgcccgcataacttgaaggaagcggagggagaagtgcagaaagcaatgtaacaacaaaagcaactgtattcttaacactcgtttcacgcttccagtttcatcgctgctgactgttggttggaggtgttccgattgcttccacgctctcaggttggccttggtattgcgaccatcagtcctcgctttgaccgccgagtggacgaacactttaaaacgcgcaaatggacctttggagatcttagaattggcgtcaaagctgggaaaaatggcacaaaggaagtggcagttgtctatggcattagaaacgatttgccattgcctcagcgtccgttaccaagcaaattggttgccttcggccggatttcaatcaggtcatcgacaatagaattgctttacatgcgcttgcctacataacttttgtctgacttttttaccaagcaaattggttgccttcggccggatttcaatcaggtcatcgacaatagaattgctttacatgcgcttgcctacataacttttgtctgacttttagttactttgatcccagtgtgttcacttttatcggactattcaacaaccgtcttcctcaatcatgcacagcaatgctcgacatatccaatgaaaatgtgcacattttgcggcacatcatgcacagtatttggccaacgttcaaagatgccgtcagtgcattgcgcttgacaccgtgttcgtttcgtcttttgcgccgatttgccccgaccatgctttgctgttgtccggggctgcagagcattggtttcaattcggacattttgcccgaattcccggccgatgacagtgccatggtgtcggatggacaagcgttggccaaatggcttttcactccccgtcgggacaatgtgccaaataaccttctgattgaatttgccaaccctgtggtggtgaagtcccaatggtcggctgtcgaagcgatcaaaacggtgcgtaaatccatgaagtgtgatttttatagttttactgttttagcagtttctcgccgctacttcacgtgtttcgttcaaacttacgcttttgaacagacagtctgctgactcttcggaaactgttgtgcccattgttccgttcgagcctttacataacgcggccacgggggagcaattgacactggaacaacaagatgcaaatatctactgcattgagcgccttccgattgggggcgacaaacatgattgggtgacccacatgcttggagagcttaacaagaaaaaccattttaatttgttctttgatgaaagcggcgtttcgctgtgattggctagcatttattgttttatttattcgctgcttttatgtctgtcccatgcacccatcattttttttgatacaataaagttgtcactttgctatcactgttcctgctattgaatggtgaaaaaatccggaatattttgctctacaaaaaagctctttacaccatttaactaccactgtttcataaaaagctatggcccgaaaagtcatctcgaatttccggaccaaagggtcccccctttgggtttcaaattgagaaattttttccttccaaaactgccttaaaatgctttttctgggctattttgggccgctgttcacggaaagctgtatgtgaaattgtagctaacacatatatacttatttttttataatttctaatatttttgatttaaaaaaaatccatagtgtagggtgtagaactgtataaaatgggtgaaattgcacaacgaaggctggttggatggcgctgaatttggacagaaatgcattgatctcatgctggtggctaatgatgcgcagcttcagactcttgaaatggaagtgcgaaagtttttgcggcgcgtgtgcaatgtttgtggcaagttatgcaaatgtgagaaaggagtcaatatacacaagacaaaaacccataagtgattatcatttggtgccttgtttgttgtttttccaccgcacaatatttattgtttttcactttacacgtttataaaatttttcaatttatccatttgtccgcataacattataaatattgcttaatttaaacattgatatttgctaagcttattttcaaaagctaataaataattttgcaattcttcgattcgtgggggtgggccgcctataggcccgtcccacggggtgggtcgcccagcgaccaacccctctgtccttggggctaggccacgcccacttggcactttttaaaattttgccggtgctaattgctaattttgctaatggatgtcgtaaatccccgtcaaaatcctgaaaactacacaattttcgaaagaaaaatgcattcattcgattacataggcaaacaattttgtgttgtggcgtgggtttgcaggagcacagcttgttccccaaatcccattaacgattttaaaaaaatcattaaatttctcagggaatttcgggcaaatttcaaacaatttattacaaatagagctaaaatttttagaccccctaagaatagaccccaaaaattttcagaaaatttttttaaaaggcatttgatcactgatttaattatgatcggtcggtcatttcttaattaattcatttcttcttcagctttggataaaaatcaaatgttttttttaattgctcacccaatgcaattagtgccactaaaaagccaaatgaacacattgttacaattgttgttccaattttcatctttcttctgctgtagcttaaccgccgtggtctccgcaattttatggacataaattctccgaattgaggggtaaattttcaaaaatattcttcaaattcattaaattctattagaatacatctaaaatggctaaatacggtataaaaactcgttttaaaagaaaaaaagctatttttaatgaaaaccaacaaaaaaaaccgaaattcctttttgcttatttttgacataaattaaccaatttctaagaaaatttaaatttaatcaattttttcgacaaaattttgttaaaaaatgtctttttcggaaaattttccagtctttggggtcaaaacggccaatttagctgacgagggccgttctaataggggttttgtagaaaaatgccaaaatatggaggacataaatcgcgaaatatggaaaaatatggatatagaaatccatcttaaaagcttcaaaccaagctaaaaacatgtttttcttgcgtgtccagaaaaaaaatatggatttccatataattggaagccctagtgatcccagtgatcccgngaaatccctgc

SEQ ID NO: 7775 - DNA, 4488 bp, Heterodera glycines
  misc_feature (54)..(54): n is a, c, g, or t
acttaattttctctggaaaaatgtgcacttcgtcattttgacacgaaatccatnatgactgcagtcggctgaacacatcttttaaatgctgaatgtgatcagtgaatgatcggcttgcgacgataatatcgtccaaataagccgtggcaaaattcaagcctgcgagcattttgtccataatagactgaaaaatgctgggcgccgcttttactccgaacggtaaacgttccatggcgaaattgcctttgtgggttgaaagtccgcacaatttctttgactcgtcatccaattccacctgaaagtacgcgtccttgaggtcaatctgcgaaaagaattgtcctccatttaacgtcgcaaaaatatcttcaggaattgggagcgggtgttggtagtcgatcaatgcatcattcaatcccgttgaataatcgatgcaaaggcgggcattcccatccgcctttttcaccaccaaaatgggtgcggcccaatccaaatgttcgacttttcgaatgattccgaggccttccaaccggtccaattcacgttcgatgacttcttttgaatgatgcggcaccggtctggcctttcggtaaattggcgcgactccttccttcagtttgagttgtgccttttctttgatgcaatggcctagtgcatcttcgcaaacacccggaaattctttccttaattccaaaatgtgctttccaatttgatcggtggctctgcaggaatttatcacatgctcgctgatccgctgcttaatgccatccaaaaatccaaatttgtccattgtttggcggctcaacaaattaagcgaaccacgcttggccacgtaaaatggttcattcgcgatcaaaattcctccaaattcaaatgtgccaaagccttttccgatgaatcgaatcggcgttccatcgaaagctcttccaatttcagtgcacttctagatcggtgggctcccagcctccagatgtgagtcttcatcaacgacattcacatccgatccagtgtcgagtgcaaatgcgatcggcttttggttgaaccgaattttggtcctcagtgaatcggcgtcatttttcgggtttaccataccgatttgtaaatgaccaattcgcttgttgcctaaccattttcctttggtcttcaaccgccattgttgcacactttcacattgcttctcaatatgccctgtgaatttgcactttcggcattttgctccaatgaatcggcattcgctgccccaatgatcggcagctccacaacgccagcaattcttgttcgcctgccgtttctctggcactttggcaacttgcattttcggcgaattgttttgctttaccggccgattcacggcgttcacgttcctccaatttgtcggtgcttcaatcgcttttgcctccacaattgttgcctgaaaattaatcaggtcttccacgactccgtcgtaagtgatgttcgccccgtccgctgaaagcttcgacaaaatcctttgacgaagtgccgaatcgttgtgcgacttcaatgccgtcaacaacattagacagttgaattgttctttattcaattcactgaatttgaaatcggccagcaatttacgatgcctgttgataaagctgcgaaaatcttcgccttcgcttctcaccgctttaaggcactcgtagcgatcaatgaagatcgattgcggtcgggcaaataacttttccattcgctggacagtcgcgtcaaaattgaagtcagtcactgctgatggcagcactgaacggctgtactcactgaacgccgcttcgctaagcttgttcatgagtgccttcactttgatttcgtcggcggcatttggcgcggcgcagtcaagcgcaaatttgaagcgcgaaatccattccgtcactcttgccttgtcatcgttttgctcaaatagcataatgtcggggagtgccggaatcgtcgtggccgcaactgctggtctagccgcgttctgtgtttggtaagtcagcaattgttgtaccaattgttgctgttgcgccaatgtgtccattaattgttgaattgtcacgttttggttggccattattgtcgaataaccgctcctggcggaacctcaaccgcctgggtttcttggtttttgtgttgaataaaaccgcgcctggcggaaaccgcaaccgtattggtatcttggttttttttgttgaatttcacgattaaccgcgcctggcggattaatcggatcgacgaatttggcttgttgaaaataaaggtgcctcctggccgaccttttttttgcagacaaattcaataaattgcactcagcaatttattcaaataggcgctgagctcaaatctcacgggcgtcgccaatttgttcggtccccgaaatgtcgaagagacgaacaaataaacaaatttattgaagacaaattaaaatacaaataaatatgtaggaggacggcggaggagacaaattgggaattgtgaacacaaaaatcataaactgaatgaatgaaatgaggggagggcaaatggtcacaaatacaatcaatagaatgtgtctgacagtgaaaggtcagacacaccaaataacaacaaatgaaatgagtgaatgtgtctgactgggaatggtcagacacaacaaataaatggaaatgaaacaaattaaataaataaatgtcttatcgggttccacccgaacagctctcgtgggttctgcccgacgggctcattctgctcagtgatttcttctttttgctgttctgtggcatcaacccaattttgtatctgtgcactcttccgtatgttttaggggcaacttttaattgagtcccattccaattcacccctctgacttcctagtgaatgggtctcgcggtgttaggtcaaacctaaaaaaagaatcaatggggtgaagctaaaaagtatcaatgtgggcaaaccaaaaaatcaatgataataacctttaaatttaattattatttaaatattttttgctgaataagatcataatttagctcaaacttagtcaaattaaacaatcttggtagtgagtgataactctatttgtactctgctatcggcatgtcaggcgaaacaacggcacatattggcgatcatttcgtattatttcgtcatcatttcgaccgtttctcctcaagagcgaatcgctatcagtgcggccttcactttgctggacagtaccactggcttcagagtgcgtactgtttctgccaatgttctgttttgggtccgatcactgcagtttggcattcccaagcgccgcaccggttcgacacacggagaacggcacaaaattcatgatcttcctgatcataagcacacaagacgttccagccaaaaaattacttaattaatgagaaaaatgagaacaaaatagagacagaaaataacaaacataacgccacataaattaaaattatttaaattaacaacaaagtcaacaaaatacatatccaacatcccggcatcctgagaaaaagcgtccctgcttttcaacgaaaggtcggaggtttcgaacggaacagtgcggcacgcctcggcggttccgattcctttttcccgaaccagcccaactgctacgaacaggaggacgatcaatgttcggcgatgggcgatggttaggccgattgctggagtagggccggaagtgcagatttccaaaatcgtgattagcagctctacgagaatcagccatttctcgaagagtcagtgagtctcgaccgactatgattaggatcactttcacacgggttgttgagaccacaattggtttgattgcccgtatcacatcagctagctttccctcttttggtctgatgtgagtggactgatcaaagaagggctggagaaggcttgctgacaagtctccgaccagtacacgcgggtgcagtataatttggtcagccttatgcactgattcagcacgaaccaattccagggtccatgccgattcgtcaaaaattggcttccactcttcttggttcattaaaataatcatttttagagagttccgtcagcactttttccgcctgtattgcgcctgttttgccaatgtttctcttccgccgcttgtcgttgcggtcgctcccgcaaatggccgtgccttcccatcgacggtcaacgtgaccaattcgtcctcctccgcggtgactgtcgttggccaatggcgcaatatgcacaaaataacgagcatccaaagcatggccaacggaggccgaacttttgccagcattgggcccagcagcagccgcatatgagaaggccaaaacggaggaatgaaccagaaatggaatcgaatgaacctgggaagactatgagggaaaaattatgggacggaccgggtttgaaccggcgtctctctggctttccggacaagtgttctatcagccgaactaccgactctgcccattccattaattttgcatgaagggttttccagaaccgagaatcgtaatgacagatatgaatgatattggaggaaactaa

SEQ ID NO: 7776 - DNA, 2388 bp, Heterodera glycines
atcattctttaacaattgtcattggtttcttatcttgataaatttagtttcctcaaatttgggggagggggtgtaaaattgcaaaatttattttattagttgtttctagaaaagatgtactatttccggtcagataattttgtacctttactgttatcaaataatgcttttaatgatttctcttctaaaggatatttgtcaattatttattgaatatagaaattcaatgttatcattggaacagaaaatgaagtaataaaacaaaacacaaaaaaaaattatgttacctcaaaaaatttataacatatctagaagatgtaagcaattaacgagagaaaatctattttaacttacataagttttatataaatttaatttcgcaatttataaaaaaataactataagtataaatgacgattttgatcaccatcaaaagttgtgtttgcatgaattatatcagatttctctgtgctttcaaattcgagattcaaaaagtggtgctaaagacatgaccatgactgtataagcaatgaaaatcatttaaataattagtttcctgcaatatcattaatataaattattacaactcccggctctggaaaaaccttcatgcaaaattaattattttaacaaatgaaataaatatgggaaatgaaaaaattgtttaaaaatatgcaaacacttggcacggtgatgggcagcaaacaagggaaataaaatcaatttaatttttgaaaatatttatgcctttttgcgaccaaaaaatgttgacaaaggcattaattagcacagaacagcaaggaaaaaaagtagtaaatgcctaatacctaaattcaacagcatattggcattttaattttaaacaaattttgttgatggcaattcataaaatgccaatgtttgccaagtcacaaaattctctctctctcacagccgtgccaccctctcaaaattggcgctatttctaccacgcgtgctctcctttccgtgccatcccaaatttggtgggagtgccatcgccaccccattcattacccattaccagtgccaacatccgcttcactgattacaattcaaagttgcatatatatatgtaaaaggagagcaattaaaaataaaatatttatatttaatttctcttaaaactctcatccctcataatgttttgctactcaatcccatcatcaacaatgcccctcattgtgctgctaattgctttcctaataagtgatgtcacttttgcaatggaaaatgaaaagaacggttcgtttaaaaagcattatttgtaagcataaatattattctttaaatatttaaattcacaggaaagccttctgctcctgctgatggtaaagctccttcaccgtcgtcggaacctccgcaaaatggtattttctgatttgtttcacctcgctttttaaaaaatattatttttactggcctccaaaaaataggtttaaaaaatggattaattaaataaacaaacattttttaaaaatttatcggtttaagataagttgctttttatgagccaataaaagtaatggtaaaaataaattataaaaaatatatttattaaattctgcgttgtattcttggcgaaagggccaaaaacccaaatcggcccaaacaaaataatttacttttgtaaaacttttgtatttgtttggatttataatttctggggggggggggcggggttcgtattcactaatcaggaaacggaacttatttgaccaatcccgaagccataacgagaattgacaatgaagaagattaattttttatttgaatttatgactcaaaaattgttaattgaaaacattagaacatttccaatgtgctttttgaattaatttttttggcttgataaaacgcaattgattttataaagtgaattttttatttttaaattcgacaattggggcttttgagatgggcagaatacggtcagggtcgttttcgtactagctggacttttgaaatgggtagaataggcatgcagtccaaaaaataaaactaataggacaaacagtgaaattccgcgccaagcaaactaacgttttaatggctaaatattttcttgccttggtaaaaccttttatttaagaaaatttctcagaaagttcttttgaaactccgaaagcaccgcttaaaggggacgacgaagactcatcacccaagtgccccggggctcccctaaaagcaacacaaagtaagcacaattgttaaaaatggagcagtaaataaaacacgcattaattaggtatttattatttattccgattaaataatatttaaaccaatggtttattggtgccattagcaatgaatgagcagcataataaaagtatttgttttaagagccttcagttgaatcagaaaaag

SEQ ID NO: 7777 - DNA, 1487 bp, Heterodera glycines
  misc_feature (13)..(13): n is a, c, g, or t
agagcactaaatnttgctatcaaattacttttggatggtggtgctacgtcttgaattagttgaaaaatagatcaccataatatgatcaattttaatcattttcccttgaaatatgtactattgaaaacagtcatttttgagttgtccaatttttcatcctctcttgctctgtgggtataagacgtaagcctaccattcaaaaggcaaatcggttgcaaattgagtgatctttccaatgggccaactcaaaatttctaaaaaaatataccaaccccctaggaattttttgaatatttttccgtagccattttcggggtttcaaatcaccatgaagaagtaatctgatcaagttgacgcaaaagacttttttatcagcatcaaaaattagctcagcagaatttttttcagaatttttccctgtataaaattgagttactgtaggataaatatttgttaattttggatcagaattttgaccatctctcacctggttgaccatagcacatacatttcatatttaattcgggatttttttgcgaatgtgaagctgacatatgagctattaaatgaatatttgcccgaaacgcatcatttattaccgtttgtgaacgcagacaaaaaaaacttatagcccaaaaacttgggctggcaaccgaaacgtcgaccaacgccgaaacgacccttttaattcggcggtgccgataggcttcgccgggggaattttgaaatttccgtcactcgtaattgcgtccagtcctgaccccggtgctaggacgaagttacaaaagtatcaatgattgaaaaatatttaaatttaattattattttattttatttgctaaaaatacgtcataatttagcttaaagttagtcaaattaattaaatttggtattggaattagtgagtcctaaatttttcggaattttttgcttacaactttttgtaaatgtttactagattaaaaaaaaaattatactatagtagaggataggtagagctctacctttcaataccaagattaattaatttgactaagtttaagctaaattatgatttggccaaaataattgaaattaaacttttgtctttgtgtctttacacttcgccattcccccggctttctgctggccattttgtgggccatttcaataaattagctgcccaatgggaggctatcatttggaagatggttgaccacctgttgctgctggcagtgttagggtgaaaaatgggcgaaataattgtcgaccgttgtaaaaggacggagaatcattcgtccaaaggccaaaaaagcattttgttggattggattggaagctaatccaaacagcaacgcctctgcagataggagaaactgaagctattatcggacgggggacagcagctcctaaatcctttacaaaattaagggaaatttcgaaaaatttaaaatttatttttttgggcaaaatatttttaaaatttaccgcccccccccccccccccc

SEQ ID NO: 7778 - DNA, 3565 bp, Heterodera glycines
cccccccccccccctcaaaaaatataaatttttgtttatatcagtgtcgacacaaaatgaaactgttgttctacagcctgctgttcactgttttgctgctgtttgctgactatgcgtttggatacggtaggtgaactacggtagggcagcggagggcccaacatttattactgtagatttaaaagggctaacaatgtactgtatttcaggaaaacagcccaaaactgggcttgagagacgccctcaatggggcctggagttgaatagcaaagccgacggtaaacttgggcagaacaaattctgggaccgctacgggcgtcccgcgtcgcacggcatttggcacggttcggtggcccttctgacgcgaaatgggcacgagtgggcacgtgccaaacagcaatttggacgcattggccatggcggcggtttcaatggacagccgggcaaagggacacgcgaaaacgagatggagaagtacaagcaggagcaggcggaaaagcagaagaaaaagggtggcggcagcactgatcggaaaagtgattgatgtcatggaaactcataaaaagacttaagctaggcctaagctttaggcttacgcttaaaaatcaggctttattttgtaaaatttttattgtacgattggccattgactcaactgattagggttggttgataccgtacccgctaccatcaaaagcacccatttttttctctactctgaactcgataaaaacgttctcgagatgaccaaacacaatcacttattttaactttttagtttggtcagagaatttatttatcaacacattaaattccagtaaataattatagctttacatttatttatttttttgctaacattgcccttttccgtcgtcctcgtcttcgtcctcctcattttgcattccgattggcacaaatgccaaattcgttggcactttcaaatgcgcaatcactttgccctccgtttccaacagaaattcaaaattgaactcacccttacctttaatatgagattaaatttattaaataagaaaataaatttaaaaattcactctgaaattttaaattattttaaaatataaattttaaattgtttttttattaaatatgtattgacattcttacagcgaaaaggtccacaaaagggatgccgaatattcgtagaataattatttaactaatcatggaaattcattgatttattataccaaaaataaaaaaatgcataaataaagtaaaagtgtttgaaagattctttcaaaaatgataaataaatattggtaatgatcagtgatcaatcgcttttccttccctttttaatcggtcaaattatcgtcctcctcctgtgccattttttgctgttgaaaatattccatacattttgcatccaactgaatgaaattaattagttaattaaatccaaaaatcgctaaaacaaatagaggacgtcgctaaatcattcaatgttttcgaagccgggaattttagctcagcccaattttaatcaaattttaattaaataatagagaaatctttggccctattaattatataaagaaactgaaatttggttgtatctgaaaaagttatgaaggctgtcatattttatggtcattaaataaaaagaaattatttattgctcaatgcccatattgtttaatttgattaagttgtgctaattttcccggcgcggaccctaaaaatcttatttttcttgagaaatttttgcttcaaatcgctaaatttggtcattttttggacaaaatttgttaagtatttgaattaaaaattataaaaattttccccggcggcgcctatcggcaccgccggacctcccccgccatgttttcaaaaattttgaaaaaacgcgccgcaaaaaaaaggtaaaatttttgatgaaaatcattgaataattttttaaagcaaatatgtatttaaatagatcaaaaaattttttagtcaccttttacttggttaggaatttaaaatttagcctattaaaatatttagaaaattttttattattttttatgttttttccgacttccgaattccgatttccgacgtttttggggtcggaattccgatttccgacttccgaaaaatttttgggcctcggaattccgatttccgaaaaatttggacccccggaattccgatttccgaaaatttttggggcctcggaatgcaatccctgagctgcacagaactgcttttcatttatggaaacagtaacacgttaattacggataatttttaattatcgaaataccaaattatcgagtttttgccattttattttatttttcataccttttttggttttggttcgggaaataatagaaactatacctcaataaaaaaagttcccgtgaacgggaatttagaaagagcgagacgggaatgggattcccggcttttcccattttaattaaaattctgataaaatcaaaagtagagtaaaaatgaggatgagtatcaaaaaaagggcgcctctatttttggagaaaggtacaaaatagagattctagtgacgaatagtgattttaaaataatgggagtttgaggcgcgattatcatactctttctaagtatagtaacctttcatttagtgtccgcaaccttcgttgtcagattggtggagctacttttgtttttgatgcggatgtattgccttcagatcagtttatgatcttgtaagttaaaataataattggaaattttttttctcaataaaaaaatttataaattattatacatacttgcaatttttcaaatggaatttttttttatttgctccaattcaaaaaagttatggccattgaactataaaactttctcgaacattttgttattttggtgcatcagtgtgataaattcctaaatatctcagtcctcgtcataaaatattgtttaagaatgggaatgaacatcatgttactaaatgcaatcaacgttgatttgcctaaccgcagtgcatttgttactggtggtcgatcaaagccatttgtaactgaagtaattttttatttgatttttgctgtaaatttattacctgcgccagttttaataatttttagttttaatttaaaagaaaattttcaggaaagatacacaaaccgatgggctactgttttaaaaattgaaacacttcaggaataccatggtatatagaaaattctcatttcattattacattcctcaaaatgagttccataaaatttatctaccattttacacctaattgaataagttttataaaattaaaaagagacaattttctacaaaaatgtgtcgtaatataatttttttctttttctttagaatggtttttttcttttttaatatattttttcatcggaacccttttttgtgtttttaattaagtttattcgtgatttctctataatttgcgccctttctcattgctttttttttattaagccattgctcgtgccgctcatcaaaattactcctttcacggttttacggatgatgttcgtttttatcaacaatttttgatgagacgagagacggagcagttctacaaacaatcgtaata

SEQ ID NO: 7779 - DNA, 1946 bp, Heterodera glycines
aaaaattttggacccccggaattccgatttccgaaaatttttgggggctcggaattcgattttccgaaaattttggggccctcggaatgccatccctgatatgtatgtatgtatattggttccgaattgccaccatgtataattgtcatattatcactaataaaagaaataaaactaatcatttgacttccgcttatttcctcttcaaaaaccccatggaattctgtgctcagcagatgaaaaaaaactataaatctttcaaaaatagctgaatttggtgttttctcaatgttttttctcaattgtcaatatttgctctttttgcatttaaagatcccaagaccataagctttcggttgacaccaagaatatagacattgatcaagtaagaagatagtaatggcctctttgctttaagcgacagagtttttggtagattattttttttaataacaggttttcacggtttacatgtaatattagggattatctttatttttattaattttttcgtcagaaaaataaaagtttaaatttttttcaccatattggttttgaattttctattatttattgacattttgtggatgtagtttggctttttcttttttttttatttattgatatgaactgaggatgatcacattggtcttggggagtatgagttggcttacaaattagtgcaagttcggtttttattaccaaaataagtgctaaaatgtgaacatttatatgataaaactacttaagtgatataacggaaaaaataagtcgaaaaatgcattaccgtatttgctaattattcttatggggaatggtaaaaaaactgaatgcatgtgacaggattcgaacctgcgcgggaaagatccctttgtgacaggagcacaacggcttaaccactcggccacacatgcggcgataccgtaggcacttcggcatatggtaacaatttaatggaccaattagcaaaaaaaaagaaaaaaattggtgataaaatgattgagttgagaggaaagcaagcgtttgtgatgatgacaaattaccgatggacaacattcgtcaaattcacacatcactcttttttaattgatgtgtatacatacagccacggcaaaaagtattgcagcaaaaaaattttttttgaaaaatccgattttatctaaaatgaatgggtggggaaaggtcttaattatgcaaaagaaacatcaattagtgcgctaataaatatccaaaaatcggcctgataactccttttgtcgacgagaaaattgctcatgatcaaaacatcgcaccttttgggtgggaaaaagtaatgcagcaaatgtttaatcgacccaaactcaattttatgaacgtggggggcccaactgacgggttccgtgctaggcgtttcgtaacgccattttaacaattttttcgacaaaacatggcataacttggcttaaaggcaataaaattttacattcttggtaccatttaatagcccaccatttttcttattagcctgcgaaattaaaagaaattgtcagctttagaaaaagtagtatgaaaataagtactatttcttccataacttatgttaaattcatacttttgcttttttattaaattaaaatttaattctcgtggaaatttacgatttattatgccaaaaataaaataaaagcatgcataaataagtaaaagtgagacaatggcattcgaatttcggaattgaaagctttcaaaaatgataaataaatattggtaatgatcagagttttccttcccttttaatctgtcacggcaacagctttcttacggcggacccccagtggtttaggaagcgcaattccattcttcttcagcgtgtagacctttccagcgattttgactatggtgtccttcttgctcttcaagtcgtacccactaattatcctgaaataaaattgacatcatcagcgtgg

SEQ ID NO: 7780 - DNA, 4272 bp, Heterodera glycines
aatcgatcagtgcgcttttgctggcgctcgaccactcattgaccatccctttttcttggtccaaatcaccgcttccgatcttttggccaatgacagcaaaacaactgatcaaagcaatgaaacgaaattatttggcattacaaaagtcagttttaacgcataaaataaagaagcatttccaaatttgaaacgaatttattacttaatgaatttttacgctttttctccaattatcaaaacccaaaacaggtggcagtgattattcgaccaaaaaagggatgtgtaaacgaccgaaaggtttatttggcggaagcctccgctgatcagcaaaatgatgctcttcccgccacatttgcggatggatcttcagaaactggcgctattctttcagggaaaaggtcgtttttcaaacaaaaaatgcattaaaatattaaatttttattaattaaatttttaagtgtatttattatttttcatatttttgttccattttagagctgttgaaatcgtccgaagtacaaaagaaactgcaaagatcagtttgaatcatatcgacgcgcaaatttcaatcatttccattggaaatcttttcttcaatgtttttgtccgtcttcgttctccaaaaatagaaaatgtaaaagtaaatgcacaattatatacagtaattaatagtaattaattccttttattgcaggcatttcagtcatcgctttgtgtccaaaattgtccggacggcgcaaaaatggacaaatattcggcatttttaaacagcaataaagaaaataaaggtgtctatataattttttaattttttgaattattaaaaaattagaattatgctcaaaaatcgtcggtgaactgacagcaaaagatggcgaagataaaagtgccaaccgacgacacaattggatcagttccatctgtgaaaaggatttggcaaaagcatcggcggcaaaagcaacaaaaaatgcttttccaacgacgcattggcttaattcattgatttacgctgctacggaaattgaagttgcttctgtaaatggccaattttacaagtaaaataaaaatctagttaataattaatggacaatgcaaatttttcgacagaaattagaaattatcaataggaaaattttacaattaattacagaagagcattgatcagtctgatcacttttacatcgtattttgaaactgatcattgtcaatttttaggaaacaaagaccattttattacaaaaggccccaattatttttcactttgattctttaaattctataaataaactatttgtgaaaaatttataattttttagcgatagtagacaaacgatcgacaaaatctttgatggtgatcctttgtccaagaatgacaaagtgtcgcctttcattgattctgggcgtttatctgacaaaaaagcgatcaatggccatcaaaacaaagccaaagaatttgaatggcttccccattcgaagcacaaatatttttcttcaaaggcatacgacaagtcattatcattggcattgccatctcttctcatattcttgcaaatttgttttattatttattatgtctattaatttattttaacaaatttattttatgaatcttttgcaaatatttattattatttttcaaaaataaatattttttctttaaaaagtcctcttctgtctcaaagctccgtttttcgttcatattaaaggtgaagaaaaagtaaattttatcaattgagaaattttttatttgaaaattatttttaaattttccataaatttccatacctaattaaaaatgataatgcgaaaaaatataccaacagaaaaagacaaagtattttttaaattatgtctaaaaagcttcaactaacataatttattaagcccatctgccgaaacacaacccgaaaatacattaattaatttatggacaaaacattttttctactctaatgtccttttcgattagcaaagtaccacaaataaagaataattacaaaaagatttaaaagtacaaagatcgattttcattttcaaaggggaattgtactcgaaacattcatgttcacgtttctgaccacgttcacttgaacatttccgattctgttcagccattttccgatcagaggccattccgcgaactgtttgcgaaacgcgaggcgataatccttgctgaatttgaattgaattttcaattgctgaattttaattgccattttattttcccgtcgcttttccctttgccccggcacctgaaaatgaaaagtaacggcgcattgctactggcggcaacgcaagtcaaaagggcgaggattgatggaaaaacatggaaggtgaagaagggctgtgatggcatggaagaagcgagcaaaacaaagacacaaatgaaaaagtaagagccgacaacgaaaagcataatggcggacagcgacttgaacaagcgatgtttgtccatttcggagcctttagtaaaaagacgacaattaattattaattaaataattaggaagcaaaattaggcaaatgcctacattttcaggaagtgttaatgctaaaataagcaagaaaaacaattttcacttagttttgagcttatatatttataaaaaattttgtgcctaaaattgactattaattaattatttaattaattactaatttaatgcgatttaacgctggatttacggaccactcatttttttccaacggaaaacgagcacaattgcaaccaaaatataaaataagaaggaagtgcagtcaatcagcagcccatttcgcaacgctgtttccgccgccatgccaaaggcgaacgcgtcactgttagtgcacaaaacgggcctaataaaaaacaataattaattaattaattgattgatttaattgaccaatccggatatgtaaaaagtgcccaattagcagccatcacaaccatataaatgctgtaaccgaaagtgacgaaaagcatcggagagatgtaaagaaggagatgtttctccaaaaggttgcaactaattgatccattaattggttaataattacacattaattatgcaaaattaccgtaacggaaagagaacggcgattaatcggtcgaagccgacaaagaaaacaatccaaacggaggagaaaatgctcaaatttggcagaagttggaggaagtaacaggtgaaaagggagatgaagttgtggccagacaaagtgacgacaaaagtgacggagaaagtgagcaaagaaacgatgtcgagcaaagaaccaatggccaaaagggtggagcaagtggagcggagactccttggaattcgggggggggggggtacaatgttttaatgagacacggaaaaaccaaaatatacatacataaataatgacatcaaagtcccaattccgaaaatggaaaaatatggccaaagagtctcaaattcggtattaattaaaaaaaaatttctatattaatgtatttccaaaaatgaaatttctggatacaacaaaaaaaggtttcttgattcattttagccgggatgttttaaatgacatttgacaaaggcatcttttgctaattatgcaattaatatttaaaattgacaaaattaacagacttctgacaaatgattgtgtgcaaaagggcgccgttgaagaacaaaccgggcaaagaaagaagccaccggaaaagcgaggaaaagaacaactccacggagaacactccatggccaaaccgagcaaatgcccaaagttaacgataaccaataattgaattaattaattaaattattttaccgggttttccatggaataattttgaaatgacatttaaatggaaaataaattgacaaatgaattctgtcttttttgaaattgacgctaccttttgaagtggttaaactttgcttacggtttgtgctaatcacgcaattttgttgattcttggaactttattgtaataattgcgtgattcgaacaaaatttcaaaaaagaaattaaataatttggtacaaattttttcagcttttactttttccatacaatatgttaaaaagacgtaaattaattaaggtgtaatgaaatttaaaaagtatatgttctgattttttaaattttcttatttttgtgttaattcaatacgatctttcatatttttactaaaagttttaaatttttgaatgttttaagaaaacatttttacatgcttacgaaataatcatcatttatctaaaatattattattttagcttaattcttttaaatttgaccaatttttcatatttttcataatga

SEQ ID NO: 7781 - DNA, 2745 bp, Heterodera glycines
  misc_feature (2715)..(2716): n is a, c, g, or t
  misc_feature (2735)..(2735): n is a, c, g, or t
accaaaatgggagtcccaggttcgagtccagttcatgctgtagctgtattttgatatttttaagagaaaaataagaaaagtcaccaaataattttaaaaattgtttcaaaattttaaacatttatttgccacttgtaatgaaaaaaccatcaatcctcgatcagtcaacgatatcgacgtcggcatcttgatcactttcttcattcgttttgtgttcctccgcttgctcccgtcgttcctcctccgcttaattagttggataacatttttaaatccccttctgtcaacccaccagattcaattcgttcagataaatatttttgttttttatccttataaaactgattttcttgctgtttttattattatctcttttcttttgccaatttgtgttctttttttccggtccgtcccttccgctgacatttgccataaaacactgaacaattcgaaaataaaaataatttcttttcgtctccctttttcgattgttctcattatcagcactttgataagcaatggattcggtttgaggaaaaaaagaacgttttatttagtcaacattttcaaagtgttgcattattcgaccgattgagaaaggactaaattcagaaaaatataattattgtgaaaaataaatattctccaattaattgttcgttttacccattgtttttccgatttctgtccaaattaagcaaataaatgtctctcaacaaagaaaaatatttaaagtaaattgcgcattttttgcgttggttattatttccaagcaaaaatgttgccttcgtaattttctttttccatttgcttacttagaaatgcttttccgtcataaacttttcgttttgctaaattctgtcgcacttttctcagtgatttcctccgctcatttgcaaagtcattgttcgtccggttggttttcgcacaaaggcaattgttacaccgtaagagctaattacccaattaacattttttaaataatatttgtgtttatttaaattccctcctttttaaggtgatcgccgggggatggagtgcaaaaagtgcaagtgcaaactgttcaattgcaaatgcgacactaatcaccccaaaaattatcgaatcggacgaagaggaagccttcctcagaggcaattaaactgtttttcccaagaaaattaaatcaaatattttcagatttaatttcatttaatgcacccaaaaagaatggccaaattttggtgggagaaaacattgacatttttatatgcagaaaagcaatgggaaaatattaacacaattttaatgtgtcactttattaaataggtataaaaagtaattttaattgattaattggactgaaaagagagcaaaatcattcatttccataaattatgaagatccgtaaataaacaaagtgagaaatcgaagaaaggacaacaacaaatgaatgaacggagagagaagagagtgagtgatcaatcttttgtcaatcacccactgatcagtccgatttaattggccaaaaagtgtcggcgtttgttcacttcgccgcctgctgttgccgactttgcaaaatttctttccgcgatgcttcctatgggcaacagaaaaaactttaattaaaagtgaaatgaaaaagcgaaaatagcgccgccctttccttttgaattggcgcggtaaaatagagtggaattaatagggaattactcacaattagtcatttcatacaaaaggcacccccccccactcatttgcaaatgtccctaaatgatggggggggggggtctaaaagaggagagagagggtgtcgcgacaaagaattggttaatccaaattttatttttcgccatcgcctggacctcttttctcctcccttaaagtatgaatcattttaatgggaattgaattaaaccatgggaaaggtgccaagtttggcgcttattggcccacctgaagcagtgccgtgtcaatgccatccgtcggaaggtgaacatagcgaatgacggagccacggacgaagcaatttttcaccgaaatcatgtggggatgcctgcgggggaagttgtttaattcccataggtaattcctttaagtgcttatggcttttcatttaaatttgtaaatttgaacggattttgcacaaaaaaaggaattttatgaaatgtaatttgttaaacgtaaaaattgaaaatcatctgcacatattctggggtaatggcgttttcccagccccaactcgttttcggagtttgaggcaaaaattgactttttataatattcaatttgctggtccctttttacctgtcaacgtccgtcaccgaaatgtcgttgattttcatgttcaaatattggtctacagaatgtaaagtgccacaaatactgaaaagaatttggaatgaaatcactgttttttaattccacctgaggtcgtttttcagctcgacgatcacttctctgccgaccatcgacttgaaaaaggagaagaaaagcatttgccaagttacgatttaaatgcctttgttgtgaaaaatggttattatgatcatttaaaatggaaaaataaatcgcaaattaaacaaaaataaataaataaatgaaaagagcaagaaatttgctttattaaatcaaaattgaaaaaaacaaaataaagaacccaaaaacaaaagcattatcaacctttttaggtcattcgtcgtcacctttccaccaattcatttccaaataataagnngcaccggtgaaaccgacangagacaatgg

SEQ ID NO: 7782 - DNA, 1086 bp, Heterodera glycines
tttcaccgaaatcatgtggggatgccgcgggggaagtgtttaattccatagggtattcctttaagtgcttatggctttcatttaaattgtaaattgaacggatttgcacaaaaaaaggaattttatgaaatgtaattctgttaaacgtacaaattgaaaatcatctgcacatattctggggtaatggcgttttcccagccccaactgttttcggagtttgaggcaaaaattgactttttataatattcaatttgctggtccctttttacctgtcaacgtccgtcaccgaaatgtcgttgattttcatgttcaaatattggtctacagaatgtaaagtgccacaaatactgaaaagaacaataattaaattataacaatggttcaattctaaaattaaatataatttggaatgaaatcactgttttttaattccacctgaggtcgtttttcagctcgacgatcacttctctgccgaccatcgacttgaaaaaggagaagaaaagcatttgccaagtcacgatttaaatgcctttgttgtgaaaaatgtttattatgatcatttaaaatggaaaaataaatcgcaaattaaacaaaaataaataaatagatgaaaagagcaagaaatttgctttattaaatcaaaattgaaaaaaacaaaataaagaacccaaaaacaaaagcattatcaccttttaggtcattcgtcgtcacctttccaccaattcatttccaaataataaggcaccggtgaaccgacagagacaatggccaaaagaattcgcttccgaacctcaaaattaaaacaagaaaaaattaccgccgaaaatttttggcggaaaatcaatgcccacgtggaactaaaccatctgacaattcccgtcgataattccgattatgctaatgccgaacagtctcgtgtccccacctgtgtgctcgccctgctcacgccgatcaaattgagtggcctcagcggcggcactccgtcgttggcattggcgtgcgtacatatgaccatgaactcagagtgctgctcaggcggcggtctccgataaacaaatagtcacaaccgaacttggcaccgtcggc

SEQ ID NO: 7783 - DNA, 3937 bp, Heterodera glycines
tttctttctttctctctttttctctctctctctttctctctctctttcctatcctctcatttctctctctttatctctctctctctctctgtcatctctcagtcttcccctctttttctatcgttaccatttcccccttctcaatcgctgtttatcttccactctctctttaattgtcttcttgctctttctcgtttatcttctctttctctctatctcttcttctctttctctctcagtctctctctctctctccccttccttcctgaatctctgcattctgtcccctctctcgcttattttttcatctctctctatagttcattcagtcctgcgtgacaaccgcacgcgttacccactctacccctccccacccgagccgacagagaaacatacactgcactctctcctctacccatcctttctctattagtctccaattatattttttaattttctgtttctttccctctattaaaacaaaacaccactttaggcacaaattcaaaagagcaaaaagtgggcggagcttcgcctcgcttaatatattaggggaatatattaggggatttctaattaatgcatttttgaaaatctccaaaaagaatggccaattaattaattatttgtttaagacacatttattattttttaggaaatattggttcgcaagcaaaataatttgttgagaaatttttcaaaatagaattaaatttagcactttttgaaccagaaccccaaataaaaaatagaggtgcgccgtgaaaaacccccaaaaatggctattaataaaaaaagctaccaaatactcaaaaagtgttaaatttatggatgatcttgggttttctatgtgttaattttactatttaaaattttatttatgtcttcaaagcgcaatatttataacaaaattgattgaaaattccaaaatttttcccggctgcgcctatcggcaccacttcaaaatttgaccaaataattagtgaaatcagcaacaatcgttgggtccatttgagaacaaaataaacaatcgatctttgaggaaaataagccaaatgataattaatatttttaaaaaaagttctcagactttttcaataagacttatgcgcaatgttaaaaaaattaaaaataattgttaacactggcaaaagcagacgttgttttatcaatttttgggaggaatactttcttatttatataatttttttaaaattttcattagattccccaaaagacgggtccccaagttgcaaatccccaaaagtcgggtaatccgtggtggtcgtaaattggtcgtgtgagtatttatgaataatttgacagaaaaaacgaaaggacataaaattattaagaaaaaacggaaaatccacaaattcattaatcttccaaatcgatcaaaggccaattggccaattccattttttgcgtcggcctctgtgccgacattcccggagtcgattgatttctcggcggaggaagttgagatgacggacacagcatcctcgtcctcttcggcatcggtcgacaacaaagctcttaggaaatgaagtcgaactgcttgttggttggtcaaatgaacgagacgtccattccgtcgaggaccgcctctctgagagcgaacagggcctgtcgagagcttatccaatttctctctttctctgttcagtccacccgaccaatgcctcttgttaacggcatattggccgatttgttgacaaagcaatgtacgcagttgaccggacgaaacccgtttttttggcgacagtgaaccggcagaaagcgggggcacggcagggcgacgaggcgaggcggacggaggacgacgaggaggagacggagttgacaggcgtctggcggaacgaaccggcgaggggaaaagcagacggtgacttggcgggcggccgatttagaggtgacggcgtcgacgggcgcatgacgggacagaccggcgccggtgagggtgaaagctgacggcggcggtggggcgacaaaggaggggcaggccgagttggacggcgaatcggagagcggttgggcactgcggagtaggtcggcgagagtgtcgtctttccgcttgtgccaaatcgttctttgcttgtttaagcgccgcttttttcttgggcaaactcataattggtggtgatgagaataagggaaagttggaaggaattttggaataaaattcggagaaatgaacggcttaaataggctccgaccggtaaatcggccgaataacaacttaatcataacagtgcttgaacgaattatgggaaaggtcgaaggtggcggaatgatcggaggtgacgagtcactgagaatgagcaaccgccgaaaggtgaattggcctccaattgcagaataatttgtaaattccaatcgctttgcaaataaatgagtgaatgaaaggtcgaatatcaaaaagcgacgtaaaaaattggcggaaattgtgctgactgatcagccctcccctcaacgaatggcatggcgagagacgtccaaggtgccaagaaaggtcaaaattataatcggtgcagcagattaggcacttctcagggtttgcaaatgctgatgcgaatttcgaatttcggcattggcggttgttttttgctgagtcataggcaggcaggcacaatgaacatgattgccgtccgagagggcaatcgaggtggttggcaccggtgccatttgtaaattgtatttcgttcgggataacattagggattttttggagaaaaattaaagaaattcaaaaaaaaccgaaaaatcgaaataaaccgaaaaattttcttcggttttttcgatttcggttttttcggttttttaaccgaaaccgttcgaccgaccctcttgtccggtctttacaagaaattccttttaaatttgtgatttaaccatttttttgttcatttttccttgagaaaatgttttttttattaaaaaattatttttcgtccatattttcgtcttttggcatttttgttaactaaaaacccgtatcctattctagctattgttttatataaattcttttaatttctaatgattatttcatcttttattataatccattttaccattattttatataaatgttacaaaatttgctgacggattgtccggaagccttcctaaatccaacaggacattccaattaagataaaaaatggccgacaaaactactattaatcttattcttcaacgacttgaagtgattgaacgtaaagtcaacaacaacaacaatgccgttccagttcagttgaatgaacaactgcaaagcattgttgaccgtttgtgtgacatcgagcggaaaattgacaccgcaaacaacaccaactgcaacgcgacggactcggaggacaaagagcggaagcgcagtcttgtactgatcggccttccagaatcaaccaaggaaaagccgacagaacgggccaaagaagacgccgacatggtgtccaacgttttggacgctttggatgtagaagtgtgcccacagatggtctaccggatggggcgccggaatgatggcaagcggaggggctctcgcctggtcaaagttgtgcttccggcgagcacctttcaacgcttcgctttggcacaatggggacgacgccgaaatgtactccgcgcaaaaaacgaggagtgggatcggctgcttgttcgaccgtcgttgacgaaagaggaacaaaaggcggaacatgaggcgcgtgtcaagaaaagggaggagtacgaacaaaaacgggatggagtgacaattcgcggacaaaaaaacaattgaggtcacaaaattttgtcgattttttgtatttcaattcaagaagtttagtaaataagttagatgatttaaaaaatttaatgatagaaaacaaatataaaattattgctatctcgcatagaaggttgagcaataagttagataattcgcttatagtccaaa

SEQ ID NO: 7784 - DNA, 4195 bp, Heterodera glycines
acattccacatttttccagggcttttcttttcggcggttggtggaatgtataaatcacaatttaaaacatcaataataacgttgaaatgaaataattgaggtcatgttgctctcaatccgcgccatcatccccatgttgtgctgctccaccatcttgtggaggcggaggttccggcccaataatcattaactgtggcggaggaagtgacggatgtagcggagggggagtatgcggtggcggtggaggaggatgcggtggtggaggagggtgcggtggcggaggaggatgtagcggtggcggaggatgcggtggtggaggagggtgcggaggaggatgtggcggtggcggaggaggatgtagcggtggaggaggatgcggtggtggaggagggtgcggaggaggatgtggcggtggcggaggaggatgtagcggtggaggaggatgcggtggtggaggagggtgcggaggaggatgtagcggtggaggaggatgcggtggtggaggaggatgtagcggtggtggcggagggtgcggttgtggtggaggagggtgcagtggaggatgcggtggcagtggcggaggatgtggtggtggttgttcttgcggcggtactgggggagggggaggaaacgccatcggctgctccggaagtgattgttctgctggagggggtggaagcacaggaactgtgcagtcggtcgctcaagtattcggcgaattactggtttaaaataataattactctgtcttattgttagtcggacggggaagtgccctccgccggtggttacgctcagccatcgacggaaagttcggcctgtacagcaggcgagggttgttcagagggagaaggagccccccagcctgaacaacaaatgcccgtccaaataaccaatgagcaaagccaatacccccaacaacagccgcagcaattgcctcaatctccttcctccgattctgaccaaaaagaacaactacaaccagtgccggtttcaacacaggaagagacttcgcagcaagttcagccagcaagtccagtggcagagccatcggaggccgcagaagcagcgactgaagtgccggcgccgagtggaagcgcagcgacggggtacggaggcgcagaatcgccggcagccgcgggcgaccgattgcaggaagtgcaggaggagccaaacgcagcagacgaattaagtgcaacgacaaacgaagtccaaaaaccaaacaaaacaatgaatttggataattttgacttttctcaacaggaagaaaaaagcaaaacggaccgaacagaacaaaaagcgaagcatcagcagaccacggcggaacagtcgccaattggggcggaagcgacggcagcgaatgcatcggccaaaacgaacaacgaaaatgccgatttattcgtggaaccgatagacgtcagccaactgcaactgaccaatgacacggagtgcaacagcgaagaactgaggcggataataaccaatgttggtaaaccaatccaagggaaacaaatgcgatggggggggggtagatggccattttacgatgaagaattggccaattcattttgtaaaaatgcctaaggcccattgtttatgctacagaacatggacaatgagctgaatgttgccaaacggtccatccaattggctgccgaagctcggttcggcggtcgcttcgatgtcgtctgttcccaccacgacttttcttacataacaaacactgtaagacctttcattggcacgttcaaaagtgaaatgtcattgcaccaatcacaggaattgtggtgccaagaaacgcgggaaacgacgagttgttatgcgtacagacagttggggtactgaactgaccgacgactgactgacggacggtcaaattaaatcattttcattttgcatatttaaaagtccaaactgaatttgctcatctctttttttgccaaaataaatgttgtgataattttattcgattaaatggttttataatattcattttgcaaaaccatttcccgaacggagcaaaaactataaaaaaggcaatggcacactgaaaaatgaagaaaattaaataatatgaataaatgtgactgaaaatatatttgaaaataatttgtcattttatatgaatttgataatggagaattgagagaatgttttgtcccgttgccttccgctgaaagcccaccgcttcgctccgttcgtcgctacgcctccgttccgccgggcattgcctccgtcgcctcgtcacttttcgtcggttcgtccatcgcttccatctcttttatttccctggtgctctatcaaaaaataacttttaaataatattttatagccaagacaattttgagtgggatgggaagtgaagtggtcaaaccgccgggggccttttggtgattatcttatgctaattaaccgatgagccatcccaacactccttttagcgggtgcttcgttgttgagtcaattatttcatttcattttgcctattaggcactgcttcctcgtcccatataaccgatacatttgccaaaaaagagaagaatcacctccaaaaactgttggaatttcaccgacttgcacaacacttcgttgttaagcacaaactggagaaattcttcgatggaattccttcgctcggcaatcgtttgagggtcggtggcaccaaaatatttgggctccgcaaaggaagggaatttgcccttcagataaagctaaaaaagtgctaaaggtttcagaggtcaaaaaacgcggatttataaaccgatcgatgtatggaggcgagggttgagtaaagggcgctcaactctttgtagcgagtgatcaaaccgaataaccgcggctcactgtcaatggaattgtgcggtgtggccagaaaaaggaaaaggtacaataaaacgagtcgcagccaatctaaccgaaatctccaatttgtactcaacgtggccgaacagtcggctcgtgggcatagtcacatcgacgactttgggagaaaaaccaaaatgctttctttccatataaaccaaatttccgagcacagatttgcagccagtttcatccggcaaaagagaatacatttaacaataaatttgattattttatcaaaactatttaattaaagaattttaaaataaaatagtttaagttggccaaatgcttttaataattattattttagcatcttttgatgcacttccgaatgtttaaatgaaaattaataatttgtttctgttaccccggagcagaagatcagaacgtacaaaaaaccacagaaaaagtcctcaaaattgcagcacaaacagacgaagtaagtacggcatttgaggtaaccaatgctattttcttgtcattctaaagattttgctccgctaaaccaattgtgtcgctattctgtcggcccatcacgaattcgtacaaaggaagaaatttgggatggattcagacgattcagagcaggcaaaacgaaccataatttttggtttagttagaaaattaccaattttaatttaggagacatcgtcagaattatcgacgaagacgaggggaagggatattttgcgcaaacagttgcatttatcaccgatgactataccaaccaatttgcgatggtcatttggcttcttccgaaactcagccgcaattcatttccaaaaccatttgagtttaatgccgacagatttcagcatggctttggtttgtcctttttttgaccattttcattttgatgaattcttttcagccgaagaacgccccgtcccaatcaaagcttgtaaaaagattcctatttcgaaaggttttaaacttttatatttaggtgaatttataagcaaatgtccgccgttccctccttacaaaagaaaatggacgccaattaatcaaatcttagctcaaaaacgcagcgaaatcactcgaaggattgaggaaatgaacctcaaatgacgcagagatataattttgtttattaataaaaataatttttgaatttttagatttttaaaaaagttactgaattcgttattacttttattttacttatgttctttgtttaaatttgtttcagatggtatccgaggaaaaggacacttctttagtcggggtgacagaatgcagaataaaaatttccaatttttctccatttgctgggactgcccaattgaaaaaaatcatccaagggtaagtcatcttatggacatgcact

SEQ ID NO: 7785 - DNA, 1115 bp, Heterodera glycines
ttcaaaagaaattgacgcaagcgcacgcaacgaattctttaattgcgaaggaatccctccctaaaaatgttacttttttgtttatttgtttttcaatttactcccttttccattaggttcttccctctccattaattgaacaatatcgcaacaaatgcgaattttctgtcggttattcgtccggcgacaaccgttctgcggtagttggttttatgagtggcaaaatggcgaacagacagtccaatgttttggcgccggatgagtgttcgaatctcacccgaaacactcggtcaattgtccgccattttgaggcatttgtacggaaattcggttcgaaattcgaatccgtttttcattatcaatattctttgttttcacaggtgaagaaccattcgacgaattcgaacggaaaggcttttggaaaatgttgactgtcaaggacttctcgggcgacacaatgattatcgtgacggtccatccgcacccgaacagcgaagtcgggtgggcccggacaaaaggcgaaagacgcacaattcttttttagattaccgataatgccaaaacaaagctgagggaattctttttgccttcggatccgttcagagatgaagcggcacagtttaacgtcacttcgttttactggcaagaacaggcaaatgcgggggacgagcgcatttacgagcacgtggccggtgagtgtaaaagaaacgccatccgtacggattggcaccaatttcgactttcagggaccccctttgtctacgagtcccttctcggccttaactttcgcatttccccttcgacatttttccaggtttttatttatgatcattttaattattgcaaacattttacaaaggttaacacccgtgccactgaaactctttacgaaacgattggaaatttgttgggtttgcctgcagcacaaaaaggggacatgagaaaagacggaagcacgcaactttttaccacggaggtaaaaataatatttattggcttgtttaaatgctaattgggatttttggggttcggcggtgccgataggcgccgccggggaaaatttttggggtttttaatgaatttgttaagaaaagtccaaaaatttgcgaccccca

SEQ ID NO: 7786 - DNA, 1268 bp, Heterodera glycines
  misc_feature (42)..(42): n is a, c, g, or t
  misc_feature (49)..(49): n is a, c, g, or t
ggggggggggagggcccccccccccccccccccccccccccnccctaanaaatgtatgctatacattgtagagacattgacaatgaatggtagttttcctaaataatgttgttcagaaacggcctttcgttgtcttggatgtgtgctgtggggctggcacggtctgtctttttgctttctcatttgtttatttttttttgcattataagtcaccgattcccgccgaacttcttttgtctccctctcctctcccaattcctttttagtctcttataaaaaaatagaaaagattttcactcaacaattggtcttcagatcagtctttgtcttatgcaacgcattcgcaaagcaattctttcgcttccttccgcttctctctgtcccatttccttcggttgcgttggcatcgaattgaacagagaggcggtgagagatgcgcgaaagaacgcatctgagaatggtttcgacgcaaaaaggtgacgcaacttattttacagctcaaatgtctgtttttgcttcagttgcgtttacattgacggcgaagcggagaaaattttcaaggaattggaggcaattaattgttcattttaaaaccaatcatcgaatttgtttcagtaccacatgcctttcggttgtccattaaatagttcacaaattttcggagtgattgacccgccgagggcgggagtgtccgacaaagtgatcatcggttgcaggagggtaagggcattggtcatagtgcagaatactcattccattgaattttacgcgtcccgtgaaattttcagtttacaatttattaatgggacgcgtaaaagcgtgttctgcactaattaacccaaatgctaactaattttgtttaaaaattcgtttttatcaagctcaactctctgcgtacgctgtgctatgtttcctgcgacccaaaagcggcaaccaaaaatttaattgatttatgcagacccccgtcaagaaaattcgatggcgacccatttcgaattgttgacattcaacccgttgatttgttcccccagactgaacacgttgagtgggtgatcaaattgaagcgatagttccacttttattgtactcttactttaataattttttaatgttcgttgttaacgatttattcgcgaaaataaaacaaaaattttaagttcgttggtacagaaaaggaaataacacgggattaacatatggacattccgatatttcctgtacgggtccaacgctaacggttcagccatgtgcgaacaaacaaaacgaca

SEQ ID NO: 7787 - DNA, 3558 bp, Heterodera glycines
  misc_feature (3496)..(3496): n is a, c, g, or t
tattatccccaaaataaaacttcaaatttccgtctgtccgttcacctttctgattttgatcagcctcctgataattctttctgacaaacctcaggtgatcagttttatggttgtgatcaaaaatgacgccaaatttgttggcgttttgcctttgtcccatcccccaaataaagtgccaatttttcgtctgtctgatcactaatctgaattctgatcagccttctgacaaatcatcaggtgatcagttcttgggtcggctttttcttcgacgtccgttccgtctctgcgcgcattacgcttggcgtttcgtcactgcttgcgttgacgtttcagtttggcaatgtgctacggtatgtgccaaaaacggtatttaaattggggataaaatggcataaatttttagaaaataaatttccaatgattaggaaaattccaaaataaatacaaattttttacatttttagacatttgccacgggtcagctacataaaggtgagcaaaaagacctgaaaattttgaaatttttcattgtttttcagtgccttgacgtgtggatgattttctctgtgatttttatttttatgtaagaaaaaacaatttaaattaatttttattttataatattttaggacattggtggaattgtccatcatatgtcaagtgagtatttgcggaaattgagcatgcttttttttattaaaatgttaattaatttactttaattaatataaattattgaataaatttaatattattaaaaataatttatataacacttttacaagaaatttgaataaataaaaattttaaatttattactatggtttaataaaagtctgcacaaaaaaaagattaatatacaaaaaagcttattttacttaatataaaacattttcatttttaacaaataaattaatttcatgaaattttttttgaaaaatattttcgaaaaattaccaataataaattattttccatggccaatttgttgttacagttaaatcgctgggaacgcgagcgtcaaatcggctccaaagtgctgggccattggcttaaccaaatccgcaagacgcgcaagcagacagggcgcgccagcgattacagcggtggcagcggcgccgatgggtcgggcgccggcggcggcatccgcaaacgctttttgctttcaccgctgaagcgaagtgagtgcgtcgggaccacggtgatgccgtgttatgcggcacggattttttttgggggagggaagcgaaatagtttcgcgattttccgaaatttttatcggcattggcatttgccgcaatttttttttggcgcggcatttaaatttctgccattttcagtcactcattcgccgtctccgtccccaccgcctcgggcacaaattcaaaatgcgctttcgatcagtcgcagtgcgacggccacagatttgccgtccaaagaaaagtgaaattttgaaatggaaactggttcattaaagctttgaaatgcgatttttctattttgggtaattagtagagcccgaaatttcaaatttgcgaatcccgcgggatttcgcacaaaaaaaacaaaacaaaattgcggatccctctgcgggattggaactcaaaagttttacgggacgggatccccccaggactaatcccataaaatcccgcattttccaaaaatgcgggattgcggactgggatcccgccaaatcccgcaccgggctcttgtattgtaattgttagttacaaaattaccacttaccaattttacaacataataatattttttgtagagtagagcgggaccgggaattttttgttttgctatttatttaataaaatccaaagttaaagctaagttaaattaattaaaattttaaaatcaaattttcttcagtcatttcaaacaattaatcatttttggaccaaatcatcgaatattaatagaaattcagatttgattttcacatcacttttttcggagcgctttttcaaaaaacttttgggaaagaaggggtcccggcggaggcgataggcgccgccgggggaaattttaaaaatttgggtgcaatttgttaacagattttcaacaaaaaaagttggtttttgcgattattaagctcaattggtaggattttcatttgaaaaatgataaaatatgtatcaatttaaaaaaaactatgaggaatcatattttgtcgataggaaagccatgagtatacaaaaagaaaattcaaaataattaaatttctgtagagggattgaaccaggggaaagaagaagggaaagtcaaggagactagccattaggccatttgcacaattggcagttttacttttaaagaatatattaattattatttcttaattttttccctttaactccaattttcttcactaatttttgactcagacccccattcttaccagtgcttgtttttcccggttcccggttgccctaccgggaccgggacctgagcttttcaaaatccgggaccgggacctgagcttttcaaaatccgggaccgggacctgagcttttcaaaatccgggaccgggaaccgggaccgggacctcggatgaccgggaattcccggcccagtcccggtcccgctctactctaattttttgtattgatagtaaaacagtaaaattcaattattatttatttcttgaaaaaatatataattaaaatattcattatttaaatttaaaaattccatcttcttttcctccctgttttcaggtcacctccatctccaatattgggacgtcaaatgtgtaataataacaacaacaacaataacaacatcaccgccgccaccggaggcggcgaaagtgaaaaattttcaaaaaaaaattttaattcgaaaaatttttcttcagtgattcgcgtctcgtcggtcagccgttgggccacttttcgcgagggatttgcagggggtaaatctttggtcttttcaaaaataattttttaaaaattgcaaattttttgcctaaattttcagcaggcggtggtgacacgagaacagcgggcagcgaagaaggtgaggaaatttgggcactattttaatttttttttaaatgtgccgaattttacatgaaaagccatgccattgaggcgccaaaattagtaattaaaaattcaaaatatttgccttttttcctggatttaaaaagtttttttcgcaagaattggcaacttaatgagaaaatttaaatttaaaaattcaaaattattaaatatttttttgcagcagacgatgcacttttttcatcaaatgtttgttactttttttatttatattttatattaatataattattaaaattattatttttaaagcatttaaagaagaaacttattaaaatgggaatttttatttaataaatgattgtttcaaataaatattttccgatttttttagcgaaagccccgctttttgaggacaatttggcaccagctgaagaagctgaacccgtgcagctcgaagcgcgaatggtccatcncttcggtccaagtggcccgcaaatggatgagtgagcagcggggcatttttaaatattttatt

SEQ ID NO: 7788 - DNA, 1601 bp, Heterodera glycines
  misc_feature (1550)..(1550): n is a, c, g, or t
cgagatttaaatcccgatctcgtccgggctctaatactcatatttaagtgacattttgcacaaatttaaatatttatcccatttactcaaaaaaatatttccatttttacataaataatttattttcagttctcttcccactttcctatttggtgttcaatttgacctattgcatttattatttgggaaagatcggcaggccgctgtgaacgcaatgaacaatttgtggtgcaacaacacccatttgattagcgaacattcgcttaaactatcattttattgaaataataatgtattttggaattcgttcattgttttttctaattatattttaaaatttttaaataaaatttgattttggcctcctgttgttttttctttacctttattcctcttaaaataggaagggaacgcttattattgcaacaaaatgcacaatattgtatgaaatgtgggtgttgtgaaactatgaaggtttgatgatggtataacatttaaaaggcacagggaaaaaagccaacaaaaacaacaaaatcggctcgggaggagggggaacggaggtggggaggacagacagacaacacatcgccaaattatggacaaaaaaaggatgaaatttgagaaattagaatcaattccgttcgttcggtccgtcggtcagtccgttgccgttgttattgcacttcgggcggaatgattctgttgttgttggacaagtgagcccaaatttggtgacgtggtcgacgtgtgcagccgaagccatgccggctcattgccgacggacatcagaaggcgctcaaacggtgccgaggtggacgagccggccaacaactgcttgtgcttcttgcgcctaaaggaatgcattttttaataaaatttcaaatacgcaataactaaaaatttattaacatcgttattttcaaatattttggcttgaggagggatactgatgcccggggcgacgacttttttttttgcgttcaaatcacttttttgcggcactttaccaaaactttcgggaaagaagtgaccgggctgtgccggtgccgacaagcgcttgttgacggaaaacagagaaattggttttggactttcacaaattaaatatattttatccctagaaataaaaatttttttttgtttccctcacttttcatgcacattgagaatgagcaaatcgatgacgaagttctcgtataaatagcacagcacgccgctgagcaacgccaaaatgagcaacaacagacggtactcaatgtacgggattgggtctgaaattttggtgacaaaaattaaaaaaaaaatggagtgcccaccaaattcgagccgttcaatgaaaaattcgggtggctggacacagatgaccacggacaaaatagcaactaacagaagcgaaatgcacaagggcttgttgctgaaatttttaagtaatttaaataatttagtttttgaaaaaaaagggaaattttttaataaatgagattggaaaaagactttatcattgaatgaaacacaaaaactattgctccaaaaagagcttatacaagtgngatcccattagtcatgaaaaatcacaacattagaaaccatgacaaaaaaga

SEQ ID NO: 7789 - DNA, 1771 bp, Heterodera glycines
tctttggtactatgagtattttactatacccatatacccactgttgtgcgtagttgtccacgtaagtttggaagtcgtttggcacagtttccggcacacacaacgacgcaattttctccggtgcgcctttacagtactgcaaaaaaggagatacagaggaatacggtatcatcaaatggtgaccaaccaaatggtgaatgtgtgagtcctcgttggggttgtgtacaaccacagccattcgttgaagggatgaactgcaacaaaattgggatatcggggaaataaaaaaattataaaaattttgagttttttaatcttttaattacacccacctgaatgtaaactgtcgaatgatcgccaattccacgtcggactcaaccgccgagtgcagtggcggcgatcggaccacggtgggctgaaatattgcatttttcaaatcaaaatttttggtttttggcagcccaatgttaaaattttttttttagcttttacaagcaggtcacatccccacctgaagcatgtcgtacatggacgtctcgtccaccaccgcactttcggtcggttcgtccatgatccaaccagttttgcggaacagcaccaggtccaacgggtccccgttgagctccttgtcaatgctgtacaaaaaagggggattattttgtgaaacaatatataaaaaatcggcacattggtgggaaaaaaagccaaaaaatttatttaaattcaagatgatgacgcaccgagtcagactgtgacaggtggcaaccgccttcagcaactccccattttggggcagttcatctgtgcaaaagtcgtgcagctcgttgccaaattcgcgcccaaactcgcaattatgtacggcacgcaaacagttaaagtcgaggctttaaaattacgaaaaaaaatccccaaattttcaactaactaacccatcctccgtcagtgtgccggtcttgtcaaagcaaacctacgaaatatttattatgttttttatgagaaactaatctataccgtattgatggcaccgcatgtgttaattgtggagggcgaaatgcaaaaaatttgttttgccctcagacgcaattgggccgcaaaaatgccaatgctcatggcggctgaaaagggggtagaataaatgatcaatactagcaaatagccaaaattagtttcatacaatactggtaaaccatttttgccaatttttggaaatcaaaatttgtcgaaaaaaggtcgccgagacaatactgggatataggtattcaccacaaaaaaaataataagattttagaaaattcaagaaaaaaacacaagttttgtctgatttttttttataacttcagcaacttttattttctgtaacaactaaattaaaaaaacaaaagaattttttaaaatttttcttaaaattttgaaatttttttgttttatttttgtgcggtgacgttatgtcccggcgatgttttggggtgtacccaaaaaaccgtacctggcagtgccggcggcaccacaatggtgatgatgtccagcgagcggatgaccattttccacaaggtggccccacgggtgtacatcaccaccacggtgtacaggaagccaaacgcggcgattgaggcgagaaagccgacaaatttgaacaggtccttggtgaagcggaaatccacgggtttcgggtacatgatggagcggacgagttggcccttcagcgtggaataggcggtgcgcaacacaaacgccttgacaagcgagggggagggaatttattaaaattcca

SEQ ID NO: 7790 - DNA, 4396 bp, Heterodera glycines
atcaattttgacatcaaatcaccagcaaatgttgattgcactgacgtgatgaacaaagcagggcgaacacgtagagaagcttgaaaaggggaaaaaaagagagagagagggaggggaaagatgcactgacacgactaataatttcacccgcccaatttatttcaaaaaagaatttgcaaaaacattcccaccaccccaactgaccgcaaaaactgttgtgttgtgtttgttgctgctgttgttggagttggcttcagttgcgttgggcccacgtgcggtgataaaaactaaaaaagaaaaatgcgattagcatggtaattaaacttaagtgtccaaaggtcagttatgtacaacaaatccaccatgggttcggtccaactcgacggttagtgaattttttctgcttttttattacttcaaaaaattccaatccaaattttatgtcggtagaaaaagcaaaaagcgatgggttaaaacataatttttattttggttaagggggcatgtttattcataagtgcagtttctcaatatttcggaagcccacatgacactttttttcgatctcaaaaaaactccaagaaaaattttaaaaatgttttctaaaaaaattagggatggcagcggaaggaacttgtcaatccattgacaaaacaaaacaaagaaaaagcaattttgcaaaaagtcgaaagtcttaacgattttatgctgattgtgagaaaactagaattttccagtgccatttattgttttcccaagggggaaatgctaaccaagtgattgattggtcaagtcaattatgttacattgttgtacatgggacacgcgggttcaaacccatttgacagtaatacttttattacattttattttttaattggaaaagggaatttttgttttttgaattttcctaacctgtaattgcgaatccgctcctccctaaacggcaccaccaccaccaccatcagttggcaccgtcgacgatgacaaattggcattggcaccgctgctgctggcactgtgctgcaactgctaagagaaaatgggaaatatttaaaatgttgcgaaataaaccaattcactttttgataaattatcaaacataaatcccatttcacatagttatccccttgggctgtgctgattaatcactaattaattaaataaaaccatcccaccaatccatcttttttggtcactcacccgtgcctgtgctggctgttcaacagaatgtcgtcattgatgctgcttgatgttgttgttgttcaccaccaatcatcagcaaaatgtttcaccgtcacactgaccgttcgttgtttatgcgctaaacaattttaattactataataaatcgatcgattttttatcaaattttcaaaaaaaatttttgaagctaaacaagccaataaacatcatgaaaattgttaacggattctcaaatttgatcaggacctgactcggatgggactaagttgtccgggctctcaaaaaatttagtgaaaataattattttacaacacttggggactcggtttattcaaggctttccttcccctcacttccaacaaaaatgaatgataacatttttcgaaattcagaaaaaaattttttttggcaaaaaacaatttattttgttgtttttcaaaaataaatgcccacccgaatggagagcaccgcgtggtccgccgtccgtgccgttttcaccccgtaaaatttgtgtttgccgtccgccgtgccgcattcggcagccaatgcgagcacttgtgccattgtgttggcttcgctgcggcggcacagttcgatcagcatggcaccgtaaaacaattcttaattgtaggacacattttaatgagccatcactgccatttggtgccggtaatttcatgagtgagagtgtaaatgatttatttattcaaaatgatttttaaaaaaatcgcattttcatgcggcggcactcaccggaaacacgcggcgacacttcgacacaaaaacaattgtgcttcttgttgttgtcgctggcactgccaaagtccactcaaccaagggcaaaaatggcacggacaagcgaaagcacacctgaaaaagcaaaactaaattatctaattgaaaaaatgatgctcggcgggatttgtaagatgtaaacaaaaaagggggtggatgttcgaatctgtcccacaccataaacatttttattcatttttctagtggggcggatgggaggaaggacagtttcaaaaatttctgtttgtctcaattttttagggttatttctagtggttatccccaaccacgacacttcaaacctcaactcgggatttgggttaaacacacatactcaccccctaagaattgcacattttggtagcaaatagcaaaaaataatacaaataccgcgtaaccgagattgaataaataatttttttttatgaatacgaggttagcctagcaaaatcccatcctacaaaaactcgttgctcttgtcacctgagatggcatccgctcgatagttttgcactttcacgaattgatgggggcgttgtggcattgccggccctctctccgccggcgccgacaaatgccaccgatggaatccaaccggtgaagaagtcgtcctccgaatgggtgggagtgctgctcaactgttgcactccttgagaatgaggggaacacattttgtgggagggatggaaaattttgtttaaaaaaattcagattttctaaatataccatatcctcccgataaaaatattggctgtatataaagccagcgttggctttattttaggaaatcaggtagaattccaaataacaaaaaattttgctctaaaaaatctacaatgaaataacttttaatatgagaaaaaatcactagaaaaatttggatttattttaaaacttttccaatttcgatggggggggggggaatcacccccttacccctggctacgggcctgaaactttttttggcccatgtcacaggccccaaaaaagccaaattccgaagttttaaaaaaacaaaaaatttacctgaccacgtcgttgaccatcaaatgcagaaccgatgaccagaccaattcgaccggttgccgcagctgaacatgaacatggcgatgcggatggcacggcacgacaaatggatggagacggagtcgtgcacagcacactgaaaaatctgcgcattctattggtatggaaaagtttcgtgtccaaaaatcctcttctccatttaagcagaatccgtggccggtatggtaaatatttgtttttggactggaggtggccctggtttaagcccaccaagggtcgaaatttttaaattagttttttaaatttatttttttgggaccgctgaacccatatttacctatttgagtacaattctaaggcaatagcacattttgttgtaatgattaaaaccgaaaaattcacacgatacatttgaagatgggaggggaggggagggggggataggattttttgcgggttgattggcccaggttatctgggcactaaaatctgaggtgcaggacacgaacctggcggccttcttttggcgcaattttaaccacacacaccgaaaatagaaaattgtaaaaaaaagaaaaaaaaattgaaagttttgattgagcgttgtttctaaaaaatttttatgacgaattaattaccaagttgttcaaaacttttccataagcactggaatttttttccctttaaattacctaattaaaattttttaaagttttctttcaaaaattttcaagtttaaaaaattcaagaagggggggggggggtgatgctagaaataattgacataaaattttaaaaatgcttttttaatggaggttgttctccaacaaacaacacgccgagaatgacgtacccccgactttttgtcgcgcagcttcagcccgtccatcgaaatgttgagcaccacgcgcggctcggcttgtgcgacccgctggccttgacgctcattttggccagtcgcatggcttccgcgcgcctcggccacgtcgcatttgccgatgaatttggcctatttgtgaaaaagacaaatgatggaaaaacgtttggcaaaaaattaaaattacgcaaaaaataggcaaaattataaattattacaaaaatgtgaaaataaactaaaaataaggaaaataaactgcataaaaataaaaaatgtacatgaatttataacatgaatgattttattttaacgaaaaaaataatttgttttgttaggggtttcgaaattagcaaatttttataaagtagtcgtgaagaaaacccgatgagaaaaatttccgaccgacccccgatcgatttgagagaaactgttttcctgttttgctgactgaatgaagatttttcggttccgatgttatttgagaaagtttgg

SEQ ID NO: 7791 - DNA, 4114 bp, Heterodera glycines
aaattttttcccctttacaggcttcacgaggccacccagtcggacgaggctctgttcaaccgactggtgccgaaaaacaaggaaggtgaggctgagagagtttactagtgctgctcgagagtctctactcgagaaaagtctctggttttttgggtctcggtctcgagtctcggggtcaattctcagtctcgggtctagggatcaaatctcggtcccgaatatgtgggtctcagtctcgagtctaggaatcaaatctcgatctctagtctagtgaaattttcggtctcgagcacactaagagttacaaggattcaatagaataacaaaaattttggattttgatcgatgatctaagcttgatcatcattttgatcggacattttacagaaaaaaatacattcttataatttgctccatcatcatgtttctgatcagaccagcatttaattaaccattttatttagatcattttttaaatgactcttaattttgtccatattctgatcaaattcagctgaacattttgatcagatactttgatcatttttcttaaaggttcattgatcagatttgtctctgatcaacacacattggtccgatcattttgccattttgatcacacaattttccacactttggcacaggaaagcgtccgctttgcgatgcgcaaaagcgtcgcctccaacgcttgggccttccggcggttgaggacgcggaacagctgagcactgatcagcgacgacagtttgcccgactgaatttggaccgtgatcagatctatttgggccgtgtggttgatctgaatgatcgcatgttgcgccgtgttgaaattgggcacggaccgcaagagcagaagcacaagcggaccaccgaatatgccatcaccgtctcatccgaagtgcgttcatctatgccgtgccaaccttgcacataaaaaatgaatgaaattttagaaaatataaaaatgatgaattccaaattgtgtccggaattccaaactctgcagtgattttttttacacaacctgttacactaacatgccgtgccaatgtcggcatggattgtttttttttgtttggctcgagactctcgaggcctaattaacaaaatttcaagaaaacaattttcagccgtttttttggatttttttttgttgaaaaaactaactaattcatccaaaaactttctccacccctctcagctaatggccattctggcccaatgcatggggctggcggatttgcgcgaacggattggcaaaattgtggtagcaaatgatcgggacatgaatccgataactgcggacgatctttgcgttgccggcgcgttggctgtgctgatgaaggatacggtgaagccaaatttgatgcaggtgggctcatttttacgtctaatttatttgtaattataattaattaatttttgtaatagctgattaattaattaacccaattagatgtaggtgtaaccgctaaaacaaatataatccatctaattattaattgattatataattggtctaattaaataattgcagatgcatcatttttttacacctaattaactaataataattacttttcttaaaatatgtaatagctcattaattaaccaatttgcaagctaattaaccagaaattactccgtgtaatagctagttgactacatataattggtataattcactaattaattattccgtttagacactcgaagggacgcccgtctttgtatgtttttcattttcattatttaaaataataaatcgatacggtatttgattactgtcatctttcttctatttccatttattgtttctctaaattacggtattttcctcgaatttccatgctcgaattgtggcacgaccatcaatttttctttgaattcaaatttttaaggtccattccggtccatttgccaacattgcgcacggtgaattttctttctgatcaatcgatcgaaaaaatctttatttttattaattaatcaaaaatattttgcttaccgttccgatcactttcccatttgtacgcctcagggaacagttccatcctggctgatcaggtggcactcaaattggtcggctcggatggctttgtgatcactgaggccggctttggcgctgacattggcatggagaaattcttcaacattaaagtgaaaattttttaaaatttttcgacattttttgtgccccgccatttcagtgccgaacgagtggcctttggccaaatgccgttgtcattgtgtgcgtttttttatttttcagaattttaattatgtgaatacgttcccaactctgtgcaatttcagtttttggttttaaaaattctaaaaaaaaaaaattccgataaaatttctcacatttctatgaattattttagaaattttcgaagaaaacaaaatttgaaaattttatagagaatttaaagaaaatttgataaatttgtttttttttttgaaaattcggtaaaaagtgaattaatcttttcgattcttaaaattgaagttttatttttttcccaattaatccgaagaagagttcgcttttcttgagtgctttcaaatgctgctttttcagtgcgacggtgcgcgcattgaaaatgcacggcggtggcccgcccgttgtgcctggttggccggccatttaattttcaaaaaaaaaaaaaaaaaaattgttggcatttttttcaggcaatccgctgccctttgaatatttgaatcccaatttggagttggtggccaagggttgtgacacaaacttgcgcaaacaggtggtcctcataatccttctgtggtaccaaccaatgttgttcgagagtctcgactcgagactcgaaaaattctcgggtttttgcggtgccacgaaattcagcaggcccgtcgccagaaaaaaaaattcggagagggaggggtggggggaatccggagttttttgctctttgggcctaaaagtctaaaaaaaaaaaaaatttttctccaatgttatttttaaattttcataaccaggaagaaaaagtaggagagaaaaagtaggaatttgtagacattttcaccaaaaaattattaaattgcttgaaattttcaaaaaaaaagtgcctatcttacaaaaaaattttcaaatttttgtatttaattcttcggtgagtgactttttgtggagcatcaattcatttttattgttgaattagtaaaagcttaaaaattaaattttagtgcgtttaaataaataaattttgtgtcatttccgatcgaaaatgcgcaactgtttggcgtgccggtgctgatctgtgtgaacaaatttggcaccgattcggacgacgaattgggacttgtggtggacaaagcacgccaatttggtgccgaagcggaagtttccgatcattgggcccggggcggcgctggtgcgatcaaattggccgaaacgctgatcaaagtgtgccagcggatgccgcctcctgccaagttgggccacaacaatcacacctgtattatccctccggggcataaagcagaatttgtgcccactttgtcttgttggcgaaagaccacaccaaagttggtcttttgtacaaattttgtcgggtcatttgtccaaattttgtaacacttttgctcaggttcaatttggcattttgtcccatgtttaagttagaattttgtccaattttacaactaatttgtccagcactttttgagaggcattttgtcccgtgttgcccctttgtctttgggtttcctttttccaaattggtcgcttttccaatttattgaccatttgtccactaaaagaattggccttttatcccattatgaccctttgtcttgcggtgggggacctcgttttttgttcaaatttgccttttgttcaatttttgtttttctcccatcacattagacattttacctcattttcgaccatttgtccaaattaattcatttgtcccccccccccacccctggacagatttctgtactcattggaggagtccattgagcaaaagtgccgcatcatcgccaccaaaatttacggtgccaaggacatcgaattttcggacgaggccaagcgcaaggctgaacaattcaagtgccaaggcttcgctgggctgcc

SEQ ID NO: 7792 - DNA, 3440 bp, Heterodera glycines
  misc_feature (142)..(142): n is a, c, g, or t
ggaattaaagtcactaaaaatcttcaaaaagtcgactaaaaaagtcataaaaaatcgccaaaaagtcacaaaaaagtcataaaatacgcaaaaaagtcacgaaaaatgaaaaaagtcctgaataatttatagaataacattntaatcgtaatttttaggcacataattttataaataggtacctaaaataggcatagaaaagagattcttccaacaattaagaaaaaattcatccatgtttcattgtctttttatcgatccaaattttatttttctgaattttctttgtatttttcggcattttcttcgctaaaattcaaattttgccccaaaaagtcaaaaaaaatcacgaaaaaattcgcaaaaaatcaaaaaagtcataaaatcctaaaaagtataaaaaaagtcacaaaaaatgcatgttagaggcttcagacaaagtttagaacactttttaagtcattttaaggccatttagagtcagcaaaaaaaaaagtcatttgacttaaattcccagccctatttattattattcctttttttaatttttgaatatttttcttcaaaatttatcactaaaatgtcaaacgaagaagaaaatgttgaagagcaaagagagttttcccctcagcaacagcagcagggcgaacttcgctatttccacgagggatttacttatgtgaaagatcggctcagtgccgacggcacaaagttattttggcgatgcgggaaaaagattagttaatgggtaaatattaattgactcattagtgccttctgttttaaacgatgccaaacgcatgcaatgggcgcatttggacggatgccaaagacggcactttcctttcgatgaggacgaaacattcgtgcagagaggggagggaagacacggacgaagccgactcccacggggacggcaccgggcctatgacccaaagtgccacggccattgtcaaaggtccgcgggagggcgcggcacagcgcaaacactcgcggcatttgcttttcactctcggaaatattcactttcctttccaatcgcttgtctcatttcgattcaaagtttctttttgggatgaaattgctgaaatccctcccttaatttaaagaaagagtcggtactgaaaaagacattttcagttgaagcgggcgacagtttgaccaatgccattctgggcattttgccccaacaatcggccgacgacgccgaggctggcagcactgggaacggaccaatgcattcagcggaacatcaccagcacgagacggaccagcaacagcagatgatctcttcagggacgggtgccgcgtcggtggaaggaaatgccatcgccgcgggggttcggcgccattctctgctgggaccgattccaatacgttcacagcaacagcaatccgtcgaaggccaacagtcgaccattggccagccgatggtgcgcaatttgccacctgcgactgttcgcactgcgaattttgcgcaaaatcatccggtgggcaagggacttctgaatgttttttggcaactgtgacttcgtttcgggaacattctttctcactgtgccgccccatttcaattaattaattaattgagcagcaatcgctcgtcaattcgcagcatccgaccgtggccaacaattgccattccgagcagcacttcgccggtcgcaagaggcgggcattccctccgccgccgcagtcgtcggcactgccgctgaacggcttctcaaattgtgtcggcgaagacggagaaacggtggaacttcgactgaaacgcctcaaatgcgaactcattgaggtgggagcagcagctaattgtgagagaaacaccacaaaatggcattaagaagcagctaatggaattggggcaccaggaggagtggcgactgaagcaggaatttctgttggggcgacagacggcggcgatggaaaacattgtcatccaactgagacagataaaggagaagctcaaatgattaactgaccttcgggctccgaattggcatttcgccgtgccacaaatccacgaaattcgcttaaatgtcaaattgccactaataatttatcacaacaaatttgccttatgccagtcacttcattagcatcagatgcattcagcttgtttaattgaatgactcactgacaattagtaaggcgtttgtccctccctcgtgccatcttttccctcgagtgcttttgctaatcatcccgacttttcgcttgctcctctgctggtgattgttgtgctgataatatggcgatgctgctcccttccgcatcattaatcacttctgatttgacatcctttcatttgctaattactccccccccccattcgttacgcctcaattccttctttggcgtgtccccccttagaccctttcattaagatcattatcccaggctaattgacgacgcattgattatatctgaagaagcgtcccccacccctctataaaagaaagcgagtaaagtatgaaaattgatatttgaaaacattcccgaagtgtgaaaaatgtccgacctgcccaccggtactgtaacggtggcggtcattctgtccgtcatttctctcagtgccattctcgtcggagtgccgctaatgctcaacgatttggtgaaccttcagcttgagtttggactgaaaagccaagcgcacttggacatgagcaacgttttgtggagagacataatgaaagaggtggcgacgattggccaatgggacaaaagggagcaaaagcagacgatacggaagcggagacaatgtgcgaaagggacggacaattgaccactcgaaacaaatgccgttcagacggaagcggaaatatcggcggagggggcgcgagcagtccaagtgccacttgccctcagggagcgcgaggggccccgggagtgccgggggcaccgggagagccgggtcaatcaaagccaagagcgaagttgctaacaaagaattgcctttaaggccaagacggacaacccggcacttcgggattctcgggctttccggaggattttgctcacgtgtcgcagtgccccacttggtgatttatttcgccatgacttaacctgtgtttctctttgttaaagtccaattggtccacctggccccccgggatacaaaggaaggagaggctttcgcggtgaaaagggcccaatcggtacacatttaaatagcccaatggcgtcattcaattttaattttaaaggacctcccgggtcgcctggtcgcgatggccatcccggtgagcagctaatgaacggattaagccgtgtgaggggaaattgtactgtttttttatcaggtgacgaagggcccgaaggcgaaattggacttcacggagatttgggagagcctgggccgagaggccctcccggcgagacgggcattggatacgcaaagggcgagccggggcccaagggagagcacggacagccggggg

SEQ ID NO: 7793 - DNA, 2296 bp, Heterodera glycines
  misc_feature (95)..(95): n is a, c, g, or t
ttttcagcctccgccctccatccgcccgtttcggcgcgtcccgtcgctgcgccccctccgccgtacgcttcgcaacgcgccgcttctgcgcctcncgctccgtcttccttcgctgcaccttccgctgctgttttccctccccgttcttcttcctataacaaattggcacttgccgccgcccttcgcacgcgacacctttaagacattttgagaagcgaaagcaaaagcaattaatattttaataaacaattagttttatccatttgaattactaaatgaaatagtctttttcactttgtaagttcggctaaatacaaaatgttattttaatttcactgctgctaatgtatgaatttattctgacttcaataaattctttaaaacaataaaaattaataataaatattaaaatttgattggttttgttcggccattggccaaaacatcaaaaggcaattaatttttgttttgttatttgtccattcgtcgccacttcttccgtttttcttttgccattcgatggcttttgccatcgttttgtttggctttgtgtcggcttttcttcggttggctttctttgtcctttcttttcgcattttatgttggcactacgaggggagaggtggccgttaaagcgatcgtcgtttggcggtgtttttgctggccgatggatgccattagcaaagtcggggccaccaatttggcatccctcggcgtcagtttggatttgctccccaattgtccgaattttcgcttcgccataaatttccgcgcattttcgggcaccaaacggagaaaagcggagcgaagttggaagttgagcaaagcgtacagaatggggttccaaatcttaacaaaaattgggggggggggacaaatggctaaaaaggggacaatttgaaatttacagtggaagtcatcgcaatggcatgagtgatgatcccgtacagaaactcctgctctcggataaagtaagggagaaggcccaagtcgcgcaaaaggttgaacagaatgaaccaaatccaactgaaatcggcaaaaaattgccaaaaatttgctaaatttggggggcggggaagaaattgcctgagaacgaaggcacagaccctaaaaggaaaagattgatcaattaatggctgtgggagatcgtacatcagaatgaacatccgattcgtcctttgccttctccgatcggccatcgattggcgatggcgcagccacgaattgcccatctttttacggcgtagcaaaatgttctaaattcgttagttttgactgatcagtcttctgatcacttggctgattcgactcactctgttcagccgaaccgaaattccgatgtaacaaatggtaattatgagcaaaggcacgaagaattggacaatctttcaaaagtccagaatagcgttgttttttataaattaaagcttttttgcctaccaacagaagggtgccgtaaatttcacgatacaattcatttgtgccccaatcttcaacgcaaaattcgccgcagtatccctccatccgcagcaatttttgtgtgaaaatcattgggaaactgacgaacattgcgaacaaacaaagaatctgttggtttggatgggatgcaaattgagataattccgtttccctcctcctcaccgggataatgagcaacgcgtggttatgccgaagctgattgttgagcggaaagcgaatgagcaaaaaacggtcgacagaaattgcggcgaggacaaaaatggaaaagcaaagggatgtaccctaaagggacgagggagggagtggtagcaaatgacaaatggcaaaacaatgccaatgccaattagccaaaaagtactgaccgcggtgaaattggccaaagagcaaagcgcaactccgaacacccaaactttagtgaaggcggtgtaaggcgtaaaggtggcggacacacaacagacgacgatgtcggagcaggacaaagcgaagatgaacaggttggacaccgtctgcagagaacgcgtccggccgatggacaaaaggacgcaaatattgccagagacgccgaccagaacgatcagcgaatagacaacggcgaaaatggcggcggtgatcggacgcgaggtgggatcacgctggaactcccacaggaagtggttcatgtccacacattcgttgaaaaacgccatggacacatcgaactcatctgccagggaaaggttggacaggaaaagccgctcctcaagcgacgcgccctccgtggtcatgggcagcggagaaagagtttgtccatcggagaaagtcatcaaatctaaagact

SEQ ID NO: 7794 - DNA, 884 bp, Heterodera glycines
ataggtagcttaatagcagcttagatttaactaattgttaggagactaagaaaaaagctaaatcctaaaaaatggccctgacgtactttccctttcttttttactttagaaaaaacaatacacttacagtatcaatacagaatattgcaaactgcggctgccttaaacacacagtgactattattgttcattggcggtttacattcacattatgctgctgccggtggttctgcttgttgctgggattacggtaataagtttggcaaaacggtacaattattggcccaatggaaatgtaaaatgtgaaattgctttcgtagttcgtttttgttgagtatcgtataagaaaaaataaataaatttaattattatttatctttatttgcttttaatttgttcattttcacccaaattgttcccattttcggccgatccctgcgggaattacgaagcactaacccaccaattcttcgaccacatttacgagcataaccatgacaaaatgcgtacgttgatcgcctctctcagcaccgacaaattggtcaatttactaaacattgaatacgcgccggaaggcacggacaaacagctgacgccgctgatgctcgccacggtgttgggggacgcgcaaatggcccaaatttttgtgagttaattcaatggcattctccgctgatttatgcactgattcaatgctattgtcagcaaaaaaaaaaattcaaatgttcaaaatttaaaaaaaaatccgttttttatttcagctggagaaaggggccgacccccacagaatgtgcctaaagaaaatcaacaccgatgacaatttaatcagtgaattgagagaggaaggcgaaaaaatggacaaatgatatttgaaaaataattta

SEQ ID NO: 7795 - DNA, 4271 bp, Heterodera glycines
tgctcgcgcacggtgccaacgtcgaattgggcctggaaattggcatcacccctttgatggccgcctgtgacgcgggtcataaggaaattggtcggcatttgttgattaattagccgagtcatacaaatatctcggcaactctcaattcatattgtgcttatttgttagctgcttttctcatgaagaacggagcgaacatcggacgaacggacgacgcggggaataacgcgctaatgggcgcctcaatttcgggacgagtaagcggagggggggggggtattggaactgacaatgaatgcctttgattggtgcctgccgaaaaatgggcagttttgaattatttaaggggatttaaagggaaaacgatatggccaagaaaaactcgtctattaaatttagctggacgttgtgcgttttttgctctctaacggtgcgcgtgtcgacgaaaggaataaatacggtaaagcgagcaaaagggacgattaaaaaggcactcaatcagactcacccgcaaattgttgcattcagaatcagctttttagtgctaatttaaaatattttcggtttttttgaataggcttttgatccattctcagttctgttttcatcttagcctcaacatatataagtaatacgtttaattgttaatgtttttatgtccaataattaaggcaaaactgcgctggattttgcttttaaatacggacactcagaaattgttcactttttacaagccgaacaaaagaaaattgcaaggcaaataagaactaattatgattatattataataattcattaagacaatacttttgattagatggctttttagacacagcgatttgtgagagggaattgccattcaaaatctggtggatctctgcagattataaaatgatttatcatcatttaaaatatttattgtaccatttacacttatttggttcgcatttatgggtcagaaataaaatttacttgaaaataaactgaagtgtgtcaattcgaatacgctgtagtcactaagtaaggaaagttatcccaaaaagaaatttttaaattcaaatgcgggttaatcccgcgggatcccgtctcctgagagaattttgaatttcaattatgtagtgggatctgcaaatttaaaaattgccgggcccctcctcctccccctcccccgttcacttctcacatcctctaattttccttcattcattttcatttggatattccctcttaatgtgcaaaattgcttattcctccttttattgatctcccccttcttatcaaattaacatgccaccattttttagttttctaatccaatttaatttacaaattacataacaaatatttccaaatggcggcacttcagcaggtaattttgatgtttaaatttgaatgcttccaacttttaatataacacaccgagagtgcaccattttatagtcgttaccatcaatgtcaatttgatttgttcttcaaaatcattttcagttttatccaacaaaatccttttgattttctttgtatgtatcgaaaccttagcatgaggaatgaatgcttttgtctaaaatgaaatttcaaatattcggttttcaactgaattgagtgtcatctttggtctctcattgtcctcgctatctgtgcgatatttctttgacatgtctatcctttagttattttgtttctccattttcgttccttgacctatgctttcatagcggtgcttttggttctctcagttttcctgggcttttccttcggtttgttgtgctgcgactccaaaacatttcgccggataaagccaatgatctgaggacaaacacaagaggaaattgatcaaatgttttcttgttgttttttcatccagctgtccaaaatgaaaatgaaccaattcacacgcccttacgcataggaaatgctctgcttgccatgcccgggtgtgcctctgtcttcatgtgttacggcggttgctctacgcgtcaacgagtgccattaaccccaaatccgcttcaaccgcggcgaccctaccggtatgccaatgccaagcagtggggtccaacaacgaatgcttcttcctctggagcgatctatgaattgcttttgtcggttccaagcactgattgccgcgctagacggcttctcatcaacaattcattgtttttccatttcatcaccggcagtaaaatggcaaaaattggaagcgtcctctgccagttttggtaaaactgttgtcaaacaattctcaattaacgacacaaatcactcattcattcacccccacgaattgtcagacatattctaatcttgatttatcgccttttcataacttattcttcaatttcatttattttcaaaggtttttgagtgctaattgcttagaaaattcgggtttctcattaattattcaagcatcccgatttagaacattgtcgaacaactttttgaaaacgaaggtcacaggggtttccgtgtggttcttccccggatccacagcgactcggcgaggcttcacccgattttcacctctcatcatactctcgcaccttacaccaatccctccgctcaaaatgctcatcggttggtccattaattttcgaatttgatttctcttggtttgacaatcatatgaatagaggaattcttttcatttttaaaatgcatcacaaatttagcgatgaccttagttaaactctgttaacgccgatccaaacccttacaaaatcagtttttattaatcctttgttatgaaatacaaaattgaaatttccagagaattgctttggaaaaagcgatcaaccaggagaagagtccgtttatcactttgatctttttcaatttctacactgcgttttgctaaaaccgcttaaaaatgaaaacaccaaatcttcttcttttgtttgaatataattatattaaaataaatgacaaaaaaacgcttatatatttttaaggactacgatgtgtagaattcagtttggaccatcgcataattggagacattgagcagtgcgaaatcgctgtgcaggaaatgatgcttcaccttacccacattatggactgggtaaatatataaataatggatattaataaatcacaagcccagtaaagtagcgcatgataagccaacaattggacaggcttggcttttgagatttgggatatgaccgggcatcagaaaatgccgaagttcattcccacgatcaattctgttaaaatgtcaactaattagcgaaatattgattttatgcaatttgacctgttattcaaatacttttttcccttcccttttaaaaaggcggcacgcggattcttaaacatcttgctcagagttgctgcttatttgtcagcatcgagactaaaatcttaaattttccatttccatgatatgggcttctgttgaattttcattttacttttcgtttcgaaccatcgaaatacgatcaaaagtgtactttttcttttgtttttccatatttacatttaatttatctcgctcaattttgtctgttctaatcgatcagtttttccaggccgctccaattgatctccgatcagttcattaaattctatttctcatgttccgttctcatgtctaaccatttactttactcacttaaacatatatgtctgttcacaatttcgtttttgttttgttcttcataaacacgactaagtaatcgtattttttaattgaaataattatcgtggaggggaggatatgtcaggtaatttcaacactgggtaaaattggttttttttgggttaaaataaagtttggtaattccccggtcggggtccccgagtcggggtttgggtacttatgctttttattacagattactttatattgttaataaacaaaatatttctgacaacttaaaccgcataagtgcaccgcatcttgagctaattcagttcctttcttcacttaaacttatattttatgatacaattccaaactccgacgatgattcattgaagacgctttgttatcatctgctcgtgccaacttctgctgctaatatcggtttcgcaatcggtgattttcaaattcacgtgcagccataaatgacccgagggatttattttgttttccgtaacattttaaattccctaagcatttttaaaattattaacctttgtcgtctccggagctcattccgctccttaaacacacaatgaaatcgcttgaaaaaaaatcttggttttttcgaagaattttagcgtgcccatttccgatagtccccattgggcaatttttggggatccggtcc

SEQ ID NO: 7796 - DNA, 1138 bp, Heterodera glycines
ccccgacatttgattgtgtacaaaattctctatctgttgcacattgtaatagtatttcttttgagaaaatctctccccacatttttgggtcatcattttgctgaaataaaaatcaatgggaatatggggggataagcaaaatccaattcaaatttgtttcttttttgggtcaccgttttgccgtgaattattattttatgtgctcgccatccatcataaatataagtgaaccatcacatctttcttcatttaactcttctagtgcattttttacaaaataatacaagaattattattttatgaattcataaatttgacttttgtgattattagtccctaaaaggaacctcgggaatccaatatgtctttttcaccaaattcaacaattgccgaatttaccgctgatcagggtaattgagcattaattagaaccaattaattcatttaattaaattaacgaaatataaaacgcatttaaatataatcatttctggtacttgctaattcaaaaattacactggaaaatgccttttttgtattttttattttgatcagccataactcgcttcattcccaactaaagtaaacaaatttggtatttaaaaaaagtttttgaaaaggagaatctttttctaagcgaattctaagcaatttgacatctcagaaaaaagttacgagagtttcaaatttttatcaccttataactcagctcattgactgctgattttaaccaaaatgcctaaaactaataattttctattgatgttaaatgtcgaaagtgaatttgttcttttataaccaaaattatttgaattagcgaatttggtgttttttgtgtgttagagacatgaaaatagtaatccaaaaggagagaaaaagaaatgcaattttttttcatcccatttttgtaatgttctaggccgaaatttttaatcaaatcactgaaattttgtttattttccttttctctatcgatatgcaaaatttggtgcaaattgtatgagtagaaaaaaagttatatgtggcgaagtaaatgttgtttttttacataattaaaatgaagagatagtacgccaaaatgagagaaattacaaagaaaaagaaaacgacgagatagtactaggcttttctctgcaca

SEQ ID NO: 7797 - DNA, 988 bp, Heterodera glycines
tttctaaactaattttttatcctatttttactggttgtttttcttcaaaaattaaaaaagagcatattcgcaaatttatttttcattaaattatttttctgtaaaattgaaaataatttttttagagtgagcccccgagggacttagggggctctatttttgggagggggagggggctttattttaggaaaacggtaacttacaatttttgtactagaatgaaatcgaaataatattttaaaattttacattttcaaattttagtctactcaaaagatttgaaaaatcaaaagtgaacataaaacaaaaggtgaaaatacaaaatcataaaacaaaaaaagtttttagttaaaaaaaaatttatttttgaaattatatagaattacactcatttattttcgaattatttcaataaatttatctcaacttttattaagaaatttccttttgcggcaacaaaactgttgggatgccaccgtttgtcacagtgcccttgaaatcttaggcccaaagcatttgatggtccactgcaaagaaaatggaaacggtcaaattttaaaaaaatttataatatttttgtattttaattgattttttaaaaactgaatttgtttctttcagcttttggctcagtgtacgcaaaatgcccagttccgataagtgacttcggcattttttactttgaaaatcaaattttaaatttggaaggtatgaagcaaaagtttattttatttcaatttattgcttttgattgagcttgcctacaattggactcgccacaaaataaatgatgcctttgtacggaatggtcgaccattttcccaacacttatggctacggaaataatggcactttttggcttaacggattcggcctggttggacagtcggcatttcacgaggcgatgttgtcggatcggcgttaatttgttcacttgtcggatgattttcacaaaactggacagcgaatgggttagaaaagcgagaaa

SEQ ID NO: 7798 - DNA, 5113 bp, Heterodera glycines
ccgctgacgaaaatcactgacgaaatcgttcactgacgaaaatgcttactgacgaaaatattaaccacgctattatagttgaagggtaacgcgatcggtaggtaattagagtaacaattttttcaaaattgaaataccggaagcgatttatacaatatcggctgtaccgtactgtgtgtggggtttcggaataaattttgtaggtaggtagagtaccccctgggttcttaaaattttttttttcaattctgcaaaatgagctccagtgctgagacaaaaaaaatgcacgactttttaaaattaagagggtttttaatcaatacaaattatcatatttaaatcactgctcggaattggatattttgcaaagctgctgttgttagatggcacaacttagaaaagtttattttgcattcgcggcactacgccatccatttttttacaaataattcaatttccaatttcttgggacatttggcaactactacagtaaaattattcaattcataagtggcatacccataattaaacatcaattaaattctatcttttccagattttttgagggtttattcagattctctcgaattgtcatgttaaaatctgaagaggaatttaagaaatttttggcgacaaaacggcgccaatctaaccaaggcgtaaattagtgtggttagtgtgaatgattttcagcgcaattttctaacattaatcataattgtagcaaatggatgtcgtattgttagccactccaagatctcttggttaaataacctaaaataaccgaatccagcaaaagcaaatttaccaaaatgccaaatcacagaaaaaaagccaaatggaaaatgccaaattgtcaaatgccaattcccgaaactttctttttcctcctccgtttagcgtccgatggtttctcaatgtcttcctccttttcttttagatccttttgaagaacggccttgagcaaagccatggccaccggcggatggataaaaggtgtttattggctcaacatccaacacttcgtcttgctgatttccaccttaatcataattaataattattagttaataataataaattttgaagaaatgaccccatggttgctcattttgaattattaataggaaaattataaaagtgtaacacacaaaaattaaatttcgaatgattgttaaattcacttattttagaattatatttatttccaatgttccaactctgttcaccttgttgtgatgattgtgaattgttggagttaaacgaaatgaaggcagaatttggcaatgaattgaaggatacagacgattggcctgaaatagtgcagcagccataacacataaaattcatattatcttttttaaatttttgccaaaatttgggcatttttaaaaatcgccaaagcgacgaagtgccaccgactttaatattaaattcattgctttttacctgttggtggctgtggtgcggcgaaatttgatgatgaattgaacgcgtttcctgctgcagatccttcgacttggctgatcaagtctcgccaatatgaacctaaaacaataattaatataataaatttgtcggatataaagtgctcatattttattactcaaaaattaatgagtcttttgtgtttcagaaaatttacagtaagaaaaagaaaatttcttgaaaatgtgcgtttcctgtcaaatcttttcatacatcttctcaattccttccacaaatccacgccaatccgtcccaatcccgagactcaaatgtcattcaaatttaattctaatttattgctttacctgatgatggcatagactgcctgttatccgtaggctgttggccatagtgaaacggattggctgataaattggatgatccaatgctactgtttccggttcttcctgaaaaatttttactcaatttaaatcaaaatttaattttgccctcattttcctccaaaacgcaattaaaagtttctaatttatgtacaacagtcagaagagtctcaatctcgagaaatttcgattctccaactcaaatatctttcaaattgaaattctattaatttaaattcccattcattgatttgccttttctcctcccggcctaatggaacccttcctttaaacttcaaacatattaaaaaaaaacttaaaagtgcaaaaaactattatttattttttatacaattgacaattaattgttcgtccttttgacattgtaccaaatttcatatacttaacaattaattaaatgaaattttaaattgatggcttatttataaaacccaccggtaagttgttggactgtttctctgtaattagcctcgttgcaatgaaaaattgtttgagacgtcggtttcttacctttgattttaaaaagaaaaaactcaaaggaatatattcaaatcccttttattttcaaatcataattaaccccgttcgttacctttctctctttttggtccaccgttcacaccatcgatggacaatgccaaaatgagcacaagagagacaaaatggcgagcataaaacatttttcacttttacaaattggcttcaaaattgcttaatcgccgttattggaaaaagtcataattttgtaacatccttggataaggtctcctaggcaataactatctatttttcggactgatgccgaattaatgggtaattttactttttttttttttttgcccgacaaattggaagaaattcaaaactagtaaacattaagatgaagaatttaaatctagactagagttgcacgggaccgggactggtactgaaaaaactacaaatgagtaccaagtcccggttttgaccgggaccaggactagtcccggttttttcccggttttcccagacaaaaattctccggggttttcaacccgaaaagtcccggtcccggtttttgtcaaaattcccgggcccgtgcaactctaatctaaaccaatgtgtattgaacttagtaacagggttggagtctagtcttgttatgctgcagaacttggtttaagaaagagagttcgtgaaaatgttttggcgctcgcatttcttccaattcctaatattttatttaatgaatggattagaagataatgcagatgccattgttttactcattctatgtggaatagagccagccaaattcggtggaataaaagcaatataattttttagttagtatcgttcgatagcccaggtttttctatattagcctgcaaaattacaacaaattcggtcaaccttcgaaaaagttgtatgaaaataattactatttctggcataactagagaccgactaaaaaggcaccaaaaatcgcgaaaaaggcactattataggcaccaaaaaattgaaaaaaaagcatgaaaaggcacgaaaatcccgaaaaaggcatgaaaaggcatttaaaaattttttattaaggatttttagggagcaaaacacgtaaaacttaacaaaaaaaaacttaattttggtcacttaaatgattattaaatattttataatgtttttcgaataaagaaaatttttaaacctaaaattttttatcaagaaaaaaattaaatgtcgatcaattgagaaaatttttcaattcttaaggctgtattttctgatttcaggtcatttcttaggggtgtattttcccgattttattgaatttttaatcgaatttttcgaaaaaaaacgccaaaaaaggcaccaaaacggcaaaatgccaaaaaggcatttaaggcacgaaaatcccgaaaaaggcaaaaaaaaggcataataaaaatcaacgtagaatcctcaaagcaagtgggaaatacgttttttatgcttaatatatcgaaactagtgcgcaaaaaaaggcatatgcctcaaaatgcggtctctagccataacttaaatttgataatttctattgagattttgcaggctaatagagaaaaatctggggctatcgaacgataccattaatgtataatttgttacttttaactgtcgaaaaatagttaaaatggcggattttacgaaatgcccaaggtggctatttacgaaacgatctagcatcgatggaattaattaatcattcaatcacgttgttttgcacaaatttaattttaatttttttatcagtttgattttgcatccttttatttttaatttttatctgagaaaaaatatggaaatgtttttttttattaaaatggcatttttcacaatatgattttttttgtattacaagtttcgatttagacagacagaagatggatttgtttgttaatggcaaatgaaaattggtaattatataattaatggaagcgatcaaaaagcatagaaatggcggacggatttccttaaaatcatatccttggaatttgctgtcaaaaactcaatcacattgtgattttcttcggcatcttcacctcgccagtgatcggatttctttctgaaatgtcatttaatttttgataaaatgcaatcataaagccagaaatttagaaattaaattaatcgagaaaataatgggttaagcctacaaatcggatttttggttcgtccaatgatgacgtgtttttaaattaaatcaaatccaacaaatcacttaacattccaatcagctaatccaataacacttattaaaatgaaatggttcaaattggatgttactgagctagaaaagttgtacaataatttttaaaattgtttaatcaattaaccaataatttataataatagcttcttaatattcaacgatttttaaatgatataaaattttcaaaaatttcattttgctccgttaaaaaaattgccggaactcagtcggcaagacacaaccctttccatgaccatttttggcattttcaaattttgcgctttttgtaaacgcaagtccaactcacccaacacgggcacacattttttgggcgttttcaccggggaacttggcgctgtgtcggagaaaatgctcgactgaaaaatcattatatggaattaattacctttaatattttttatttaaatcaatttatatcattgccagaaaaatgttttgttaaatttttagcagttttattttataaattttgaatgatgtcataaattaaattttttaattctgtttcccaaat

SEQ ID NO: 7799 - DNA, 1634 bp, Heterodera glycines
gggggggggggggggggggggggagagaaaaaaaaacccccccccccccccccccccccccccccccccccccccgcggagggggggggggggggggggggggggggggggggggggggggagaaaaaaaaaaaaaaaaaaaaaaatttttttttatttttttttttttttatattttttttttctcccacaaaaaaaagaggggggggcgggtttttttttttattaaacacacaaaaaaaggcgccttttcaaaaaaaaaaacccacaaatttttctccccccccccccgaaagagaggggggggggggggggaaaccccgtttttttttttgccacccccccccttctgggccccccgagggggattttttcttaaaaaaaaaattttttttggggggggggttttttttttacaccccccccctttcccaatttttttccccttcaaaaggggaaaaaatggggttgctggcgggcccccccataaacaatttgagggtcccccctttttttcccccaatttttcccaaaaaaattccggggggcgcttgaaaaaccccaaaaaaatcccccgaaaacctttttgggccccggccggaattttgggcccttttgaatttaaaagggttttaaaaatttggaaaaattggggtttcgtaaccctttgaaaccccgacaaaatttgggcgttttgggccctttccaaaggggttcaaaaaggcttttgcgaatgggcgacggctaattggacggcgaaagggtcgtccaacgacggatgagaattgatggcacaacgggagacggaggaacagaaattgagcacctaaaaagggaaatgctaaaaaaacacggagactaatcttggtaacattcggtagctataagggttctctcttattattagtcacaatgtttgaaaaaactggccccaaccaaaaacttatggcaaacaaaaaaaatgtgaagcgaattttaaaatttttagttttactagtatttctgaaaccaaatgaacctttttaatttttaaaggttaatagatacaaaacttttagagccatcgaatgatacaaaaaatgtttatttatagggcataaagtaaagcacctgcaattcgtctttcatctccaatccgacgagttcatcgccaaccaccaaaaggatgaggtcgagcgcagaagcacagcaaatttggctgatcggctcgcgcgacgtcttaaaaaggcaagaaacaacaggtcaatggaagtcaatttcaataattatgacattttttcaaattcggaatcgattggcttttccctccgtgccgtacttcgtcaaagccaagcccttccaacgccgcttcgttctcccaattgacgacgccttttgtgctgaacaccaaaacacgacccatgctggtgccgaccacaaaagtgctgccgaaaccggagaatgcggaaacataaaaaatgaaaataattgaaaaatagagaaaaatgtaatgacaaataccccttcgccaaatttgagcaaagaaccgatgcaacgcctcttccgttcgaacaatttgagctccatcagactaaacttattttaattgttggactttgaaattcagcagaaaataatgaaaaataaattttttg

SEQ ID NO: 7800 - DNA, 4059 bp, Heterodera glycines
  misc_feature (3559)..(3559): n is a, c, g, or t
ggagtcacgataggagaaatatgcgcaaagttaggtacatctaccccccccccctcagaggagcgccggacttttcgacagaggacatttcgaattttgcgatttttgccattttcatgaattttatttcctttttgcggtagaaacccaactcgtttttgacccaactcgttttttgggtcgaaacccgaaaatcgaggccaaatcgcctaaattacctaatttaattcgggaatacttttatgtcattttaagtgatttttaagtttaaagccaaaatttagttgaaatccgaattttctaacttttcgaacttacttttcaaatgcctgtccaatttcgaagcccggattcaaattcgactaaaaagaaagaaaattcaaaaaagtgcaaaaattcatttccacctcaatttaattataacgtaaaactaagaaatgatcaaattttaacaactccagtggaagcaattttcaaacacggtaagaccgcactaacttgaaaaatttttcgagggaaacgaatatccgggtttttgcggtatgctggaaatcggacattggctgccaacggaacgacagattatcatttaaaaaaaaatttaattatacccaacaatatacaattccgacatccatttcgaacctctgacccgaatttgtaattcgaaaattcaatttttaacaaaatctaagtgtacaacgaaactggctcaactgcaggaaatttatgtcttgcctttattttgagtgtttctggcttgtttattgtattaattacaatctgaaaagaaattttagctcgaataattttatttctcaaattttcccatggtctaatccaaaattcgcataaaattatacccattagatggtcaatcattcccaaaatttcacactcggccaatcttttccacaataaccattttcaaattttattaatgcattttgttgtaaattcgaaattcgttcaaaattgaattttcaaattttgattcgatcacgggtcggcattcgaagtgggttaaatattctgaaagctcaagataaaagagacacgggtggatacaagacgctaattaaatttcaactggtgaatcattaaggaattaaatcatttacattcttttaaaatgagtgtaatgcctaataacgaccagcagaagcagaatttggacaccaaaacatctcaggtgaagaggacatttagtgatttaaacaacaccttatttatgggtgtaaagtctgttggccagggatagggagacctgaaaacaatgacgttcaaaaactcgaagtgatagaaaagtgatttaaaaaaaacaaattttaggaaaacggccaattgtcagattcacacgaaacggcagttataaaagcgccgagtggagggaacagaaaagtgccaaagaactgctggaagaaggttaacattgacttggagtacaacacgagcagagaaatttcgaggaggcgacagttggcatggcgtggcgaaagacgcggcggcgaaacgtacggacggagggatcagccgaaagagcagaggaagggaagcgcaagagtggcggaagaaagcagcgccaggaaagacgaagcagccgaaaagagggacagaaacgaggcacaaaaagagacggcaggggaagcggaagacggacgagcggagggaggaggagacgaagagacggcacggaagaggacgacggccccgacaggcggcacaaagacgaagaacggaccgaatgaggacggggcggagacaggcacggaccaacaacagcaacagtcgagggactactggtaatggcagacggggaaacggcacggcatttggagggggggggggtgaaatctgaaatatgccatgggagacacggcaatggtagaaaattgaatattataagagcatttgtgcacttctcatccatttcgcatttattctttaaagttatttgacttattctgttattttatctgtttcccatgtgcgtcttcataaaggctggtgatttttattttcactgatcattggtctgctcactgatagataatcattcatttgattggtgaactcttaaagggattaggccagctctattaaatgtcatccataggtcttttttaaacctggaatgtcaaataagaaattccctgtaattcatttacgtaataaattcccataaaacatttcgtttttgaccagagagatccaaaatgccctttgcaattttatttttctcatttcgtttcattgggtttctctgctccttcagttcatgtttttgtttatgatcggacttcgcttacaatttgagactaaatccgattcttcatttgtttacattacatcttgtcctcaagaatttaatcatacctgctaaatcagaaacaaaatgcaatgtaatgagaatatttcctaattttgacaatcctcactcgtattccttctgttcctaaaaagggacggagagcagaaaagaatcccttcccagaatgggatgtaaaatccaacgattcacaaaattcactgattcatttcttccttataaaaataaatgttatgtatttttgccttgtattatttactgatctttttgcactgtcaaattgtttatttgtcatttagtgcctcaccactccctcacttcactgtttttatgcttttacagtttcacctccttagaaaggatttatcatcgcaattcctttcccattcgctgccttttctctagtgtcctactattttcatttccttttttctttcccttgctctttcatcccctttctctgtttctcttttatgagtgcctttccacaattcgttctccactgttgtgtaataataaccacatctgtcccaccctcttttagggtctgttggtcaaaatttacttatacctatttaattttgcattgcttttctcattttttctaaatgctgattgtgattgaatatgggcggtcggggtggcaatgattttgattttgctgctgatcagagtgttttgtcttgtctgtattgatatgttatgatttgatttgctgtttcgcacctctcttaagcaccagcggtgctcccaaaataaataaatacacaaaaatttcaatttattttccaatcttttctctctttcccttctcataaactcgtccatttcttatttattccatccgttttactctcacacatttcttttccattttttcattccaacgttagtcttctcccaacatttacactttctgtccatccgtcgctctttcttttccttcgttcttttgcttttctgtttcttttcccattctttaccattgacacttcgtcctctcttccgtcctctcctctttttcgcgtgtgttcacagttactcctccaacaaccagacaattcattatgcactgtgccgctccactccttcctccccctctaaaatgccttaccacgccttcccttttagaaaacacaattaaataacaattcattgtttcattgacttaatagaaaaaaaaacaacaacaaaagtcggctaatgtctaaattttttttataggtactntgatgaaatgtccaacggatattattaccaacactcgggatcgcatggatggaaaaagacgggcacggaccaaccacaacaacagcccagggactattggtaaggacagagggcggggtgaaatcagaaatatgcatgggagaaggggatacgggcacggcatttgggaggtgggggttaaatctggaatataataattgtaagagtatcggtgccgtttgtcagccatttcggatttatttgggtaatttggcttttctgttattattttgcccatttagacctttaaaaaccctaaaatagagacacgtttataaatatacttgtgcaagggggtagtaaccatttgttcattttttgcctgctgaagaccttctcagggagtccggcgccgtccgggaaattttttgtgtttttaaggaggtttgttaacgaattttgtccaaaaaaatctggggggggaggttaagaaaaatttttaaataaaattatagacgaaa

SEQ ID NO: 7801 - DNA, 2333 bp, Heterodera glycines
  misc_feature (865)..(865): n is a, c, g, or t
  misc_feature (874)..(874): n is a, c, g, or t
cgacagattctgatttgctgttgagcagtttggagtcctgtctccgttaacggcacagtcactcgaatctgagactccttgtcgggaaaggccaatttggcaaaagacaattgccaaagagagggagcaaaggccaagcatttcgaacaaaaggcccttaatcaaaaaattaaattaaataatatttaatataaaaatggaaatacagagccgctgatttaaatgcagtgcaaaattaatggaccatccgatgttttcaaggaagaaaaatgatcaaattttaaaggaattgaaatgataagaaccaaaaatgaatagtcatgagagaattccaacaaattttgcaaggtttcctgttttgaaatgaatggtttttgctttattttattgaatatttgggaaagtattaaagaggcgatttggagatttgcataatatttctcctttttttgcaaaaattatatttcacggaaatccaaaaatagtaacaaagaaaattttataattaagtttgtgtctatgaaacattttgttttgattcttaacaaaaacattttttacttttcagagctcaacgaattagaatactaagcatttaagagcagatttttccccaaaaatcagagtttacttaaatagccaaacatttttattcttacaaattagccctgttttaatgggttattttaaaaagagcacaaacagatgttgatattccgctggtgaatttagagcatttagaatgaattttaaaaaattcaaaattctatggaatggttctgccaattaattgtctttgattttattctgctgaactccagacaacaaccaagtcaaacaaattactatcagattaattagtcanagagtttanacagcttcttctcccgttcttttttgatggataaaaatggaaaagtctccgctgtgaccaaaaccgaaaattaattataataattaatctgaacaaatttatatgcgggatccaaacaaaacacaaagaattgaaaacgatggggggggggggcgtcactccaacactaatgacattttaataacaggatcatttttataaaaaaaagaaaaggagcgacgggaaaagcacaaaatttctcttcaaactccttttcggatttgtcatttttagcaaaaaacaaaatgcgttttttggagtttccaatcgtaattttttggcgacatttttataactcaccaaaggggaatatcagaaataaataccatagccctaaatcattagcttaatatttttaatttatttaataaggcataaattaaatgaccttaaattttatttgtcgccattttttccaaatgacttcaacttcttcgaattttttgattattttgaaaattggcatttttgaatgattttggctgatttggtggaatgaataaatgatgctggttggttgatgggattggcttattcatattgcttaaatacgcttttttgttggaaagtgccgacattctttccaagttggcattggctggcggcggctttttctttttgagaggaaattgttggatattttcaaagatattttcctttaattttaaatatttaaataattgcgggcaggaagcagttgaattttgcaatatgtttatatgtagctttccccaatttttcaaaatatttgtcaggtagatgctgtcccggtcaggggagtttgaaaacgaaaaaataattttcgataacgaaaacgaaacgaaaaaacaaccgttttcttacgaaactaaacgaaatacacgaaaattttttgaattatttcatccataattaagaaacattaaacttttaaattgtatcctcaaattgagggaatggagatgctagtaggtgaaaaagcggatgtgtctctaggatgataattttttttagtcttaaaacaaaagagtccggcggtttcgacatgcaccgccagagaatttgaaaatttcattgcaatttattaacagaattagtacaaaaattgctaattttttgaaaaaaatcaaaaatttttataaatttctgactttttatcaaaaatttggaatggaattccgacccctaaaatgtcggaaatcggaaattccgtgccatccctggtgcttactgttttaattttcaaaatttaacgagatataccatgtatgtagaacaaatcttaaaaaaaaattactgtcgaaaacaatcattgccgaaaactaacagcactgaaatatatatactgtacatacattttgtatatacatactgtacatacatttttgtaaatgcactaaaaaccatcaaaataaaatttgaacgaataaatgctattttg

SEQ ID NO: 7802 - DNA, 1060 bp, Heterodera glycines
  misc_feature (61)..(61): n is a, c, g, or t
aaaaaattaaataatttatttcttttacctatttattcttatgttgatatggtctagtggntataccttctgcctttcattatttgtcgcttgggttcaattccccaccttggtagaatatatcttttatttctttacattatttcaattggaattaattaataaaaaatatttcaactaattattattttttcttttttaaacagcttaaaatcgcaaatttaaccaaagatttggctatttttttgacaaaatctgttaacaaatctattaaaacttttctcggcggcgcctatcggcaccgccggccccccggttccccaaaagcttttggaaaaagcgccgtaaaaaaggcagtttaaagaagcaaaaattcgtcgcttggcttaaaagcgcaaaaatttggcaatttttggtgaaaatctgttatcaaacttcactcaaatttaaaaaaattttacccggcggcgcctattggcaccgccagacccctgctcaagaatttactttgaaagaaaaagcgcgacgcagaaaatttttattgattttttcatatgaataaaaaaattttttattgatttttgaatatatattagagtgacacgggaccgggacctgttcagcggacaactgaggtcaactgagtaccaaggttcaggatgtggccggcgatcggaagtattcccgatttatcgcgaatttgtcgtcagtagtgacaagcaattattcttgaaacggcttacggacgcatatttatgtaagagttcgatgagaacggaaaattaaagcacggcggtcgtcggctgtcattgtttcaagggaaaggcaaaaaagtaacaaagtgctctgggggaacggatgatcaccgtgtaaaaaagacaatctatttcgattcgaatcgaagcgatgtgtccatggtccgcaaggtgaagtttagactgattaaaatacttaaaaacaatgcaatgttgcaattttgggacattttagcgctaccataatttgtctccgctctaccaacccgatgtaagaccaccagtgattcaaggaaatgattttt

SEQ ID NO: 7803 - DNA, 2959 bp, Heterodera glycines
  misc_feature (33)..(33): n is a, c, g, or t
  misc_feature (36)..(36): n is a, c, g, or t
tatttttttgacaaaatctgtttacaaatctanttnaaacttttctcggcggcgcctatcggcaccgccggcccccccggttccccaaaagcttttggaaaaagcgccgtaaaaaaggcagtttaaagaagcaaaaattcgtcgcttggcttaaaagcgcaaaaatttggcaatttttggtgaaaatctgttatcaaacttcactcaaatttaaaaaaattttacccggcggcgcctattggcaccgccagacccctgctcaagaatttactttgaaagaaaaagcgcgacgcagaaaatttttattgattttttcatatgaataaaaaaattttttattgatttttgaatatatattagagtgccacgggaccgggacctggtagcggacaactgagttcaactgagtaccaaggtcccggttttgaccgggaccgggactagtcccggtttttcccggttttcccagccaaaaattcccggtttttcaacccgaaaaggtcccggtcccgggtttacccaaaattcccggtcccgtggcactctaatatatatttaaaaaaatttaattattaacctgaatcccgaaacccgatatttttatcgtcccgcggcaaccctgctgcacatattaacatccgtaaatatacctttgccctaaccaatatccaaagacaacccgagaccgacacacataatatttaatccacaaattatggatttaattttgtttctttttttatttaattttgttgaaaaataaaatatatattatgtgtgaaatgcgtaaacatcaaaattttatttgtcactggtggccctgtccctttttattttttctttgttgtcaacattcttttgggagtaaacaactttataaacgaaaagcactcgcggctaatttccgcagaaagtgcattacattgattaggcaattatttttgaaaatataactcgcttataataaaatgtattttaatttattagcccaatttaattattttttgaattttcaacttaacttcatcaaaatggttcttcactcggtaagaattaacggttgaaagttgttcttaaaatatctcgcactaatgggttgtgcctctcctaaattatagcacagcaatttttttaatttataatattgtttagtaagtatcttcaatttttactcggtctcgaaatttccactctcgagcggactttccgtttaaaattaaaaaaagcctggcatcatgcaaaagcccaagtgttatttattagcctacaattttttttagaaaagctgaggctagaaaacatgattccaaaaaacccttataaggatatcaggaaatgtaaaaatttggtgcttcaaaatttcttttttttgtccataagcgtcccaaggtgaggtgaatttacgaaatgtcccggcacggattgtgccattggcgctgtgtcataatttttctgctgaattttcctccgatcactttttttccagcaactccgtggcgtacacattgcgaaattggcgtggcccccgaggggtgtccagtcgccctatctgagcaaagcaatggccgcgatcgaagagaaccgcagtctgtcgctgtatgcgttggcggtcggcaccgcacttgcggccgccctttggttcggtcgcggccgaacgtctccgcccccgggcaaccgtttcctggcggagcccagcgcggacagtctgctcacctgactgatcagtgatcaccagggccgttgggggactgatcggagtgcggaatcgttcattttgatcacttcttttgatcattttgttgtgatcgacgaacgcaataattgatggatgctttaacaacctttgtttataattttctcagtaaagaattttaacatatttttgtttgaatatatttagggttggtaggggccggaagagtcccaaaatgccggccgatggaagaagccgactttgtgagcgaggaatgagcccaacaacggcgggagcccgtaaccgtcacccgtttttaaattccaaaatagcttttttggatttgagaatacaaggaaatatatttcttaagaattacataatttcattttttcgctttcattcatgaaggctatgtgttgaatccccttttgacaaaatcatttatttaatttaatgatcaattttcacttatttattttgtacaacttttcttctctctccaccgatttcctctcccatcctaaccaatcgttacactttactgtaaacccaagccaagccaatttgtgtccatcccagctcactctcgactccaccccttttctcttttgctatttaaactgaattcattccttgcattattacccttttttttactcactttgactcattcccattttacttgcctttctcacttttgctaaataaactttcattaacaaacctaaagtcttacttttgattgggaaataagtcgggaacacaacatctttttggtgccacgacccgggaccaaaaaaaaaaaaaaaagttcccttttcccaaatttctgagcaaggccgcgtgccgaattgctgtcgagggttggtcgaagctgtgtgctcccaaccgaagagactaattgcggagggctagtcgaagctgtgtgctcctagctgatcaaacggataattatttgagttagtcgatctgtgtgatcctaaccgggctgtgtgccaatttcaaaaaaaaaaagtggaaaaaacagtaaaatgtcaggcgagggatctgactttaacccagcttttttcacggtggaggaaaatgctcaataccaaaccattctcgagcgtttgcgttcttttgaagctgcagtttgcagccaatttcgaaagcttgaaagttctctgaatggaagtgaacgagccacaaaggaccaattgagccgtctcgagtcatcgctacaaaatttggacgagaatgaggagatggatgaattcgaga

SEQ ID NO: 7804 - DNA, 2717 bp, Heterodera glycines
  misc_feature (239)..(239): n is a, c, g, or t
tttaagcaaaattatgccatattttattgaaaaaataataaaatgacagcttgcacgaaatcacccagcatgaaaacccgtaatccccgtaattatgggaggggggggggggccttaaacccgaataaaaaatgcttaatgctccgcgttccctcgctcgttcgtcagacatggtgctgctgttgctggacggatgcatctcgtgtgagaaccccagcggaaaggaactccaacgtganacatttcgatcattcgatacgtcaaagctgtaacctgaaaataaattaaaattaatttaatttgatttctattttcttttagggtttccttcccacgaccgattgtgacgcttattggcaccaatacaagtgggctcccctttttgacaatttatttatgaaagaaaaaattcatttgtggaaccaattttaggaccaaaaattttttctgcattttttggccataaacttttttttatcaaacttaaaacgaaatgaatattttttttctgactttcactgacacgattttttaaatgaaaattcatgcccaattttaaatcgtctaaatcacagtctaattgtacgttgaaaagtcagtactgctgggcgcccaatctcgggttttcttgacctagcaaattgatcacaatttttcacaaagtgttgatgtttacaattaaaaatacattttttttgtaatcgaaaaaaaattgcttattattttcaaaaaaatttctccacaactttttccatttgtttagacaattggacgtgaaattgaaagatggtaaaggcagctttgcgtacaatgctttgttgatggagcggtaaatttggatttaatttaaaatgccacacttttattcttaatgaatattggcacaaaaattccaattttttttttcttcataaaatttggtgtccattttcagtctttgtccaatggtcaataaaatgggagaagctgcaaacaaagacaacatgataatgcagccactggagtaaattttaaattttttaaaatttaattgcagacaattaaaacccttaatttattgtttattaaataattgagcatttttactggtggtttaaataatgtttttgttatttttatttttttaaaattatattttggcatatgacaacaaattttatcgtggcagcattcaatagtcaataattaaaattataaaatttaaaaaaatttaatgttacattttcaacttttgcaaatgagttaatggaaaatttcattgatttctgccaattaaatatatttttaaatgaagttaaatacattttaaaataatatattgtttttactatttagatacaaattcgagaatgtgcacgtggacatcatgcacagctgtgccggaggagagccaaaaaaagtgcaattgtttatttggaaaattaaattttataaaaatgtttgttatatactgagctaatttttacggaatgatccatcgagattattcccaaagtcacccgaaaatggatgatttttgaccgtgaccggaaaatcggtcagtggaaaatgcgtcagtggaaaatgcgtcagtagaaaatgcgtcagtgatgcaaatttttaaaataaaattctatggcattagtattgtaatatagaagtaaacttctataagaaaatcattctcaattgcgaaccccggacccaaactcgaacaaaaaatcgaaagtcaaaattttcgaaattagtgtttttcttcaaatcggtttaaatacacagaaacaaactgaaatacatcaatcctgcaataggagatcatttatgccgtttttgaacaaaaaatgcttaattcgaaaatttagacttgcaacttttttgttcgaattcgcgtccggggttcagaattggccgaaatggataccagattcgtggtaagtgcccccgaaaacgcaaggaacttgtttttatgacaataaaattttcactgacgcattttccactgacgcattttccactgacgcattttccgggcgcctttttgactcccaaaatttctaatgtaccacttttcctttttaaaaaaaaatctctcctcatacatttttttagcaatgctttaatttattttttcaattaaaaataatgctttcaaaacaaaagcagttttttaatttttcctagtttttagataagtttttgagctatttggttttttgggggagggtctatttttggcgtttttgatctaaattcttctcattttttttaaaattacatttcaacaaaatttattttggagaaatttttattacatttaataaaaaaaagaattggtcggcataaataaagtcaacaaactaactttgtcgaaaaattttcaaaaatattaatatttaagttttttcccgatttcagatcagactccaccttccgaccatcgacaaatttgagaaaaactttatgattaatgaccatgtcatgcaggtaaatttggtgacgcttacttaatttgaattttatgaaattattaatttacaaaagaaattatttatttatttattgccacaagttttttatatattttaaatttttatttaaaataattatggaagggatgaggcctgtcctttttgccgaaaataattcaaattttcacaaaaaattttaaaatggtatttaattaatttcttttgctattatccataaagtttccaccttctcaaaccaacttccgaact

SEQ ID NO: 7805 - DNA, 4993 bp, Heterodera glycines
tagattcgcaatcttcgtttgaacttggacgatctgcaacacgaaaccgagctggatctgagcgacaccaaccatttcaaagctggcgttggccgatacatttcggcaaaattggtcgggcctaagagaggctagccgaacacggtgaaactcgcagaaaaaacaaattattgaaaaaaaagaattttctaaatatgctaaaaaaaaaaaattaattttttaactttaaaattagctaaagagattaatggatatcaactttttattaaatttacattgaaatggcaaaaaaaaagattttggtcagtcttgcaatacttattagaccgcgttattttgaaaaagcctgggcaagtacctatattttctgtaaaaaatccagacccaaaaaactagttccaaaaaattcctaggcaagtcctttgtgctaaaaatttataaattttttaaattttaatcgaaacagaaaaaatacgcagacggatgaggaaggactaagaatgaggaagtgtagcgcgataattaccgtgcttggaaaattaatttttaaacctgactattttctggcattgtgtttttctgccattttatgcataaaatcgatttatatatataatttttattttgtttaatgctactcgagaccaaaatcccacctttctcctgttgagacttttctctcaaagagcaaatcatcgatggccagcaataattttctttaatttgcaccgtcggcgtctattagcaataacatagcccccccccccccccgatttaccatattttgagatttgacccttatggccagatactctgcaatactgtgaagctttcatatataccaaagttttaatagaactcatgttattataaggaagaaaaaatactaaaaagtatatatatttttttattttaatcaaattcaaaaaagttacatgtcttaaaacttttgtacatataattttggaataacaaattcgagtcaagtttcggggaaaatttaatatttttttctacactttccaattttttattggaagtatgagaaataataataatataaaaatgtttgttcttgtaattttaaagattgatttttttataaatttaaaggttaatttttgtaacatatattcaacattttcagaatgagacatattttacaggaaaaatgccttggaatttgttttatcgaccagtgaaaaatcataaactaattaacatttgggataaatttatatattatttcatttcttcgtccattttattcaattagacttttaaagagttccgttcatttattttggcatgctgtccttgcactgtttgcccttgcatttgtacagcccatcgcccttctaaaaaagtttttcatttattttttgagtaaattgggacaaaaaagaaccctaaacagtgatcagcaattttgaattgatcggaccaatgttttcaagtttgttattaaaactttaaaatcgcaaaaaaaacaaaacaaattttaatcgatttttaagttaaaactcaattataaatagttatgcaaataaaaatttaataatcaaaatttttttgtaattgtcatctattaactcgaaaatgtgtttttttttgccgtactttttcaaaaaaataatgggggagcgggtcttcgtgccgatagcgccaagtcgaaatatttccaaaaaaataacaaattgttaggaaaaaaaagttagtattattctataaattttttaaaattaacacaaccacaaccattgagtattatggactggcaactctttttaagagaattagatccttcagctccataaaatgcgacataaaccggaaattaataacattaaattattcttaaaatacgcttgccaaagtaatccatgaagctgcgcccactgcgccgccgtctccgatgatgccgaacgcgcccccctggggaatgccggccaaaaagtcgtatgccaatgcggtgatgccattctccatgctcagcagtgcggtgtgcatttgcctcactttgtatgtctcgtgcaactgttttcgctcgccttgaacatatccatccaaatatccattctcgccaagaatcacatcgatgcattttgtgacattgctttcgttgaatgcaaagtattgacttaagcacaaccaaatttggataaaggaattttcacggtccgtacacttgccgtcaatttttttttaaaaaaaaaaaccaaaataaggcttaaatcttcggatgcgaaaaatctgacacatatccgacagttacatttgaaaaatattgtagaaagtgatgtatccaaaaaaaacctatttttttttgccttataacgtttaggaacaaaattacaattaactacgaattctttaattacaaaaattctatttatttttggaattgctgaggcaaaaaaaattattactcgtcatggataattaacggtggtgttacactactaatctctgtcaattaactattgaaattaatctcgacaatcaccttatcgggttaaacgaagtggagaccatcaacgatttgttcacgtaataataagaaagttcaaatccatgaagaactttgtcaccaaattggggccaagatttcttttgtgccttgcggcatttttccgcaatttcactcttttcaaaattttccaattcaaatcgagaattgagcggcccattggcgggattcatttgtcccacataacaaacggtcaatttacaacaattcttcggctcgcaattcgtcaccacacacatttgcatggtcaacgtgcgtcgattagtgttcggtggggcatcattaaagtacagcttgacaagttcgggcagtgccccattgagttggtcggcgtaaattgagctaaaaaggttatgggctcgaacaaagaaggcaaactcgtacaagtactaggccaactcgtactgtattcgatagcccttgagcttttttgtttcgaagcaaaatttaaaattttttttatcatgtttgaaaacagtcaaggacaagttttttttaatcatttctgaaatataatttttgaatttagcataaagatagagcatcttaagggccaccacttgaaaccaagaattttgacaaaagatatgacgatttttttttgttgaaaaacagaacgagtggggacaaaaacatgaaaaatttagcaaattaaaaagattatgggttgtgcaggttttcaaacatatttttgcgcatattaggatttatgcatatgagaagattaaaaaattagtttaaaataaacatatacaaaagtttaaaaaagacctactgatacttgattaccttatcaaaactaaaaatcatatgtttcccaattcagctggttttttttttgtattcaccaataaaataatgtgtattcatttttaataattattattttttatttacatttcgccgtgttcatcaaacacaactggcacatttcgagaggtggtttctttgccggttttccagtctttccattttttcgcgttccttgtttcacggctctggcccacttgtccgtcattaactattgcttcgtaattgggaaaattattagtagatgcttattaaatttttagttatacttaatttattaactaattaattaattaattttaattaattaattaattaccctcgtcggctgattccacacaaaaattatggagaagcaaaggaagccaaaaaagggtgaagagtttaaggatgtccattaatttaattaatcaaaaatttggtttaaactaaattattaatattattttaaattcttctcattacgattgatttataaacatatttataaaaatagttggtgttaacccagggacagaaattatcatcatactccatcaaagcaaaacgaaaatggatggtgaattttgatgaatcaccaaaacgttaaacgatttagaatatttttgtactataatttttttttattagtgtaagaaaaaaacaaatttttaaaagaaataatgaataaaatggcatggtataaatatttaaaaaataaattaattttgactaagaaaaatagcagaagcattttggaaaatctttaccatttttgtaaaggtatatattattaagggtgcattttttgtttttttttaatatgttttacaccgaaaattgattggttttttaaaattttaaacagattggaactttagaatttattttctttttttatgatttaaaatccgaagaattttcagcataatcaccagtccgtccgaaattttaatctgttaacaaattgcactcttaattttctaaattttccccggcggcgactaacggcactaccggcttctcccaaaaaaatttttgggaaaataatgcgtcaaaaaattgaaaacttgggaactttccaattgaaaaaataataattttcttaatttaagaattcagataaaaacaaaatttgaaataattgattccgatatttttttgattgattttgaaaatgttaaaaaattttagaatttctcagtaagaaaaaaattcgtatttcgcatttcttttcgtgtttttaagaagtttcgtgttcgtgtttcatatttcgtaatattttttttagtttggtatttttcgtattttattttccgattcgcaacactcctgacaaatgagtaattagtcgatatctctctaattatcgcaaaatatagttatataattagttaaatgacttcaattttttattaaaattgattcatttatccgatttaatggtcgccccaatgaaaccccgctaaaattttttgtttaccgcacccgagttgccgcccgaatcccgacctttttctcgtcccgaaacccgaatcccgacccgatgtttttggttcgggattcgggacaaaataagcactggtaagaaaggggtctgagtgaaaattaggtagataaggaaattggcgaggaatgataaatttttgaaaaaaaaattaaaaaattgatttc

SEQ ID NO: 7806 - DNA, 1811 bp, Heterodera glycines
atgactattttacaacgcatggcgggaaaaattgccccctatgtttgatgttgcggaacctgtgtgggtccagtgcttgtaaaaaattcagcatggacaatcgatgtgataaagtgcaagaaccaacaacatttgtaacacgtaacttgtggattcctagctgggagtccaacgcatgctgcaccctccgtctgattttttgtgtctcgcgcaccgctctgtctggacaaggcacaccagtcaacacagcacgggctgatcgaaataaaagacatgcaagagtgcgttttttggggagacgtagtcgtatgatgattgcatgaaatcgttgggggtcgtactcggaattgaagccattttttgcaattttcaaaaactgctcttttgtgaaaggcaacagctgtaatttaaacaccgcggtacaattttgaataattaacattttttatctaggagaaattaaaaaaaacaacaacaacaacaataacacagcaaacttaagcacatataaaacacccgatgcgtattaatcaggcatcttttatgacgctcagacactcaagcggaaacagagaacaatggcaccaccgccaaattgaagaacacagggaagctgaggataaacgagctttacgccatgcttcacatagtagtaaatacggacctaaaaacaatgtatatctatacaattgaggagctgataaatttaaattaaaaaaccgtaatgccaagataaccgcgcatggcatatgcagtttgagcaggatgaattgtcagttcgttgcaatggacgcgaaaatttttccaggcaggacgcagatgattggtgcgtaactgaagctgagagcgcaacatttccgaaatttcgcgacgtttgttcagcgtctgaagcagaacgtgaagctctttaacagaacatttgtagtgttggcagagaaagtcaatcagcgggacactcttttgcttttcgttacagctacacttggactgtaagtgttgtcgctttggcggctcaatctctaaattttttttcatttttttcttgtaaacaaccaaacctttcgctcgttccacttccatttcaccagtttgcaattcatttcctcgctcctcctcctcttcgataattttaagccaactgatttgctcttccttgattttatttattcatttattttatttttttaaatttatttttgtgtaaaactcactgctttgacggcatcgtctaattcttcttccacactagaaattgttgttgttgttgttgttgtctttcgctctgggaacgcattgtggagccaatcggttgcaagaattgcgtccatttggtgtttgaacaatttaagaatgatctaaacacacacacacttatttttattatatgtatatataaaatagaaaatgtaggtattttgaaacaatttatgaaattaaacaaatggctgacaattttcaaaaatttgatgaaaaacatttgcaattcagacacccgttcacgctgacaatctcggggagcacggggagtggaaaatcggaatgggtgctgcgaatgctgaggaatgtgaatgcgctagtttcggaacccatctccgagattttctattgttatggggagttgaacccaaatataatacagctacagaaaagtggacacatcggcggctgtagggttgttgtacatgctggaagcccaaccgaagagcaggttaaccggcgcgcaaaagagagtgatggaaaactgctgatggtgctggatgatctcatggatggtatggggcaacaatttcttgacactgtgttcacccggg

SEQ ID NO: 7807 - DNA, 4902 bp, Heterodera glycines
gcgggctccccccattggtttatgttgcaaaatgaaccttgtaaaaggaagaagacgtacagttaaacataatatgaatgttagcccgctgatgttgaaaaatgctgacttcttacgccactttcgctctaaatatcgctcaaaaagcagtcagcgccaaatgattgagaatgctttggatcaacagctgctctgctttgtggaaatgtgttttaatgtgttgaagggtcttgttccgttagggaagcgacaaattcaacggttggatgaactgaagcaccagttgaggagcttagcacgcgcgcgttgcgctaaaacagctcgcagggtgctattgctgaatcatcaacaacaacaacaacaaaccggtgctgggttcccaatggtagccagtatgttggccagtgttctcttaccagtgttgatggacaaatttttgccaaaaaaaactaattgacggggaaataaataaatatataaaagcgaaacagcaggaacactcatatatttgagacatttgaggagagcgcaaaatgcgtcatgcaatgcgaatgtttctcgtcccggaggacgtctttcagtcggtatttgttcaacaccacacaacagcagcagcagcagcagacggtgccgacggcacaccaattgggcttttgcgctcgcgcatccaacaaattgagcgcagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaattcagcaacgccgctgccgccgccgcaaacgatcaatcattcaacgccaaaaagattggagaaaaacattgtaccatcagcgtttgggttgaggaggcaaagacaccactacacacaaaaggctggggcattatcaaatcgcagacctgcccaaaaacaacaaagaaaagcagcagcagcagaaacaccaaacagcagtggaaatggagaaacggaaaaagaagaggggaatggagatgatggggaacagtgggacgacgcacaatcatcatcgtccacggcgtcaacaggtggtgccgcagcaaaaagagtgctcagagcaagagatggggaagcaggaaaaggaggaggagaaacggctgatcgccttcaaacaaaacacaactaccaaatgaccaaaaatgcactgatcacacatattcgaaaaaaggggcacagtctgggagtcagtgatcagggaaaggttttgcgcgcagatgggtccgagtttaaaacgagcaacgtggaggcaattgtcagccatttgttgaacagggacaagcgaagcgaattcaaaaggccgcctgtgggctataaggaatttgctgataaggctagagaggatccgttgctaaaaaagtatttgtttccggaacagcctctacaatttggcaaaggcctgactgactttaggcatggaaaaagacataaaaagaagtgcgaagggggaggagggaaaagtgtcttcaggttcaaaccgacactatggtgatagaccgaaagaaagaacagctgttggaccaactgtacaaagatgttaactcatcggtcagctttaccagcgttgagccgcttttgcgcgaggcgaaaaaggtgaacaatcaaatgagtagaaaggatgtagtggactatttggccacccaacgcacatacaccattcatagacaagcgaagaggcgctacaaacaactatcaacactcgcttctggactgcacaccgaatggcaagcagacctgtctgtctttgacaaattgtcgcgagagaatcacggctacaagtaccttcttgtctgcatcgacacattgagcagacagctctttgttgagccggtgaaaagcaaaaagagctccgacatggttgctgcttttgaacgcttgtttaaacgctccaaatacataccatggacattgttgaccgaccaagggctcgaatttaaggcaaaagaggttcaggaatatttcaaaagtaaaaacgtgaaaaactttttcatgtacacctcaccgcgaattcacgcagggatggcagaacgggccaaccgaaccatcaaagagcgactttatcgctatttcacggaacggggtacccaaaaatgggttgatgtgatacagcaaattgtgcatggaataaaccactcgtagaactcaagcataaaaatgcgcccagttgatgtgaattttgagaatgcagaaaagctcagaaaaaaacttaagcagaacgcagttggtgggacagcggaattaaagcggaaaccaccactaccacgtttccaggtgggtaaccgtgtgcgcattgagaagtacaaacacgtgttccaaaagggctacactggacgcttcaccaacgaagtgttcactgttgccgaagtgcacactgaccgctttccagtcacgtaccgaatacgtgatgacgatggttcactgattaagggtcgtttctatgccaacgatctttgtcgtgtgctagtgcgcaaaaatgatgatgataccctatatgacattgaaaaggtcgtccgaaagaggaaaaagcaaggtgttgaatacgttttggtgaaatggaaaggctacagtcaacggcacaacagctggattcctgcaagctcgatgacatggaaaaatatataaaggggctcttttttttaaaatttcaaatgagaatgccttcatcaaactcatgaaaaagcatggtgttgaatacgttttggtgaaatggaaactttatttcaaaaaatttgtaccactgacgcattttctttctactgacgcatttcccactgacgcattttccactaacgcaatttccggtcacgcaacttttacatgcttgctctaacctgacctgataattgtcgcagagtccaaacacgtaggttatttcttcatggtaattagcgtcctgtgatttaatagaaatatgattatatacttaaactcggacctcttgtgacgagtcctcatcagtggtttcagtcaaatcaattccttcaaggagtctataatcaaaaatttatcttttttcaactctaaagagattaaaaaattaattaatatttagaaagcgtttagcgaatcatatattattgcatttaaacaagattttgaaccgaatcgaaaatatggaaaaatggacctttacagaagcttttaaaggccaatacatttttctgaaaatttgttggatttcgaataaaataattaaaattcactgaatattgaataaaatcattaaccggaatagtttgaattttttttaattttgaagttcaatagcgcctataaattttcaaaataaagcctaagcacagacctagcccaaaaaatttagctagagttgaacggatacatttacattttagattcattatttttgtgatacaagaaaaattttagaacaaatgtgaattgtttctaaatggcgcctcgtggcgatcacaattttagagaagcctcattttaccaaataaaatttttgtttttaaccacacgcaaaataaacaaattattacctgctcggttttgtctttgatttctggttgttgaagtcgagcaaccactgcacattttctttctgtaatgattttttgcatttggctctcaacatcggtgctaagtacagtcggaagagcaaacagtcccgtttttttaagtccaaatatctgcttcaccacctaagaaattcaaaaattatgaatttatattctaaagatagggttctgctcaaattaaatgaaaaagtaaataagattaaattaaaaattaaaaactcagaattttaaatttttcggtggttggcgattcgggcgacgctcgattcgagataccgcaccaaaaataaataaattttgcgataaaataaaatagataaataaagctggatcctgtggcatatgagcctaaagtaaatttttattttatcgaaagttaattgacatttggcctgccaatatttcgcttttcgaaacaccaaaatttcgagaagataaatcagaaatttttcgaggtagaagacgcaattatataaattttttaaataattaattttattaattttaaattatatagaaaataatttagtgagagcaaaaaaggtaacttacatatgtgtatgccgcagatcgaatcgaacgcatatcacctttcccaccttgctcgtttccatgatgagcaatttcgttacctattccaccttaaaaacattttatttttgctctaagctgcttaaattaccaaatttgagatctatgaacgcaagtaactgctcagcaagtaactgctcatctgtatacgtagatggcagtttgtgcgttgtgtggctctccatggcatccgctttgattgttatctacatttattaatacattctttcccaaaattagaagtacataattattctcatacttcctatgatcgcatcgggctgaactttttactaagtttactgacccaaattaaaaagcaaagaaatttatttaaaaatttagaggaaaatttgttacgttttttaaaaattaataatgccccaaaatgataaattctacttatgttttaaaaccgagaattttggccaaactcttcgcagatagcgataatacaagtaatgatgtgcttatagtaaggtacaatcacttttttattcatgtggcaatgcgcaaaaaatgaacaaatggcgcacctctaaaaatataaaaattgtattctatatttataaactttttgggttcttaatatttatgggacatgtatgtttgctaaaaactacagcccgattgaaacataagaagtatgagcaaaagtcttaaaaagaatcggtctaaaaacatacgctgatg

SEQ ID NO: 7808 - DNA, 2091 bp, Heterodera glycines
taattttacatttaatccatgccaaacgtagcgcaattgccccataaaatgcgaatgaaacgatcaaatacgtccaagagtaggggtaaacatctaaattaaaaaatgttttaattgttttattaattaattttacataggtaaaatggaactgaaatgatggccaacagatgcattacaatacactggatgaaaattgtcctaaaattgaaaaatatatctgttttttaaagttatctaattagcatgattcttggtaatttcggtagtttaagctataagcgaaaatgtcaaatttgctgattccgctgagggattgtaattcaaaatatttttgtgaacacgatatcccacggcattaatcccaaaaatgccgcaattgccaaaaaatgctggattgcggattggaccccgtaaatttccggcgccgaccttttattagcattatttttaggggtatattttatgaaatttttgaatcgattcttaggtgtgtatttttggtatttaatgcatatttgctatgaaatttcaggaaaaggggctctaattattagcattaattcttttcgtaagtttgatattttaggcatttgaccaattaccgtacaaatgtacagtaagtatccttgtagtgtttttgttttctctcacttttttgtgactttttgtgcataatgaaacgggaacagtacggcatgggcacggtttgcagccactgcaacaatgtgcaaacgcatactgatccagccaaatgtttggcaatttgccgctgttttcacaatgaatccacgaacattggcagggattagaaaaaagactgaactcttgtttggaatacttgacaacaggtagataattgttggcaaaatctaaaaggcaaaatttggaaattttttcggaaatttcctcgctttttattgcacatattttggtgtttcccgccgttgtaccgttcatgcgcgaaaaccgcaaaaaaggatatttcgctaaaaccgcaaaaattttaattattaatttatttaaaatgttattaagtaaattaattgaataaaattatttattaatttattaaagtaaattcctgatgacatttgcggaccgacttttgcggaccgacttttgcggaccattatttctgggttgaactgtctaaaaaaacaaaaataaatatttttttttcaaaaattgagcaacaaaattagttttatttgtggtttttccgagttgaacatcatcatccattaacagtagtaatctaatcaacttatgtaatcaacatcgaaagaacccatttaatttttagaagtttagtttccattaagaaataaatagatatacttagttgctcgtttttaattttggttggatcaatggttttagaacaacaaatatgggcaatttttggggaaaagatagaactatttttgcttttgtttattaattcaattgtttgatatgccgtataaaaatttaaactctcggttaatagtgaaacactaaaaaaatttttccttggtataaaatcctgaactgacttttatatgtattaaaatagcgaattttttcgccaattttcactacgcgtagagaagcaagaaaaaaattttccacttggtttgggctaggataaaataaattctccaattgaacagatcgccttgcatcagcttaccttcactaatttttaattttggtagtatttaatttattgaaaattttttttctttattttgacagttcaacccagaaataatggtccgcaaatgtcgcactacggaatataatcaagcatttaattcgtagtgcgacattcgcggtcatttgcctgacttgatgagaatcttcaactgactcgcgacctcgtcgaaaaggaattatctgatccagtgcgattacgtggatcgaggtgatcaatcccctgaagaacatcatgctgctacttggctacaaggtgtggtttgactttttcagacgatactaaagaaacgttaccatttttaggtcatataatcgacatcgattgtgctgctgacaggaaaccacgagactagacacatcaacgcaacgtgaagttttatttctcacact

SEQ ID NO: 7809 - DNA, 2498 bp, Heterodera glycines
  misc_feature (2430)..(2431): n is a, c, g, or t
gagcagcggaacaacagaaacggaagcgaaagataagaaaaggcgaaggaaaagccgacggaaacgcagcggaagagccccggggcaaatgccatcggtcaatgggaaaggaaatgccaacggaagagcagcggaaaagcgcagggacaagtgcagactttgtatgggcttcagcgacagatgacaattgaccactcattgtgccattctttaggcccctctgcacgttcagcttgtccgtctgctagtctccagatcaggccaagggcgcgactctacctgtatgtacgcttggtttatcctctcgagcaaacaacgtttagtttgttgaactattttgaccagagagaaatgccccccacgggaaaaaaaacgctgcccggaaaaagacacatctaatttcaataaatggtcaaatttgtttaaatgcatttttagcgcctaaattttttcatattttttatttataatttaaaataaaggaaattgtagtaaatattcattgtaataatttttttgatacgaataaattatattttgtgattattcaatttaaattaaagaatgaacgactgcttatcattcattattcgttgcaattcttatcaaatcctgagattgtttttcattaaattaaacagacaaatatctcgtgagtagatttcatcgtaaacaaaatttgggcatttaaatatatgttttaattttatcataaaattcttgaataatcttgggatttctaattgattttgttggggatctcatcaagggattggcggaaaaaggttaaagaaatttttaacttaaaaaactgagtacttaagagaatcgtgagctcttaatggatttctttcctatccacgtttttgtggatgataaagaaatcagtgtccatcttgacgaattcaaagtcgatatcttattccccaaaattgctgctttgtttgaatcgcctgcggcttcttttgaccaaatttgtttttatggttaataaattaaataattattatctttttttatttatttttgttaggtgttgatgggtcgccaaaacgaattcagaaagaagaaaagcaacttgcactgttgcttttgtatgcatcacacaactttggcaaattgaaattgtttaaatgcgatgactgacttatcgtagaatattttgatattaatcccttatatatttggatatattttattttttaaacttactcgtatatttttggttatttttattttttaaaatcaattatttgtttcacttaaattgtagttcatattgttaaatttatttttttaattcactaaattatccgcaaatgtcgatccgcaaatgtcggctaaccatttaattcaatcaattttgatctatgatcacttgaaaatgtccacttttgaagtaaataaagttgatttatattctcttgcttagtcaattcagcagtatgattatttaaagctatttatttacttaacataacttattataatattgaataataatgcaaataattttaaatgaatgtcttatgactagggatgcgatttttaggcaaatgcctaaaatttttgcgcacttaatacgcacagataagcacaaaaacgcattttccgcttggtttggggtgcctaggatgacttttacaatgcctaactttgcctattttggagtttttgtgcttaatgcctatttttatgcctatttcgccatttttggcgcctttacaaggttttcggcaaaatacacataaatgtgtagttccctaacagaaatgaatttatttatttttttttctcaaaaattttctcttttcacaccaattttttattttcgtctcaataaaaattccctatataaaatgccaatcacggatcaaaatcacggaaaaattgaaaaaatccgtgacccgtgatccgagatcacggcaccccaataaaccccgtgatttccgtgatcagtgatccgtgatcacggccagccctggtccctactcatcagcagtaagattataattaaacattcagtccccatttatttatgataagagtcataccccatattttagtcattctctaggaataacgacctaccatttgaactgcggctttatgccacgaaaaagaatttcttatgagtaattttttttgcgagtttgacttcatgggtgctcaaaaatctatgaattttgaacaagcgacataaattttttaataaaaaatttaatagtttcaatcatatctgaaagagcaaattctgctctatgaataacattataatatttttatcatttgagcaaatgtgttacagcccgagatttctcacgttgtttgtcgagaaacctatcgatgaattttacacacatattttattatctgagagaaatttgcttaataatattaaaaaaaataaattataaataagttgtattnngcatatatatttttaaatgaatgacttatagaattattttatttgattactttgcttaataacattt

SEQ ID NO: 7810 - DNA, 3160 bp, Heterodera glycines
  misc_feature (798)..(798): n is a, c, g, or t
cgaacactatatatatatttttgaatcgctattcaaaatttataatttttgattccatgaaaacattaaaattctttaaaatttaccataatcaaaggcacaaagaatgggaagctcgaaaagacagcagcagctctgaccaaattaaagaaagaagaaacaaaggatggaaagaaaaaaaggaatattcattaattatttgtcgattaagaatgggaaaatagatgtgaattttattttataaaaatttctttagttgttaatttaagaaaaaaaatcataatcacaaatgaaatttccaataaattgcgggatcccgccgtgcgggattgcgggattttggaaatttcaaaaaaaaatttaaaactaaataaaaaatttcaaaataaatatacctaaaatggcgacacataaaattttaattaaaaactaattgaatgaataaacgatggaagcagaatttgttattttaaagatcaaaaaaaaaacatatttttgaaccttttgttcaactgttttttgcgataaatagaaattggtttaacactaaaacacaccctttggatttcatttgtcattatggtacattagccaaccgtatacccattaaaataatgtgcatgaaaaacgagacctttatcttttttagtcgcttctagcatgaaatttttgttgcttttttttattcgtgaattcattaatttttctacaaaatttcaaatgaaccgcaaagtcggttctaaatggggaaaatattttttttaatgaaaattttgaaaatatgccttaaaattgtgnagaagatagtgatcgatcaacaacaaaaaaaacggccgatcaatgggatttacgcgcaattgatcagacaatttgagcggaatgagcatattttgtgctatgttggaaatttaaaaaagaaatatcttctttttttatgggttttattatttatttatttgacttctttgcacttttatgacgtttttacctttttaagcaaaattatttaatttgtctattaaaaataaaaataaaaattcagagtcccaatttggtttgtaagaaataggtgaaagacaaatcaattaataataactttacctcaaaaatgaatttcttaaaagggccggccaaccatcgacagtatcaacagcgggggtggcacggaattccgattacggcatttttggggtcaaaatccgatttttggctgttgttttagaataaataaattttctaagttgtagaacaaaatttcaaattgaaaattttatatacgcaaatcttttttaaacgcttccacgaatatattgttggaaaatgtataagttaagcaaaaaatagaaaagtgagctttttcgtaagttatggatgatgtgagagatggacgtaatgcacaaagaaaacggtagaaaaaatgccggaccaaatgagatttgggacgagaaaattggaggaaaaaggtggcaaaaaagagaggcggatgaatgagaggcacttgacgaatggcaccagaaaaaggtaagacgaagagcatttctgtcgatcattcttactccatttcagaaggggaatcagccggcggcggtggactaggcgcataaagctataatttgaaaagtgcaagaaaatatgttttaatgaattactaaaaaaatcaatggattaattttaaataaaaataaacaaaacagctcttttttattataggtttttatgggcatttgaaaattgcatttaatttgtttgatacgttagcttacttcatttagcaggtcgctgacttcactcatgaacccgtcccaggcatccaaagtggcgaaaaaggtgaccatacaaacgtcccattgctgtttgattttaaaatatttaattaaaagaaataaacccacaaaaacattatcaaaaggcaaaaaaataaaatttaaataaaaacttgtttaaggataatttgtgctaaatttagtgggcttatcataagaattgacccacaaaatcaattcattatgcttacaatatgaagcggcaacggatggaaagtcaggccaacattgaagcgcatttcaagttcattcaaaacgccctcagtgaagtgctcgcgaatggccgctttctgaatcaattttcaaaaattttatgtaattatttaattccgaggatagaataataaatatttgaatattatttatttatttaaatggcttaaaccccgtggccatgcggtggcagaagagaaacaatgaagcgtctctcattagcaccaacgtaacagtaattgatgagatcgtggatatgatcaaaagagaaagaagcccaactccagtgtagacgaggaatcagtgcctggattgtgtgcggagaagggccagttgacacataagtggtattggcctcacgtgcctccaagtcctaggacaattttttagagatttgctggtagaaactgtcattttgaaaagcctacacctgtatttatctgggaaaaccttttaaggctcagaaaaaagtaaaaaatattaaggtggccaaaatttcttttaatttctataaacctaaaaccattctgcaatttatttcccactggcaacaaattagagcaattattttcaaaattattattaaaaattattgtacttcgattttccatcgtttttcacgttttgtgcatcgaaacaaaaggtaaaatattgagtttgttttgctcaaaattttacggcaaaaaaggccgggaacgaaacgggacatttcgtcgaagagttcggctgggagagaacgatgctttaccaataggtgatccatggggacaattaagcaattttggggggggaggggggggggcggtttgccgacaagtcggaaaatgggacaattgaaaaggaaagtggaaagtgagcttaaatggagatgagaataaatatgtacaaaacatacctctattaatgggacattgactaaatatggaaaagccatttgacaacacaggattgaagaaatattgtataataaatgaatgcttttcaaaaaccaaagagattaataggagttgtttgcgcctcacccatgtttgatttttcggttttaagtaattagggtttttcagttcaaaaatgatccaaagtagtaaatataatagagataaattcactgataaacaacccca

SEQ ID NO: 7811 - DNA, 1953 bp, Heterodera glycines
tgagaaatggaaaagaaaattgaagagagagaaataacacatggaaagacagagcagagggaaggagagagtgtgcgtatttctcggcccttctctccctttttccaacccatcataaatattcgattcattgcctgttccttcactctttcccacgtttccttagccttgcgctcggtcaatacagcgagcaatgaggcctaaccgagctgctgttattgctgattgaaaacttttaccaattacccgccttggcctgcgaaagcggtgccatgtgcaatttttggacgccctccggggcttaaaaacgaagcatttggtttttgcctctttccccgctcatttgaatcgcattagagaaacctcttaaaggaatagcccgtagctcagtcagttaggaaaatttttaggccgctgatcgtgattttaaggacagaatcactgatactgaccgtaactcttaaaaaatttaaattctttttatttctattactaagtatatattatttgattatttattctttattttttattaaattataaattgttcatttgaaaataatcagttaataataattctaaaaaactaatgaatgtgttgaagcgttgccaaaaataaataaaaatgcgatcaatcggtaagacagataatttaattaactcaacttaacaaactacgaattttatttgattttttttttaattttttatttttgatgatgcatttccataaaaattcattgacatcagaagtgatttttattaatgaatgtagctaattaaattattaagaattttattttttatgagatttaaatcctaaaaaaatttcatatttttctcaggcactacattatttatttattaattgtcccccaattataagtaaatacaataaaaaaatgtatgttgccactttcaggcaaaagatcaatataaatggaaaagtcattaaggagttagagttgataaagtaaaaatggtgattttttgggtaggtatttttgtggctgatttcaagaaaatgaaaagagatacagaggcagagaaaagtgagtaaatagagaaaagttaggattataaaaagtaagaaaaaaaatttttattacctaataaatgaattatttgagggccgagtctgaaagtggtctccaaaaacggcatttttcggaaccaccgctaacaattttttttgtaatgccatttgaaaacactgaatttacttaatcttggctaaatcggccacgctgagtccgaatatggccttagatttgagctctgtgtcaatgagcatgtacagcttgaacttcatgcacgaagttgaagcagtacaagctctggttgaaaagataggacagatttaaggccatatttggattatacgaccctaatttgttatacaaaaccgtttcatgaatgattacaaaatttctgggcgcgctttttcaagaaatttctaattctaagaaaatatactctttaaatatttggtcagtcacctttagttggaaggggccggcggtgccgatagacgccgtcggaccgggacctagcttttcaaaatccaggacctggaaccgggacctcggatgaccgggaattcccggccggtcccggtcccgtgactctagttttacgtgttttctttcaaaaaatcctaaataaaaaattttaaatgccttttttcatggaaatacacatttccaatcattctgttctacgtagagtattggatcgggataccaagctctgcctttgaattttcgtaattgtctgacccgttgtcaaacacgaagttcaaagggaaaatctagtaaatgcttctcataaatgctggaagaccttgtttccgattaacacatggaatcaccagaaaacttcatcgaatgaaaattcattaatcgagttatactgttaaatatagaacatgtaaattatttttattagtgataa

SEQ ID NO: 7812 - DNA, 1113 bp, Heterodera glycines
actgactttgcttcgaacaacgtgcccatcgaatgcgttgtgcaaaattcggccgttcgactggtcaccgatcagtgagccgtaaatgcccatttcactcacaacatcctccaacaacgccggcattttttgtcgcatcatataatttttttaaaatagaattattttatttttttgccaaattctaaaaaaggacatttgagaatttttattgtatccatttacagagaaattttggagttactttagtctaccacccgcaaaaaaaatgaataaaaatgatgccatttattctctcgtgccctgtaatgcccaggaaaaatactcatgaagtgcggaaatggcaaaaaaacgggttttgaagcagttcaaaatgcgtaaaatcggaccaggtggggcacttctaaccttttaaaagggtcaaacccatacaaatttggtatcattcgaaatctattaccacgactggtaaagtgcgtaggcaatgttttgacgagaacggtttaggggcgcctccgaattagccaaaatggccggctatccgccgtgctcaatcgcaagtttgtccagcactttttgatgcaattttgaaactgcactgccaaagccgggccccccaattcctccgatgtttacttcaacctaaaatttgaaagaattttttcttgtaaatctttgaaaattttattatttgaaattatttttaattttcggggagcgggcgcggaacgtagtgcatccatagattccaccaggacctgtttgagtgccatggtgccgtcgccatctgacgggtcccaatgtgccatataatccgcacgttggagttgaacagccaatggctgatgaatgccctcatcgtggaacattttggcgatttgcacaaagcgtgccataaatgggtcaccttttgagaaatgaaaaatattcattcaagtataatttttttgacccgcagttggaaaatattaaaattttgttttaagtaaacataaattaaaaaaaagataaatgaaacctataaacgaattggcgatcatacattaacaaggggtgcgccagtcagacccccccatacgtcggacgtttggcgcagggggggggggggggggg

SEQ ID NO: 7813 - DNA, 2667 bp, Heterodera glycines
ttttggaaaaaatcaagtgcttgatgaaaagtacagacaaaatcaatgatttttcaaaatcagagtttagattcgtgatcagcacattttttttaccctagaaaaaatgctttttgaaattttattttttttccccgtcgggccacaattctacacctttgccatttacatacagtaatacactactgaccaattgaatgagcatagtcaatggcatattgttccagcgtgcgcaattgatcattgtcgctgatcacttccaggacatatttgttgcagtggtgctcccccctgttggcgccgctttttttgtcccaatttccagcgaatgttcaaagcgatcagcaagttttgtgccattctgatcattgacatttttggcatagacgccaccgtcgcactccatgctgctgtgagcagtgtaaaagaaaaaagaaagtttgaaattacgaaataattcataaaaattggtgtcaggccgtaattgagataaaactgagatccgagaattttggccctatttggaatatagcaggacttgaaattatatggaaacctatttttctcggggctttttgattccaaaagactgaaaatgttatggaaatttactcgataatattgttaaatttaaattctttcttataaaattggggaatttgtagcaaagttattttatatgtatattttacacgaaatttcagcgccgccaaggagaaaaattaggcatttatagccgtttttcgccaaaacaaagactaatttggccactttgggaccaaatttcaaaaaatatggtaaagtgggggtctggtgatgccgctaggcgccgccgggaaaatttttggacctttaatgcaattttttaaatttaacatggtaatttgttgtgtggtcggcaactgaaaaatagggaaaaaccagcagcactaaattaatggacgaaattgcttctgcggcttatgagaagaacatcacacaccagagaaagggaggaacaagttgcagtttggtgacgtgtttcacacacatttgtatgttctctaaccatatgacagatatacagcaagaggaaaagattgtttggcagagagaaaagcactcaacgcacgagacgaagtcaaacgctgattggctgaatcaggccgaaggcgggcggcaggccggcaacgagagggaaaaactgttagccagagagaaaattaaagacacactgcttggcagagagaaaagggaaaagtgaaattttggcgtattatctcttcatttttaatcggaaaacaattttatctcgttgacttggatcctagtaaatccgctttaaattttgcataccattagatagagaattcttgatctaatataggctttttgtataataattgagatatgttttttaaatccaagtttattgtcattaggagacctaaatctcttatagttgttgattcttttatttatggccatatttttgcgattttatatccatatttttccgagccctactaataattgtttgtacggacaaatttggagaatcaatggaaagcagccaataaagtaaataaatgatcattttcccgtggtgagccgaagtgacaaaagtatcaatgttcgtaataattaaatttaattattatttaaatttaatttgctaaataattaatcataacttagcttaaacttagtcaaattaatgaaatttaatatttagagacagctccaattatcctctactacttaggtgatttttaaaaaattactaaaaatttacaaacagttgcgaccaaaaacttccaaaaaatttagattcaacaagtttaaccctaacttttttgaaattcaataaaatgtaaggtcgtttaaatgcatgaaaattcttcaaaaatcaattaattcacaccgcacttgatatgaaaagatagcccaaagctttctctattattcagttaaatttcgaaaaattttattgaatttcaaaaaagttaggatcaaaattgttgagtcaaaactttttcgtactcttttggtaaaactgtttatacatttttagtaattttttaaaaatcacataaatagtagtgctgttcgagaccaaaaatttcccgagactcgagaccgagactcgaccccgagaccgaaaaccccgagaccgagacccaaaaaacccgagacttttttcaaaaaattttcctattcgcttaaaaatcgttaaaaacattttttgctctattcttaactaatttttggttttttttttaattttgattcaatttggtacaatatttatcatttcaaaaacgcacaaaacaaaaattcattaaaatttaagtgcaatttgttaactgatttagtccaaaaaatgaaaatattttacgaatttaattgttaaaattatgattgaattcccaccgaaaaatgaataattttgaaaaattagaagaaaaacaactacttggaggggaattacttttttttaaaattttcttatttcttaaaaattatgaaaaattactattacgtttgaaataatttcatttattcaactgaaaaattatgaatcaaaggccggcggtgccgataggcgccgctggggaaaatttgtaattttagtgcactttgttaatagatttagtccaaaaatgacaatattttatgattttaaat

SEQ ID NO: 7814 - DNA, 848 bp, Heterodera glycines
attcgttgtaaattcattcattaaattaaaatttcattaaattaattctcaaactcgtcacagggtgcgttatattcttcgtttatttctgctcatatggtgttctgtatatgatatttaatcaaattgcattatttatttataaaaaataacgtataaattcttattttcatttttaaatacaagcatgttgttttttatttgtttgtcgttttttaaataaataaatagttattcttttgcatctgataaaaagttaataacaatttttattatttaattcttttttataaaaaacaaaaaattctacttattgtttttctaaaaattgcataatatttctatcttttttggtgtaattattaattattgctgattatccatcgtattagttagtgtcaattttattaatattatataattgtaaatctataaacaaacgggttagaaatgcgtcaataacattattcaagtaaaacaatacataattaacaacttttagaattaaaattaaaactttttaaaataaattttggttaaaaaactcggtatcatgtttacgaaaactaattaattaattaagaaaataatttaaacataaataaaatttttttattaaccaacaaacaaaaacaaaaatgtttatgaacttaatttcataaaaatcattttgattttaaaatattttctttttacatggttatttttaagttctatttttgcaccaatatgttaagaaataaactttgcgaaaaaatggaaaactttgaaaatatttaaattccaatatatattttgaatttttaatttttttgaatctaatttttctttaaatttaattgattttt

SEQ ID NO: 7815 - DNA, 2148 bp, Heterodera glycines
cgggcgtctcgcgcccgttttttaaattcgttgaactcatacaggcgcttcgcgcccgttttttgaattttgaggtacaacagcgattagaagagtgattaaaaaaggtacaacagtgattagaagaggtacaacaatgattagaagaggtaaaacagtgattaaaagagagaggtacaacaaatggcagaagaggtacaaaaatgcattaataatttttaaaaattgtaaattaaatgcctctttttattattaaaaaaaactttgaagtttataataaaaattaataatatttattttatttaaaatgaaattaatttttttacaaattcagaaaaaataatgctattctttaatttaaaaaaaaataaattcaaataatttacaaaaaatcttcaaattaataaatacattagtgattaaaagaggtaaaacagtgatcagaagaggtacaacgtgattagaagaggtaaaacagtgatcagaagaggtacaacaatgattagaagaggtaaaacagtgattaaaagagagaggtacaacaaatggcagaagaggtacaaaaatgcattaataatttttaaaaattgtaaattaaatgcctctttttattattaaaaaaaactttgaagtttataataattgaaatttatttagattgaaatgaaattaatttctgaaaaactcaaataaaaaaaaatatatgaaattatttaattaaaaaaaataattaattttaataaaatttttcataaaaaaataatttaatttaaattaaaaaatttattttttattataaaacaaacactcttctaaatgaattaaaaacattaaaaataaccataaatataacgaaaataatttacaccgtccggatccgaacctgcccctcccccccccccctcaaaatgatgcctcagaatccccaatcacacagggattctgaggtcttgactatgtcaaaagtaaaatctgatcacgtattcgtgatcagcggcccaaataacccctaaagacatatttttggaggatttttggtgaaaaaaattttccacataaaaaccatgtgcacccccctttggtcccgaataaaaaactgcgtttctttattttctttcattatttgttttctttatttggattttccaatttggtttttactgcctcgccgtttcagcaacggaatgcaaaatgcttaaaacatgaaaaaatcttacattttttaaatgaatttattttgaaagggcgaggcatattcttttttttttgctgtattttttgttttgaaattttgcatttatttcattattttttggtattttaaaagtaaagttgacaaggcatttatatattctgaaaaatcgttttttaatgatcattgctgacctgactttagtacgaaattatacacaaaaaggtaaaataaaattggtttttttcttttactgaccttagaaattaaaatcatttaaaaaattgacaattttcatttatatttgaataaaaaattgtaaaaaaccaactaaacttcaaaaaattgattaaaatattgcttaaaaaattgctcagttttctcttccggatgcaaagtttaaattaattaaaactcattatatatttctttaaaaaattcgctcaaaataaattattttgggcaaaatatgttaacaaaatccaacaatttgtcaaaaatcttcattgaaggaatatttaaacttcagggcttttttctgttcaccagaattgtttaaagtcatcaatgacagtgaggaaaagcagaacaaagatgctgaaactgctgaaagtgggaaaacggtaggaatgctcgggattttcctgttcaggagacggaatatttattggagtattactgaaatatcaatgtgcaattaatagatttttaaaaattaacacgaaatcatatttatttttttagttttcgacatttttattatttaaattgaaacgagacgctgtctaaaacaaaaaaaattaaaattaaaaaataataattatattttccctattggcgccttacaaattaaagagtttccagacagagttcactgtgaaataatatttcttaattcattattggtatttcgtaaaagttgcttcaaacgaatgccaatgccaaagaagagaatc

SEQ ID NO: 7816 - DNA, 3549 bp, Heterodera glycines
aaaaaaagaatatgggatattttttattgatactttttcaaaagattttgagattttttaaatacatattctattgtacaccacttaaaaatacgaatatcaataatataaatttttgatgtttttaactagtgttattaataaagttccccctttttagaaaaaattttttgtttaaaaagtcagggaaactcttgccccaattgtgaaacagtggatcaaacatcatgagaagacttgtgataagaatatcatactttaaaaggtgccagcgcgtttcttaaaactgccagaacgataaaaatatttacagaaagaactcgcttaatataatatttattcaaaaattgttgattatgtagtgtaattaatttgatgcgaaaaaatccaattgttcaacaatatgccaacacgttcagtgaggtcgacatgcgtttacatatcactgcaatggggctgaacagagtccccgcactattcttcccatttcattattctgaaaaaaacaccaaaaaataattaaagaaaacttgtaactatcctaatgataaaaattgctattcattttcaataattctcgaatttaaaaataattttttaagatttgttcttatccaacgtttccttattcacttactgtccgtcgctttgattcattttatcccggtgatgaaattaattggtttatttagataatattttttgggatttagaattattgttttatacgtggacttatctttttgtttcctcatcattttacgtggcaagcgattcttttggcgtggattaaatgtaaaaacatactgtagtttttctcaaaacagtaagcctcccatttcatagagcacctacatagtttgaacgcatcgccatcataggacagggacagtacacgaattactgtcacatgctttggaattcaaatccaagtttgtttttatgcgttggtcattactgcaatcaatgccaaatggtacactggctttacgacctgtcatgtcacccaatcggactcattttttattagccaatccaactcttttggcattatatcccgttttagaggaggtaatttaaatgggaaaataaagggtttttttctgtcaaggttttgatttcgagaaaaaaaacagtaacatccaatcaaactgtaagaaatttactcttcaaatgagttattttggaatttttgttgttagttgactctacaccaaagcaaaaatttaattgtataaaaattgattagttttagtggatatttatttattcctcagagagttgccaaatcgaatttgaaattgggcccaaaattcgcctcaattttgtcatcagaatgacccaaagtaaggaagggatgaaaagaatcatcagcgaaagatggatcaacgagaagatcagagaaacctataaaaaaagttaaatgattttgataattcaaataaaaattaatggtcataaaaaagttaattaaaatgattattttaaaaattgctcatttttgtttattatttgccaacccaaacgaagtccatttttggtgcaaaagagctgtcgagtggccaaattgatgcccattcctacagtatcaccaataccgtatgaatattcgtaatttgttcttttttcttttgagttgcctaaccaaatttcaccatcactttcatatacataaatgcccttttcatatagaattattccatccaattttgtcttctgtttgacggcgaatccaaagctaatgaaccaactgaaaatgaaaaattattaaaaaaagaaatacaattaaaataataaatgaataaaattaataataatttcaaattttagtaatctgataaattggattgaaacaaaataaattactaatttttatttttgactaaaatttcgtagtaaaaaatgttagacgaatccttgttgagcaaaatcggatatttagcgaagacggaacgccatgcatctttttagaagaaatagaatttatttattatataatttttaaaaaataccataagaatttttcttataatggacaatgagacttttgttgccaatgatttcgagattctcatgacaaaaattggcatcccaataattttgccggaaatttgaagatgccttaatggtttaaattaaataatttatatttgttctctctttttcacctgctgctggacttttgcggggtcaaattcgaattttggcccaaaatttgtctcaattaaatcgccagaatcactcaaagaaataaatggaaacaatggaagaccaaaaggaggcgaaaggaataaatcggaagtatctgaaaaataattgaaatataaataatttaaaataaaataagcaactcaaaggttggccattctttgtgaaaatgacccgacgagtggccaaattaatgccacaaccgacgaaatcgccacgagaaaagttcgcatttccaatattgcttggtccattgacccaaaattggccatcgctttgatatgcacaactgtcccaattttggccaacacttccgtccaatggcatcgctttggtggcaaatccgaatgagcaaagactgaaattgaaaataaaaatcaaccattttcatatgtttcatatggtagtgctaccttttgcaacttttaatcttgatttcgaagaaaaaaatgcctgattcggtgaacaaaattgaatgtttagcgaagacagaacgacgaccttaatgttatttttttataaaatatatattagtattaaaaattaataaataattcatccattactgtatgtctataactcagtataaattagcctacaagggagctcaccaactgtaactccacgtactgtaactcggaaaattaacctattttctccatgtccccgtcctttcttagaaatgctttattccgattttgtggatttgtaactcgaatttttcgtacctttcagaaattaattcacttaccgctcccatcgcctttgtaatagacttttaaagattccgtgccaaagacttcgagatcattgtgactggcattggcatcccaatagttttgttttgggtacgaaaacttctaaaataattttcatgttttataaatctattcgttctctttcacctcaacaatattcttgcgaatgtccgggtgcacagcttttaaaagctctaaaaattaaattaaaaatattaaaatttataaattaaattttcatttttaccctttccaaatcggtctttcaaaacgccaataaaaatttcttcattctttttatgttcctccaatgcgatgatttttgtttcaatggctttgatcatgtctttttcggtgttcattttggcataaaattccctctgttggccatctaaacaattttcaaaagaaaatttttaattaaataaaatttcttagctcatataaaaatatcctcaacaaaaataactatttaataagtgataatttattcttcgcttaaaattcactcgcctttggccgtattttcttcgtgctgctgtttttgctgattttccatttcactgattttttccaaaatttt

SEQ ID NO: 7817 - DNA, 4214 bp, Heterodera glycines
aaacatggaacggaaagtgatttttggctcgtccctccattattgacaacaaaacaaacaccaaatagcaaatacaaaaacaaccaaattcaatggaccattcgaatttaattcattccgaccggttggaaagggtgggagagattaagagattaacagcgaaagaaaagggtggcacaacagcgaattggagagaaaaagaaaaacagagaacggaaatagacatagagagagaaaaagagagagagggctaaaggaacgcgcaaaaaaagagcgaaaaatgccgaaccaacggagaaggaatgaacgaaggaaaagagggagcgaatgccgtggcatgacaacgaaatgaacgaacgaacgaacgaacgactaactgaatgtgactgactgttgttgcttgttgctattgccaatttgtgcattcgttacatttttaaattatactttatggcgaaatatttattttaaatgcattaggtaaatttgaatttcgctaacaaatcaaacaatccatccattcggtcggactttttcattaaatgctttaaattttcagaagattttaccaatttagatcaaaaaattttcccaatctttatatattatttttttcaaaatgcggcagtcgaccaaccaaacgccggtcactcgcacaacgacgacgacaatcactgaacaacagagggaaggcggaggagaccaagtgattgttttatcaatttttcaaatacagccgataagtccgatcctttttctaatttagcagaccaattctgaacaatttgtgcttaggctggaagcaccgcccgacacgcggccgaggttagccaattccaagcaaaaaaaaggactttgttttgtttttaaagggtccaatggagcaccggaacagtggacaatgaaaacatgggcaaaaagaagtcgaaatgttgttgtatttacaagaaaaagcgcagttgggacgacccaaacgcatcgagcgaagacgacgacggagttggtttaattaattaattaattggcaaaagtaaataattaaacagcaaacagacccagattctcttgacttatacgatgtttttttctcttggaccaatctcgacgaatatggtaccaatcgatagctctcgatgagacagatcgatctaggggtgggggaagttgatccgacaagtataaaccggtttttgaaccgattcaaaacacaaaaagtgaagaaaattgggcaacctcatgttgcatgaatttgttattcaaaactttttttctgtacatttaaaataaaaattgatatgggccaaaagcggcgcaaacttttggtcaatgttaaaaaaagtgagaaaacaatcattggtaaaaaaagcactgggatgagaatgaattcgtgagagatgtcactgctcaatggaagtcttggcaaattgccatttcattttttcgtttcatttcgctgccattggcaatgtcccgcgactggccaaaatggccaacacgaggaaaagtgcgtagacggcgagcagtacgaaggcatggagcggacggacgaagaacttctgggccacgaggagcagcaaagtgcacagcagagacagggccaggaacacgaacatcaccagggccacggggtcgggctcaatctgacgacggcacggggaggggacattttggatcaattattgacaaacatttgaaaaacgaagtaaaacttcaaaaagaagcctactgtacttggaatactgtgccggaaactcagccagaatggcattttcattgtgatttcataaatttacgagggagtcccctccctcgcggaaaattaattgccactcgcccaaaatcactcacaatgatcactttcccctgcaattccgcaatcaaaaaagtggtgccaaagccaaccatcaaatctgtaatcaaactgagaattgctcactgactttcgtacagtgccaaaaccaactgaataacggcgcgccaatggccgccgaaaatgccatccgcggcgtgccctggcgagcaacggtcacgtccgcaatcagatcaccgatcgaattggcccttgattttggaaatgtctcacactttcatacgttttggccattgtggcttaagtggggtctcaaaagtgatcggagtctgcttttgattgtttttcctccttttgtctttacgctttctcctctccccctccctttttttgcttaccacgcaatggccgtaaggcccaaaatttggtgagggatgccggatattgtgccgaacatcagaacaacattcatcacctcaaaagagaaaacagacaaagggggaaagaacgggggaaaaaagcaaaaaatggacggacttccgaagctgtggcataaatccaagcgatggaaatggcaaagccaaagtaagcggcgcatctctgcaaaaaaaatatatgcattattacgtcattattaaaaaagagacttggtgctacattgtttataatatttcaattaaatggtccggcagcccaatatttcggagaattcgaccagaaatggcaatttggtcagaccggaagtgccggcggaagctcactctgctgatgagttcggaataaaacagatgcagtgttttagcaataaatgtgaatgatcatcagcagaaggtccctcacattagcaaaaaaggtaattaattctaatcatctgatcagagaggagactccatctgtgatcagtgagcatttagaaagtgtgggcatttgatcagataggccattgtttgtccatttttgaacccattgaaatggcctcaccctgtaacagctgggctctttttggagtttggtgaagcagagaacaaacagtgcgagaaggacggaaaggagcagtgccaactcaccgaggacaaaaggcggcacaaatgggagcggagttttgagacctgaacttggcatttcgacaaattatcactctctcagggagcagaatgaatggcacacattggaacgcggcacagaaaaggagcggtgccatgaaggcatggagtgcggagatgggctttgaccaatgctgagaagcacagggaacggtcagccgaagcagcaacagagagggaatctgaacggagcaaaaatggaagaaagggaaacggaaggaaatgaaaaagcaattaaagcaattaaagaaggacggactctccgtaacgagagtctcgactcaagaaaagccatttttaaggcagcactctcgagtcttggtctaattaatgaaaaagtgactttatgcgattgtaagttgtcccatcactgcgcctaattaggaaattacttttcccagtaaaaagagccgttttggccacgtcgagtgccgtaatcgctgagtgtccagcggacagaggaggcgcagcgcgcgtcccaattccgccttccatggacacacggctgttgaagccgcttcgcccagcgcagaaacgacacattgtctctcgtcgacagaaatagaggacgacagagtcgcggatggcgtacagcagcggacggaaggcgtgcggtcgccgtcactcgccgctgcggtaaattccgtgccctcgtctccgcccagttcgtccaattcctcctaaaagaaaccggtcaatttgtatcggaaacattctcatgcagtatgccgttatactcgagtaaattttccaacagaatgaatggcccttcttttgtgtcgagagtctcgagttatcgtactcaataaggcattaccgcaaatccccgggcacaaaaacaaactttggcaaagaatttgcccgctcccaaaaaggcatctgctggtgcttctccctcttcttgtccctcttctgctcccttttggttctgttgcagttggccattcagtcgactaattgtgccggcgggggaagcgatcagtgccccgggtgatagcgctatccccatgctcatcagtcgcgccgctgtcttttccattggccttcgccccgggggtgtcgtcgtccgcgccatttcggtcagtttcggcgttgcactgctttttgtcaccccgtcgcccgcctccgtcgttgtgcttacgctacttaggctgtttttccttttctggtcacttctgccgctgtcttccatcggtgccactttgtttctgaggctgctcttcggcggcacagcagagagaagcgactaatcgccgcgtgcattcgcccgcgccgctccgccggtcgcagcactcgctgac

SEQ ID NO: 7818 - DNA, 1419 bp, Heterodera glycines
acttctcgagtgcatattgtattccaaacaatgggaagcacgtaattatggcttacgaagaatacggcatttaaaaaacctttaatgctggattaagggttctccctaatcagcatttgattgcgctactttcagttctctaactccctcccggctatcccccttcgacgatatctcttggctttttcgactttgtccgttttgtttctctttctctgtaccgcatgggtgccacaattgcattgtgcgactgctgaatgaaacatagacgagcagcgagagtgccaaaaggtagaagaagaggtcgcgcagaatcggacggcgcatcaaatggaagggccgactgagcgcgatcaaagcaagaacgcacgtggtgacgaaaatgccgccacctgcggccacaatcactgatcagtgatcatcctcagaatagaagggtttgacaactgaccgagcaattcgctgatggccaaatcagcgcgcggatgcttggccgaaatgaccgaagcgatggaactgaaaatgtccggcgctccgttgccaaaggccataaaactgacgccggcgatctgaggaagggaaagtgggcgatgggaacggaaggaatgggcgaacaaaaggacagacattttgggagatgcgatgcaggtcgacctgtccaaaaagcgaaaagtgatcagataaagtgatcagagaatgatgaaagattggtagcctaacagctaatccgcttgttatcgtctcggtctatcgcagccggattagatccaggttaatgataagccaactggtcccgataatctgatcagatttggtcctaataaaacccccgagcagatcagtgacattcccattttagaactttgccatgcgaaatttttaaatttttcttacgatggcagcgatatttttgcagaaaaatgagtcggcagtgatgctgagatggacaaacaacagaatgaagaacagaacggagcagaagagcacaagcacacgagagaaggggggagaaacaccggcggaggagggggagggggaggagcacaaggcatactcagtccactgatcagaaaggggaacaaccaaagcatgggcagctactactgatcagcagcatttgaaaggcttaaagccaaggctgatcggttgtgattaacattatctaagccacaattttcgataggggagatgatcaaacgcggacaatacatataaaaacccatcaccactcacttgaaggtatccgcctccgtcacaaagttccgagtgatttttgacgtattggcaaacggctgaggcgggggggggggcgaatgagaaagggaaaaacggcacggaaaaggaaaaaaccaccaaaatgggaccatgcgaaaagggccggaaggtctcattaatcatccgcaattggacgagatgaca

SEQ ID NO: 7819 - DNA, 2482 bp, Heterodera glycines
tctcgacctctttcgaatggaattgggccaactttcaaattcaattgaatttccaatgcccgggtcgattggtgacatccgaactccgcgcttcattcccctaggccttttcgcaatcacaagtttttgtggccatattttgggcatgtgtttgcccagcgtatttcagcccaactttttctgtaggcaaatattttattggctttaatttaatgacaaatttctcacaaaagaaatatattatttacacgaggaatggagaaagaaagcacagggcaattgcaatgacaaattgaaatggaaactttgaaatggacaaacagagaaagagaaagtgggacgagtaaggggggggggggactgatcaacgatcatattaatcacaacagtactgtaagtactgaatattttgcctgtgtaaatgttgcggattttgtacggtaaacccagccgaactgtctaatttctgaaaagcattctcgagaatcccattaccaaaacggtcttttccaataccatttgtaaaatttcatcgctccccctcccccaaaaaaaatttgtttttccccttctctttgtcttttctcagtctgaattagaaattccgcttaatttgttccggacacattctttgaaggagttcagccaaaacatttgctctgtccgttgcttctggaaatggaaatgtttggtatttattcattttttgaaagtgcctgtcaatagggtaattaacccatggccaattcccatatcaggtaattaatttcccattaattgcactgactttgagcccgcgactcagccggtcgctcatcaccgcaataaactcgcgatagctgagtttgtcgtccgcatttgcgtcaaatattttgtatattacgcggacgagtgccgagtcaagcgaaaagccagtggagcatttgactgcacggatgaactcactttgggacacggggatatcggccaacgaatagagacgcacagccttactgaaagaacgaaggaaggagagagtgatcgggaaatggaaaaagacaacaaaaaaaaaatgatcgagaaagtgatgggaatgaaagacataaaaagtgataggaaaaatggaaaaagtcataaaaattatttttcaaaattttttattcatgtacaaaaaagcaggccaaaaaaagttaaaaaactgagtctttgagttctttctggccataacttttatgacacaacgaaaatttttgaatatttgcccgttaataatagacacataaagctatcgaacaacaccaagaatacttaatatggttgagaagggaaaaagttatggtccaaaaatggagaaagtcgggataaaaataaaagcaaaaaataggaaatccgtttcacctgaactcttccaaattattgaggaacatgctgaactgctcgaactgctgcagtgtaacgccctgacaatgaaattgcgaaccattcaaacccatctattcgcccactcacctcctcatcatactcactgacagtgaaacatttaatgcctcatctaaatcattgaaaatggtaataagccacgcccggttacaatcacagaataccaaagccaaactaatgccaattgaaagtttggtataaaaaagcgaaatttcgaatgactattttttgtaaatattctttattagaaaattcaaaatgtcctcaaaaagtgccacctccgttcgtacgcccttcgaatgtacggcgaatgctcctccttgtgcaaaatggagtatcggaggacgagccgggcaaaatcgacggtggaaattcgggttttgccccgggcgaactcgtggaactcaatttcaatgatttctcgctggagacgatggtaaaaactgaaccaacaataattcgtgggtgattcatctctgttttttcattcgtccgatgataccgtattatgttatgaacacggtaatttaccgtacttctgaaactcgtcaaatgaaagtgtgttctgcccacgtcgtccgaacaaatgaatggttagtgttgtgtcgcgccttttcatcgcctcagtcagttcgtcctaaacggcggcgggagagaggtcaaaggatggtggcaaatggaaggaaaaagtgccaaaatgaagaaatgttgaattatcgtcctaacgaaaaacaaatgagcaaaaattaaaattttgcccaaatttttcggtgccatggcccatgggacaaagccataatcgatgaaaaatcaccgcaatttaaattaaaatttgcttttcggaggatggatcaatcagctgaccattgttggtcggtaaacagccaatttggaagaattatccttcgtgtttttagaagacatatttttcaatcgttgttcggcctttgtacgaattaatgccacattcgaggagatcaaatgttcaaactgaaaaattgggggaaaaaaggcaattttgaaaaaaaactaatggaaaaatgggttttattgtgggataacc

SEQ ID NO: 7820 - DNA, 1080 bp, Heterodera glycines
cccttcccgtaacacttcgccgagggttgaaagccatatcattcgctccattcattcatcatcattgcctcggactgtgcaatcaataaataaacatccaaaaaggcccaccgctgacttgcacacattcattcaattcacacaaagttctatctttttctctttgaaatctctgtcaattcacatcatcaccatggcaagtcaagcggaaatggcaaatttatttcggcaattaacggatgccctccaaaacattgcaacccaaacaaacccaaacccgaataaacaaaattccgacctattcactacaattaattcacaattgtctgagtttgtgtataatccggaaacggattctacatttgacatttggcatgatcggtttggcgctttcatcgagaaggacggacaacaaatgccagacgacatgaaaacgcggttacttttgggtaaaatgagttcacaggattacgcgaggtattctgagagtattttgccacaaaatccaactgaccttggttatcaggcaacggtaaataagctgaaaagcttgttctgccagacaaagtcaatttttgtgaaaaggtttgaatgttttcaacttcagagggcaccatcacaaagcgtaatggactttgccgaacaggtcaacgcctgctgcgaaaaggcgcaaatggcactttcaaaagaggagatcaaggcgctaatttttgtaagcggtttaaattcaggtgatcgagatttacgtgagcgatgccttaaattgttggaggagagtcggacaaagaacgtggcgatcaaattcgtagcaattgtcgaggagtgccgcaccattttgtcacttcgtagtgcagcggcagctctggaacaacccggccaatgtttcaatgccaatgcaattgctttaaaaccccaacaggcaaaagagcgacatagtcggcatcaaaagttcagtccttcatcacgccgtgaaaacagcggaaatcagtcccgctctccatcattgaacattcgccgatcataaaattcgcgtccaccgttcccctgcaagtggtgcggcgcaaaccattggaacagcga

SEQ ID NO: 7821 - DNA, 3799 bp, Heterodera glycines
  misc_feature (49)..(49): n is a, c, g, or t
tcctgaccctgatcgctcacggtcaatcaaggaaatgccagtaccgtcntgatcaacaaaagctcagatcatttttgggggcaattaactattattcccgatttgttagccaaatgagagacatcagagctccactggacgaacttttgaaaaaggataaagaatggaattggggaccggaacagcagcaagcatttgaaaacgcgaaacaaatcatcacgtctgaccttttgctcactcactacgacccgtccaaaccaatcgtagtcgcagctgacgcgagcagcaaagggatcggagcaacgatcagtcatgttttcgccgatggaaaagaaaaagtcgttgagcatgcttcacgatctctgtctccggccgaaagaaactagtcgcagatagagaaagaagcattggccatcattttcgccgtgcaaaaattccaccgcatgttgtatgggaggaaatttacactattaacggatcacaaaccgttaattagcatttttgggtctaaaaatggcatcccaatttatacagcatccaggctttcaagatgggctttgacactgttcaatacgatttcaaatttagtacatttccaccaaagattttggacaggtcgatgttctctctcgattgatcatgcagcaccgcgaggcacagcagacgacgaccatgtcatcgcaacggcacaaacaattccgatttcaattcaagttcagaagattcaattgaacatgccacggctgccgttgagtatgttttgcatgcaccaattaccggtgacagcaacagaagtggcagagaaaacaaagcaggacgaagagttgcaagaagttttgcaaaattgtcgtaatcattggccaaaaacggcacattcttcccttctttctgcattttatacacagcgtgcacgtctcacggaagttgatggttgtctgctcatgggcgaccgtgttgttattccgagttcattgcgcaaccgcattctcacggcattgcattttacacatccaggaactgtcagaatgaaaagtttggccaaacaattcgtttattggccaagaatggatttggacattgaccggtgggtgagaaattgtcaggagtgtctgtccgctgccaaaatgtcaccgaaagtgccgttgagtccatggcctttccaagcgaagtgtacgaacgattgcacatggatttcgccggcccgtgtgcggatggaaataaatatttggttgttgtggactcgtacagtaagtggccagaaattttcaaaatgaagacgacgactgctcgaattttggtcgataagtttagtcttgttattctctcggtatggctatccaaaagagattgttaccgataacggacagccatttaaatcatttgaaatttccaaattttgcagagaacacggaattcggcacacttttgcaccaccgtaccatcccatgagcaacggtcgcgctgagcgctttgtggacacgctgaagcgtcagttaaagaagtgtggggaaacagattcgcattgggtccaaaactcgttgttggcgtttcgcagcacgccaaacgcaagtctaaacggcaagacgccagctgaattgtttctaggcagtccagtccgcacaattctgtcattagttaggccagacgaaaagaaaaagcattcggacacaactgataagcaataccggcacaaaatggcacaacaattcaaccgccattatgggacgaaacaacgcacgttttgcaccgacaatccagtgcaatttgccaactacaggaacggctcaaaaatgtggttgtcaggaagaattgtttccggaaatggtgtcgtttggcgaatatattccccacagttaaacgcagtggttactcgccattccaatcagatcaggaaatcttttcccatcccgtacagagacagttcagaaccaaacgagcaacaagatcaggatgaacagcaacaagaagcacctcagtcaccacgtcatgtgcgatttgccgacgaggagaatgagccgcttgaacatgtccaaatcattgagccaagacggtcaacacgtcaacgaaaacaaacacaaatatttgacatggacacgacgagagcaaaatacgatcttgtcaatcccgggcaaaatatttaaaaagggagatgttgggataagacaaaatagacatgcattaatttattttctctatcttttcccttcgctattttccctcaatgtcttttcctttctctctgcccgtcgaagtgcataaatagtgactgttcctttcgttctctccccattcattcgcaatttgccttctcttctcttcattcactctctctctcctcagacttttattatttaattttgtcaataaactttttgttcactgtgccctttggacacaacaaaaaatatataattaaataaataatatgagaaattatgaaaaggtataaaaaatatttgctgtaatcaaaataataaagcttttgaaaaagtaaaaaatataaatgcatagatttgaaaaaaaccaacaaaaaaataataattcatattccttttaatttatttattatgggataaaaaaagcactaaataacccagacaaaatattttcagctaaatgcaaagaggaaagagtaaaaataaaaaataaaaaattggaataaaaaatttatataatttttaaaatcaaaaaattttgtttaataataaattttaaaagttgcaaaagtttatttttaatttttttttttctattgcaatcaatgatgatttaaagattaaaaaatttcagatttaaaagtttatttattaacaaaaattatttaaattctattttaaaactcgaaagacctcaaaataaattcaaaagctgcaatctcttaatgtttttatttatatacacaaaatcgtatctgtaatctttacataaaaagaaacttgcgaggaagataattaatgtaaatagaatatttaaataaaataaacgaatttatttaaaaagtagacaaaatattatttttgaacttaaaaataaatataatagctatttaataattaaattttttaaaactttcttaaatatgacaaaggcaagcatctttgaatgaattattgatggaaatttttacttgaaattaatatgctttattttattttcgttttacatatacttattttgttatgaattataattaaaacgaagaaatcttttaaatgaatatgaaataatttctaatcaaaacataaattaaaaaatacattatattattatttgtattccattattaaggcattgcaaactcaaaaaagaaaaataatattttttattttacttttaattatttttaatattatagaaaatgtttttatcttaaacaaaacccacccacacatagaattatattattaaagataatataatttcttttattgggtttttgagaaaaaaaattgtgttcattattttttacagataaaaaaatcacaaaaaaaaatcattaataaaatttcatggactaaaaacgattgttcacaaatacaaatacaagtaaaattaaatacaatacttattaatatattaattttttaaataagtctttgcaataattttagtattaaaaaataattatgaaatagtcaatttagaagttaagttgaacttaattttttttttattaggatcacaattaaatttagattttttttaagtaaaaatccgaaatttttatattcttaattaaatagatttcaatataaagagaagaacttactcttggcgaagatttatttttatttatttt

SEQ ID NO: 7822 - DNA, 2353 bp, Heterodera glycines
  misc_feature (49)..(49): n is a, c, g, or t
  misc_feature (71)..(71): n is a, c, g, or t
  misc_feature (81)..(81): n is a, c, g, or t
  misc_feature (118)..(118): n is a, c, g, or t
  misc_feature (122)..(122): n is a, c, g, or t
  misc_feature (134)..(134): n is a, c, g, or t
  misc_feature (150)..(150): n is a, c, g, or t
  misc_feature (154)..(154): n is a, c, g, or t
  misc_feature (189)..(189): n is a, c, g, or t
  misc_feature (210)..(210): n is a, c, g, or t
  misc_feature (220)..(220): n is a, c, g, or t
  misc_feature (238)..(238): n is a, c, g, or t
  misc_feature (240)..(240): n is a, c, g, or t
  misc_feature (252)..(252): n is a, c, g, or t
  misc_feature (256)..(256): n is a, c, g, or t
  misc_feature (267)..(268): n is a, c, g, or t
  misc_feature (270)..(270): n is a, c, g, or t
  misc_feature (278)..(278): n is a, c, g, or t
  misc_feature (283)..(283): n is a, c, g, or t
  misc_feature (286)..(287): n is a, c, g, or t
  misc_feature (321)..(321): n is a, c, g, or t
  misc_feature (329)..(329): n is a, c, g, or t
  misc_feature (341)..(341): n is a, c, g, or t
  misc_feature (387)..(387): n is a, c, g, or t
  misc_feature (397)..(397): n is a, c, g, or t
  misc_feature (410)..(410): n is a, c, g, or t
  misc_feature (440)..(440): n is a, c, g, or t
  misc_feature (451)..(451): n is a, c, g, or t
  misc_feature (453)..(453): n is a, c, g, or t
  misc_feature (457)..(457): n is a, c, g, or t
  misc_feature (477)..(477): n is a, c, g, or t
  misc_feature (486)..(488): n is a, c, g, or t
  misc_feature (490)..(491): n is a, c, g, or t
  misc_feature (493)..(497): n is a, c, g, or t
  misc_feature (501)..(501): n is a, c, g, or t
  misc_feature (2216)..(2216): n is a, c, g, or t
aaaccataaataaattatttatttttaaattaacctcccactaaattanaacccccactcctcaaataaanctccctttcnaaaaaatttaacctataacttctatctcaaaattttnaaantcctcatttcanctacaaaaaatcctcntttnccactaaatacctcaaaaaatcatcatttcacacnaaaaatcttcatttttaaaancataaaaatncaaacaaaatcaattaanantcatatttttcntttnaaacaatcacnncncctatcancaccnccnnatctattttttcttaaaaaattaacccaaaatcncaaaattnttaatttttttntaaaaatctataacaaatctcatttataacctcaaaaaaaaattcnatttttattnttttaatatattnacaatctcttaattttttccttttaaattnctttttttttncncctnttttccaaaaaaacatttanataaaattnnnannannnnntccnccagtgcgataggcgctgccggaaaagatttgggattttgagtgcgatttgttaacaggaaattaattaaaatttattacaaaatgaggatttttcgaaaaaatgtttaaaaaagttcgaacattttgccaaatatatctaatttttcaaaaaatcatgcgtttttgtcacttttttatcaaaagacaaccaaaatcctcaaatttctcaaaagaccacaaaaatccgcaaatcctcattaaaaaatccactttgactctctaaaagaccacaaaatgaggaaaaatcctcagatatcgaagctctggttttgccggacgagtattttagaattaacaggactttttttaacccgtagaatattatggaattttaagaaattgaattagatggtagattaaatcaactaaaaaaattatggcatcacttcttaaaactagagttgagcggaccgggaaatttgacaaaaaccggaacgggacttaccgggacccgaaaagtcgggaccgggaccgagtttttctactgggaaacagaatttaccaaaaaatgaccaaatatttagttaatttgtgggtttttcggctgtttaaaaatatgagaaaaataaaaattggaattttttatttattaattaaaatttcaattaaaaaaatagaaaaagaatatataaaaattttctgttcaatcggataattgaacctaagataaaaataatcaaagtcaaaaggtttaaccacttgaccagttattatttgaacaagtgctttaaatgaaaattaattaattaattttttatcaaaaatttctctttctccaccaattcccttcttttttcttactcagacccccattcttaccagtgcttattcagtcccgccgggaccgggactggcaaaaccgggccaggatttctgtttttccaaaaaccgggaccgggacctgaaaaaaccgggaattcccgtcccggtctctgtcccgctcaactctactttttaaagagcaatatagaagaaaaacgtgtaaagcaaatatggttttttatatgtgttatgtccgaagataataaattaaaagttaatttgccgaataaaataaatgataaaataaattcagagaataaattgaggacgtcaaatatagaaacttaaaataaataataaaattgaaaagggcttaaacaaagaaaaattgcattattttataaaaaagctaattacaatctgattacaaataaatatatttttgaataattatttatgtaaaaatttaaataaatttatttttaatgccatataatttatggaccgaaatttaaatacaaaattttggagcaaaccgcaaaaaaatacgaatgaaaacaaataatgtcataaaacataactgaattacaaaaacacattaaaaatcattttatttaattagagtcctactacacagggctaattaaagatgacacaacgagaatataaattgtaatagaataaggcaaaaaaatgtccttggtaattaaaaacaaaattttaaaaaatttagaattttatggatgtgtaaattatggctctatttaataggcaacaattaataattctaaaaaatacattatatcaaaaaataaacgatttttcgtttttttcattttaaaaagggaaaattaatttttggtcagaagattaaaaaaaattaatattatctaattaaaaaaataaataatnccaataaaaatatagacttaaatttttaatataaaaaataattatgttatttcttaaagatttaagctaattccagttctcatttatttttgacaaagaagttaaaaaaaaatttatccaatgctttttagggtttt

SEQ ID NO: 7823 - DNA, 1015 bp, Heterodera glycines
ataaaatgtatggcacgtcaaatgtctacggattaactgttgtaatgggaaggatgctcatggaaggcaattctcctctggtcatcccaattcatcccagaaatggtcgccgttttaccagcgaagaaatcacgacggattcggtggattgtatgcaccattttaataaactttttgttctaatcacaaaaacattaagcgaaatgggagagataagagaagaccaaaacaattcaaactattccccaaatattgttcataaacaaaaaatgtcgcagcaacaaatgcagtcgaaaatgtgcaaagataaaacgagcaaaccattaacaaaggttggacaggaggaattagcgaaaaaatgcgtcagtgatacagtatttgtagaaagcaatatactgtaatggactattaatcttacaatttgtttttacgcctccaatgactataaagtcgataggacttttgtctaacaaaattatggattaataacaaaagataaaaaaactttccttagattggatgatggactgtagtagagccgttggaagataacacacaataagcatatgcatactaagaaaaaggaggggcttcaaaaattagcaaactttcctttgaaagagataatgatgatttattgggggggggggggggaaaggggcataaccaaaatatcctttggtgatacgttctgtggttacaaaaaccgaaaatattgaaatataatttttagcaaaatgtttttatagcaggttgaccaacttctttatgaacttccacaacaaaacaaattctcaataaattcgctttgtcaaccgccagagtttcttaaagtgttcagtgatatgcgttgtttggtgggcgaaaaagcagtttttgattgtgtgcttttgggttctccacgccccgagggtgattttcaatttatatctgaggcattatgcctaattatgcttaacttccaggtttgttggttgtttaatgatgacaaattggtaatttgacaatattttac

SEQ ID NO: 7824 - DNA, 1278 bp, Heterodera glycines
ttttttgaaaatttttcattcccctcctccttagatactccccccccccaaaaaaaaaaaatccaccgatcagcaagcattaattgatttatatgagaaatcctctaaataatttgcctctggcttaatgaatagtgcataaatttagacatttgtcgttgtacgataaaaagagtccgcccccgtcattacggtagtcttttatttaacgataataaaaagcattaacttaaggaatatattcggtcagtttgtatgttcataaatacattttcattgttgaatttacgcacagattttggccgagaatgaagtgggaagagcgatcacaacagcgacgcttttaccagtttcagtatacgataatgctgataactactgtatctaagtacaataaacgaaacagagataatttgtatcaaaataaggaaaaacgaggattaaaaaaaataacacatttggaccaaaaaaattacagacatatgatagggatcccaactgaaaatttttaaggtacttgtgcgttttgggcctacgccacataattttaaaaaaggtagggcgcgctgaaggcattttagcgcgcgttgctattttggcggcataaattcagcaatctgaagcaaaatttcttcaaagggatcaattttgcgtcttttacagtcctcacgccaaaggaattcgcacaaataggagtcgagttttgtgctgtaggcccaaaacccacaagtaccatttttaaaatcattttgattattttgcttattataataaatttagcacaataattgggccttggatacctaatttttttaattaaaaagttactgaacattaaatttgcaaaggtatttttgctgaaaattaaaatatttatacgtcaaaaacaccaacaaaaaaaaatgtttttcgctgcaaaatttccgggagcgggatcgggaatcccgctcccgttaaaatcccgcagaaattttacgggagtcccgggcgggagcgagagtaattcgaaaatttaattaaatactcacaaaaatatttttaatgcacaaatttgaaggacaatccttttattagagaaaaaaatagacagaaaaatttagtaagcagaaatttgaaattaaaaaaatcatatttttggtcgaaaatcagaaattttttcaaattgcttcaaataaaatttttaaataatttatttgttgactccctttattaattttaacaattttttgcggcttattttttgaaaaaactttttggtgaccagggtggaagagggag

SEQ ID NO: 7825 - DNA, 3868 bp, Heterodera glycines
  misc_feature (81)..(81): n is a, c, g, or t
  misc_feature (91)..(91): n is a, c, g, or t
  misc_feature (3837)..(3837): n is a, c, g, or t
atttccaccgtcgcacctgctgcgcctaaaattatcattaaaaaaagtattgcaaaacaaacaaaaaaaccgatttgattnggatttctgntgtaaaattctgatgttacatcgcgcatgaagtttttccaatcggtcactgtagcacttcccaattccatttgaaaaatgatttcatcgtttgaaaattttcgtgcccaatagtaggaaaattcaaaaaccttaatatcaattgattcgtgtaaatttggcctttataaaaaacttgtttaggcgtcaaatgggctccttcaaaaaaagtgcctttgtaaaatccaattgttggtcgtttgctatcatgttttttcactgcattgcatatccaaagaggttgttgtcgatcttgcttccatttgtagctcatttcattgccacagtcgcaaaaacgggtggtgtgtaggagtttaagttctttgagccatttttcgaaatcgttgtctggaagagccaaagctttggataaatcagcaagtttaaaatttttaagtgcttccattaatctaaaagcaattctgataataaaagagaaaaaaaaatttttgaaaaaatttgacccaaaaccgggatccaaactgaatgagtaccttttccgcctggtttggggtgtctatgatgacttttactagtataatgcctatttttgactttttgtgcttaatgcctatttttgtgcctattcgccatttttggcgcttttttcaggattttcggaaaaattcttaactaaaatgaaaattacacccctaagaatcgatccgaaaaattttcacaaaaattgatccccaaaattcaattatttttttcttaataaaaatttttgaaaaaaatgtccttattcgataaaactttaaaacaacaattgaaatataagcaaaattaagttttttgattaagtcgtttttacgtgatttgctacctaaatagtgttaataagaaaaaaattttttgcctatttttgtgcctattcgtggatttttgtgtctatttaatgcctattttgcgattttttatgcctttttaggtgcctatttcgcgattttttgtaccaaaaaatggaagccctaattatgaatgatcaaaatcaaaatgaacagcataaaaaagcattgaccaatattttgaattagcgcgcaaaggcaactcgtacaattaaaaaataaagcataggctcaagaaagcctaagtttcggcctaaacctaggcgtaagtctaagcctatgtacgagttgctttttgtacgaattgtcataacacctgaaaaattaatattagactaatccttagatttggcgttttttactattgaatgctcagaaattgctcaaatggattttggttttttaaatgactcgactaacaaatgggggaaaaaccaacgcaattattatgggacatcatatgttgacaaggactttggtggagttaatgattcggaggaggaagagatgcttcaattggaagaagaggacgcgatttcccggcagaagaaaattgagacgggaaattcgttggtcgattttgattgtctaattgcaaattcaacgataaagaacaaaggaaggagcaaactcttcgaagtccttcacatttcagttgcaaaagaaacgcctgaaaaggaaactgcgcaaggaaaaccgctagaaaatgtaattcaaatttactttaccagtaataatgttgcgcagattggcagaacttttgaacaaaacgtgtgcgatctgcagtcagaaacatcaaccgatggagggaatttcgacgatggaggaccgtgcgtttcaaaagaaatgcggcgaaaaataaattacgaggtgccaattttaatttttacagtgctataattggccgcttattatgacgaggacttttcagattcggaagaacaaaggcattcgaaaggacaaagggcgaaggaaagctaaacagcggcattcgcgggtgatgaagcgaacgcaatacgaaaaagcactgatcaagcgcaaatcgcaggtatttgttgggagcagtaaaaattttgttgtggtatttacctttaaagccataaattacttttctcaggtcccaaacatgcgtcgggaaatggagagatatgatggtgaaaagcgtggaattcgtatttctacaatccgttccacaaaattttaatttttgattaaattctttcttgcttttttgcgcacaatgccacagttaaatacaataaaattatcgtttttacttccatcaactaattatttgtagaaggttaatgacttcgcgaattttaagactttggcaggtaaaaatgaatttcattgattaatctgcttggagttttcagcccggagctccccgtcctagggtatttttgcctgatttctggataaaattggttgagcaaccgagcaagggttacaaccgtcttccaaaaaatgccgctgcgtttgagatcgacctcaaaatgtcgcgaatggatgtccgcgaatatttggaaaaaatttacaaatatccggttcgggatgtgcggattcgtgtcactatgggggatatcacatgggaccaccccaaagaccgggacaagagaagagcactttggaaggaagaggaccgaaagattgctatcgtcttttttaaagtatgcgaatactaatgacgcactggaatatccatgttcatttcagaagggtttcattgctgaagtcccggatctgttccccggccgtggcaccgatgctgaaattgatcagatgaagaagttccaagagcaggacgcaaatactttcaacagtcgctttgtcaataggggaagggcagggataggagaaatgctacctatttaatgctggaatttttgttgataaaatgcgatgaatgtacgaaaacttcgaacctaattaaacatgtttaatttactaaaatgggcttgctcattttattttctattttgttatttgttacttatcatttatttgatttcaccatgaaaccaacaatcgatttgaagcaggacatttccaagtacaaggaacgcttccaaaaacttcatcataaaagagttgcttttttaccataactttattttataaaaaagaattaaggaagagtcaagaaaaataaaccacgaacacgtcgtggaggaggatcgacgtctgaagttgcccaacaattttgaggcaaagcgaaaacgacaagaatgggagttggaggagcttgtggcaagaaaggtgaagtgtaacggaaactcgattttatttgcctttgaactgattcgtctaacaaattctttttttgaggaagcggaggagcgtggcgaagattatgacagaataaaggcactgggaacgcaagcagacatcgccgacaaaatggaagcggcaaaacgaagaaaagcaaaccccgacacgggatttgcgagtgagccatcccagccgagggaaagtctatttatcgtgaaattaaggttatgaagcgatgtcaattcggcaatacgaaagaatgaccaatgggataaagccggacatggaatcttaccaaaagatgaaaggagtcgtgtaagacgctgactattttttgcctaatttaagattttatactcaaaagacaacaactcgtgattactaactgttatgcttttcaccatttagcggagaagatcaattctacgcaagtgcaaatacgttgatccaaggctcgcattatcccaccgacaaggcactcgataaactttcggaggatgttcataaccagtgagtgggacaagttattccttacgtgttggttcacccaaaaggatgaagaaacgtgaccagtaccaccgccgtncgatgttcgaccctgatgccccgattgactt

SEQ ID NO: 7826 - DNA, 5086 bp, Heterodera glycines
  misc_feature (1502)..(1502): n is a, c, g, or t
aaaagagcgatttaaaaacaaaaaatttaagagatttcattaattaaaacaattgaaaaacaccattaaataaaaaaatactcaatcatttacatagagaaatatgtattttgtgtttaaattatcattctaatttatgcattttgatgaaaatttttggaattttcaaaattttttctattggaaaataaattcccggttggtcacggctttttcacggtcccggacccggacgaaaactgaggtcccggtctcgacttttctggtcccggtaagtccggtcccggtttttgtcaaaattcccggtcccgtgcaactccagaatttaacctgacaagtttgatatatttgactattaaagaatattaaaaagtagtaaaaattaaatcaatatttaaatttttataaagaatttcttgcaatcagaccaggatggtttttaacaaaacatatatatttttttgtttttctgtttaaatttcttaatttttattgttcgttagatagataaataatttgggtgccaaacagtaccgaaaggcaccgccgaaattttttttgattgtttttattaacataattttgaaaaagtgaaaaaagataacgaaaaatattaactcattaagttatcagcaactaccggcatggtcaattctataaaaattatcttaatacttactagaaatttatttataattgtttaaacgcattttttcttttatattttattattttttaaaataaattctaaacaggaatattttatttgaagttcaatatagaaaaacattaattcgtaaatatagggatgcgaaatacataaaaaaaattaaattcgaaatatataagaatatacaaaccctaaaatgtgtaccaaaatatctaaattaataattttttattatttgtatgattatcagataatttgtctcatcccgtctcgacgtcccgatgaaatcccgactcagctcaatcccgatgaaatataaaaatacatcaaataataaacgagcgcataataataaaacataaaaatatatttttaataatgatttttttttataatcaacattagaacttaaattaaaaataataataaatgaaaaagattctaggaataacggtgataattaaaagaacaaaaaggagataaaagatatttaattaatttatttcgaattatttaaataaatgaatgaagtaaaaaaatgattattaaatatataataagtacatattttacgaaataaaaaaaaagttaaagcaaaagatattttctcatgccattctcaaacaaataaaaatgattatttactacaaagaacttaaaataaattgcaacaaaatctaaattaaaatgttgcaattttcaataatataaaaatattcaatcattactgatatgctgtaatattttagtcatttatgaatatgagagcatttttaaactataaagcaacattaataaattaatttgtaaaaaaataacaagatccctgtgngataaaataagaaacctttaatacacaatagaaaattttaaaaacacaaattacacaatgagcaaagaattatattttataaacatcccttaaaatattaaaccgccaaggcgtacgcaagaaaaaattgtgggtcgagtacaagtttaaaaaatttaaaaaattcactccgaagaagcaattaaatataatttaagatacaatcttttaaatgaataaacaacaaataaatactgtgtaataaatgagattttgataattttgttatttttaattttcaaatttaattaaaaagtttggcatcgtaagcatcataattagttataattttaaattattaataaaacaatgaaaaaatcattatttaatgcaaattaatcctatttctttaactttattttctaaactaatgaaccggcaaaagaataaatttaattttgaatgaactattaatgaaacaatcttagtttttggtcttcgaattgcaaacaaattaaatattataaaaaaacagattttaatgctcatattcattcaacaaatcatgggatctacatgaatgatttataaaagaaataattatcatctaaaattaattttattttgcttccacttacttattaaattaaataataataataataataataaataactcaccaggaccgccatttttaaaaaaaagaatcttcaatatctttttctcactatatctagttctatggccatgtatttttttctctatttttttggctttatatgttagtcgaatatataaaataaaaaaattgacaattagtgtactaaaaattgattgctaaagaaaataaattgaaaaaataatctacatatgaacaaatttaattttagtgaaaatttcatccctcataatttttcgagaagtgatcagaggtgctttctatctcatagtgtttccttaaaaaattttcggtttttccaattttatatactaatccaattttgaaaaaaaatattcaaaaatgatcagaaaaaagtgatcaaagtttcgaaaaatagataaaaatgaccaaatttttaaaaattcataaaaaaataaaaaataatggagagaataatgcccagcggatccgaacccatgaaattggtaattaaaatgaaagaggaaaaaatgaatcaaattaacaattttgggctgggttttcatttgtcgcaattaatcaaaaaaaaaattaaattttaaaaaagcattcaattaataataaatttttcacaaaatacacatataggaattgaaagttctactgctttatacattttcatcatcaaatatttttagaaaaatattcatttgttaaagcaggcgctccctgaaatccttcactaaataaagttatgtcgttaatttattagcagtaaataagatcaatgaaattttaattaaaatcgcatatgggttattcaagttaaataaaaaacatataataatgaaaactaataattgttggtttttttaatttaataacgcaattaaattttttagcaaaataatcagatttgtttataatgataataaaatttttgctaaacattaattttaaaagttttatttcaaatatttgatttatatttttgtttacgaaaaaacaaaaaattggccttaaataaattaatactctgtacggtatttatacttaaatttttttaatgtattataaatagtttgctcataaacacttaaattaactgttattttttaatgtgcttatcaaatgactcaatgaaaaggtatctaataaaaaaatattttaacatttaaatttaaagatagaaaatatgagcaatttatatattcagaaacaaataaaaatggcaagggtttaaataaaattaaataaaatactttatataaataagaacaaaatacccaaataaaaatttactaaacataactaagaaatgcaaatttaacaggtccacacaaatgggacgataactaggtaaaaaaaacgacccagagaattatttaaaatagtaaaattaatgattaatattttaaatttttttataatgattaaaaaatatctataaaaattattaaataaaataaatatcatttaaatacaaaaaaatatcctttttatgaaagcggaaattttattatttaagtaaaaatgaaaaattagttataatttaaattattaatcaaacaatgaaaaaattacaaaaaatatttgcaaacaatgacgattttctggacatcattactacccttttagcgactacaaaaataaattgaatatttcagaattacatatagaaatttggtaattttttagcaaaatttgctagaaatcggatcaaaattttcaaaatttacccggcggtgcctgtcggcaccgtcgatacccaaaaataattttattgcaaaactaacatttatttctttaaacagtgacaaaaaaaaaagtgaaaataaattcggcattatattcagaatatattttataaataatttgttactttttttacaaaattaatattcataattaatatgcttattatgatatttaaaataaactttaaaaagtcttctatgcatattttttttaatttaaaaaagatacactatagagaattaaaaagtaatcattaaaaatttaattgaataaagcagtgccgggaacaaatgatttaaaaacagaaatggtatatggcaacaaaagattactaagaaaataaataagtagtaccttaaaatgctattgagtattaaaaattataaattcagtttaagaaataattgttatagcaattgcgaaagtgtaatactgataaattaaaattaataaatatttgaatgttttaatttaagaatagcataaaaattaaataaaaattgcacaagaaagagcaaataaatttgtatgtctcttgcaaataattatttagaaatatgtctaagaggatcggtatttagccagcaaagcacagcagagctcttggacaagtttttgttgttgaggcaactattaagattgacaaaaaattttaatagcaattgtaaattaaataaattaataaaactttttaaaaaactattaatatttcgttttttaaagttaccaattatatgaaagttccaaattttacatattattaagcaacaaatgaagaaaagtaacaatcttaatatatcacattctaattttttatataattaagataagattttttattatttattttttaaattcaagaaactttgaaatatcgaattatataaatataatcttaacattaattatggaattatataaaacatagaactttattttacggaaaatgagaagataactaattaattaatttaaaaaatatcgtgaccggaaaatcggtcagtggaaaatgcgtcagtgataagcaaatattttaaaataaagttgtatggcatacgtattgtaatatagaagtaaacttctataagaaaatcgttctcaatttcgaaccccggacgcgatctcgaacaaaaagtaggaagtcaaaaatttcgaaattggggttttcttcactagtgtaggtaaatacacggatacaaactgaaa

SEQ ID NO: 7827 - DNA, 2604 bp, Heterodera glycines
  misc_feature (14)..(14): n is a, c, g, or t
aaaaaaagatttcnacagcatataattactagagggtgtgctttcgtgaccgtgaccgtgaattttataaaaaaaaataatgttcagggcccttttaccatataatctataaatatcgaaatactttctagagtattattatatgaataaaagattttttggtttgcttgatttggcgatagaatttgaatgaaaccccattatataattacctatatttaatattaaatgtttattttaaattaaaatgaatactaatatataaggaaaccttcgtatcttctgtataattcaaataatactcatcatttacgaaaatgtatcgttcgtagattttcaccgatttattcaagcgcaaaaattttaaaaagcataataattaaaaataataaaaaagataattccggtaacttgaaaatggaagatttgtaaacatataaacgaatttataataatttatgctaaaattaaaaatatacatagattaaaagttgtaagataaatgaaaataaattcttgagaccatttcttggttttggttgctgttctttactctacaagtggatttcaaataaatatccgatcttaataaagtagtaatagataaaattaaaaaattaagtaagtaacaagtggcagttccatgtgtattggttgtttggataagctaattatcatttttaaagatgaaaaatacttaaaaatatttttttttagtaattataaaaaccaattagataagagcaaatttattgaatttgaaatgaattatagaaattaaaaaaacagtgtttattattatcgtaattaaaaaattttaaattacaggatattttctcaattatttgtaatgataaatcaaaatgataaaaggaagttatagaaaaaacgaactcaaaatttataaaacctaataatgtatatttattttaatttaattttagaaataacatgataatacaattaactcataaatttaattttttaacttaggatttaattttcattccatataaaataaaaatattaaaaaaaacagacaaaccatgactgaaattttaaaagagcaaaaaaaaatattaaagtagataatattcccaatcaaattatcgattgatttcgataatttgattggtcatccaatcatgagcccaaacctattgacctgtttggggatcccttcccctccctctcccgatccataaatcccaaacttattgcaaagaatgagagagagagaatgcgcgagagagagagcggacgggctgatcaatggatacagtactctccccagtaccttaatcgctttccccccccccccaaatgcttacgcccgctattagcggcctttaacccccttccttgcgttgttaatcccctccctcttccttccggtatgtttagtggaacgtttgccgttatccacccccctccccatccctcgtttcacccctttagctcagctaatagctgatccccccccctccgttattccctgtccttatcgggacaatctctcgatggcaggcaaagggctgaacagcaaattgtggatggaaacgcaaggcgtcttcggccgatttcttcagttcattttattgtaagcaaaaaaatgcaatctcttttttttaaaatttaatgttaattatttataaaaaaaatgattggtgccattagcatttagcatttttgtggtattgttcgttttcgtcctggcgtttctatacgctttttgctgttcgccctttgcctgcccccattcatcaccgaggaggtggaggaggaggcgggagtggatttgccaattcccatgaccacttttggtaattttttgaaaagatttttcaaaaataattaaatgattatttattgaacacttttgtccattttttggaactaaaaaaatgccatttttatggctcgaaatgtttttttatgactggtaaatggattattttgggtattaaaatgtttttttttgactggtaaatggattattgttcttgaatatttaaaaaaataattaaatgacattctttattaaattgtgtctttttaggctctttaattaacattctacaggtattaacatttgaaaacaaaagcgaccatcctaacttcctcatacaacttctattgcttgcccactatctcattgcttttcccgttttcattttatgctggtattctttgataaactttcttaagagaagaggacatatttcccagcgtgatgccagtgagatgatggatgatttgcgaaatttccaattaccaaaaaatacatcaattatttttccaagtttatcaataaagaagtgacacaattctcttttttatcacttgatcctcctttaagtcttgataaagaccaaaactaaatttaaggagtgttttttttcttgttgaaaaattagggttacgtgacgaacgcatatgggccaagcttttccaataacattaattcgattgttatgagaagggttggcgacccaccgctcggataggcccaactgcaaatctctgtgtgttcattgcgaaaaattgtcaacgtgcaattctgtctcatggtgaattcacgaagaaaaaacgaaattgcaatca

SEQ ID NO: 7828 - DNA, 1615 bp, Heterodera glycines
  misc_feature (36)..(36): n is a, c, g, or t
  misc_feature (58)..(58): n is a, c, g, or t
  misc_feature (65)..(65): n is a, c, g, or t
tttttacttattacttctcatttatttcctattatntacgtcaataaaattttatatntatttantatgtttcgagtggagttaaaatttgtttaaggatgtgtaattttaatagttgcataattttttactcgactaattaattgcgctctttcaattcgatttttgaaatgatatttcattattttgcataattattaaatatttggcttttctattaaattattactttattaatttaactattttctgcacataacttgtacgacccacccagataaggcgcacttggcgcacggaacgaatagaaagaatattattatacggatttatttatgtatattacaaaaaataaatgttatttaaattttcttaagatattaaaagaataaattgctttaacatcaaacacgttttttttctcatttaaatttcacttattattttttttgttaaaatatttttcaaataaaataaaatctttttttttttgatcacatattatatttgtcattttattaagagtaaataaatgaaatatatttagttctgagtttatgtgtgcatatttttttatttttacattgttttgtattaatatgttaatggatttttgtaaaaattgcttaaattaactttcatgatttcgtaaaataatataaaattcttattgaaaaattttcattaaatttaattaaaaatttggctgcgattattttgtgcttctcatatgataacgtacgtgtacaaaaaatgatagaagtgaatttgaaattatgtaactaatgaatttttaattttatttttatttttgaatttttttatttctctttttatctaaatcaaaattatgcatcttcgtcatcaggcatttattgttgccattcacccgatgtgaactgtgagccattgtcaagacaatttgatctgaaagtccatgtgtagcaaaaatccgacctcatttttcattttacaattataaaattttttttattgataatctaaattataaatttaatttggattatttttttgatttcattttctttttaaattgcttgaagccgtcgttttcatcatgcgtaagtaaaatttaaaaaaattaaatatcaattttttttcaacaactatggtatttaaattatttatatattcaagacttgttggattttataagatagaaattcatttccttattgaatattgtacttattttctttaaaatattttttttcatataataatgagaaaatatttaatcagacctctaaaaccccaagaaaggcattttgcacgacttttttcaaattacggacgttcaaagagaacaatttccctcccttgttatgacataattcaatatcaatttttccttcatggatttttcaaatttaatcatttggtttagttttaataattatttattagtttttataaaatgtggccatttaatttataatgaaaagaataggaattaataaataaatgggttcttttttcaatataaaataagaagaacaaataattattattaatggcaaaagatgcatttataaatggtgatttagagtaaaaattatttaacaaatttgttttgtgaattaatatttatttg

SEQ ID NO: 7829 - DNA, 4144 bp, Heterodera glycines
aataatgctttttatatatttttctcgctaattgacttttcagggaatccaactattggagcgagcgctgtaccctttccatttcacaagtacatattccacaccgttctgcctctttttcttcaaaatcttttcaatttcatacattttttgttgtttgtcttctagtgatttgcataaatcttattgtcatcacgtaaccgataaacaactggcgaacgctcagagtgtacctctgccaccgtgaaaagttcattggtgaagcgtgggaggtaacccttttggaacacgtgcttgtacttttcaatgcgcacgcgatctcccacacggtattttggcttgcgtcgtacaacattttcaacggcatcatgtaatttttgtcgcaatgcttctgcgtttttaaagttcacgtctgctgggcacattccaatgctcgaatttgtcgagtggttaattgcgcaaacaatgtcttgcacaacatcaatccacttgtacgtgttacgctccgtgaagtagcggtaaaggcgctctttgatgctacgattcgcacgttctgccattccggcatgaaattggggagaagtgagcatacaaaagtgttcaacgtcttttgtgcggaagaactgctgtactgcccgggcagtgaattcctttccctgatctgttaacaccttccacgggatatattttgatcttttgaatatacgatcaaaggcaatgatcatgttagcgctcgtcttggtctttacgggctcggcaaacacctgtcgactaagggtatcaatacagactaacaagtacttgaagccatgattttgtttagcgattcggtcaaaaatagccaaatcggcctgccattcagtatgcaagccgggcgccaatgttggcaatcggcggtagcgccgcttcgcctggcgatgcagtgtgtatgtacgttggctggtcaaataattttggacatcgtttcgattgatttttggttgacttttccgcgcctctctcagcagcggttcaacgctcgtgaatgcgacaggcgaacttaggtccttgtacaaaaactcgagcaagcgaagctttttcaaatccataatgatggcttaaacttaagtggggtgtttttataaattcctttgccggattggccttcgggaaataaatgcctactcaagagcggattctgccttgccctttcaacaaattctttgaatgccgttggctctttattttggccacgcttgtccttgttcaacaggtgactaacaatgtcatcaacactgctggttataaatggacgcccaccggctctcaaaacttgcccttcctccgacacccctagagattgggcgtttttataaattaattttaagatttccgtttgtgtgggttgtcgtttatttgaacttgacgaccgtgggttttgataatcatcatcatcatcagtatcttctaattgttcaacattttctttttgcgcacgcccaactttaagatggcgacgcgtagaaacaacaattggccttgtaacgttgactggttttggcatggcgtcaaccacatcactcaaattttctaatttaacacccacgggacgttcatcttcgtcctttgtgagcttgttgagacgcttaacttcctgctcatatttgactgccctttccgcctcatttatggcggcatcattttttatttgtttaattcgggtacggaccagcccaattggtgttccgtcagatggtggcggtgctgccaaactctgataaatctcttcggggactaacaaatagcgctttgtatgctgcattttttcttgtttttaattttttggaaactatttatatttttcaatgacatcagcaataagcgggagagcaattgacgcaatgagccccacaatagctgggaggccatctccgtgttgtagcaaaacctttttggcagagcgcgagcagcgtgtgcgggcgagacgacgaagcacctgtgcatgagctttcagcttattcaaataccggggacgcaaagggactcggccctttagaatgtttaggcagatttcgacaaggcacaaaagttgctcatcggatgcatatcgaataagggctttcgcctttttggcattacacagtgtctccaaaaagcatttatttattgttattatttgtgaccctttcattttggtaggtaaactatttgtttttgttcatatatatttgttcgaaggcggatctcttccggactctctgggtgcatgtccacgagaaggtatccaaaattttttgcgcatgcgtcccggtaggcctcaataaaatgggcagtccttgacgggaagaggtgggtggcgatggtgcgtatctgcaacgcccccgcaggattacgcattaatactaaatagtgtgaattagtgcgcgccacacgcagctctttgttgaacaggtgctgagttaccaaaatgacactgacgccccaattgtgtgagccacgggtgaagagtgcgtccaaatattgttgactcatacccaccaccaaatcatccagcaccagcaaggtttttacttttttggcacactcccgcacttgttccgcgcgtgggacgccgctgtgtacagtgactggcacattgccaactttgccggcgcgctgcagattcatcacatttgtgttcaactcaccatagctataaataacgcgttcaacaggggtagagatcattttgtctacatttcgcaacagacgcattatccactctgacttcccacttcctgtgctcccagacacaatcattgtgaatggatgacgaaattgtccatcctcccttttaaattgttggaaggcgtccattttacttttttatgtaattttctttttatttatagttttggataaacaccgcttatcccgaaatggacttacaggacgccaacaaagagaacaaagagccaacgaaaaagcaagaggaggaggcagatgatcccagttggatcagcctcattgacgaggagatgaagcgcgagccgctcgctccaattggtgaggagacgcccgcaacaagttgcttttgttttaaacgtatatttaaatttaaatttaggcactccaaaaaaatgtgcatgtgccgaacgccgtcgccccgttccgctcgtggaccacctctgcaagcggttcaaatgcaacgcccacgagctgcatgtgcttttcaaaagcctagagaaacgccgggacattgtgaagcatttgcgctccgtccaactgcgcaccgcccacctgcgcccgtccgtgcgcaattttccggtccgctgtaatgacctgtccatcctggacacccactcggcccccgcgtaccgaggctacctcggcataacggtatttttatttgttttgtttgtcggtaacaaaaaatttaaaggtccggatgcactattacataaaacatggcatccgcttgcgccaccccaacttgccatgcgtcgttgaatttggaggcggagatcacaaaacttttttccctcttgaaattttgtccattgttttgtagatgtgttcaatttccaattgtactgttgtttttaaaataaatgttcaacctttatctcgggagcaatttttggcaattgcgcagcgtggcgtaaacactgagtacacaaccccagccgcttccacgcaatcatcatgcgcatacgtgcaacaacaacgactaaaactgtggcagcactggtcttccaatcggcgcgtgtggtcctcaccggagtgccccacccaagcagcgacgtagaacaaggaggcgtgggaattctttaagcaaatggtgaccacctttcacagctactgtgccattggcggttgggcccacggcgtgcgcctgttgttgcaggagttgcgcaagctggcaacctctgcggcatcgtccctgacgctgacgtcaaattctctgaagccaccgccgcagctcccattcagttcggtacgttactgacagattgaaaatgaaatgaatgaaatgtctttcccctgatttcttcctctccaattgacacaaattttcatgaaagatttattatactatacattacggacatgtaccctcatgacgattgattgtatataagcgcagattatgttattgaaaattatgaaatttatccaaatttta

SEQ ID NO: 7830 - DNA, 5197 bp, Heterodera glycines
tcttttgtaaaggcttgatattcacgaaaaaaacaattatataattcaaattttttgatgatcctatgtatttttaagtttgtttaatcaaaattcaaaaggtttttaaagggttggttgggcaacagtttctcattatctccacataaaaatgattgttttcttgaaacccaaggtacattttgcattttaatggacccaatgaaaaaaaaaatgtaggatccttattaggtacctaatttgtttcattttttgtaaaaatcatatgtatatcaattgatcaaaataaatatgtaacaaatccgggataagcgactctttaagtataaaacagtttaaaaaaccaaaagggtcacctttatggtttttcatctgttcctgtaactcactcggattctccgtaagatttttcaatttggcactttttagggagattgccgattaaaattttgttttccaaagtcataaaacattttccgaggttctctttcagagcatcattcaactcactgatttggcccgtgatctcattgtttccaacttttcatcttttcaaattgaatattatgttcgttctctgatgtttttccctttttctgtatttatttatatattttagcttcccgactccgttatgcctttggctgaacaactgttgtccgattaccccggcatttgtcataaaccggcgtggccattgcccgacaaacaaaaattgggagaatttcgggaaagggaagcggagatatgcggacgaaatcgcgagtcagtgaccaaatcactaacaataagcttgactatttggaccaataaatactttcatttgaatcgcaaacattcagaaattttcttgccttggccgagaagctgctgacaatcgcaaaagacgagaatttgcactggcggcagatcgactttgccgaaacgcttctctcattgctgcttcggaaggactgcgacttgccggagggtaaaattagtgaaataccagtagaagcgaaggaggaattaaacccaatttacgtgcggttttatcatgcacccaataaatgtcatcattagaccaacaaattggcctgtatgtgttttttaattgttggtagagcctcccaacttatagttcgtcgttctgttgaacgctcatcattcctcttattactgtttcaggtgttgtgctgcacttcttcaagctgctcacttctgacatcataaacactcgcaaaattgcgtccgtttgtcccattcacattgtcaaacaattaatttattgttgctatttagcattggcttctgtagttcatggttgaaaatacacaggcaaaaggcggttaaggaggacgtcgttattccggtcggttggtgggaaagtttccttctttacgacgcagcaaatgcaccctccgatgccgacaaatgggacagtgccaaattccactcgaatgtccacccgggcttttacacttggccaagcaaattccgtgtgtatgcgccaccgagtgaacaaaaatgggtgagttttcgttaatcagccaatttttatgattttctaaatttactcccttttcaggcaaatcgcaacttttccgaactaacgccaattgtaaataaaaatccaattaaatttatttatatgaacaaattttaaggagcaagcgattgttacgatgttcaaagacaacaaattcatggaaagatttttgacctttttctctctggaggaaaaagtgagtggactttttccaattcaaagtgtttatccctttttcttttccctttacagaaaggaagcgaaaaagtgagtaataatggagaaattggaatgttttaattgttaattttatttatttttgcagttcgatcctgtcaacatgtcattgttttatgtgagtatgatgagtgattaattgctctctaaattaaaagcttttccttatctagcgcattttccgcagcttcaatgacattctcctcccggaattcctcgaaatgctcgacaaattgctggacatcggacacgtaaatagcaaaattgtttatttagaaatattttctgattaatttaatttgcattaatttgtattgtataaaaggaatcgcatcaccgtttggcttccgaattggtcaccggaatggtcagcgggtcgaagctgtggcagtacgcaaaagtcaagaaggtgcaggagcggctggagcaacgattgaccgacacttttttgggccttacggaagaagtcgaaaagaattggggcacggcgttggccaccattgttcgtcatcattttgtcagtttaatcattagtaattatttcatcgtttagttcggtgcgtgtgagccgcgcgtcactaattggcttatccaaatgcttttcggactcgcaaagcgacccacagaaataagcacccaaataaaaacgtaatttgtttgctttcctcacaaattcgttcctttttttaatatttatttaccgtttaggcgtttatatttgctacaatcgggccttaaccaggtgcggtaaaagacgacattctttcattttttaatgccatttgtcttacattgtttagtatgaatggcgaattccgaacgaatggcgccgattgtttgaactttgcatggatcatgtcaacggattgggctgttcctatcaaaatgtccgcttgcgtatcggaaggtgaacaaaatgatcaatgaaatttgggataaatggtgggcccataaaaatagaatgggaaatcggtggctctttttttcggcaatttgcggacaacggagtaccaaattcattctactaaataattaatcaattactcttaaacaaatcaatcataattaaattttaaaaaacgtaatttggcattccattgaccgaaaatggacccttaagaaactgaccacaaatttccgattttcagcaggccgcaaatttcatataacagtttaatttcctttcttcagctgtcttgccaccatttcatcgtccgatttcaagaaagcacttgtcgaggcgaatggaggagaagcgaacgccgacgacgacagccaattgaaacatgtcaccgttgaggaagtgatctcgcgcataaatgccatggtaacgtttgttgattgaatttggtggcgagaataccgcgtgggaaattattcaaattttatcattatccaatcagtgtgattctttttcaacatttttggggggattaattggttttcctataaatgatgcttttcgcttttctagcttactccactgtggagtgaagcactccgttcgtccgttggtgtgtccgccgatgttcctcacaccgaatcggcactttccttggatggcattgtcgtcactcccgccgatgaacacaaacgagaaaagctggcgctaattacactgcttaactacttcagcagtttgagcacgcattgggcacagttactgcgcccatttgcaacgtccatcttccaactgatcccattgttttcacactattccaatgaaaatacgtaagttttcctttttgtgccatatgaagggttgcacagggtgcttcacctccccctccgggtgcaccccaaaatctcgccgccgaaatcaaatcttagaaacttttttaagaaaatttcaagaacaaaccttattagttaaccgaaaaaattggtccaaaaattgtcctgttctcaaatggctaaaagacaattctcctgcgggtacttccccctcccccccccctcccctttcgagaattctaaatcattgatcgcctctatttttacggttaatgctatctctatgtacacttttaatttctggaatttgtttaagtcaattaattaaccactgtttcagtgatgaagaattgagagggtgttgtaatgcgcaattggtgcgttacatgggcctttcaactgtggcctcggcagcggacttggaagaactgttcgccacttgcacaacattgcgcgagcgggcgtcttggtggaagagcaaagtgtggtaaggaaatgatctctttaaaataacaattaagccgaaaaataactacatatttaccattaagccagataatcatggccccaaattggggtcctccaagaaatggttttgtattttggtgtttattttttggctgctttttctttaaccatcgtgttccaagtttacttttttgtaattttagcctgttgcgctttctccaagtgttcgcgttcaccaatcagttcttcatcagtgcccatccaaatggcttttcggcactcgagcaactgatcatcgactttttgtgtgacccccgctttgatgttcgcgtagcggcagcagaaacactcgggggactcatccgagccgccatcattgcagtggaccaacaattcctggccaaggcacgagacatggcgaattcgactgatccaatcacacgtcactcgggcgtcctcgcactttccgtatgtttcacatggaggggaacattttatgccagttaattaatattttattctttcaggccatcgttcgtgctttcccatactcagtgcccgactttttgcccgacgtattgatggcattggcgaggcattcgaaggaaccgcatccaatttatgtgggttccgatcaattgatttactgaaatgttggcaagagtcatgatttttccagggaaagggataaaattttagggagatttgataaaagctaatctcctttattattttatcattttaaggacactgtgaagcgcgccctcaacgaattcaagcggacgcatcaagacgaatggcacacgcataagcttacattcactgaagatcagctgctggtccttacaaatgtgatgatttcgccttcatattatgtttaatttgcattttggttttaaatttttgttctatgataaattgattattggaagtgttttgaatgccataacgaattatggaggattaatgggaaaaagggaggattatttggcaaattcaattttcccattctgacttctcccaaacttgattttggaaaagcggcaattaggtgtaattaaatcaattgtttaaaattatattataaacattttatattttaaaacattttagggtattatttccttgttcttttatgttcaaaatgggcttttcttttttaggttcttctgaatttctttctctaataatgtttttgtttatatttggcctatttcccattcttatact

SEQ ID NO: 7831 - DNA, 2818 bp, Heterodera glycines
tttattttgtgttttattatttaggaagggcaataatcaaaccaacgaccagaaatatgtaaaaaataacttttttaacaaaacaaatgatttttaactattaatttaaaaaacgactcaccgtcacatcactcatctgacaattcatattgtcctcggcctcgttcagcttgcctctgtatacctcacctgaaatattcagtcaaaattcatctgtttggctttgatcaccaattgtggtttcgagcgtgacaatgtgtccctctgcttcatgcaatattttgattggtactccgatggcagtcattttgtttcaataatgaaaatgtaaacctcagcaaattcaaagcttcctaaaaaagtgtagaatcaaacataaaataagtacaacaaatgcagattaatttaaaaacaaattttaaaatttatagatacctacactatgggtcaaccccactgtgcagagaaaagcctaatactatctcgtcgtttctcttttactatctcttcatttttatggtgtaaaaacaacatttacttttctatgtgcagctttttttccctatgttaataaatcttcactaaattttgcatatcgatagttagaagaataacaaacaaaatttgggtataatggaaaatatttgaagatttctttttctctcattttgacgtactattttcatgtctctaacacatgaaaaaacacggaattcgcaaattctaataattttgcttataaaggtataaaatcaatttggacatttaaaattaatagaaaaatgattaattaaacggcagtttatgacccgagttataacgtaatgaaaatttgagtcacacaacttttttctaaaaaatcaaattgcttagttttcggttagaaaaatttttgacaaaatctgtaaacaaatcgtattataaattaccaaatttttcccggcggcgcctaattcgtgatcagctcatttttaagcctagaaaaaatacccgacaaatttttaacatttttttcgtcgggacaccattcttaatattgccaaaaagggcgctaaaaatatgcatacatttaaaaattcataaaaaaaactttttgcttttatttgaaaaaaaggagctcaaaaaagcatttctgtattgaaattttcgattctgaagtcactatgcgtcattaaaaatcagactttgacgcttctcatcaaagggatcgagccatttccctaccgccacttccctaccagccatttccctactaaggcatttgggccatttccctaccaaagtatgaatattaataaacagtactattcaaacaagcaagaaaattaaataacattttatctgtttcaaatcacggtctcatttcataatttcgagaaattccgatcaaaaaggtaatgataaatagatgattaaagcgctgctcaagtggaaaaacattggggtctccattgttgagtggtaaataattttgaaccatcgtgagaattcggcggtctgcttcgcgatatttctttgccttttgcggtgggtcttgtccagttgaacacttcgcgaagtcatcatccgataacttttgatccttcgcagaaggtcaatgaaatgccaaatcgtgttcagtttgttcttcggtgcgcccatacattttgtatgcgtctgggatgattaagtctgtgagcgtgtttggaattggcggtggtgcgtttatttcatgacgtacacgcttgattacctaagcacaaaaatctcataacaaaaaaaagagaaaaaacttttttgatcgcattcttggtagggagttgcgcaaggactggcgtggccacattctgcagtgacaaagagcgaattgtcgctggtggttccattgtctgttccgcccggcgtttgattttagtgattactcgttgcgcttccattcgagctgcacttggttcacattggtggtttccaacttcacgcaaaacgttgttgttgaggttagtgtgaaggcgccctttgcaacggatgtcttttgcgtgatggtgttcacacgaccaaaagcgaacttcaccatcggcactcggcttgtgaaaaatgtatgaatgcccgttgtgttgaagctttgtacggttcttttgtgttagaattgcctgcattttctaatctataacttaaacaaaaaacttattgtctaataattagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatatttggccatatttggcctttttagtccatatttcgggcttttttagtccatat

SEQ ID NO: 7832 - DNA, 1423 bp, Heterodera glycines
  misc_feature (1246)..(1246): n is a, c, g, or t
  misc_feature (1379)..(1379): n is a, c, g, or t
ggccctagtcattaaaaatctgttgaaaaataatccccccgtctccattaaaggccctgtctccaattatgtccccctttctgaagaggttgcaaaataggtactagttgggtttgggtccgccttttgggtcaaatttttttttttattgtcagaattgcttttagattaatggaaacgcttaaaaatttcactcttgacgatttattcaaagtattggctcttcaagagaaagaattcgaagaatggctcaaagaacttaaggcaattgtgaagattattggtcccacaaaaaaaaaggaataaaaattcaaaaaacacttttctaggggttatttggtgcgctgagaacgaatttgaccttcttttgacttaatttcgaaccccgaacccggattcgaacatttgaaaaaattcaatttttgcaaatattgctgatgctttgcttggtactgtaactacaatatgagtaaaggagaagcgaattcttcctatttacatacgttaatcaataactttgaataacaaacggatcgagtcagtttgatgaagtcgtaaacaaaaaattatgaaatcaggcaaactattgacataataggcggtcaataataatgaccagatcaaaagagacaatgagaacattttcatctaaccttactattagcttactaacaatttagcaatggatatttttgaaatttgttcacaatttcaaaccaatgagcatacaatcgcatacatgcgaaaccttggtctcttacggcaaattgcccccatctgtggtcggcatagatgcccgcggcgtatgactcaagtcaaaaatccaacctttacgtttgacgggtgccaatggcgttgcccaacacacaaagggcagaaagtgtcaatcagggcggggtcattttttgaagaagcgcgttttccccttcgaaagggaatgttcttgatgtattgctgggcacttagtaattataaaattttcataatatgggtcggaacaatatctaggtttgccgttacacacgcaacaacaaatgatcagattgtcattgcatacactgatcgattggtcaaatttttacagagggatttgcagccgttggttgcttgacaaccccattcggttattcttttttttaatagatatcatttttggttaaggtttggaggggttggccatgtggtgcaaatagatgaggcacttattgcgcgtcgaaagtatcaccgggggcacagagtgcgcganatttggttgtttgggatgtatgacgtgcacaccaacaattggagtggttcgcatcgtaccagacagatctcgcgctacactcttgccgataattgagaatttgtggtggcagggtccagcatacattccgatncaatgggcgcatacatgggtggcgcaattcagccatccctgtca

SEQ ID NO: 7833 - DNA, 2710 bp, Heterodera glycines
attagaccattcaaggcgtaacaaaattccaattccccttctaagctggtatttctgctgctctttttctcgcccttcctctgccaattaattcggccaatcgcacaacgcaattttaaactattctctcattccattagggaaaaaagtcctccaaaaatgaattcttacgacttttgctgctggtgacataaaccaccaaatttactctttgaagaagtgacgccgtggggagagaaagtgcggacgaacggacaaagcgaaggcaatgaacgcggaaaagacagtcttcggcaaatgctccccaaaatttgccaacgttgaaaaagcattcaggtggaagagggaaagggccgaccaacggcactggagggagaagggcactgatcggacactttaacattgccattgcctcccctcaggcgacactttgcggacggatgggagcgggagggggcgtcgttggccatttactggaagggccaattggtggtggatttgtgcgggggatacgccgacaaagcgtcgctgaagcggtggggcgaggagacgcggacggttctgttctcagtgacgaaggtgaaacgcgcatcggatttcaattcgtcatttgttttggcccaggcagtcgctgccctcgcggttcaaatgctcatcgaccgtggccacatcgcttattccgacaaaatcagcgtgttctggcccgagttcgcccgcaacggcaaggagaacatcacgctggaggacgtccttctgcaccgggctgggctcgccgctttggatgagacggtgacgatgaaagcggcacgggaccacgtccgaatggcacaaatccttgaagcgcaaacgccaaattggccactcggtgcagaaaatggcgagacaaaggcacaaactaagggtgtttaaggcacaactcggagtgggtaccatgccgtcacttttggctggctgatcgatcagatcatccgtcgggtggacccgcagaagcgcggcattagtcaatttgtgcgcgaagaaatcactgacaaacacagtgggcttaagcgccttccgttgatcggatggattaagcattgcttctcccctctcagacattgactttcacctcggcctccctctgtccctctctcacaccgtttctcgtctcacatttccttccttttggtaccaattgcgtgaatttgtttatgatccacgagtgatcgtcgttcaaggagttcttcatttgcgcacgagaaattctttacgaacgcgaattgcagagaatgcaacatggattcggatagacggagtgggactttgataaaattcaaacgaaataataaaattagatattcagaacaccaacactttcaacaatccgcaattatttgaactcgaacaagcggccgccctcggcgttagtcgtgcgaaagacgtcgccaaaatcttctctctgatgctttccggcgaactgatctcacgcaaatcgctgattcggctgtccaaacctcaaatcataaaccaaattgattacgtgatgaaggtgccattcagcaaagggcacggctttatgtttgaaaagcaccctaggaaagaagtgagaaaattgcaaccaattttctttgtgaattatctatcatatggttaagtttattgtgacaatgagaaacaacaattccaaaaactcgaaaacaggttgcgatatcgaaggcccaaaaaaaggggggcgcgagctaaaaaacaacaatttttcgcattttttgggtggatttgcagtacgtattcgataggtattgttgataaagctccaaatgctaaactattatagcaataagacgaagacaagtcaaacgaatggaaactttggcaaatactactgaaatttaagataacatttatgtttgatatgtacctaaatgatttttataccttttgctcactcaatgggtttcccttcccactcattgccaatataaaccgcggcatttctcacacgtattaaaccgtgttctgttcgtttagggaaaatggctgttcggacacccggggttcggcggatcatcggtgatgatggacccggaggaggaattggtcattgcttatgtgtccaatgggatgaagtccggtaaaaaagagcatccgctgattttgacattttcgagttcgataagcttcgcttaaggcatgggtgagctgacacgaacattcagacgattgaaattggcggcatttgactctatcaaagcaatttccgatggacgaactgatggcaaaaatcagacgcaatataataaatttaacagcagcagagcagaaggagactccccaaaaatacgatagaaatggcacttttttcttttggcttattgtaattaatgtcttgcaaataaatgatcgttttgcatattcatacatagaagtttatttatttatttttaataatacaattcattaaattatgatttattcattgttaaatgataaatttaagaatcaatgttaaataatgtatttctgacatttcattttcgctttttgtaataaaatccgcaggtgatcatcggtcctccgttcactgattcccttagttaattaactaatgattgttgggaacacccataattaaattattattattattaattagaccattcaaggcgtaacaaaattccaattccccttcaaaactggtatttctgctgctctttttctcgccctttctctg

SEQ ID NO: 7834 - DNA, 2033 bp, Heterodera glycines
aggaattgaaggaccttaagcaatcgaaggtcaaattcgaattcgaaatgtctgatcggagagacttttgccaattcaatcgccttttgggccaacctttttcatgtgctgccgatggaaccgttccgggtcccgcgcgatgacgaacacggggtaccgtacccagttggacaccaccgcgtaatcgtactgtaagagttagcaaaattttggctttttaagaccatcatttggcatttcatccatttcacctgattgtattcgttcagtgggcccagtttgatcacccaaaatggctctgcgtctggtgaattgctcgagtgcagcagaaattggcccgtgtcgcccgctttgaagccgtagccaagcgaaaagcgaggcggaccattcgaattgccctcacggtaaaacttcagaatggtgaaagtggccgagtaagtgttgttggtcagagcgccgaaatgggaaacggtgcacgcctcacggatgacatgcggactgttgatcacctgaaaagcggagagtgccaaaacgggaggaaaaagtgccaaagagtgccaaaaagggaggaaaaagtgccaacggaggaggaaaagcggaaaagaataccaaaagaggttaaaaagagaaaggaatggcaaagatagaaaacccttcacctgaaaccatctgcccatcattcgcgcaacgtcaacattctctgctgcggggtgaacagcgcggaacacattttttgccaaatttttggtcgcatcttttggcaaaagccgcgaaatggacgagccgagcaaagtgttggtgggagggatcatttggggcacaagttgaccaacgatgtaattgaagttgctgaggccggggatagtgttcacgcccggcaccgtcggtgcgtcctgtggcccagcgaagccgggaaccggaatgggtgccaacccgggaatctgaccactggccaacccctgaacagaacaaaaatggtggcattccgtctgtgactgcctcacatgcaagtcgattcgattcgctgccaaatccgcacccaacgcggcgagttcgtccgtctgataggaggagacgggcggctgccggcggatgtcgcccttttgctgctgagcgtcgttctgtccggccaatccgagccgttccagcagagaattggtgaacgaagtggccttctccacgttttctttgtccttgtcggtgagttgaagctgaacaatcaccatgctcagtcagctgttttttcctcacttcacctgagttggcaagtcattgcttatcggctgaaagagcggtgccgattttgcggcatcggacgaaggcgcggcggacgcaccggcggagtgctggcgcggaaagcgcagggaccgttcgtggcccatgtcgaactgaacaaggtcaaatgtgagggaatggaccagcagaagggcatagtaatgttaaaagacctggacaaaatggacaatgccattggcaatgttggacagactgagggcaaacagaaaaagggccacagacattgccgtggggtttccaatcattctgcaaaatttaaagaatgaattaatcctatttctaattcactaaatcggcatgaaatgatgaaagcgcctgagggtaaatgaacagcgaatttgaagtggagaggcacaaatgagaggggagagatgagcagaaggggagaagggaagggaaacggagggaaacggcgccggtgcgcaacggaagcacatcgatcccattcaatcctaaaactacccgacgggatggaaagagagagacccagaaaacgccgcgagcgatggaatggatattatcggaagagggggggggggagcatcatctcatccagaaaaagggaagagaatgacaatcggtcattcggacgggagacaatttgtgaaaatggagcaaattgaaaggggaaaagtcattttgtgagacataaataaaaaaaagaaaatacaataaggtaaacatttatacttttaaatgataaattaatgaaattcacactaaaaatgaaacacaaa

SEQ ID NO: 7835 - DNA, 2130 bp, Heterodera glycines
gtgtattttctgaaatttgtttgggtcatttcttatgggtgtatttttcgtttttattgcatttttgttaaagattttttcaaaaatccaaaagtaggcacattaatcacaaaaatcccgaaataggcaaaaataggcattataaaagtcatcgtagacaccccaaaccaagcggaaaacgcgttttttgtgcttatctgtacgtattaaatgcgcaaaattttaggcatttgcctaaaaaggaagccctagttacctaataataatttaaaattttgataatcttcaaaaaaaatctttttgtattatattatagttgctgaactcactgattctgctgatcgccaaacagagaaatgttgaacaaaaacaaacacatttaacggccgtacagtaaaaccgggacctcggtttttgtaggggaaccgggtccaaccggaaaatctttcaagttaataaaaaatattttaatttaaaattattatttttttcatttttaatagcctaaaaacccataaattaaccaaatatttggtcattttttgacaaattctgttaacaaatctcgctcaaatttcaaaatttttccggcggcgcctatcggcaccgccggaccccgccccttcccaatgttccaaaaaagttttttgaaaaaacattgccacaaaaacagcgatttaaaacagggctcggatctgtccttatttataagatttgtccttatttggagggtccaaatcttacaaaataaaaatgtccttatttgtaagatttgtccttatttggagggtccaaatcttacaaaataaaaatgtccttatttgtaagatttgtccttatttccggctattcttattttgttcttatttcttaaatatattcaaaattttgaaattttatggcagaatgtcactattttatcaagaaaatataaggtttgcgcaaaatttggttattgtttgacaaaaaactgttagcaaatcgcattaaaaattacaaaatttttcccggcggcgcctatcggcgccaccggaccatctccccccttgttccccaaaagtagttattttttcttctaattttcaaaattattcccttttcggtgggaattcaatcacaattttaacaattaaaatgagaaaatattgttatttttggactaaatttgttcacaaagtgcactaaaaatttcaaaaattttccccggcggcgcctatcggcaccgccggaccccagaaccttatttttataaaaagttggctcaaaatcgcaaaaaattggccttttttggtgaaaatctgttaacaaatcagaattaaattacaaaaaatttttccggcggcgcctatcgggccggaccctctcccctcgcacttcccaaaagttttttggaaaaatgcgccgcaaaaaattgttaaaaatctgattttttttatcccgaatgcactaaaattttatgatttgctaatttcctccccaaaattgttaaaatcgttaatgggagacaaaaatataatatttgatacattattgatcgaataaattgtaaaaataactgatttgaagcaattttgcaaaatgtccttattttggacccaaaaatcttattttttggccttgatgttcttattttgaaaaattttcgatccgagccctgatttaaaccaatcgtttcacaaatttatgatcacaaaaattccaaatttgtcctttttccaattttatcatttttctccgttccaaccctttccaaatgatttaaatttaatcattctttctcccccttttcagcaccgcccgcattcaccaaaagaggacaaaaataattcagaaaaaggggcaaagaatgaatggttggccaacgaattaatatgcgaaaggtacggcaaaacggtggtgaaaaatcacattaattggccaagccaatttaatcaaaatggggaaacagaacggacaagcgaccgaccaattaagcaaattaaaatttggctggaaaatggccgaaattggctaatgacattttcaatgaagcaattaaaaattagataaagttatcaaattttatgtttatggttattttatgcaaaaggtcagcacataattattgtaccacacaaaaccatccactcc

SEQ ID NO: 7836 - DNA, 2775 bp, Heterodera glycines
  misc_feature (1876)..(1876): n is a, c, g, or t
  misc_feature (1881)..(1881): n is a, c, g, or t
catttttcctatttttattgcataaattgcggctcattttgaagagaattttgttttgaagctaattagcttagttttcctacaatcacccaatttttatgtaaaatttaattgatcaaatctaacaatgtttctgaaaaacttcttactaccaaatggaaatgccccaagggcggaggtccctgcgagctcgcacctccagcgaagagaagggaacacaaaactccgcccagcccaaacacaaacaaaacaaatgcgtatttttctcttccttcgaccgaatgggcgggcaaagaaaagacgccaattgcaaagggaggggaggcgcataaaagggagagagcggagcattgggcgcacagagagagggaaagagagagagagtggcggacggagcgccgagggggcgtcacttcggtgcacttgcgattcatttgccattcattccctccctcccttttcatcccctacccaatcgaaatgcgtcggaacaattttttcccaactcttttttttggagtgcggatagcgagaagatagacaattcatggccatggcacattaacattaaggttctggacggttttatgcgtcccataacatattatgcgtcccatgaagggaaccggccattttggcgcaagactatatcattttgatttcacagcaaaattaaataatcttggtatgattttaagtggcttgatagtgcctattaacctgcaaagtttcaaaaaatttagctgagaaacaaaaaagttatggccaaaaaacctcaaaaaattgcattttcctggccattttggcgcagcgcgccatatcttttttaaaacctaatataattttttgaaattttgcaggctaataaagaacatttagacctattgattaatatcaacattattttatttggtcgaattaaaaaaaagttatgaatctttaaacttgtctgcgccaaaatgaccccgaccctcccatgaatgaccgaccatcctggtatcaaatgaaagctaaaagtctcaggattttataaatgcaagaaaagtgcaaacactggcattaaaaaagaaattacaatgagaaatcacgcaattcaactttttcgagaataattttttgtctacttatataaaagcttctatagaccttaagctttcatttgataccaagaatataagtattggccaagtaagaaaaaagttatggcctaagaaactgggtatggtcattcatgggacgcataaaaccgactagaaccaacattaaacgaattgcctaaaaacgaattggaatttttaatgaccaaaattgaaaaggagttaaccttccttctgtattagacatattcccaaggaagagtaaattattttccgaatcctcccaatatgttaatttcatatttttatttccattctttttaagtggatttgttctttattcattgcttacaaacaaaacccattgattcttcgtcaaaaatgtcatctgccccttcgattgcttctccaactttgcaggctcctgcttcgtctcaacaaactccgaaaaaatctctgacgcctacgaaagcttcaaaatcgaaatcgctgaagacggccaagccgaaggcaatgaaggcctctaagccaaagttgccaaaagcttccaagcccaagtctccgaaggtttccaaatcgaaagctccgaaggtcaaaactgctaaggctccgtcaaaccacccgtcttacagctcagtaagagatgattccgataagaaataggcaaatattggtcaccttttcagatgatcaagaaagcgatcgctgagttgaaagagaagaaaggcagcagtcgtacagcgatgtaaagcatcattcgatatttaaaaaccaatctnaattntagtctgaaatatctcatgtcccactaccaattgggcgaaaatgcgacgaaggtggttttgcttgagaaaacgtaaattatttttgcttcgttactttttagatcaattccagcctcaaattgggccttaagcgcggcgttgtttcgggtgaattgaagcaagtcaaaggcattggtgcttctggttctttccgtctcggcggaagtggcacgccaaaaacatcggatgtgaaaaagagcccaaagaaaagaattgctgcgaagaagccatcggtgatgaaagcgacgccgaagaaagccaaaaaggccgtcccgaagaagtcgccggctgcgaagaaggcgaagcccaccgctgctgcaaaacccgaagttcctctgcccgtttcgccggcagtgacaaagtctaagaccgcgaaggcactgaagaaagacgtcccgaaaaagtctaagatggccaagagatctcctaaggtacttttttctctgttttattgcacatttataactttgcttctttcgcagatcgctaagaagtcgaagactccgaaaaaggcgacggggggtgcgaaaacttcgcggaaggtcaagaatgtggtggcgtcaaaatctgccaagaaggatgtcggtgttgatgctgcttcgtgaatatttcttttcccttccatcgatctccaaaatgtaaaattcgtttatgtatctctcaattaccttgcattttccactcagatattttccgatcattcttcactccatttgttttcgcgcaattatctttgcctttttgagtatatatgatttgattttaatgcacagcaggcgggaaatgagctcctgtaccagaaaagattctcagggagagctcagtggtttttgtaagatagtaaagggacaaag

SEQ ID NO: 7837 - DNA, 1777 bp, Heterodera glycines
tttttagcacctattttagtacctatttagggatctttagcacctaaaaatccgagccctattttttacccaggcggcaatcatgaagaatggttgtccctaattttcatttttttttaattttgtgctcaaaaccagtttttaggcgtttttgagggtgctgataacggatcttaactcgggtttgcccaattccgaactccagacccgaattcgaacaaaaaaaaaattgtttttttaatcaagaatagttttttcagggtaaaagcttctaattcattatcaactatttaggtgtaaaacaatgtttcaatttttaattaaaaaaataagcaatttgcgccgaaaattgacaaactaaagccattctcataatgctactttgaaaaaaacgaaaaaaaaacttttttatattgatcccaaatccgcaccgtcatatatcatcattttgacaaaaagtgcgcacagacaatacgccaaaaaaccccactaatttaaaaattttgccgagattttcccttgtaaaaacggaagagccgatctcgagttaaaaagcattttgataaaaaacaaagcatcatcctataggttgggttaaaatatgtgtttatgcaaaatttcaagaaaaaataccaacaggaaaaaattttttccaagggcaaagttttttctttttctctcattttgacgcactatttccatgtctctaacatataagataacacatggttcattttcttgctaataaactattttttcaaatttttatttaacttagaaatattcttaagaattttcccatcaaaatgagcacaaaatggttttgtttggtttacccttcaccaagttataagtattagaaatttagttaaaatcaatgataaaacatatagtgtctaattccgctgtctgtttttcattggcgttttgttcacttttattttcaataatttttaatgtagtgtctgacttatatagtgtctgctgtttcttcacttttcttgtttttttacatttcgtttcaatactcatttttttttataatgatacgcactttttgtcaaaatgatgatatatgcaccgtccatataattttgcagaaatttgaattttatttaaaaaaatatatttaattttattgtcgaaacggcattgtcgaaaaggtattgtcgaaacggtcattggcgaaatgtccgggagccgttgtttttcctaaattagatagtacgccaaaaggagacaaaaaattagagaaaaaaagataatgtttttctctggcactctctatttattggtacacatctcgttttttcggacggtgtgaatagagatgctttttgtcgtcaatcttcatttgaaaacattagggcgacagtcttttaaattgaattgcttaattccagcgagtttattgaaattttcgtggaaataaaccatagtcggaatcgttcagccttaagaatttggacttggtttactgatttacaatggtaacaaagtatttttttttacaaaagttggttagattttttatgtaaatatatttggataataaatattaattggggtgttatttcttcccaaacggtcctccgatgcctcccccgccaattccaccgaagcctccgcaaattccgcagctccacaaacacgcttcggcaattgactgtaagattggacgtgaaattttaattgtttttatttactcgagcacctgataaattggcccggctttgcctctaatcaagccccggccttatggttattttcggttttg

SEQ ID NO: 7838 - DNA, 1899 bp, Heterodera glycines
aggccaatactggtttttcgacaaaaaaaaaatctgtcacaatcttgttgttaaagtcaactggtttttttgtcgaaaaacagtacgagctggcctagtgctagttgggtttcgtccttattatttttatactataattttgtttgtcaattcgaacaaactgtattggtatttgcctccagaaaaacgagacgcttgaaaattgtaaattgcaacacatgcattacgccaaataaaatttaacaaaaataaaatatgaaaatctttaggctgctcacaaattcacaatcattatatgccgagcataaaatgggccattgtttaattctgcttttggtatgacaacaaatgagaaaactgtttgctttcaataaaaatgaaaaaaaaagacacgaaatattgtgaaagatagacaaaaaccaaaacaaaattgaaacataaatatttattcaaaacaacaacaaaaaattcttacccgccaaaataaatttcaaaacgagatcagagtgaaattaacaataaaccaatcaagtccatgacagaacatcaattctaacaacagcaggagaaagtgaaaatcgtcctaataattatttcatttgcctctctctctctcttaattcgccgccgttcccaataagttctgaccgtccatctcctccggcttagtcagtcccataaggtaaagcacagtcggggccacgtcgcacaatgctcgcgcccggggcacaccctccgcagtgatgggcggcgcacttttgaaggagtgtgaggtggaagagcaggcgaacggaactgaaaaatgcaaaaaatgagtgttcaaaattaagcttttacagttaatgaaaactgacccttgttgcacgtgtgggcggtgtgtgggccgccatccttggctatcatttgctccgcattcccatggtccgcggtcaccaacagcacataaccgtgacttttgcatgcctccaaaatgcgtccaattgccacatcttagaaaattaggggaaattaaatctaaaaatgagaaacaaaagtgtggatttgtaccagtcgcttcacacgccttcaccgtcggctcaaatttaccggtgtgaccaaccatgtcgggtgctgcaaaattgcacatgatgaacgggtgcttgcctaattcaatttgtttgaccacctaaaagtagaggaaaattgaaatgccaaaaacattttttggaaacaatttcatgttttttactctctaaaaatcgtgggtctccccccctccccccccccccctcccgaaaaaactgccttagcgatggtcacagaggatttaggattttcgaggcttgggcggataccccgatttggtgttgtttaagcgcttttctgttttttcttcaaagaattaacccagaccatccctaaacatgacccgtttcgtactttgtccgcaatgccttcacagttcatctccggcttcttgtcataagtggcaaccctcggcgatgggaccatcacgtgttcttcaccctcaaatgcctcttctcgtccaccgttgaaaaagaaagtcacatgggcatacttttcggactctaaaaaacattttattaaaaataaatttaaaaatgataaattgaaacctgcgcaatggaattgagacactttcagtttactgagccattcagcgagcacattttgatgggacacgggagggaacagaatggggaatggaaactaaaattaagggtaatacaattaaagttttgtaaggttttggggctttcgtccttgcgcaacagtaaacaatacctctgcgttgtactgtgtcatcgttttgatgtgaagtctcttcggcagtgcgactttggtgggcaaatcctgcaagttttgcagaccacccatgcatttggtaatctgacgcat

SEQ ID NO: 7839 - DNA, 2144 bp, Heterodera glycines
tgttttttcaaccaaagattcttcctttgttttttcctctcctaagttacccccccccctaaaattcctggataaaaacagttatttttcatacctttcacacgcgcttcgtccgaaaacacgatgggcgtcaggaattcgtcagtctcttcttggattgcgtagcgcttgttcaccaattgtacagcattcgccggttcgcactgttcgcccactccgccaaccaatgcctcgtaggcaacctttaggaaaaatgaaaatccaaaaaatgatatttttttcgaaaatgagtgccttaattcgctcccatcgattgtcacggtccatggcataataacgcccaacaatggttgccaattcgccatatttttccttacttaagaagtcaagcagttgttgcaaaaagccggctaaaaatggcgggagcatatataatcgcagatttgttaaattgaattttttattttacctccactcgttggcgatgtgtcacggccgtcggcaaaaaaatggacaaaaacttttggcacttgtaattgtttgaaggaatgcaacagaccaaacaaatggcctatgtgtgagtgaacaccggcgttactgatctgaacatttttgtatttgattggagaaaatggaataaaaaacgattttttataaaactcaccaaacccaacaaatggagtcgtccgtttccgttgattgcttgttctgcggcgtcgatcacttccctgttctcaatcagttgtccgttgcgcactgccaaattgatgcgaataatgtcctaaacagaaaaattatgaatgaatgaggttgtgattattcaattgaaatttgtgtgttaattgaaaagtggcacttttgtaaatttttgaaaaaatagagacccaattggacagcaatttattttaatatgatgcctagcgtaaaaacatttttatatttctgaatagggattcggaaatgtgactctgaaaacctcgggaaaagtttgccgattttcatcactattgcagtttacacgatttttttcaaccaagaagtccccacatttcaacaagcactaaaaattttgatgactaaaaattaaattgtatattgccaaaatgtgactatgcgttatccaatgtgtcttaatttaatcttaaaaacctggtcaatcacgcgacccgctccgatgttcagatggccacatttggaattgcccatacgctccttatcaagtccaacatgttcaccatgcgcttccaactgttgccaattgccggaacaaagttggtccatcaccggtgtgttcgcatttgcaatggcattgccatgttcctcctcggtcagtccccatccgtcaataacaatcagcacacatttgttttccactaagtgattattaatcatttttaatcgctaaaaatgaatgtttttacaatctcgaatcaaaacatgatcaaaaacattggataatgaattgtctacaaattaggtcggaccgggtcagcttagtctggccgttctgtttttttgggtttattttatgccactaattttgggcatggggttttgagggtcgctgatcaccaatatgacattcttttttaccaattccgaatcacgaagccgagttcgaacaaaaagtcgaaaattcaaaacttttttgacttatcatttgctattgacataaatagtgtattttagggaattgcatctcacagagtcaatcaaatgccaccggagaaggataaagcggccaacattgagccgacgggttccgattaccctgacagtgaagatgaaagttatattttgtttatttaatggtcaagatttattctttttttcattgtttagtggcaattttggaatggtttgacaagccgatcagcgaagacattttgaacctttctgtaattttactatttaaaaaaaatttgtgtacattttggtccattcttttttagaaacatccaccgccacaaaacaaaattcacaatctgcaaccggctcgcgaaaatgatgatgatgatttggatatcattgcatatatctgcaaaaacatgaacgagggatgggggctcggctggggtttaatgcattattaagggctggaaatcggtgggcccggatccggggaaaaaaaaaatttttttttt

SEQ ID NO: 7840 - DNA, 1489 bp, Heterodera glycines
aacaatattgacgttgattttaagtcaaaaaagcaacaacaaaaaattgttcgaatttgggttcggggttcgaaattggtcgaaattaatatcatattcgtgataagcgccctcgagaaccctaaaggactttgaagaattgcataaaaccctctttttgcctctttttttgtgggacctgtaaaccatactattacccaaaaattctcgattttcagttctgttcactttgttaaaatacacgaaagtgaacagaatgtcatcatcatttaaaccattcttggactaaatagaaaatcgaaaaattgagttttcgattttttgttcgaactcggtctggaattcggaatcggtcgaaaagaatctcatattcgtgatcagcaaccctcaaaaccccataaaacgtgttttcacgactttttaaaagaaaaaaatttttattccaaaaaaaaggggggggggatttcatccgaaaagaactttttctttccacaattggtgaaaatttttcgtttttgtatctcgtcctcaattttctgcggaaaaaattttaaaaaagcaggatattgatattagcaacaaaaaaaagaaatgagaaaaaaaaggaaaaaatttacggaagaagaagggaaggaaaaagtgagcgaatgaaagaaaatggaagaaagggggacttttatagcaagacgtcgaatacatcttctttgagagattagaaaattagagagtttaggtaagtgagtttcttgtttaagggaatgggtcgttttggcgccgacgttttggcgccagcctcagtttttttattataactagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtcttttttttataaatcatttctataaattgaaagttccagcagagaacttcgaaatccaatgacgaattaatgaattcgagatttcattagtttctacaatcgaagaaaaaattttttaatttgaaaattatgttaataattatgaaaaaagtcgatttttaggggtgtatttttcaattttcttgtatttttattgcaatttttctcaaaaatgccaaaatatgtgcaaaatatgtgccaaaccccaaaatatgtgctaactagggctaggatttttatgttttaacatattttttttgcggcttagttatggcgagagaagcccaaaaatagcattttctccgaacaatttttggtttagagcgacttataaaaacataaaaacacatgtggggtggttttggcacataaaatatgttagcaccatattttgggg

SEQ ID NO: 7841 - DNA, 1898 bp, Heterodera glycines
tgttttgcgtgatgatcaaactgaagaagcaccaccctcgatgaataccaatgatgaagtgttgaacaaatttgctctgtcacgacgcatcgaaatcatcaaaatcggacggaaaacggttttttttcttcaagtttttgcttgtacaattatacaaatttaactatgttagacaaatgttgtggacgatgatgaggaggagggcttggttggcattccgcgaattgtggaatccattgaaactgtctgttggccgaacatgaaactgaagccgaacccggtgaagcagcgcgagcatcggactcgtcttgaaaaatacatcaactccgaggcgtgcgctgatgacactgcggtttttgacatgttcccccattgtgctgatgattttgctccggtacgcctctttttttaatggtataatcgacaatttggcaattgtccagttcgtgtccacttatttgttatggttttcaacacattgacaccgcgaaatagtgtatatcatagaagttcagtgtcttgacaactcgtacaataggcaaccgtatatatttgctttgggtttattttgtaaagtttactattgcgcgttttgcctttacgagttgccatagactcaaattttcgaattcaaacaatatttaaccaaaaagagtatacacagaaggggtcggtcaaacaaacataagcaacatttcccttaccatttgcttttgtcataaattgtttattttagggaattgcatctcacagagtcaatcaaatgccaccggagaaggataaagcggccaacattgagccgacgggttccgattaccctgacagtgaagatgaaagttatattttgtttatttaatggtcaagatttattctttttttcattgtttagtggcaattttggaatggtttgacaagccgatcagcgaagacattttgaacctttctgtaattttactatttaaaaaaaatttgtgtacatttggtccattcttttttagaacattccaccgccacaaaacaaaatcaccaatctgcaaccggctcgcgaaaatgatgatgatgatttggatatcaatgcatatatctgcaaaaacatgaacgaggtatgtggctccgctgggtttagtgcattattagggcttgaatcgttggtccggttcggacttgacatgcataaaaagtgatctaaacgttttggtgtatctgaggctatttgttggaaaatttgtgtttatccctctaaaatgctaattggcatggaggctttttgttttgtttttttttaatgggggtgctgtatgctgtaccaaaaccacgcgcgacaccgttgctctaaaaaattgtttgtttgccaaatataagacaatacgaacatcgaaagcaataaaataccaaccacattacctgagggaccaccaccaccttccaattctcttgaatttgaaaccattgaaaagtttttctttagttacgcctcggcaacacccagcggcccttaatggcgcgagtcgatgtcaacgagggaatcacttacgaccttttgaaggccatttcctcttcatgcaacaacaacaataaacggggcgataataataaataattgtttttgctcaatttccatttgctttttttgtgttttaaaattttattgcatcgtttttccctttttctcattcattttttcgttatttatttccatgccattatccaaatgattatctacatagttttttgatttaatcatttctaattcattttttcttttctttttttcctgtttgcgaatttattggaaaatgactgaagccaaaaagttgcccgaagtgccggagacgctgttgaagcgacgcaaaatcagagccgcgcaacgggctgccaaggcgaagaacaactgaaca

SEQ ID NO: 7842 - DNA, 1028 bp, Heterodera glycines
ccacctttcccgctgttcgtcaaccatccgtgccggcactttgtaccgcttcaactgcccatcccagtccaagtcgacaagtccgccacggacagcgatcgccttcttcacccgattggccaaactgatggccgattcgccgggctaaaaaacataggacttttttttttgtgatgacgacttcaaaaaattttttttgaaattttcttataaaaaattctaagatttttttcttaaaaaatttctgttcaattttttttttaatttttgcggcgaaattttgtcccggcgaaattacggtggcggaattttgtccgtcccccttattctaccgagttaccacaaggtcatggtcatttaaccactcttttattgaaatttttattgtgaattactaagatttttcaaaatttttccaaaaaatcgctgaaaatttaacgaaattagaaatttttcaaaaaaaagtattaaaaatttttttttagaaaattcaaagaaaaaaaaattctcgaaaaattttccagagcgattttttcaaaatttaatggtgaataactaagttttttcaaaaaaaaaatcaaaaaaatcactggaaaattttttgaaattttttttcccttcgaatttcctaagaaaaaattttctaagatttttttcttaaaaaatttctgtttaaaaattttttaaaaatttattcccggctgtgtttcggcgcctgttttgggatgtaccggagtcgaccccaccccccccccccacccatttttctttgaccccacctctttggtcatcggtggcaaataccacacgtggcagatcagtgcccagctggtcatcatctgcagcaagtagcgaaaatagctctgctcgctggagttccaaaaggcgtcgccgaagcgcgagtcgtatttcatggcgatgggataaattggcgcattgacctgtgaagcgtggagaaggggggatgtctaaatttgcaataaacataaaggcaacaggaagcagagagatagcgagagagaaggggg

SEQ ID NO: 7843 - DNA, 1277 bp, Heterodera glycines
aaaaaatgagtatcatcataatagaaaacgctaataaatttctaagatatattttataaattccatcccttgcacaattgcagtgaaaatgaaaaatttgaggaactttaggccacattttttgaggacaaacacccaccggttgcacaccaacgagcggtccttggcctcggagcgttcaaaccaaatgtgggacgacgcacgactgagtgcccgttggatgagcccgatgacgccgccgtgtttttgtccgatcagcgcgtaggcggtgtccgagccgaggatcaccacgtcaatgggcgatgtgtggttggccacgcaaatgccttttgattggaaaaaatttaaaaaaaaatttttttttaaatgaaataaaaatttttgaaatgtaattaccgccactctgtgccttgttgtgactgtcatggaagaagatcagtgccgagaaagcacgtgaaccgatgcgcatgaccacctttgtacacaaatgggggggggggggatgggtataaaatgtaaaaataaattgaaataatccaaaataaaatttgaaaatatcagagggtcccctacgcaaagagagcggaatttgtactttgtaaatctgtaatccaaaaaataaaattttactttttcaaataataaagctataaaaatggggaaaaaaatgctccgtgctggaatcgaaccagcgatcttctgtttactagacagacgccttgccactgggccaacggagcacattgtggtataaatttttttatcaaagaaaacaatttctctttgtcgcatgttattctttttcctgcgttactggattatattgggtatagagaattatttatgctttttcaatgatatttaaattagtgtattttttaaagaaaaaaagcttggtctgagaatttataaaaaaatatattaaaattaaattagtctcacaaaaaggacagtagtaataaaaacataaagaataaatatatagcagaaaattcaagagagcagctcgttttcaccgaaaatcttttttttaatttttgctaacttagaaattttacaatgaaaaaatgttagaaaattttttcataaaatattttaagaaagaattttacagcaatttttaaataaaaataaaagcatttaaaatgatatggatttgtaactaccggaaaggataaagaaattcgaaaaaaagacggcatgctccgtgctggaatcgaaccagcgatcttctgtttactagacagacgccttgccactgggccaacggagcacat

SEQ ID NO: 7844 - DNA, 2415 bp, Heterodera glycines
  misc_feature (9)..(9): n is a, c, g, or t
  misc_feature (2369)..(2369): n is a, c, g, or t
taggaaaanaaacttaaattgaacaaatttccttatcaaatttcattcaaaatcccaaaatttttctttaaaaaaaatttctcaaaattgcaaaatttagtcattttttggacaaaatctgtcaacaaatagcagtcaattttcaaaaaaaaaatttttcggcggcgccgcctcaccccctgttccccaaaagtttttggaaaaattgcgtcgcgaacaacaaaaaaaaggtcgaagttttaaaaagaaaaaataatgtttaaaattttatagctattttttttaaattttaatatgaatgactaagtttttgcaaaatttttcttgtaattttcatagaaaatttttttatgacaaactgacgcccctcgccaaaagcaggaaaaattgttggaaaatttgtcaaactatcgcaaaaaaaaaaatgcccgccaatttggatggaaagagaaattaattaatttgtttatttttgagcacctcagaaattggtagaagctgacgctggtccgtgtcagcatattccacgaggccaactgctcggcctgaatggaaaaaatttttaaaaaataaaaataaataaataatcattttttgggccctttttgccttgaatcggctggtcacttcgtcctcaatgatcgcctcaacgccggccttgaaaagttggggaaaaatttgcaattaaaaaaatgattaaaaaaatgtgaataacgaaaattttaaaaaaattttagaaaaaatcctcgtaaaataatttttaaatttattgaaattcaaagaaattttgagattttcaaaggtttaaaaaaatatataaaatttagaaaattattatgaaattgcaaaaaacaaaacaaaaattgggaaaattgaattttgtcattaaatttttaaaaataaccgcaaaaattaatgccatgccacacacacacctttatgaagtacatggagtcccgaatgccttgccatccgcgcgaattgacgaacgtttggaattggaactcctgctgctggtactggtcctgctcgtccaagtgctggatggacgtctcgcggatgataatgccttgggggaaatggggataaataatggacggaaataaattttaaaaaatgaatgaaaatcggcatcgaattttgcaataaaaattgacgatggctcatctcttctccggaaaatgttattttgcaacaaaaaaaaaattaccaaacaatttttataaaaaatgaaaaatctttttgagatttctgactaaaaaaaattggggcctgattcgtgaccagcaaccccctgaaaatcccaattttttcacgtcgtaaatttcctggggcataggtgctgtaattgaggggagccttccgttttcccaccacctccaattttttttaattttcaaaaaaattcttaattttttacaaaagaattacaagaaaattttttttttggaaaaagtaaatgatgaattactaaatttttatagaattcttccaaaaaaaatcgttgaaaaaaaatttttttttttttaatattttcttataatttttttgttagtcaatctccgtcaatatgccaacaacaaaaaacaaactttggccggagccgtgccgagctcgagcagaccgagtggaggtggccgagcaaagacctgcgaattttttgaaaatttgcaaccaaaatgaaaaattcaaaaaaaaaaaatccccaacttgttgagctgccgtggtgcaacgacgtcttgcgcaggcttggcatcgagttcatcgagcgtgccaatgggcttggtgccaatcccgagtcggttggactcttaaaaatgaaccaaaaatttccataaattcaatctttacatatttatttggttttgaaattccgtccaacaagcccatttaattattttaaaacttttgcatttaaaaaataaattcaataaaggcaatgcattggattctgggccaaatcatcgggtcttggggccaaattaggcataaattgatcctattctcgggtccaggccggcagggacagggggtacctactgcccctgggcgacgaatcttttttgcttttcactccatttttcacggcacggatttaaacatttttttaaggaaccaggggggtccgcgcgatatcgaaagagacagtcggggaaatttttacaatttctaacagaatttctcaaaaattttgcatattttatggattttttgaaaaaactcagaggttttttttctcttggaaaatttgggtgagttcagcgcaaaaaataatttttattgaaatggggtcgataggccaggtcgcgtccaaattggcaatttcttggggccaggccggcaggacaatctcagcattttgacttggntgggggtaccgcacctgtgcgcctaatttttattctaacgacaatc

SEQ ID NO: 7845 - DNA, 1294 bp, Heterodera glycines
taatggggacgggttaggtgaggaaatggcatttgaacgtatttgaaatagattttttttttgagatgggagtgaaaatttaaaaaaaatacgattttatgcatctccccaggaggacccatcaacacttgaaattttaaggaaaaatagtaatttgtgctgaaattttcgattttttcttcccttccaaggctgcgtcatccaaattttccaaaaaatttcgctaagtttttccaatgcaacgctagtcgacaccgacggatccctccaattccaccaaaaaaaaattttttttttagaaattacgccgcaaaaatggcgtaaaaaaaggtcgtcgcccgggagaggggcgatacccctccaagccgaaatcctgtgcaaaatttgtttactatattaaatttgtgcaatcaaatttttagtaaaaaatttccactctaaaaaccataaaatgaatgaaacctcaaatttcgccaaaaaatgggatgaattttcacatataaactcatagaattttttgctgcaaatttggcatggcaaacctcaaaaattcggatcaaaatgctgacatagcgctcgcggaggcccaacgatttgccaaaagtggccaaaacgacgaccaaaagcacaatgagcagagcgggcgggaagaagaaggcggacagcaccagcagatgctcagccgtggccgacaacagcaaaagggacattgggagaagaagtgaagggaacggagagagtctaaaatggaaaaacaatgaaaaaaaatatgaaaattatggaaaaaacaatgccaaagtgaagggagccaaagggggaaataaaaaaaaaatggaaaatttgagaaaatttggaaaactatggtaaaagcgaaatgagtttaaggggaaaaaatattggaaaaaatagaaattttggaaaaactatggcaaagtgaagggagcctaaaagggaaaattttaaaaaatggaaaagtgatgggagtctgggggaaatgaaaaatacgacaaaatgaatggaatctaaataaggaaaaattaaaaaaatggaaatttggaaaaaatgaaaacgctagcaaagggcaagagggcggggggaggaaaatttgaaaaaaatcgggtaatttttgtggaaaatttatgtaaaaagagagagaaaggtgaaaaatctggaaggggggggggtagaaaattaagtcgttggctcctcacgctcattttaaaaaaaatctaaaaatgaagattttttgaccggaaaaatctgaaaattttggttaacgagcatagaggataaa

SEQ ID NO: 7846 - DNA, 1468 bp, Heterodera glycines
  misc_feature (34)..(35): n is a, c, g, or t
  misc_feature (106)..(106): n is a, c, g, or t
tcaatgaatgaatgattagtattagtcagtaatnnatagggtggaaattgcattaaatacataaaatctaaaaatcgcaagttttttttcttcaaaaacagacaanaattaattattaaatacctaaaaaaatttaagctatttttaagggattctatgattatacatatcacgctttttggtaaaggctgaaaattagcattttttacaatggcaaatgacaaaaaattaaatttaaagaggtaatttggcccagaaaaattgaatttgatggaacattgaattgggaagccctttttaaaaaaattcaattttcctttcttgtggggagaaccttttgcaaattgaatcatcacttcttaaaatggaggtatatgagtttttatttttacgcaaaagcagaaaaaacgaaaatggaaaaaataggcagcaggccaaaaaaaaataaatcaaattcaaaatcttaaacaaaggtactttaaaggatgcctttttgaagcatcaaaaataagtttttgccggaggagtgatgaaaaattgttgtgaaggcagcaggagagattcagaacattgcccagacctgaacactgttagattcatcgtgtaaaaaaataaactaacaaaatccctgaatttttttgaaaattcggtttttgaggatttttttggaaaattatttttcgaattgggctctccaaaaactgtccaagacacataagatttccaaaaatcattaaaacaggtaggcaatacatgcctggggcacaaaatttcgcctgcccggcccatatgcattttgaaaatttgaaaaacatttatttgccactaatggctcgaccgctgtcgcgctaatcgaaatttcaaagaaacaattagctgctaattgtttccctgctcaaatttcgatgatgccttagtagggtcattaattactctattctattgaattgagagaatttaacacctcggcagtacattttacacagtttaactaaacgcgcccctttttaaaaaatgataattgggcggaactttgatgctttttgcttcggggcgtcgttcgttcgttcgtttttcagtcccccatttaattcgattaattaccatcatgttaaattactcctaatttaaaaaaaatgcatataaaatcaccaccacaaaggaataataaacatcaggccagcagtccaataataaaattccgattcatttgcttaccaaagaattttaattttgatgatcggttattgaatattgaccaaaaatacaacaaaatgaatccgtgggagaaaagcaaattttattttacggttttatgcggccacaattggaaaaaaagagaatggaagcaaagggaggagaaagtgtgtagcgagagaaagaaagggagggaggagagcgagagagagagagaaagagagagatatagagagagaaaattgaagaaagagaggtctaaaaaagagaa

SEQ ID NO: 7847 - DNA, 6371 bp, Heterodera glycines
  misc_feature (50)..(50): n is a, c, g, or t
tagccacgttgtaatttatttttctgccattttcccattaagtggatggntattcattcaattttcgcactatacaattaaaaaaacattcattgttgccatttaacattattttttctttttgtttcttttgtacaattaatttttttattgtttcatgcggaacagaaaaaagacaaattttaattttttttataaatgcttgtgacaaacaatgggattaattccaaaaaatgttgctccgccggccaatgcttttttcctccattcttttcaatcattgacaaattaaggagcaaaatttgaaatatgtgccaagactcaaaacaaaagttatgaaggcgaacagaaagaacaatgcgtgggcctcacttgctttttggataagcaaaaaaaaggcgtaaaataaagtgccaagggaaagaaaagcgatcgtcaaaacgcagttgcatctccagttcggacgatgctcctgatgctgaacagctccaacttggcttcgtccggcttgactttgccgtggttgctgaacaccgtcaaaactgtgcatgcgcttacggcgtcgttgtgtttgttggagaccagcagtacttacagtaacctaaaagaatgggtacgaacattgtaccatataattgggtgcgaaaaaaagaatttctcatgagaatggagggaatctaatttattgttaattatttcaattactgttgccaatgcacttcggagaagttctgtagccaacgattgcatatgttttgcgatggaaatttggtgccgaaaacggcacattttttgattgttgactgaaaatttaatagaaaaattgagagaaataaaaacccaaaattgtctaaatttacctgattcaacgaacactttaaatgcatcgaaaagattcttaagaattttgtcgctttcctttccaaaatattttacaaatttatcattggcattttgaacattcgttcgaatattttcttcatttattttcatctcttcaaaataattggcaaattgaattgccatatttttcgttttttcttccgttacttttaaaatttcccccttctccatttctttacaaaaagcactttggatttttcctaactcatgccatttagatttttcaagttcaaaattgtttttttcatttaaatccaaaaaatttgcacggcacaaaaagtgtgatacacatttttgtagcaatttcattaataaaagtttgttttgaccatcatctttcaataaaggaacagccaaagaagccagttccatcatttccacagattttgcatctaaaattaaacaatcggagacggaactctaaattaaaagctaccgctttgtgcttggcaaatgcttaacaaactcagcaataataaaacaaataaatgcatttctatgaaatgattaaaaaatatattattttgaagaaagacttcttgttgtttatattttattgaacagttattgaaaaaacacatccctaaattacgtggccacgacaatcggaagtgacaatttggttataatttttgtgttaccgccggaaaataagaaaattttaaatagataaaaaaataatggagattagaaaaagctcaaacactgcattacaaattattaaacgcaatttaaaaataattgataattccaccaaatatattttattgaaattagaaaatttaattgattgaaaaaatgttttcgatgcatgaagctggaagtttggctcaggcctagagaatgacaaatcaacctttttattgctttttgcggagtatcaatttaaatgttgatatttatttaaatcaactaacattatgccatcaacgcaaatatcaacgtattttttaaaaattacgataattttttaaaatttgtttcaacgggtaataattttagtgcgagagataacgcaaaaatgagggagtgctggatctcagtcccagtcatacaagacatttttgatgaaggagggtagagaaaatatttccaatagagagtgcaatgggaagataattcacttctcttcttcgctgattcttttggtaatagacgcagattcctcactatattctctgttctctctcggtcttaaatctcttcccataacactctctttttaattaatttttctttattcttcttcaccaaaaatgcttttgtatgactggggctgatttttataccctctcatttttgcgttatctttctccccattttattttccgccaaaagtcatttttaaaaaatttgctttaaattaaaaaaaattatcccaattttaaaaatagtgttgatattacattgatggcataatgtattttgatttaaataaatatcatactaaaacaatgttcgctaagagaaaaatgtctcaggcctcctcctgtccttattgttagtaattatgtaaatacttgaaaaaggctgatataaaaacagaatcgattgtaagacccgaatgtcgggattaggaaaactcggggttcgagcttcaagcatatagaaaaccatcaaagtaatactttattattagttaactttatatcattacaattaaattattaatatgcaaaaataaatgtgtttttgtcaaaccaaatttctctaagaaaacaaaaattgaaaaacttattgagaaatttactattttcttggcgaaaaatattgatttatcatcaaattaaatttataatctataaaaaataataatctttattgatatttagagcggaagaataatttaaaagtaaaattttatttgaatttttatcataagataagaagtatataattgaaaaaataaaagaattttgttgaaaaattgcattttcaagattaatcatttttaaacaagcccgtgtttttcatggacttggattttcctgaacgtttgtccacgaaatccaggttcaggctttttaaaaatgcccagctctactagtgatttaaaaaaatattatgtaaaatccttgaattcaaaacttcatattcatttttttgtctttcattcgttcaagatgagcaatggtcaatcttcaatcacccaaccgtaaaaatatttgaaatttattatttagttatattttcgtaattttgcattaattcgaataggtcgtgcaaatccgatatgctgccgaacgatgaatatgaaaggtaaaacaaaaataatagaaagaacttttgcaattaatgaagaaaaaatatgttaattaagtaaatttttgaatttcaggcttttcccgaaaaaagttgacaaatatttgtttccgcagagagcaaaatgtgaaggaataggcaatgaaatggtactatttttaatggagttttaacgtgatggacttaggaaaaaagcggtattggcaccatttggggagggggactaatgaggagaatgccccccccccgcaccttttaacaattcaaagtgttcctggaccatttgacatgcttttagttccgttttgccgcattgtacggcattggaaaaccgtacggacggaagctaattttcacggaggtcaaaagatgcgaaaagtcacaccacgcaatagaaggagagcacgagatagaggagctcttcccggtgttcgccagtcaaagaaaatattttgtaaaaaaaaattaaattcattttcgttaagactttcggaattcgcctcagaatccgacggggaagcaaaatgagacttttaatatcgaaaacggggattttggatgtcacaattacgaggcaccacaaaagttggcacagttttttgtttccgactcttttgaattttgttgaatttaagatttgcaatttcaagaatcaaagagaaatacttggaattgaaggtatgtaagtaatttatatttaaaaaactttttctcataaaactcattccttattttgaggggtagcttgtcttataaattacaaatattttgaaacgcgaagaatggaaatgcgtaaaagttttcaaattgggcatgaactctgtaaaaatgtgacggcattcaaaagagaattgtttgggttggtattcaaaacaaatattttaaatcactgcatacagtgccggaaaaaagtttaaaaatttttaaatttttgtattttacttgggaacaatatagaaaatggtttgttttttccgaagcgcattttgaatggtgcgcatacgtttgatagcaaaaaagtgaagagggaattaaaattcagtaaatggcaatgagcttttgtttaacatagttaattctttattttcgttaaacaaaacattttctatcgttaattgttcccaagtaaaatacaaaaatttaaaaattttagttcgttgcataaactttccggcactgtattttgtttgtaattatacgcacataaattacacgattagttgaaaatgtgtttttctctttgcttcacaattatgtgaaattttcaaaatattcgttagtataagggctctaaagcctataaaatttacaaaattttcaattatgcataaatattataaatctgttcgcattttttgtaaaattcttttaaaaaaccatgccaaaattttacgtgaaattttctagttttgaaattaaatattttggaattttgcagctccttgtaaacttatttcttgaagatttcaaatcatttctgtcattaataccgactaaataatccactcgctcctttgttgcctctttgtaaatttagccctgtttgcacataaccgaaaattggtccaactatccataaaatttatggcatataattacaacctataattattcgtttttaattatattttaaaattttgcaatttaaataaatttttaaccaatgataaattaattcattaataaaatgctaaattaataatgttttttaaaatttttagagatgatcaggcgcacaaattttgcgtgcacaacccgaaggggagattttgtctcccggggttgggaatcgaaaaaagattttacagagcaaggaatcaattcggatttgaatatttaaaggttgttctaaatgtcgaattgcatctcaatattattaatttaaatttcagaaaaatttaacaacatttccgtttccgtaattttaatgcgagaagataaacaatttttgagggatttaacatttaatcgaaaggcaattagcattgttgaacatttaaattaatttttattttttgcttttctccaatgtttacgtgccgaaaccaatgtttagaaggaatgatttcgcttttggcgttatggcatgcgattctttgctgattacggcacaagtgtcaacttttgcttttgtattgcttatttgatgccggatgacgcaactattttttacaattcgaatttccccaagtgtcagtcttttttcatctttttcaaaatcaacgagcataaaattaattgtaaaggctgtgaaatattgaaaaatcttttggcttcatttgaatttagacacctgtagccgagaaggttatttgcccgagtgggtaccgttacaaatgattaacggggcaatgactctcgattaaaccgcggacgcaaatggaatatctgcaagaaaacgagataattttcaaattggatttcattatatctattgctgaccatttataaattaagtgattttaaaaaaggttttgtttattgttttaaaaagttagaggaattcgtttagtaatctttttaatttaaaatttctgagttttgagattgtacaaaaaaaattaaagaataatccaacattaaaaaaaaaaaattattttcattattttttattaccaatgatttaaataattgccttggacagcgcccaaaaaaatcgcatttaaaaaaaaaattatataaaattttatttatcatttttaataaatttccttctttaatttctttgtttgcttgcgctgtttcctttttctgttcacctcaattttttggttatatacacacattaaaattgccatttaattgctgctgtgtcttcgcagtcaattttgtggtgactgaaaatgaaaaactcgaaatgtttgttgttcttttggcaaaacaattttcatataaatttactcaattgatatgattttgtttattgtaaaatatatttattttttatttaagttaaaaagcttacattttatttttgtttattaatataaaattatattttttctccaaaatttgagaatttattgaaacttgagaaaataaaggggaccagtaaaagacgggaatattgaccagagacggcgcaattgaaattttagtaacttcgaattttctcttaaaaaattctttcaacaaattttttttatgaagtttctttgaaatttaatgtttttattaaaatttgcaaattcctttaaaatatttaa

SEQ ID NO: 7848 - DNA, 4446 bp, Heterodera glycines
cccgtagctgaactgactatagtttctaaaaataccgtaataggacggactaaaccgggacattattcttctttcattactgtaattgcactaaacaaaggtttaagtaataaaatgataattctttgctccattaattaaatagtcataaccaatttcaagtagccaaatcaataacatactgtactattttacagtcctcaattttctgtcgatggccgcctaccgaatggagcgcatttattcggtgatcggcaccattctgttcatcgtggcattcatttgcatggtctggtaagtaattagaggattaattagggaagctgattcgtgccattttttgattgaatttatttttaaaggtatctgatcgactatgacatcaatcgtggacagttgatcgctgctacggtaaaaataaaaaattaggaaatttaattatttatcactgcttttaattttcggttcaataaatcgtcataactttttgcaaagtcaaacgaattaaacaaacattagtttggtattattcggtagcccttaagatacatattctctatttccttgaaaattaaaaaaatgttatcaccttagaaaaaaattgttgtcaaaaaaaagttagacttgatcataacttttttgaaaacaatagattttcttgaattttgtgcgtctgttgaatgataccaaacgaatgtttaatttggtaaactttgagaatgaaaagttaagatgatttttttgtcgaaaaacactaagagtcggggcagtaccagttgggttttaccgtttatcaacagtttaatttttgttgaagattagctccaacagcccaaccgttagaatttttttagggggcagagcgaaattaaaaaaagtttttttatggccattttttaacctaattaatggttgccctcccccgcaaaaggtgttcatcggcatccaaatggtgctgttcatctgggactatcagatcctgcatggccaggccttcaactgaatgaatggatggatggacttcttcggtcggaaatgaatggagatgaaaatggcaaatgatggaattttgaatttttttttgcgctttgatttttgctgttaaatgatgaaaaaggcaaaaattcccttccctaccctcctccctccacccaaatcgaatttgtgcgcttttacgaataattttaggtaaaatttagccgaatttggccattggcttggacattaaaaatgatattggtattgagtaattccttatgtgtattcgtcttaaatgtgcacagattccatatctccttctcatcctcttgatgaatttgtttttatactgtcggctaccgtatgccttcgaccttatctgaaaagtgcaaattttgctttaatagctaaaatatcggccaattttttgcttttctctagtcaaagccactttccgataactttcaactgatacggtagttgtgcggtggaatttatacagtctgcccctttcaacaatttctttgtcttcccctttaattttagagcattttcgcacacattacacaaattcttttggaataaatatttttaaatgaaacataattgtttgcaattgtacatataattttattgttaatattggtttcgttatcgaactgaaaaaacggggaggatgctgagaccacacaatgatgaagcagaatcattactccccctccccccaccccggcatttttacttttattagcaatttttgctgatagccgatcatggggacaattaccctctccttttgctccccgcccccggcgtcttttttgcatatattgccatttttttttgacaaccgaccccctcacccaacccatcccctcgtcggtgacctcactttctgcttgccatgtaccttccaacaccattggacgcgaacgtgtgaagcagtgatgccaaccggaccccgagacccgaaacccgaagtttttctcaacccgaaacccgaattcgaaatgggttatttttaatgttttaattcatttaaaagagtgtttgtttttttaataaaaaataaattttttaatttaaattaaattattttttgtgaaaaatgttttaaattaaaataataatttatttacttttattaaagaactcctgtattttttaaattataatttgtaaaattaatttcaatttaaataaatattcaatccttgtacatttcaaactttctttttaattaataaaaggaataatttattttatttttaaaaatttattaattacattcaatattaatcttactttttaataaacgatttcctttatttaattttaaaaccatgattgtaccctttttaaccattattgtaccctttttaaccattattgtagcttttcgacagtggttgtacctcttctcatcattgttgtacctcttttaccgtggccatcagtgatgccaacccgaacccgaaacccgaaacccgatacccgaaatccgaagtttttctcaacccgaaacccgaactcgaaatttttcgagtgctcgacccgaaacccgaacccgaaatttttctcaacccacggcatcactggtgtgaagggcaggcgacctgtgcccccgcccgccggcggggaaatggacaaaatagaaaaaatcagcggcagagggaggagggattatcggaaaagttaaaaaagtgcgaaaggaaaagcataaatgtgggaaaacattttgactgacaatgagtgcggaataagtgggagagttacttgatgaccccttttacaacgaaaagcatatgcctaattaattttaataatttttaattgttttctctatttttcaaatttaaaaaggcacagttgttgattcaaattatatagaacaatttttgaaacatttcaattagtaatgcgcgccctttcaccaatttttgcgctgcttttttgccaaagtgcattttgcaacagcggtaataaattgtttttttaaatttaaatgatatttcaaaaattatgcacttgcatgcaagcgtggtgtttttacagaggatggcgatcttggcgtcaaaatgcttggtgccgaacaagcaaaaggtgggcctttaaatgcagggaaggaagcataggtgggggattggctttgtatgctcgagaccaaaagattctcgacaatcaccgaataatagattttttgtcttttttactcaaatcccatccctcgtctaagaaattttccgtataatgtgcaaagatttttttcaagaaaaactttcgcgtttgaatttataatttttcgcattgttttaattaggaaaaaacatttattaatttaaattaattttatttataaatctttaaattaactattttttgtcaaaattttccgccagaaaaattgggttaaagaatgtagcaataacaaaaccaattttcaagaactgtccttgcattcagtgacggatttgaaaacgaatattttgttctttgagttagctcaaaaattttaatacatcaaaaattacttataatccagaactgctgaagcagccatgccatcctgggttgaagcaatgttgtgcccttttctgcccatcaggtgggcttttcaagaccgagatttgaaatcagctgggccgggccgggttgacattctcaaaaacaatttgttttggtttccccacacccggccaatctggatttttgctaaaagcacagggatggcttgccgggccaggtaaaaaccggtaaaggatctggcccggctatggggagggatgtccgataaaattttttcaatggaaaattgaacggaaaaagctgctttgagaaaatttcatatcaacttcgttttttgtatttttatttatgtacgagtggagaccgcgagaagtcagacagttctcatacaattggagtatacaaatttttttttaattttattaatcaaaattctacaaattttgaaaaaatcccggacctatgggcgtccggccaaaattaggcacaaaacggccttttgtgaaattcaggtaaatacatttaaaattactgggattgttcggacggaagcatttcggctgaagaaaccgccaatgttttgggactgaagccggaggactggcactgtgaagcgcacttctcgccgttggtggaaagccgaaatgaagagctctgagaagcgatagcatggattggcattttgcaagaataattaaggatttttaggtttttaattatttaaacggagaaattgctatttcatgttcaaaattcacgaatttaatggattttaattttttttgataatttttatgtctttcattatccgttcgtcctgttatccaacattttttcttaaagtttttgatgccatttacttaatcgatctgctgctatttatggaatatctcaaacatttacaaatctaaaaagaaatttgtttatttaaatcttaagttc

SEQ ID NO: 7849 - DNA, 1173 bp, Heterodera glycines
ctcaagaaatggacaaaataaaagcatattacagctctacagatagtattcgtagaaattaatttttattaaaatttcatgtaacggacccaaaaagaggaaatagtacaaaatattatttcgttctgtatgcacttaaaaatgaaaaaagaaaaaacaacctacaattttatggagaggaatcgctagtttttattattatcgacgcttaatgcaaatattattccatgcggatatcatgttttataattgccatccatttgctaaatttgaaaaagttgttaagcatttgaaagcttctgggccaataattaaaacaagccgatatttatatagttattcaaaataaatcactcctaaatagaaatgtgtgtgcttattagtgaaattactcaagaaatggacaaaattaaagcatattttatttcgttctgtatgcacttaaaaatgaaaaaagaaaaaacaacctacaattttatggagaggaattgctagtttttattattatcgacgcttaatgtaaatattattccatgcggatatcatgttttataattccaatccatttgctaaatttgaaaaagttgttaagcatttgaaagcttctgggccaataattaaaacaagccgatatttatatagttattcaaaataaatcactcctaattagaaatgtgtgtgcttattagtgaaattactcaagaaatggacaaaattaaagcatattacagctctacagatagtattcgtagaaattaatttttattaaaattcatgtaacgaaccaaaacgataaagtaacaaaatattatttcgttctgtatgcacttaaaaatgaaaaaagaaaaaacaacctacaattttatggagaggaatcgctagtttttattattatcgacgcttaatgcaaatattattccatgcggatatcatgttttataattgccatccatttgctaaatttgaaaaagttgttaagcatttgaaagcttctgggccaataattaaaacaagccgatatttatatagttattcaaaataaatcactcctaaatagaaatgtgtgtgcttattagtgaaattactcaagaaatggacaaaattaaagcatattttatttcgttctgtctgcaatgaaaaatgaaaaaagaaaaaacaacctacaattttatg

SEQ ID NO: 7850 - DNA, 989 bp, Heterodera glycines
  misc_feature (8)..(8): n is a, c, g, or t
  misc_feature (22)..(22): n is a, c, g, or t
cttaattncaatcagtaaaatntgctaataggttaaaaaattgcaattaaaatttaaaaattgggacgaattttaagtatgaaatgattaagtgcaattacttaattatttttcaacttgggtgggatgggtgaacttttaagcgtggataataataaataatccctgcgaagtgctaattccggtgggacgcttttgttagccgtgccattctgcgaaataaaatccaaaaaatggaatggcggctacgagttcagcagagattaaatgcaaatgttttggatggtggtgagattaaaataacaggcggagcttttggaatgggaaatatttgcaatggcatgccatttagggattgaatttaaaaattattaaaataaaaaataaatacaacttggattaaaataaatgccaatttaataaattgaataggttctgtccagcttatgtacgtaaaagtctgtctgttctatttttggtgggtcagcaggtgatacgtcttgttaaacttccccccgccgacagtaccccgggcgtcgcatcagccgggccgaggtgcgccgctatatggcccgccaccgcgtctacaccctacaccatcgggtcatgtccgacgatttcgtcgtctgccgacgcttgcgtcatgtctgcataccgaatgtcaagcggatctgcactatttcccggcgctgaagcggcacaatcgcgtccacgcgtacctgctggagtgtgcggacacattgagccgtcaactgtttgtggagacgttgaagagcaagcgctcctccaacattgttcaagctattgagaaaatattccgccgggttggttatgtgccatggaagctgatgaggcaccgggcaaatagttcaccgcccgccccattgtcacgctttttagacgacccagaggtgcaactccattgcacgcccccctcacctccccggcctgctcgaattgcggagcgtggcatcacaaccatcaaggtt

SEQ ID NO: 7851 - DNA, 2310 bp, Heterodera glycines
aatccaggtccaggtccaagttaggcatgaaaaaactggatttcctggataatattttagaatttgttatttcgagtgaccaagtttatttaaaattatcaaaaaatgatttaatagatttgcaattagatacttttagatttttcctaagcaataattgattgattttttcaaacatttattttctttataacatatttctaaaaaaaaatccaagtccatgccttgattccggccatgataagcctagattttttctggacctgaatattcctgggttcttgtccaggaaatccaaatccaggtgcaatttggaatcaaggctcaggtccaggctttttaaaaatgtcgagttctaaaaatggcatattaattaattttttaaatttttttattatctatcgttgtcaaacaataataattattagaaatgagcatttcattaatttgtcaagaaattaaaattatttttgaccagctcaatctctatcgaaaaagttaattttaaacaagcattcaactttgaattgatttggctctttccttgcaaaaaatgtcgccttcttcgatcagcaacagacagacaaatcgtacaaaatattatgtctcccccccgccactcattcattggccgtcgtttgttgcgctgctccatctccgccattcatttggcccattttattgcctttttgtaattcccaataattggccattcatcggccccattttttaggctttgctttttttgtttgctgctgctcgttggctcacttccctttgatttggccactataaaaggtgtgttttgtctgccaattgtcgcattcattccttcgtcctttgatcaacgattatttggcaatccgattgactgactgaccgacagtccctctattttcccactgatcatccgtccgtctatctgtcactgatcgaatgtttccccaatctctttctctctccgtcctttggcttttggcactgtccaatttcgctaccgcttcgggtgccgttcaacactatgatgggttcgctcctcgctttatctttgattaaacattttttctttcataatcccccctttcccccgctttctcagtttccaattgcttcgtgtcatcccacaaacattagaacagctcgctgcccttcgcaacttcagcgaacatgtcggccttcagcccaattcgggtgccgaagtttggaactttcgccctttcgttggccaaccgtccgaattttttgccgcgccggacaatgtcaaaagagtcaccgacttttttgacgacaaccaaatcccgaacggggttctggtcgaaaattttggaatgtaatgggaaatcgagaaatagtttattttctcgtctttttagacagctcagagaggcacagagaaaattcattcttcacgacccggcggagagaattcgaagtccgtccgacttcgacttgaatcgtttccaccccttcgaatcggtcattcttttcatctgggtttaaatgggttttacccccatttaattgctgctccattcagattgagagttacctccgtctgttggcccagtcccaccccaatttcatcaaattcgactccatcggcaaaacctccgagggtcgtgaaattcccttcctgacggtcggttatttcatcgaatatttgttttgactgtactcgtttgtgatctcgagattctcgactctcggattttcgccatttctcggtctaatttcttggtctctgttttgcgtttctctgggtatttcttggtctcgggatctttttcgtcttgtttatcaagtcagtctctattctctgattttctctgttcttctgggctccgcttaccaattttttgataaatttccgactctccttcaccccgctgttatccatggccatttttaagcctcccccaaaaaatgcctttcagctgggctacccctcgaaaacctccaaaaagccggctctgttcctcgatgctggcatccacgcccgcgaatggatcgcgcccgcgatcgcccttcactttatcaacgcggttcgtttcaatagtgtcttacctttgctgattcgttgtccgcttcttcagctgatcaatgagcccaaattccattctctgctctccgacatcgatgtgcacgtccttccgtcgcttaacccggacggatacgctcacacgtggaccaaagacagttcagagatttaaataaaatatttgattaggttcagagatttaaataaattataaaaaatatttcatcaaatgtttgaggactttggagtcggacgcgttcggggccaataaa

SEQ ID NO: 7852 - DNA, 2016 bp, Heterodera glycines
atttacagggccaagccggcgttagcaaatgcccgtgcttgtcaaaaaatgcttgtgccaagaaacaaaaaagaaaattttttgtttagccaagtgtacaacggggagcggcctttgtctgagccggaatgtgccaatttggccaaatttatcagtgccaacacgggcactatcaaagcgtatttgactctgcacgcgtacagcaatttgatcatccatccgtacggattcgaaagacatttctacccggaaaatgtggcggaaattgtcagtgtgggacaaattaataaagcgaaaatgaacaaatttaagctgcggatggcaaattcaatggcaaaagccatcgttcaagcggggggagagaaattccgtgtcggaagtgcgccggacattctctgttagtgccatttgtaattactataactaatctaataattaattgtctattccgtagatatggtgtcggggagcagcgacgattttgcacggagtgcgggcattaagtgagtgaagcatttgactgattagcaatgctaatgattgtggtactgatcaggtacacgtacacaatggaactgacctcgggatggtacggcgaccgatacgtgggctttgtgtacccggaagaagggattagcaaagaagcggaacaggtggacaaaggagggcaattagaaattaattagcaaaggaatcaatcgcctcccgcttaaggtattgccggcatttttgatattggcagagcaagtcaaaagtgagagcagcggaaaagaagcagaagaccaaaaaggcataggtggacagtgatcggcggagggagcgattggacagaagctgatcagcggcattgatcaaagggatgtagcatcaagagatcagcaacaaacttaaaaccaattagcttggaaaataatagaatagttaattcacttggcaattatttttatttattgtaattgtaattttccctctcaaattatgcttactcagaaatattgtagcctatttcatgtattcacatttactagaaatgacaactctgataaaattagttttaaattaattttttcttagtcttcgaaaatggtactcatttttcggtgcttaattcaattcttaagttttttattacttgtttagttttcagaatggtttgaaaggctctcgtctgctaaaacaattagtgtttcggtactaaaaataacttaaattcaaaaaatgttttaacaaatttataattatcgattcttagagggtggagcatatttttatttttaatgtatttaaaaattttggaaataatataaaataaggaaggacaaaatggggacccgttgagttttgattttgggattaattccgaaaaaataaaaataactctaaaaactggagaccaataattaagcgtataatttcaaagaataaatagtcaaaaaataccaaaacaaaaattatattccattgccaatttgtccatctgttaaattattataaaatatttttgtccttgttttattttccacttttgcttattctttttcttctcatttatcagcttcttttcagcctgttgaactgctcgctgctgtcgttggggccggtgaatttgttgaattcgaaactggcaatatgccaatttgtgatgaagctttgttcccagcagcagcagaaaccaacacactaaacataatgcaaaaattatgaacataagctgatcaaataagataatacagaacagatcaaaactgggctgatcatttcgatcagaatcaatgagattagcggatattagtaaaaaaatatttaaattaaaattagagctgaagccgggttgggaagaatcacgggattttgatccccttccatttttcatttatttttaaatttgcctttgattgtttaagccatttgctggtgccattccctgctgtgtttgcgttgttgaattggttgaatttgcgttaattgttattgcatttcccgtggctaatgtggaatttcctgctgttattgacg

SEQ ID NO: 7853 - DNA, 1649 bp, Heterodera glycines
ttgtgcatatatattttttaagaattaactttatttaaatattttttattaaaaataaaataatttagcggtgctaattgtcagttgtttcataaattgttggattttttgtcaatgaaacacacaaagaaataatgataaagcacggattttgctacttgaaatggacccgtcgatgctccgattgtgacatttgctgggcccgggccttggacgagcggagtttgttggcacattgtcgtcaaattgagtggaatttggtcaattttctggcatacattcaaaaccacaaatggacttgtccagtaactgaattaaaataactattttaattaatagagatcgtttttaataccaaaagttgttaaataaaatgaaaaaaagtaattcatccatttttgcaaatcagccttttaccagggcatattgcttttcttgtgtctcatattttggcaagacgagatatttattttgtaaattctttcttaaagtaaattacaattattattattgtgaatgaaattttaattgccctcgtttttttaagtattgttgcaattaatttgggattaaaaaaactcaaatgatgaaaaatgcgccttttaatagtaaaataaaagtgatcaatgttatattagtttatttgattccgttatttccaatttttacctgaacattaaggaaccattgcttggtagtgaaggcacaacatcactaattagacaagcgtgaagtgactgattaacactgttgcttgacgcgatggcataacttccgtctattaaaaatattggagattcgaattttaaaaagtgattcttgacttgcatttggcattattccccgtccgcttattgttggatcatcggaaattatccgtcctttttatgaaaaaccttggaccttcaaacatttttaatggttttaccaaaacatgaaaaaaaaaattttatttaaattaatgctttttccgtgattttcatagcaaatggtcgtttaaaaagaaggtttaatatattttcatggaaaattcgtcgaaactttttgttttcgttggacaccaataaaaaaatgaaaaaaaaattctgatttttgagatagcgaaatcccaacttggcatcactccagtgcccgtcgtggtcatcatctgatcactgcttatgtttgccgaagtgcgaaaccacatcagctgggcagcgggcgtttggcaattgtgccatgcgcaagtgtcgtcgaactccacgcagttcaaatttggcatttgttggcaaaagactaaaagaatatttataaatatttatagaaaaataataaaacaatgttaatgtgtttttaaatgattattgaggtaccttctttaccatagtcgaacacacaaaattgtgaaacaattttaaataaaaataaagaataaaatttcatttttaaataaatttaaccctcagtaggattctataaaaataataataatatcaacactcgcatttgattagtgttggatttactcaatttaatgatgtgcgcaataaaaggattatttatagaaaaaaagaatttattaaaaagaccaaaaacttaccttagtattataacaaaaaatatattgaatgtacactaaatggtgattaatatggctgtctaattatttg

SEQ ID NO: 7854 - DNA, 3048 bp, Heterodera glycines
ttctctctctcgctctctctctctctaactttctctctctctctctctctttctctaactttctctctctcgctctctctctctctctttctctctctcttctctctctctctctctctttctctctctctcttctctctctcgctctcctctctgtctctctctctcacgctctctctctttctctaacgttctctctctcgctctctctctctctcccccgccctctctctctctctctccgctccctccccctctcgtgccctctctttttcccctttctttttttctctctcttcccctcccctccctcacatcttgtccagcatgaagcctagctagatccaggtccaggttgagtgttaattaacacacgatcatcccccgctttccaattggattatccttggaaaaacaaaatgccatcattttttcttgccaatgccctcggtcactctctgcctctgaattttgaaccaaattttccgccgctcgaatcattttcaaattcagttttttccgcctgaactcaaaatttgcgcgtccgtcgagacgaacaaaggcgcggcggcgctcgcgcgcgacacgcggcgcaccatctttctgaacgcgagcgtgcagctgtggctgcgtccggtgggctctggccagcggtgcactgtggagtatacggtgggcaccacttaagacgggttactgtaaaaagtggcattttatgctccacgaattttggaaactaagctcttttatgcaatgccttttgccccccccccagggctatcagggcgagtatcggttcgcgcccgacttgggctattaccagccgtgccaacggagcatcgctttgctcatcgagcggctggtcgaagcggacgagcggggcggcgaccggtaaaagccgaacggacaattggaaaaaaattccgcctgagtttttaaataagcacttttcaagaatggcgttgaatttaatggatgggttcaacatttaatttgaatgccgtaaattaaaaataattggtaggctaatctatcgcccccggggcacgtgctgtgctgccccccccccccccgttggacatgggcctgatttggactaatttgggttcaataatctatttaattttatacagcggcaacagcagcaatgatcaaatgaagcggggatggcaccgccaaaatcagtggtggccaatcaatcaacaaagtgatgcaaattcggcaaccgccggcaacccaaactgtccgatcagagccttacccggcacaattcgggtgatgcccaaaagactgctaattaatttgaatgaatgctataattagtggtaatgttggtccgctgttaagtcgctgaacgcgtgccaactccaagccggtcattggtacgaattggcatttcgcagtgccattcattttgagcagcttttgccgactcgacgcctttaccagcagcattgggccaaccacagcagcaccttcgtgttcaaggtgaacacaccatgaaataatgatggcattggcactttgcctttttggcacctattgaatgtgaaatgatattcaactaaaaccctttttaattgtttcgtagccggagcgtgaagtgtggcgcaatgggaggtgggaaaatggcaaacaaagtgttcaaacaactatattttaataatttaaataaattaatttaatactaagatactgtatttaattgaaaataaaataaaatccaatttattcttttaaacaattaatttaatttttgaaatagtaaaattaaaaatgtttaaatttttaaaattattctattcttagttttaagggcaataaataaatttataataatattaaatatttcattttttaataaatgacccaataaatcttgaaattaaatttattgaattatttttcttttttccctttttccagtgaactctcttggcttcaacgactcctccaattgcgtgtgaagttaaaaaaacaaggcttaatctcttttacaaaaccaccatttttaaaggatgaaaaactgtgaagctgttcgttatctgatcagattggacgagcaatggtccgccgttgcgttgcccgtcactgtgttcatcgactaccaagtgaatgaataatgaatgattgaatggttgtggaacgataaaaaaacagttttaaatgcatttggtgaaatgtttgaggacaagggccccgagggcaattaattgatgacggggaaaactgctggccaaaagacaacaacaatcataggtaggcattgttccaaagctccaaatatttttaagctgttactaaaatttttttgtggctggatagagaaagcatcctttgattcttaagaagcgcttcccctttttttgcataaagtgagaccaaatgccgtgaaaaatgccaaagtattattttctacttcattaaaaacttggcattttctctcactttgtaaaaagggaattcttgaggaccaaaggattatatctctctatccatccattaaatttacgtaccgaagaaactccacggcggcccaagacacttttccttttttgagcagagcaatggcaactcgtacaaatggcaactcgtattttacaaataatgcctaacaaataaggtgcgtgagaatgcgtatgtgaaacacgcgcggcacttgggcaacggcactctgttggacggatggttcaccggcactttccccgtctggcggacgcccgacctccggacgcacgaactttgtgtgcgggtgcgtaccgctgcgtgactccggaggcagcaaaaaaaactgtggaaaccgcggaattccaacctagcaaagcgacggaacccggcccggttccaccccttcttcggcattttgccgactcccggacaatccgtcagcaaaatttatttgtaaacatcagattttatccaaatcatatgaaaattaatttaaatcgctaaaaaatgaattaatgttttgtgttaatttatttaaaaaattatgaaagaaaataatttttaaaagaattaaatgattatttctatagatgatccatt

SEQ ID NO: 7855 - DNA, 2867 bp, Heterodera glycines
aattgtccactcactgacagattgtccaatgacggattgtccggacctcatgccggctctgctcccaaattcccgcccccttttttcccccggatgaatctaaattggcataatccacctcccgtgtcaaccctgtctaaaccccgtccccccccccccccgaaaaaaacagttcgcctggccccgctcattgaatcggcaccgaatttgccgcgtgtttatgcacgggcgctcctcgctcgactgcgacccgttgtcctactataatctgtacactacggtagtcgctgggtctgccgaagacgtcattcgcgtgaagaaccgccacccttttttacttacgatttacggcattttgccaaatgttcttttcccatttctttcaaacaaaatttttattttccccaaaatttaatcaccgataaatgtttattacttcgactttttggcgatttttcccctttttaccgtcataacgtaatctgctgcagatctatttccgcagataaacggcagattgtcaaaacggacgagacgcttcgtaatgaagaaacattcaatgaaagaagtaaataaatagaacattgtacagcaaaatcaacaatttacaatacaatataataataaaagaaaataactgatgagatcgtttctaatcatcagagccatcattcgcattcgacgacatttgccgttcattcacatttttcttagctgccgacaatttgtccaaattcactcggccaaataacattttgttgtagaggtgaatgatgcgggcctttgctctgcgcggaaacattaagccaagcacaaaaaacagcacaaatcgctgcacaacgaaaccgaggaacacctgcaaatggggagagaaagtgccattctccgcgactgatcaaaatgccattctccgactgacctgtagcagaaacatcagaaccagtgggcccatcagataccacgcgttgaatgtccaattgggtgcgttcggttgggtcagacagtgcaaattgtccaagtctgtgtcgaggtccttggaatagttgaactgcaacacgttgcgaaggagttcagcaactgcgccagagccatttacaacctgcggaggatggaattagagcaaaaatgcaaatcccaagacaaaaccactgacaatgttcagactgttgccgcccttctgaccgcggagaatcttcccatgggtgaccacaatttggaggaggcgaaagtaaaagtggtcgaccaccatcacaatgacaacgataaataccaaaacggacaaacggacgaaggaactgatcattttctttgtctcttccttgcgtggcaaactgaaaaaaagtgtaataaaacaaaagatggagacgaagcggacaaatgatcattcgtatttcgtacccgtaagggctgatcactttgttgtgctttttctcgggttttcgcaatgtgcccagcgaaacttttcccatttcatttctttttgcgtcgatgcgccttaaatttaaaaatgcattggaatgaacggaggagggagggaccaaaagtaaggcgttgtgaaggaattgcgaaattcgatgtcgttcaaatagctgagagtcgttttcacacagtttttgaagatgaaataggtgaacagcaccacaacaaaatccaacacaaggttgaacgtgcccaaaaagaccttaaaaagacaaaaggattagcattacggctgttcacatataaattcaatggattgttcagacccgtaaccataggggggggggcagttgcccacaaaatgaatattcaattttcttggttaatttgaccaaaaatttctaaattcggcgcccaatgctacccagctggatcccaatttccccagttttttcaaaattagctttttcccatagaatttgcctgcagaatcttcacgtcgtgctccagctcactgtgcagttgactcgtcgaatatccctgctcaatttcgggctgttccaccgcttggaaatgcaactgaaaaatgtaacggcgcaaaacaattaaaaacaacagcgaaaagcgccgtacgttcagttgcagttggcgttcgatctgtttgctcacattctgaaggccgtacatttgtccgtccaattcaggcgtgaagagcatttcgtgttcttctttgcccgagtcagtgctttttccgagttcacaaaatttgacagacatttcgccgacttttttggccttaaaatggtgggaagacggcgcatggcgtcgcacggacaaaaaaggaaaagcacttggcataagctgagagcactaatgcgtgaacaagcgaaggaatcgagtggccatgggatggcatcgtaacagagactctttttgaaacagacaaacaaaaattagcagcgaaacttcatgctcggcgggactaacacctgcgattgttgcagccgtttgtggcacgactccaccgaactggcgtaaatgtatttgcaacggcgttcaaaacggcgcgcaatggagcggccgagttgcgacttgagccgtttccaggccggcttcgccgcgcggtcaacagtcccgacggaagggtcttccccctcagtagacagttgacggtcggcaagtttcttgaaaaaattctttagtaacattgccacacaaaaaggacactcctcgcccgtgagccctcacaatcaaaagcaatcacttgggccgtgtcaatgattgctgccaaatgcgaatcctcttcgctgtcctcctccacgtcgtcgtcaaagggttggagcaacgacttcagcatgtggaccactttacttccaattgatgtaacctttcctaattgtcggggaaaaaaacaaacaattgtcaacagcgatcaaaaaaagtataag

SEQ ID NO: 7856 - DNA, 6972 bp, Heterodera glycines
ctcccccccccccccgcggactgtcgggcaaaggatgcattagcacttattccctccacccccgtcaaaagctcaagcggaaggggggactaaagataaagctatgaagaatgggtggattgtgtcaatcttcattctcagcctgtcccgccccctttagctcttaaaaatggccgaacaaaagacgacaattaattcttaattaactaattagtaaaagcattgacaatcagaaaatcctttttttgtccaatgaatgacaaatggccaaagtctaatcggccgaaagaaaagtgttgcgagcaattgaaaagaatttagaaaagaaaagaattgaaataaaacgaattttttaagaaagttaaaaataaataaaaatttaaattctaatgagcgattttttaatttaataaaataaaattatgcatagcataaaatgtttaacagtttttaacgacaatcacaacaatttcagaaacgctttgtccttctaaaaaggcttccttttcccatttaaaatggtcgcaacgcgttctttttcatattcattctggcattaatgtttgccatgccttccattagtcggcttgagaaccctccagttgcaaatccgtggctcggcacttttttgtccaagtttacagttcgtccaatccctgtcgcgttccgtgttaggccgaccggttggcccacgcgtgagctgtaaacggcacttttgccgtatctgtttgctttggtcatgtcgtgagcagatgccgatgatggagaagatgatgccaatcgatggctagcaaaagtgccagctaaataaaaccctttttgctttttcaattaaacttttccaaacaccttttgccaattgtggttctttctccattttctcatcattcgtcgatgacttttgcaatctcgacttcccaatcttcccaatagtgtcttttctgctcggtgattttaccttttttgggttgttccgctccaaccactcttttgccacattcgttgacggcccaacaagttgggagtatttatcagcagcaatcggttttgccgatttgttgccaaaattttggtcttttaaggggttccgctccgacatttcattttcccgatgattatggacaaatttggatgggtttaaaatgacgggtccatttgaggggttatcgcccaaggcatcggcggagcagaacaaaaaggcaaaatagagaatgaaaaaatattcagcattaaaaagcatttcaatttctttctgttatataaaaaaatattttttaagatcaatgaaaatgcacttttccagcaaaattattccatgtaaatgattttacatcataaaaaactttgattgtcactaatggcatggcatgggctgactaatctgacgagggaggcgagggggagtgggcacttttcccgcaaaagttattgagattgagtgaaatgcgttcacttttatacaaaatttttcgcattttctcgtgcgaaaatatttattatgttgtcgtgtgatttctcctttttctttagggcccttttattttttagctcttatttccgttaaaaatattatgttttttagcattgagacaccactaacattataataataataattattattattattattgttttttattttgttttttgaagtcacatgccacgtgccaactaacgaatgacgtgagttgggaaggtgttttttcatttaataataattataataaaaaagaattaaattaatgtaatgcgttttgtagagaaattaagcaaattatgacaaatcggtgatgctaattgtaagttttttttcgtaaatccgctattatggttaacagtgcgtatgtgaccttctttttcattgatcagttttgcttaacattttgactttttattttaaatgctttcattaattaatttattcggtggtgtccaaatcctgcttaatatgatgcgttttgctcactcattgttcacagatgggactttctttttgcatttcgttggcggactgtttgctgtcggtgaccaagaatggctgattagtaaacaggttgacaccaacggggctgattgatcctgccgattgctctgatcatccgtctcccccccccccgcctaatcggccgatggattgcgccttttccatttgaccgtcgtcggcagcagcgaaaaggatcaaatccacgcccgtcgaatgtttgtggacagttttttatgatttatgcctctgataaagcggagcgggggaggcgaacggcggaccgatgattaatgggcgatcagaagcagagaagcggccgaaaaagcaatatttataaggcaaatcacgacaaaaacattcacacttcagcagctgatcagcgaatgagtggtaatgcgattatcatgatgctcttaataattgtggcttaattagatcattacacacactaatgaacaataaattattagggaatgggttgcccctggggatatcatgcgaataacacagcaaaatgttgcctttcttactgatttaattatacatttgtatgagattgaaaccttatttaaacatgctgaaatcggatggacattaaaagaaattcgaaattcataataattgttatttataataaaaataattttaaaatgcaatatacaaaaatatttttatgctttaaagcttccagcaaattaaaagtataaaatattaatctctcataaattaaggaaaatgagaatttctcacattaatttattattatttaccaacataatttttctttcaaacctttatttttcagcagcacaatgtaagccttttttttaatttcaatgattaataagaccaattatttgcctaattacccatttaccattgctaatgttgcttaatttggtgttgttcagcttcttcccccgccctttccgcctccctttcgcgcattggtctctacgaaatcccgccgttggggccgctgctgcgcacgcgcgacaatgcgacgaccgacgcgcggaaaagcgaacgctgtgacaatttttacgcgagtgtttgtgcgccggtccacgaaatgccattgcgacaacacttcaaaagttacgcgggccgagcggacaatgcgatcagtgtttatgacgtggcaaaccgacacattgacaacgaactgttcagtaagtaaatctaatcaaaaaaaaataaaaaataaaatggatttaaattttgaaaagtggaaatttaaatttagcatttttggagacgtacgaacacagcaaagggtcggattttcacagaagtcaaatcgcacgcaaaatgctaatgttccacaacaaatgcattgacgaaagaacgcgggcaaaacaggccggactgtccattgaaatgcttatcaaacggctcaaaacaatgcgcagcgatggatttgtaagttgaacaaaacattaataagattaattaaaaattatttttaattttctatttctataaagcattcattaatgattattcaaccgttcagtcgacgaccgacatgatgatcgaaatgtttccacaaattccatttctgttcctccaaaaatggatagacaagcacatcgccgttcaaatcaactttggccttttctacaatgtgtggccattgccaaattgggacgaagatgtcagagcccttctgaaggatttgctcaaggtggcatttgattttgccttttgaatactcagttaattagtgattaattaattaggcagtggtcgatgatgccaaagaacacattggggatgagaatgcagagccaatgccggaatggttcagtgccctggggacggacgagcagcaaatgaagcagcgcattgatacgctaattgagatggaaaggcaaatgcacgaagatgaccgtaagcaaagcgagaagcttaatttggggatttgaatttaattctaatggtaaaattgatatttattatgcaaaagtgccacttttcagaaagcattgaggagaacaacattgacaccattgagctgagtttgggcgaactccgttcggactttcccaacggattcgccgtcgattggcaaaaactgttcaatgccattgtgcccgatcgcaacttcaccgcctcctccaccgttctgttggtagcgcaaaaaatgaacggacgcactgagaggcaaacgccactcgacgtaatggcggaatatatgcgcaattttgggcccaaaaacgacaccctcaacaagtgggagcagtatgtagagtggctgctgatactgcaacatgccacactatcggacaacaaaatgtacacatgggggaagaccgattggaattatttttgtggttatttactttcagatttcatcgtattttccgccggcacccgcggtcagccaatgccatgatgagtgctttgctcgtcaacaaatactttttcgagaggcacgacgacgagcagtatatccgggatggcacatcggaggaacgccgcgtggcacaaatccggcacaattgcctggaacagctgaagcatttcttcccagaatatgttgaccgaatgtttgcacttggtatgtaaaaatttagaatttaaaaataaataatacttaaaaataattcgaattggaaaatttaaatgtcttttaaagggttaaacgacgccattgaggaggaggccaaaacggtgctggacaatgtgaagatggcatttgccgaagtgttggatcaaacggaatggttgagaaatgagacggacaaagcgaaggccaaggagaaattggccaaaatgagcaatttcatcggaaaggcgccggccatcggaaatcccaaagacccggaggacccggatttggcacggatcgacgaacgctacgcgccgtactatcagtttgatgtagcagtgaatttattaattgcattgtaaaccaacaaaattggcaggattcgattccctacgtggaaattgtgcgttctctgatgcgccagtggcgaatcgtcgacttggccaacccggcccaattctatgggatgggcgtccacgaagtgaacggctacaacatttaccattggaactcaatgcaagtcaccgggggaatgctgcgtcctccgttcatcgcgtccaatcagtcgttagcacaaaattttggtgctcacaaatatatacttttattttaattaacaactaattgccaaaggttctgttggattcatcattggccatgagctgggccacagtttcgactcgtacggctatgaatacaatgcggacggagtgaaggacgaaaagtggtggagcaaagcgtcgaagaattcatttgtgaagcgaaagaaatgttttgtggaccaatactcggcatataaggtgagtaaattggtggcaattgattattaaggctttatctttttggttaattattgttaattgtcctcctctcccccaatttccaattccattcatcctcccctcctccgtttttgccgtagatgacttttgagggcaatggcctttctgtgaacggcacgcacacagtgttcgaaaatatcgcggacaatgttggcatccgtgcctctttcgccgctttgaaggcacggctggccaaactgagcacaaacaaacggaggcgggaggagaaaaaggcgcaagagcaaatgcaaattgaggaagagaaactgagcaatgaacaactgttcttcctcagttacgcttatgtgagttacaaaagcaattcttttaaatacttaaattttatttgaattttgcttttattttaattgacttttaatttttagttttgttttaaattacattttaaatttagtcctggtgcggacgaacaacgcgcgaacgaatggccaaatatgtgaagcgcgacccgcacgcgccgcgcgaagtgcgcgtcaatttggcactcgccaactttcccgaattcgccagtgcatttggctgcgcctccggcactccgatgaatccggaaaagcggtgcactctttggggaaagcaatcggcggaaagtggtgccgaacagaaaaagaaaaagcgaagccgaagccgaagctaagcaaaagcaaaaacaaacaattagttggtttggaattggcaatggatggaatttattttaaaatatacttaaaaaggcattaattaattcattccatttcaaatgcaaatttcgtttaattaattgtgtataaaattttataaattgggtttaaatgagagagaaagagaaaaaacatttagttgctaaagcgataattaacatagattagcaattgacacggtgaggtttgcttcaactaatttaacaaaagttttaaccaattctgtcggcttttccttttccatttttactctttgccctttctcatttttgtcttttcctccgtttttcgttacgattggccattgtccgtcgcggttgttccgtccgtattcgctgcggttgttccgtccgtattcgctgcggttgttccgtccgtattcgctgcggttgttccgtccgtattcgttgcggttgttccgtccgtacttctgctgctttccgtcccctccgttggcgttggggtcgtctccgtttcgttgtttacgatgaactggtccgccaatgctgcactgttggtagacgacggagaagcggtgctaccggtcggtccgcgtcgccgaccaccgcgacggaaaccgccgcgacgcggtggtgggcccatgaaagggtagcggaaaccgccgtaacgcgatggtggctccatgaaagggtaagagccaaaatcgcagcaaggacttcgcttggcccggtaggatccgttgccggcgggcgggggagaagccgtgccattgtcgctgacactcatttggccgaattgagcctgctgttgttgcgctgaattgacattcccattttgctgctggacggacccacgggagcccagcgaaggatggccaaatgtttagcgactaaaatgtgacagggaaaagcaaaccaaaacgaatttgat

SEQ ID NO: 7857 - DNA, 4676 bp, Heterodera glycines
  misc_feature (37)..(37): n is a, c, g, or t
tgtttttattaccgtcaaaaaatgccggatagacttntttgccgtgccgtcaaaatatttatgtacgtggcacattgtgtgctgctattgacggaaggaaatttatttggaaaaagatgaatatttaaaggaaatttattttctttccaaattaaattaaataaatcaaacaaagcaaaaattggcactctctcaatggcatttctcctgttgtcacttgcacccctcttcgttgcccttagcgggattgatgcaaatagtaaaattatttttttaaattattttattaaatttattattatttattttattaaaaaaatcttttagaagtgccactgcaattgtgctgtgctggtggccaaagcttggctggccttatctacgactattctgaccatttcagcgaagttttgcaacagtcggaaactgagatgtgcactagcctgaaaaaggttgttaattgtagttaaatcagggctcagatctgtcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttatttttttaataaaaatctgttaacaaatcgattaaaaatcgcaaaaaattttccggcggcgcctatcggcaccgccggaccccctgtccatcctccaaaattttttgaaaaaatgcgacgcaaaaaaagcgtttttaaagcaaaaaagtcgtcgcttgacttttaatttatgcaaaattggccttttttggtgaaaatctgttaacaaatcagaattaaattacaaaaaatttttccgggggcgcctatcggcaccgccggaccccctcccctctcacttcccaaaagttttttggaaaaatgcgccgcaaaaaattgttaaaaatctgatttttttttatcccgaatgcactaaaattttatgattttttgaaattttatggcagaatgtcactattttatcaagaaaatataaattaaataaataaatttatgcaaaaataaaataacaaaaaatttttcccaaaaattgttaaaatcgttaatgggagacaaaaatatactatttgatacatttttgatcgaataaattgtaaaaataactgatttgaagcaattttgcgaaatgttcttatttttgaccctaaaatcttattttttggccttgatgttcttattttgaaaaattttcgatacgagccctgtttattaacagaactctgaatacatatcaatgtcatttcaaactaaatcctactcagcaacaatacaactgacagatgaacaaagggagcgggttaagcaaaacagggaaagggcgctgagaatacaggcggaaaaggccgagcagagaattaaacagggtccaactgcagcagcaagtcaacttcttccccacatggatggaatggccatttccaacaacaaaccaccaccgctaattggagaagttggcactttcctatttttactgaattttattatgtctctttaaagagacttgtgtgccctcgtcccattcaaattcaaccccctattacaacaaaaaattccaattcgccccgaccttcgacgagttctgtgcagaaagtacttgttcaaatggacttttctctaattaacgcgaatcgctttaaggtgatttcactattcctgtccacaaaataccattttaataatttaggtgcaatttactccttttaatagagatgtggtggacaaactcaagtcaattccttcacggcctttcaatgcagacgacaaaacatggtctttccttatcgatgattatgaatcgaccaaaaaggcattgaacggactgaatcgcacagtaaatttgaaactcgccgaaattccatttgacgtgagaagggtcagtcaagtctatgtgttttgtacttttaaaaccgtaattaaaaacattttagttgtttttgactaaaagtaatgccaaacccaaagtgaatttggccaaaattggacaacatctgctagattcgctattttcttttcagcgctgtggagtaaggtccttttccacattatctattttgataattttcaatttctgcaaattttaagcgttggcattgaaagagatggacggattttgatagcggacgaaatgggccttggcaaatccatacaggctttggccatcgccaattactaccgtaacgagtggcctctgcttattgtctgtccctcctccgtgaagtacgcctggatggggcagttcaaacgatttatgcccaatgcaaatgtttacatcatcgaaaaacaaagcgaccctttgcctatctcacgcaacacttccgtcgcaattgtaaattttacgaaattttactagtttttccacttttcttcaggtacttagctatgacctcatggtttccaaggccaaacaattgaaaagcaattccatttatgttgttgtttttgtgagtttagctaagttattatttaattggaaaggaaacaaaattaggatgaatgtcatttgctgaaggagcagacaacgcagcggacaaaagtcgcatttgaactttcggtaattaccaattccttataaatttagtcattaatttacagaaaattgccaatcgcgtcattcttctcagcggcacacccgcgctgtcaagacccagtgaattgttcacgcaagtccgaatgattgacccgaaaatatttcctagttgggtgaaatatgccgtgcgttactgcggaggaaaaaagggacgttttgggtttgaggcgaaaggaaggtgtgcactttgtatgtcatattttgcatttggaagaaataatttcgaaattaaaggtctaaccccgacgaattaaaaactgtgatggataaaattatgataaggtaaaccattttcttttcacttttaataaaaattcattttttgctaggcgtttgaaaaaggatgtgctggacgatttgcccgagaagagacgtgaagttgtgtacctttctggcgatgccattgatgccaaaattcgggagttaaaaaaagctcgggatgcgtgtgaacaagcgaacagatattcagtgaattgctgaagcagttcggaaaaaattggccaaattttcattttaggatgcgaaaacaaagaaagagacttttgcggagtattatgttcaggttgcgcctttcttcccccttcttttttcctctgtattttttagacgggccttgtaaaaatgcgcgcggttgccgaacacgtggtggacacgtacttccatgaaggagctgccgacagaaaggttttagtgtttgcgcatcacttggccgttttggacacattgggcgttgcgatggcgagagcggtgagaacaaatcgccctacatttgtttaaccattcaattttccaaaatgcttttgtggggtcaatggtaggtaatacaaaaaatcaattaaaaccgaattaaaaaaacacctaggtctaaaaattaaaaaataccgaattgctgaacttgcccatgacaccgttttcttgcccccgtttcccagggtgttcaatacattcggatagacggtgccacgcctgcgcatgatcgggcgctctattgcgaacaattccaaagtgaccgccgaacaaaggcggctttgctgtcaatcactgcggctggcacgggcatcactctgacggcggcatccgtcgttgtcttcgccgagctctactggaacccttccgttgcttctctatttggaaactaaaccatacaaatttccattaagttaatgatccaagcggaagaccgagctcatcgagtcgggcagaaggattctgtgcatgttcaatatttgctggcgcgtaagacggctgacatggatatttggtcattggttggctcaaaattgaaagtgctcggtgaagtgaatctctctaacgaaacgtatgttattgtttttattcgcttttttggttattctgaatatgtttaagctatcgcggcattgagaactcagagaaatattgtggggcgagctcgcttatcacggatttctttaacgtgatgaattgtggcgatgacaatggagaaccggtgacaaaacgcataaaaccgatggattttggagtgcaaagaatgcaataggacatctgtgagccattgtatagaaagagtcttggaacttttaattgtttcccaattgtaattcctttctttatttatttgctttaaaaatacaatatgacaaaataaaaactgttcgtgcctgccggtcagattcattggtgggttttcttgcttgtcgctattatggcgtacagcttccgttttgcgtcactgccatccgggaatgaattgaggtcgtaatacgtcggagccatttgtatgagcctgaaaacccaagattttaattcgaaattaaggcctgggtttgaataacgaatgatttcagttttttaggggtttaaaaatcacttcccgtcattccacattattacaaaataatattatcacataaaaatattaccattctgggcgcacatccgtcactgtccgaatgtaatttttgctggtcacacaaattcg

SEQ ID NO: 7858 - DNA, 1528 bp, Heterodera glycines
  misc_feature (80)..(80): n is a, c, g, or t
gactgttcgaactgcggcctcccaatagtctctttccggctcgggtgtatactaaatagatcatgaatttcaaaaaattntggatttcacttacgaatatttcaactggaaaagtacggccagggaccgaaagtaacggacagctgtcgaagtaattctgaaatttccccgcatctaaagtggcactcatcacgacaattttgagatcctgacgctgtcggattatttcctaaacgtgggaaattttttcgcaaaatttggaactaggtaaccttgatcagccccatcaaaatgtcggtggctaaagtgcgttcgtgagcttcatccaagaggaccacgttgtactgctccagaagtgggttgttcatagcctcgcgcaaaagcattccatcagtgcagtatttgagaactgtccgatcgctgacacagtcttcgaaccgaattgaatagccaacttcctggcccaactaaaaaacaattgtgaaaattaaagctgctgcacaccaatgcacgaaaagggaccaaccgaaacatcgagttcttcggcaacccttaaatgttggaagttaaactaagtgtcacaacgacatcatttttcttacctcgtggctacactcatcgccgccactcgcctcggctgagtgcaggacaccatgtacttccgattggccaaagcgcctttctcccgcgcaaagtccatgcaccactgcggaatttgtgttgttttgccactgccagtctcaccaacgagcgtaatgcactggttcttgttcaacaattccatgaacttctccctgtagtcccagacgggcaaccccatcctcttcttcaacaagtcccaaaaccgttgcgtatacggccgtccagttaatggattgcgcttcgactaaatatatactttcaaaacataaaaaaaagattcaaaccaagtcaatttgcgtttcttctcttttgaaagtttgtatttttgcaacagtcgcctcagaattgtcatcgagatgtctttttcgattattagccgtttcaatttgaatgtcttgtttattaatcaccggggcatcaaatttttgttttttaactgccgggactttaaattcgtcagagacttttctttgttccgcagttttagtttccatttggaaggctatctgttgtaaggattgaaaattagattatctatgtatgacaaactgcctagaaaacaagtgacataaaccagggttctcattgtcagatgaaatttgacaagttttctaacaaatgtttaaaaaaatcaacgtgtaattgatgggcttgcgggccgatatgggcagctgggaaattttgaaaattcaagtgaattttaataataaaattgtccaaaatgtcgaaatttcactgatttttgagtcaaattgaagaaataagatagtgactataggcgccgccggatatctaatttaatttttatggttaattttgtaccaaaatggattttcgaggaatttctctaaaaccaaagccttaaagcctcatttgaaaattagct

SEQ ID NO: 7859 - DNA, 4022 bp, Heterodera glycines
  misc_feature (337)..(337): n is a, c, g, or t
  misc_feature (387)..(388): n is a, c, g, or t
  misc_feature (393)..(393): n is a, c, g, or t
  misc_feature (483)..(483): n is a, c, g, or t
  misc_feature (3938)..(3938): n is a, c, g, or t
ccccccccccccccccccccccccccccccctccccccaaaaaaaaaaaaaaaaaaaaaaaaaaaaaaaaaaaaaaaaaaaaaaaaaaaaaaaaaaaaaaaaaaaaaaaaaaatatattttatgtgtaagtgggtgttttttttcgtttggtattttcccccccccatcccccatggccagccgtagcctttttgggggtttttgttatttcaaaatttactttttttaatttatcaaaggctggggatattgctaacctctgattaattaataacaataaataaaaatttcaagtaatgtcacttttgaattagcataatagaaaaagtaccgatngggttaaaatgctcgatgtcagcttctcgggtcccggacatcatttccannttcanccagtcaaaaaatgtcgttcattattccatctgatataaataaatagcatttgccgcgcctgcagaaaaaaaggtgtgctctgcacatcncattccaataataatatgctaattaatgataattattgttttgctcagtttattatcgttgagccaatctccgacataaaacacctttggaatttaatcaattaaaaatgctattaaaaaaattgggtaaaactttaattggcgtagccagtggtggtgatcagatatcgaaaacttaccgagactcgagaacggaatttaatcttgcgattaaaaaaaattaaatttttgtaattataaagcaatttatgtagaaatttttgtttatttcaagaagcaaacactaaaattagagtccttgggatttatgtgccatgctctttggactctgcccatcgcttacgtccaaagcggacccgattatcgaccttattgacacagttcttgattaaattcgacgcatacagatataaaaagcggtacatccgttgtgactcatttcaaaaatctaaaaacgatttttacacgcaaaacaacaacaataaaaagcaaagaaagaaagtaaaagggttgtttaaaataagaaatggaaaatatcgacgaattctgctgttcacatgaaaaatgcagtcttctttctgctacacagtaggactgacttgttactcctattgtacggtgcgagttccttgctttttccgctgctgttcaccctgtacaatcacttttgccttaccgttttgtgttacggtactttttgccatggaaatctgttttttgttcacttgaatgttcgaattccctctttgttgtatggtatgattgtcgtttgtcgattctaccgtattcagcgggctgacatcgcttttgttaaagtcaattttaaatgaactgtaattgttccacatttcatcgttaattcggtagattttctgtaaaattttttattgttgttaataatttttatattttaatttaaaaaatatgttaccacaaaattttttgtctcattttcgttgtcagtgttgtcaatttgcttaattttttaatcagttttgattataaattttaaatgatacaatgatattatttattacagaattgattttgatttgtatgccgtcacgacgttcgctgattttaatctctttggttatagggaccgtaatatttacagtaccaccggtcagcgtctttttgtagacaacaaaatcttgctggaggataaagttttggctgctaacgccggatgcctttgagatgcgtaaagtgaattcaaatggttgcttttccatgtgtgaaatgatctcaaactttttacagtattcctcctcaaagtcgtactctaatttgtcggttcgtttaaactgttcaatggtcattcgctcgagctttaactaaaaatgaaaattttcaaattaatgattttggatgaaaatagaggcattctgacaaaataaaaactcaacacggaaaattataaaaaaaaatcgcggcaattaaaagaattaaaatacacaaaaataatttttcggattttaatttttgaaaaatgatttacaatttaattttcctacatttcaaggttttaatatgcatagttaacactttcgttttcaaatataaagttatgccaagaaataagaaggggtcttaccagtttctcttctctttgatttaaaaaacctgtggcaaaaattttaacaatttcgatgaacaattcattgttggcacattgtgttaaattttcctcagcttttgcgggcattgaaattgtaaaattgaatttgttttgagcaactgtaccgagttgcgtttgttttccattcaattgtttatctgtgcctttatatttgtaatttaaaaatataataatttaaggacaactttaaggtacgcaacgcggaattccgactttcgactttttgaactcgaatacttatgtatatgttgtacgacaaagaagcaaaaaattaccgaaaatatataaattttaaataaacgatttataaagtttgctataaatcaaagtgtaaaaagccttactctcgaagaccgagtccgaaaccccgtgagaaagacagcaaaaaaaaaaaaactctagagggactcgagaccgagacgctcggaaagcgctagtatataaacaacttggcctgcctttttcaaattttcagcaattttctctgaattaaatcaaaaattttaaaattcaaatggggtatttcttcggaaaggggagggcgaataacagccaaatattcctgttacttacttttcaaaaaaaaattatttagggggtgcgacatttggcatcccttgttttcctggtaacgggactgattaattccatttttaccattttcgaggaattgcccttcgttcacattctgctctgaatttttcgttccacacagagtatgttcggcaattaacttctgttggtgaagtgaaaatggcacttcaacagctgctccactattactgttttgattacagcaaatttttatacggtaattgtagtcgttggatatgggaggcggataaatggacaaatttatttcccttttagcagcgcagacggtgactatgctaattgcaagcaaaaagccaaagagcaaaagctggcagaacatttctaaatgttgcgctttgaaattatttcgctttaattttaacttattttattttttaaaacgttaaaaatattataaaaaatttaaaaaagtaaaatgtaaattaaaaataatataaatataacgttattaaataatgaaaatttatttcccttcacattatatgcatatgcataaaaagatattcagcaataatgtaagtgtaaatcacatgaaatagggcaatacatatagatgaatgaatacgaatatgcgggcgagcatttttacaaatgaattttatgtgcattgattttgcatttttctcagaatatacaacataaatttattccgaatcatattacgattagggatgggatttatatatatttttaaaatacatattcttgctgagaaatgcacgaaaaagacctttgtagcgcgaaattcttaggtttaatctccaatatccattaaaaaatatttgactcttttttatttagtaaatattttggcatttttcataaatacaaatcctatccatagttatatattcataaaactattaatgtttctatattttatagttcgatttgtccgtaacccatgtccgccatcgtcgctgacgatacacaacccaaacatcgaccaaataaacaaccgagcagagaatgagcgcggcgaaaattgtgccgatgagcaacggatccgtcgacggcacgacatgccattggagaagcaatgtttcatcactgtccatatgtagaaaattccgatgggaaatatgtgcaagaattgtcacatttgcacaaagcattaatccagcagaaaggagcgcataagttaatgactccttaattgataggaagagatttatggctaaacaaatggaatctttanaacgaaatttgtcattagaccgggaattttgggctaaaccagaaccagaaaagccatgaattttcaaaaaaattttaaattttt

SEQ ID NO: 7860 - DNA, 2240 bp, Heterodera glycines
gtataaattgaaattgaaattgtcttttgttaacagatttcaccaaaattgtaacttttatgaattttgggtcaaattttgaaatttttaaggggacatttgtggtccagcgataatgatcacgataggcgctgtttttctcaccaaacagaaaaacaggagaaaagaaaagaaaataaaacttaaaaaattataaaaaaataatttagataattttgaatttattataatgaagaataaataactaccataataaaccattgtttttgagttgcccatcgattcaatgttctcagtttgatcacaacaaaagcacaagaaattgtcagagacgctgcagcaacagcaattgaaagcccaacttcgccgtaaaatccattgttgaaaagagaaaccaaaataataaaaaggcaaatgcactggcaaaacaaaaaaaataattattttgttttaaagttagatttgtaattaaattgaaaaaaaatatttcaatgaaatgaataaataattttatatattttcatagcgcctaggataaattttctttggattattttaatgaactatataattaagcaaataagtagatagcggatggacgagaaaatcaaaaaatatggcaaaaaataagtaagaataaagcacattctaaaagcataaaaccaagcaaaaacgctatttacttgatttttaggcccatctaaatgtacaaaaaatttgaaacccgtaaaacccgcgctctaacgataaaaaaaaatcaaaaaaggttaatcaaagctaacgtcctaagaaattgatgaggtcgaaggaatttcccaactaattttgaccaatcaagttaaattagaaccttttttaagtcagcaataactgtggaatatttttaactttgttggctgggtaaaaataaaaaaatttttaaattaaaatttaattcaacaaaatttcatacaatttccgcaattttggcaagccattgaccactttttaagaattcttcgtcataataagcagctgaacagcagaatagatttgtcctacactgcttgcattttatgcttttcctaatggaagtgttgaagtcgtgcacaaattggcgctcggagcccaaatacctacaaaaaaaaacgaaaaacaaaaattaaaaacattaaattaccattccgaatgaaactgaacagtgcttgaaatggtttcaagaacatcatcactttttgtcttctgcatattttactgagtgattatcattcgtaaataattggtaaaaacaatttttttcactgccatttaattgtctccattcgcgcgtacacaaagtattagagagaatttgcactgtcattagcccttttaatctttgcacatgagaaaaaaatagaaatttagctactaaaacatttaacccttaagatttttaattagttcgcttagattggtaaaattcacaagaaaaataataataatttcatgacccattgaaaacttatttaaaaaaaacaattaaaccagaaatgccgtcgaaatttttcttacaattacaagaagaacaccattgtttaaaaatgattttttgaggtgaaaattaaggataaagctttaactttttaaaaatccaatgttgatgctttatgacattgtcgtttaagtgtggggttcaagaatttacatgtaaaataaataaattaaaccaagtatgtccaaatgtttatgtgcgaagtaaaaaaaaattcaaaccaaatgttcaataaattatgtataaaattaacaagttgcaggaaaaataattgaaaattaacttagaccataaagaatactattcgaataattaaatcttagaatttttggattcttggacaagatttaaaaaattaaggcaatttggggtcatcagcggcaagctttgaaaatttctgctatttgttaaaaaagcggaacatataaatgtgaattatcttttattttttgaatggccgatgggaaatttttaaaaaaataatgcatttttgatttttttttgtttttaaaagtgacaaaattatatgtttgatcaaactagctgtaatgaatcgtaaatgctatagtgaaaactgccaaatcattaattttaaggcccgagaaccaaatgaattaataaaaaattttttggttttttatcatataagcaagtttttgtgtcttttaaaattttaatattactgggaagcaagaatttaatttatttttaaacatttttaatttaa

SEQ ID NO: 7861 - DNA, 3352 bp, Heterodera glycines
aattggtttgagatttattgcttgaagaaaattgctgtggtcaatgatgatttggtcaaaagaattcggaacacaatgccatttgtcgcttttagcggcatcattttgaatttttccgttttcgttatgacatatttttacattgagacggagaaacaccatttacaagttaatatatattatttaaatttatatttattaaaaaaataaaaataaatattttaataattaaattttaaattaatatttaaagactaaatttttattataaataataaaaaaatctaataaaaatatgtagaaatttaaaggaaataatcagaagtttgccaagtgattattttgtgttggtcggtgttgttggacgaattttggacacagccaattatgtgtacacatttaccagtgccctttgttgggtagacgttttgctacggtaaaccattaaaaaataaataaataattaaattactttaatttagttataaaaataccaaactttttgtaattggtggcaaatgtatggaagaaagtaaacaaaattacaaaattgaggaaacggcggagttttaaaaaattggatcatttcttgcacaatttttttgacaatttaatcatttttcttaacaaattctattatcgaaagagtcgctcgatatcgccggattcgcattttaattttgaaaatctgatgcaaaaattgaaaaaatttgaaaaagtcttcggattccgcactctcctaaatgttttttttctggttacgggcctgaagaaacttttcattcttaattttggtttcctgtatatttactagggttcggaccccgtgggcgggggtggcttttcgcgggggcgggggatggcgggggtcagagtcgcgggggcggggacgggggcacgaaaatttcgcccccgcggggacgggggcgagggtttggtttgaattactccaaaaaatctcacaaaaaaaattatttttatgcatgatgtttctcataattatttggcctcgttatcattattttcatcatctttttcatcttcatcaatatcattagatggtcccaaaaataatttgttcatgtttgctttgatgatcaacaagttttgagccatttcaccagaaagccttaaaattaaattttttattaaggcacaaaatgttaaaaccgatttctaagcgaatttgcgtaaaggagccccgctttcgagaagacacgttcactacaaacagaagtagccggtgttgtgagaaaaatccgtgccagccttgccaattctggaaattttggtgcgttgtcgcgccaccaacaaaaaacatcagcgtcaattgccggacgaacaatggccttgtaatgagccaattgtgattcaattttggaattgagatcagcattaatttctcccgaaagtgttgatggaattgacccggcacctggcgatttaggagtaacccaaatgtcatcttaaattcaataaaatcaaaaaaattgctaaaatttcgaacatcgaacactctcatcgctgcttccaccttcgtccaaagcactcaaatcgacgttatcatggtgaactaagccagaaaaggcggcattttgatcatccaactgctcatcatcgaccgacacatttttttggccctcaactgaattcaaaaaattaaaattaaaaataaatattcatggacttgatttggcaaaatttttcaattcttcctcaatatctggccataagtttttacgccaaatgttttcatcatacgcaaatcgtgggtcaagaatagttgcaatttgaagcgctgtgttatgtgccaaattagaaacacggcgatcgattgcatttgccaatgaattcgcaagaaattgaactgatgagttgaatggtgtcaaagcgagaaagtcacggattttttttaaagttgggataacagatgcagcgatggatgtttcagtagaaaactaagattgataaaacattgtaactaagtttgagatgaaaatcttctaacttttcgagtctccgcatcaaaaatgtccaaaatcgaacagacatgacgcaataaatcaaaatcgactgcatcaattctcggtaaatcattagaaattttttcgacttttgcccgcttaaccgttcgaatttctgaatgcattcgatcaaactcaagcgcaaggattgtttttttttgctggcgaaattgagaaagcattgcataggtagaattccacctggtgggaactgactaaaatttaaaaaatcacgccatgttcattttactgtttttaccatgatcagttttgttgttttttgaccctgttcattttgctttttccgaaataatgcagctccttttgttgtacggcactctttcacccattctctcactttctcgatcagatcagataatttcggttctttcaaaacatcacatattgtaagatgcaaaaaatggttaacacattgaaagctaaacaatatttttaaatattttaccaattatattttacctttcaatttctaatattcggcatgttttgatcatgttttttgcgtcatctctgaccatcataaccaatttttccattgaaaacccattattaatcaaacacttttcaatgtgatctgcgagattttcgccggtgtgagcatcatatattggcgcaacattgagaacaaaatcgcttcgcacaaaattttcatcgactgaatgaattgtcacactaaaaaatgataatataacattgattaggtttttatagtttttaattagtaataacctctgcaatgagggtgattttgtaggtagttgccaaccatcgcttgtgatgctgtaataaccagtaccaatcttgtctttgattttttgttgaagattttcagccattcttggaatcacaatttttcgaaaatgcgattcactgcgagtctgaataatatctcattctaaatagtggctgactgtcaaacctcaaaattagggtatgcacgttgcgttaatttaagaagaattgaattttcaaaaactgaaaaggcgcagttttgctggaccataaaattagtcaacatttcctcaacttccttttgctcgtcatgttttttaagcaaaaaggaatcaattgtcttaatttgtgaaataaacttaatagccttaaattataaccttattttttggcttttccggctcctgcaattgcaattcattgtattcctctaaatgcatcgacttcaaatggctccacattcctttggtcgatgcatctcctcgattcaaaaccatgtggcataaattgcattgtacattcatagattgtcagggggggaaaacaattccaaactttagaaacacaagagtcca

SEQ ID NO: 7862 - DNA, 2779 bp, Heterodera glycines
  misc_feature (17)..(17): n is a, c, g, or t
  misc_feature (48)..(48): n is a, c, g, or t
  misc_feature (75)..(75): n is a, c, g, or t
ataaatgtgatttttcnaataatttcttttttaaattttcattactancagtaaaaagataagcaagatcctctntaaaagggattaaaattacttttgataaaaatggcatgaaactaataaattctttcaaaaaatttccgtctattttttcaaatttcatgaaactgctgtgtaaaaggggactctaaaagttaattttttaaaataacttttattttttgtttattcttttattgtaaaaaactaataacttttaaggttaaatatgtttatgatttcatttattattatgaaattatttcaaaacttagttttatttaaatttcagctttttatactcactcgggaaattcctaaagatgggcttgacacggcacgtgctgccgaatcgcgtgccgaccatgtgttgctgctcggatcaaccattattttgacagttgaatgtgtttgtgaggtgtattgcttttttaaatttaattatttatgtaatttaaaaaaattgatttttctaaaataaaaaggaaattatattatttttagttggtcgaaatatcatatttttcaccaaagaagaaaatgcactttgtgaccaaacttctggacattttttacagtttatttacgcaggtaaataaaaaaaaaagaattaaaataaatttatttttaaaatttaagttggcaaattggtttgagatttattgcttgaagaaaattgctgcggtcaatgatgatttggtcaaaagaattcggaacacaatgccatttgtcgcttttagcggcatcattttgaatttttccgttttcgttatgacatatttttacattgagacggagaaacaccatttacaagttaatatatattatttaaatttatatttattaaaaaaataaaaataaaaattttaataattaaattttaaattaatatttaaagactaaatttttattataaataataaaaaaatctaataaaaatatgtagaaatttaaaggaaataatcagaagtttgccaagtgattattttgtgttggtcggtgttgttggacgaattttggacacagccaattatgtgtacacatttaccagtgccctttgttgggtagacgttttgctacggtaaaccattaaaaaataaataaataattaaattactttaatttagttataaaaataccaaactttttgtaattggtggcaaatgtatggaagaaagtaaacaaaattacaaaattgaggaaacggcggagttttaaaaaattggatcatttcttgcacaatttttttgacaatttaatcatttttcttaacaaattctattatcgaaagagtcgctcgatatcgccggattcgcattttaattttgaaaatctgatgcaaaaattgaaaaaatttgaaaaagtcttcggattccgcaccctcctaaatgttttttttctggttacgggcctgaagaaacttttcattcttaattttggtttcctgtatatttacctaataatttttaaaaaagacattaaatttatttgccaaatcttcttcaaatagaacagcatacaaggtcaatattttgagtgtttccataaactgtagttcgagcacattcacaagtaacaaactttcgtagcgattccttaagaaaaaatggggatgtacaagttttttttttaattttaactaaataatgtttgttctaaactgattaaaaatttattaccgcgaagcttttcacaaaaatattaattaaaatcttttaaatcattaattaaaaaatagctttttaaatatgtcaaatttttcaaataaacatttgaaatttatctaaatgaaattaaaatatacctgaacatttgtgttgcagcatgatctcattgcatgccgaattgaacaggttgtgcatggaaagcatttaaaaagcattgacaaatccatgggcccgactgaagtgtcaaatgctaacggagtcgaacaacaaaattggttttccttgaaatatttaatgaatttcttaaaaatattacaatggtatattaatttaaagcattttttcggttttagcttttttatggcaaaaaaaattggtctctttttttgatgttttcgtctcaaatttctgaattaaatatgatgtactcataaaaaactcaaaaaattggcaaaaaaatcaacaaaattcgatttataaaattttgcaatttcgcttgccttcattattttagtaaccagttgactcaaagcaacaaaaacgcaataaattaacaaaattatggccacagaaaaactaatttgttgggagaacggtgacagcaacgacttgaggaaattttcatttggtttcacattaaatatttccaaaattcccattctcgggctttaaaattaaaagaaaaataaagcaattttaatatacaagcaatcgaaatagcaaaggagatgcattcttatgtgtgtcaaaagcgttgtcatggaaatattgttgaatattaatggtggacaacaagaaaatataactagggttttaccattataacggtcgatctttttacattttaattaccgaaaatatacggatatttttgaaaaaaaatgaaaaaaagacaatattattaaagaagaaagagatccacacgtattaataacgaataagaaaatcgactacataaaatcattattaacataaaagaatatagggcgagggagaccctgaccattattaacataaaagaaaatcgaattttagtattttatatattttttatttattaaaattaagatgaa

SEQ ID NO: 7863 - DNA, 2034 bp, Heterodera glycines
  misc_feature (1982)..(1982): n is a, c, g, or t
tttttgaacaattttcgacattgaaagaatttttgaacggtgctaaaaacattgtattcaatccaaataaatatacggtgtgaaattcttactaatatttaaaaaatgaaatttagttaatgaatagtttttaaagtttgattagcgctaaaaattaaatttaaaaaaaaagagtgtgtacgaaactcgcatcatttcttgtcccaccttcggggacaagaatgtcggaaaggaaatcccgaccgaaaaattttagccattccgacatgaatctcaaaattttttgatcccgaaaccagattatgggccgaaaattttggccgtcctggtccaaatcctggctttttctcgtcccgtgacaaccatagcgggattgggccggggacatcggcagcttatctaattaaaaaaaaattagtttaaagaacttatttttagaaaataatgacccaacatgtaaatcctgatcagatttataaatgggtttccgagcatggcaattttggtggcaaaaatcctttgctggtgtctgaaatagtatcagtgatcgatctgttccgtacaatgccgcacttcaacatgttagagccaaaggatcaagtaatctttgatattaaaaaacgaattttaaaaaatatttttaatttatttttgttttaggcaattcttttgagttttgttgctattccactaatttatctgaatgcccgtttttactcatcaaaaatcaattcaccgattgtaaaaatcattccgaacagctcatttagcccattatacctttattacaaaaatccattctacgccggtgataaaacgtaaacaattttttgtatcgggaaaatattttattttaaaaatttttaattattttttatatttaagaaattttgtcagtttaattttctatggttctttttattaataaaaaaaacataattattagcatccaaacattgtccgaattaatgtatgtcaaaacgatggatctatttaacaaattgcaacttacggatgaggaatttcttttggttcgtgctttgatatcgtcacattcaggcaataaataaattatttaaaatatctaaataaattaaaaatattattgaaacaaattaaagaatattaattttttggaaataaaaatacaatattctcgatatttaaaatatgcataaaaaagcaaaaaaagagttgaaaagtatcaaaaactgtatgaaaatcaaaattggaatgaaaccttaaaagtctgaaaattttctattttaaagagcaatttcaaaaagatttaatgaatttacagattaaaaatatagttttaataattttaataataattatcaaattcaaaaagtttttatttcaacttttcagcagttaccggtctgtccgctgctggtcgtctcaccctgcagcatttgtccgaacattatgccaatctgttgatgcattatttgcgcaccaactacggcaacattgccggcgcacaccgttatgccgaattggtccatctggccgagtcggtgtttttcaacgcggagcggcaccgtgaattcttcacctatttggccatggtcactgaccagggccgtttccatgccgcaattccgcccatttttacgccgatgattttgcatgggacgttggatgaatgaaccaagcaaacgacatttattcgtttttgtggatggaaagattttaaaaattataaattatgaaaaaaaagcttttctggctttttaaatttttgattctgtttaatttaattttaaagaatgttatgcaaaacaattgtccgatcattgatcaattctcgatcctttatcattttaattacgaaaagatcattaggagtgatcaaaggagctttttgaaatagggtcgatcgaagtgtgttggttccgatttaatgcatttatttaccaaatcattgaaaaaaaggtcaattttagaaaatgtcaaaacatgaataaagccattanaatttataaagaagtagttttaaaaactgttcattagcccattgacaaatca

SEQ ID NO: 7864 - DNA, 4640 bp, Heterodera glycines
cgacgactcagcgaacaacccttgcaacaagagcaaggccttaaatccagtacgtcaccagggcgagaacgcagaccacgctagcaagaagccaacaaacggatgcaacgacaccccccggtacgatcaaatcggcaaaatcagcaaaaagagacttgggaacgaaccgagacggagcggacgttttctggtgttccgacaggggcagtacgatttgggaacccaagggcacggaaaattcacctttctgccgtcccccgcctacactcactgctcaatggcacaatctggcaattgagctcttcgcaaaagtcatcaagccagagcaaatcgcattagcatggcattgctccatcaaacgcaccagtgaacgttattatacaaatttgttggccgataagttcgtcaccatcgagaaggaatttccaccggtcaacaagcggatctgcaaacaaatggccattcaccaggatgcccattcgccaagtctgaaatgacgaatcacgaagcacaattgtggtcaacgaatgacgaattggaagtcaacttccctggatcaatcaccggacttttcaaaggcgaacaaatcagcacggcgacaaactgctttgctcaaccagcaacacttttcgtaaaacggcacaatctgcagatgttttcgccagtccaccaagttcagaactgtcaatacgccaccgaattctgccaactgcccgacaactcaactctgatttggaaatcaacctgcaatggcaacgaatgccaaacatgcgactacgagaaagcggaagtcatcaacagaaaattcactgcggcctacggagaatcaatggccacttggatctccgaagatcaccaaaaggcattaactttcgccaaaaatgcgccagaactcatcgcctgcgatggcacacgcatcgtcatgtccgaacagaacttcggaattgccaaggagcaatacgacgacattgtcagcaccacgacaagatggaaaagaggcatccgaccagaacagctcgcatcacagctctcggcatcccaagtggcagcaagcgttgcgttaaatcagctctacacgaggtgatgtcagcgaaacacgagggcaaccaacccgactctctaggccagacgcttactacggcaaccaaacatccaagctcgttggatcggcgaaacgacaatggaagtgtttccatgtgtcaacatttcgctacaggacatctcatacaggccaatgaatgaatgtcgcctctacattcccgtgactgcgcactttcccgaccgagctatcgcagctttcctggatccggaacttcgcatcatctcgctgacagcacaacaggcaagctgtaatagctaccggttccatcatcttcaactgcgaagcaatcccaacatctggttatggattgactctcgaaccggcacagcacgacgaatgccgaaggactacgtccacgaattgtacgaaacaacgatcaaccaaacgaatagcaatttggaacttcatccattgatcttccacgcatggcaactcgacaatgagtctgacgcgacacgcttcccgcacatcaacgaattcatcaactcggagcagttcaaggacaagctggaacagcacattacggcaaggactgaagctttgggcgcgttgaagggcggaatagaaggattcaccatgcgctggctaaaaggccttatcgacgaagcaatcacatggtggattcgagtcgcctgcgtttattcaaccttcctcatgctgcgcggcattgttctcccatgcactctggcgtatttactcaatcccatccgagtgactcttctcagcctcgttggagtacgcccgcactcgacattccgacccaccgtttccaaaccactcgggatcgaagagggaatgccgctgcatgaaatgccacaaacccccaaaccaccagcgcgcagggcagagcaccgatccatgtcaccaatcaaattggacatgatcgccagaacggctcggtaccaacaaccacgaacacagagccatctcgacctcacagaagactcgccctttgggaggcccagacgaaaagaattctgacgggcccatcttttcacgccggaatgtcggaactctgggattccgactgccgatcaattgatcagcagaattgaagaaaggaagtggcgacccttccccctccctttcacatgcgtcacaccccgttccactcctctgccccccatttccctccaaattgttaattgtttttctgctttccttccatgccccgcgcacaattaatgaccaatttgtcaaaaccgcaacttttctgccgccgtccccaattcggcgaatgagactccaaagaacgatgaacccccaaatttcccgttttccgcccattttgttcatctgttcattttgtcccccgttttttcatttcgtgcccaattttcggcccattttcgttctgctcacatttgccactttttatttaactttattgttatttaagcggccaaaaatgtcccccaatttcacaaccaaatttcatttggcaattttgccgtttctctccccgcccccccccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggcttttttcccggaataaattttgcttaatcaattctcggcgtttgatttggccggtcctcgtccctgcctgccccgaccccgcaccggtagaattcacatttggcccgacccagagcaatcgggacaaattggcgctcctgggtggatttgctgtgaaccacggattgactcgacgaatcccggtgacacaggggaagggaaaagcaaattagagagcctagacaaggaccctctgaggcttgtctagtgttcatagtttcgtatagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaaagggtgttcaagcgcgcacaaggccactgacaaataaggaaaaaggcaaactaacagtcctccgaggctttagtttagccataaggcaaaaggcaaacaccttgtcctccgaggcaggtgtttagtcacagaaggtccaggaccaaggccagactgatcccggaaaaagacacaaaacaacaagtgcaccacaacacacacacacgcacaaccaaactgcacgcaatgtctgggccaatacaaaaagggatcatcaatgcactcaaagctctggacaatgccaaaagcgccacctcactccttctacaccccgacccggacctgtcaaactgggaaaatgccgtcaacttggaggctcaatttgatcgcgtcgtcaaagaaatccgtacaatagaaatgcagatggacagtctacgagactcatccaacgcttggattgaacttctcgcccgcctgaccggagacgacaaagacaacggcgaaaaagaatacgtcaaattcgacaagaatgaaaaaatcgccgaccgatacgacgcagcaacaaccaaacttcgggatttgcgagatctcgaagcaacacttagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttgctccgcaatctgctgggcggagaagcgcgagaactcatagcgagcttccggctggaagacgcaaactacgaaacggtccttcagctgttaaaggacacgtatggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcattctcacaaagaaaggagaggatccggcaaactggacgacaaccaaattccgggatgtgctaaccgaagcagtccggaaagaagtccaaatccaagaagtgatgggagaatatggcatcactacgtccaaccaaagcagaagtcgtctcagcagcacctgtacaagcaccgagaacacccaaacaaaggtcacgaaggccta

SEQ ID NO: 7865 - DNA, 1233 bp, Heterodera glycines
ttattatattttccttttattttttttgtctcattctgttaattctttttttttatttaattatataaatggactatttaatctatttaaaaatattcgattttataatttcatcaataaattaaaatacaaaaaaaaatttaattattgtcatggataaaccttaaaattagttttctttaattgtgatttatttacttggtaacggagcaaaatataagcttctgaaaagacttttgagttgtcatatttaggccgttaacctcaattcttgcactatctttgaattgaattgtttagttgtatgtttattattaaattattaaattttgtttgtgataattgttaacggagttgcattgtaaatttcaaattaatctttttaaaatatttccattaactattcatttataggcaattacatgttttttttagtttttcttaaataaaaagcataaaaattttttattttagaaatataaatattcatagtattaattaaattcccgtgaagagaaaattccataaattcagaaaaactttatgagcaacagattattcttttgtttgtcgtatttattcattatttaaataaataattagttatcttataacaacaataaatttaatgtattattattattattattttatttatatatctgaaatattggctgattttaaattattttttaaattttctttccgtataaagttcatctgacaatttgcgaattatgtaaataaaatatgtataaaaaatgctaaaatatgtatgtccccaaatatgtattaaaatatgtaaataaaatttgactactttatatattttttttaagaataattttttccaaaatgctcgttttggtcccaaatgctgaaaaattgttaaaatgcaagcacatttaaaaaaacttaaataaaattaaatagatttacaagcataatttatttattaaaaaaggatggcgtcagaaaaagggcgtttcgcgaaaagtgcaaaaatggtcaaatttatctgaaaatttttgaagaaataatttggttggtaaaattttaatatttaaagttatataaattaatgtgaatttttagtttttccattcttccattattttataaacatattattacatttaaaattaaaatgagaaagagaaagaattttttttattttattagctatttataagatataaatgatagttttaatgtttatcattagactctaga

SEQ ID NO: 7866 - DNA, 3674 bp, Heterodera glycines
acttcgactttctatctgcggcgttgttagagcccgaagaccgggaataaacgcagcagacggcattgcaaattgctcaaagattgagaaattgcacaaaatttttgctcaaagactgagaaagtgccgaaactctcgagttagcccgtcgaccatccatgattttcgacgaatttgtggcgttagcggcgagagctgaagcaacccaaaaagcgtcgaagctttcaatgctaaaggcaaacaattctcgaagattcgacagcgaatttcaaatgccgcgatacagcccacggccaatgcaacagcattttcgccaagaaaattttccacaggccaataaccagcaacaaaaccgcccaacttgttataattacggaaaattcggacattttgccaggcaatgttcggagccacaacgaaaccaaggcacacagaataacaacagctcggcaacaaactttgttcgtcaaaattttcttgttgaacaacaggaaaaacctccacaacagaatcaaaatctttttgttggtggcatttcgatgagtcctgctgatgtggaaaaactgtttggaaaggatgggaccgaaaacgagacgaaaaatttgaataaggtttcgatcgggagaataatggccttaaaggtatcggtttgtggtttgacggcaaaagctatgttggacggaggtgcccaaatttcgatggtttcttccaaattctttgcaaaattattaactgagaaaagaatcggtaccgaacagcttcgcccatctcgtcacaacactcgcgtgatcgacataaatggaaatgcagttgagtgtattggaattgtgtctctcccaattgtcaggaaaggcaaatgtgtgtggattcgtttccacgtctcacacgcatcttttggctaggaatttgtttttgggacaaatgcattggctcgactaagttttaaacttttcgacgaggcaaatgacgaattggtcagtttttcggaagttaataatgtggaacgcaattctgtgcacgtcatttatcatgcgaccataccatctcgtaacaaaaatttggttcactcggcccagcaaatgaaatttaagagtaacgctacggcaatttttacaaattcgggcaccaaaagtgaagtggaaagcaaacggacgtcggaattttgtgccaccaaaagcagccatcggccaagttttcgtcaaaagcggaagaaagctgaaaaggcaccaaagaacatcgtgcccaatgtggagaaccgaattatcagaaattgtgatgagaaagggcacaaaaagttcggcccaaaggaacaattgggaaagaaattcgaagtgcaaagtggcgatggtgaaaattcggtaaaaagtggaaggatttttcgaggcaaaaattctgaagttcaattagggacaattgaaattttggaaggtcggaaggagtttgagagaaaaagattgaagttgggcagaaactctcaacgagaaaagattggacgaaatgtctcacttgatggaaatggcccacgacgaattatggcacaaatttgaattcgtttcgacaaaactgtgttttctggccaaggagagcgaatgcagaccagatgagccgtgaaactttgccatttgatcggggttgggtcgagttgaccgcctcgtgtccggattcaacttcgacttctgctgatcgacaaccaatgatgcgcggacttcggtgcaatggcagtgagctgatcccaaacggacctcacctttcgacagccggatgcgggatgtgcagctgatcggcagggacgcctctcgtcagcggccggggatgtgttattatttaaattagtgcgtaattgcttggcgttttgaccatttattgatgtttgttttattcattctcatttttcatgcacttcttctcccctcttagagttttgtcatgtttggctgttctcagtaattttggatttgattgattgtttggttcccacctcgtcttccgactttgttttattttgttttgtgtgttttaataaagtgaaagcctatttggtcatttggttgtgagtgttcttcaacagaaaatatatttatacataaaataatatacataaattaaacataaactaattttaataaatgctctataataataaaaaagcaacaaaaatatatatatatataatcatacacaatcttttaaatacgatattttggtctaaaagtaaaatacattttttaattagaaaattttaaaaactttaaaatatcagttttgaaagggtggaagattactaataaaaatcggactgaataaaaattaattcaaaaataaaagcagtaaattttaaccaaaaatattctttaaattcaaagaagattgcattataaaagaatcggacgacttaggtcaagaatacataataaaaattcatagactgagaagaaaatgaattaataatgtaaaaaatcgtaaaattagaaaataatgccgtataaattggaaaaaataatatacatgcattctcttcgtgttaaacaataactttcaactaatacctccattctgagtctgcaattgagtgtcctaaatacgttttttataatactaattaataatatatcaatcataccatgttgattgaatgtgaaaatgcagaaagataaataataaaaaccaataattaaaagcaaattttactattgatacaaaatttaattacaaagtaattatattacaatcatacaaaataatattaaatctcatggacccttgaaacgggacaacgaaatgtgcctatttttttaaattaaataatctaaaagaagagatttgatttgttcgaaattcataaataattgtaaaattttattaaattattaatatgaaaagtgaaactaataatattaaaaaaccggaataaaaacaataaatatataaaaaaaactaaaatttcaaagcgctttaatgattaagatatataaaataaataatgaataaattatgaggaaagataatcaaataaaatggatggaacggattcaaagacttgaataaactgattttaaaatacaaaatttatttaatactaaattgaaattatataaaaataaaaacatcaaaatatcatggaaaacgaaacgcttctctagcatgaatttttatcaaaacaaatcactaatacggaacaaaagatgaaaaattagtgaagtagcattcatgcgaggattgtgggaagcagcatgaggactgcaaaaaataacgataaattttaattgcaatgcttttgtaaaaataaaaatatttaaatgctttaaaaaatattcatttgcgaaattttgaaaatatataattaacagaaaatagtaaaagttccaaatttaatcagagaaaagaaaacaaaaataatctatcataaaaatgaaagtaacaaaaaaaacaataatatattgaaaaacctaagcaatctaattattaataaaaaaaaatatataaattaatacgaaaatgcaaaaaaaggattagaaataaataaatagaaataaaaattactaataataactaaattttaaatgtaattggcacacgaggcgaatcttcgagggagaaacatgcagcgaaacaagaaaatgcttgtcgggcggggagggaagcattccgtaacagttgattgtgttttgaaataa

SEQ ID NO: 7867 - DNA, 2465 bp, Heterodera glycines
  misc_feature (4)..(4): n is a, c, g, or t
cccntcccccaagttcaccaaattttctttggataagcgcgccgcaaaaaagggtgtaactgtcccaaaaaaaaattccaaaataatataaaaattacataaaaatattttgaaatcattaaaaaatttttcaaataaatatattaaaaacagtttgaaatcaccttttacatggtcaagaattttaaaatttagcctattaaatatttaaaaatttttaattatatttaatatttttgaaaaattccgacttccgacatttttggggtcggaattccgacttccaacttccgaaaaattttttggcctcggaattccgtcttccgaaaaatttttgacctcggaattccgacttccgaaaaatttttggcctcggaattccgacttccgaaaaatttttggccttcggaattccgacttccgaaattttttggtgtctcggaattccatccctgccacacacccatcataattcaaaataaaatgaacaataaaccgcaaattacgcttttaaattataaaatatatatgatataataataatttattaataatcaataaaacaaaaagttaaaaacggactaagagaaaataattttatattattagcaattggaacattatattataagctattggggtgacaacagaattagtttcacaaaaaatccattttcttaacccctttcaaacattgtggtcgacaaacacacaacccaggcgcatgaaaatttaaaaaatttataaaattaaattgattcaaattatttaacaaaactataattacaccttgttaacaaagaaaaaatatattattaataaatcaaataatcttgtaaacgaaaaaatatttaataaacgaatataattgaaaataaaatttaatattatgataaataatttaaaaaatttaatctatcttcaaaaaaaagagtttaaaaatcaaaaaataattattaaattgaaaatctttatttgacttttgctttatatatttcttcgtatgaagaaaataaagaaaaaatcattttttgaaaataaaagttttaaaaatctgagaagctatgatgcttgaaaagatataagtttataaattattaaaatatatccaacttaaaggaagcctagccatcggcctaattaaaaagttattgaaatctttcaaataaataataaattttaaattgccaaaaaggtactgattaattgaaattatgcggaactagaacctataattaattataatgaaaacataaacatttattcaatgtttattattatgacgtcctcttgaccgatttctggattgcgtaatataacactattcaatatgaaaattataataaaatttatgaataaattatttattttagaaaacaataaataaaataatttttagttcttctttgtcattaaataagttaattttatggtaaattgcttcgctgataaaagttataatgaataaaatttagatttctataaataaattaaacctagactggtataattagcgaaatattgaagcacaaccgagcctatacgaattataaaggaatgcatattgtgtaattgtttataattttaaatatgttctataggataaaaattgtgtcaaaaaatattctaaaatacgagtaacagctatttctgaaaacaattaaactaataaatatttagaagaatacgttatcagccagctgaatataaaatgctttaagtccactgatgatggaaacatcgagacaagacgggacaaggataaaaaattagttccttaaagaaacaaagataaaatgagataatcatttaaaagacaaaaaaacgaatgtaaaaattttaatttaaaataattaataaattaatgatattgtggaaaggattcagttacgacgataacgcgtggaagtctgagaacacttggaaagagccaaagtgctttttgaagagttcaaaaaatgaaagttaaaaacagtgaaaaaataaaataatttattagaaaaaaaaatcaaataccttccaatgctacaaaaatggtaatgggaaaaaataatagaaaataaataaaccaataatgaagataaataatttaataaaaaatatatttaaaataatttaccaacaaagggacaacgaaaatcagcccaaaaaataataaaattaaaaaataaattaataaattacaggcaaagggacaacgaaagtcatcaaaaaaaaagtgggataaataaaataattaaattttaaaaatatattttaatttatatgtaaagataaacaatttatttgcaaatgcatattaacaaagaagattttcaaaacagagggaagtgggtccatggggaaaactacaagagtaaaataggaataaacgacgtaaaataaatttttaaaaatatattgaaaaatataatttaacgagagagaaaatatttttttaattaaaaaatatatgataaaataat

SEQ ID NO: 7868 - DNA, 3672 bp, Heterodera glycines
  misc_feature (19)..(20): n is a, c, g, or t
  misc_feature (1120)..(1120): n is a, c, g, or t
  misc_feature (3521)..(3522): n is a, c, g, or t
  misc_feature (3525)..(3526): n is a, c, g, or t
  misc_feature (3572)..(3572): n is a, c, g, or t
  misc_feature (3624)..(3624): n is a, c, g, or t
  misc_feature (3664)..(3664): n is a, c, g, or t
tgcaggtctcaaaaatatnnctttattaggttttggccacacctagaaaataattatggaaaaaagaaaattaaataggtaataggaaaagaattttctttttaggtagcaaaacacataaaaattttttcaaaatttaattttgtttgtatttcaattgaaaatgaagaaattattaaatattttaaaatttttttcgattaagtaaaattttaaactaaaaatttctcaagaaaaaaacatattttttgaataaatttttggaaaccaattcttagggggtggggggtgtattttctgcttttttcgcagaggtttgaaaattttcgttttttattgcatttttattaaggatttttcaaaaatcttaaataggcgccaaaaacaccaaaataggcaaaatcaggcattataaaattctcgttgaaactccaaaccaagcggaaaatgcgtttttcgtgctaatttgtgcgcattaagtgcgcataaagaaattttaggaatttgcctaaaaggaattctaataattaaaattattattttattaaattttaatttaccagcaatttcatagccctgggcaatgttttccttcagatcctttatcgttttttttctattatatttaggatcattataatcattttccattgttcctattacaaatttgaattccacttgttgcgctacgacgcttccaatgaaaagtgccgaacagaaaaggaataataaaattaatgggacggaaaaggagggcattttttgcgagaatttggccatttttaggggcaataaatgtgcgagaattttgcaaactttaataaattgggaggcttaagaaaaaattaattaattaattaattacataatcaaatggtaattttgcgtgcgaattgcgaaatttggtctatttttttttgcggcgctttttccaaaaaaaacttggagaaaggggggggtgggtccggcgcgccgggagaaattttgaaaacttgtgtgaaaatgttaacagattacgattctaagcctgaatgagtggcttcactcccatcaaaatttcaaattttgctttttcaggtgtttttcgaccacggttttactgtaaaactcagtcattttnttccgggttttcctgaatttctggggtctgctgggttttccgggacgggccaaattttgcgggtcatcttgctcttacatgcgcgaccttggctatttttttgacaaaaaaggattaataaatttgctccaaagcaaccaacttttaatttattcttgctactattttatattctaattattagtcaatttgcatcaaaatttccagaaaattcattagactcaaaaaagccaaacccaaaaaggtgtcagcagttatttaaaaaaaaaatttacattattcacattcataaattgtttaaataataaaaatgaaaaataaatgcaagccgacccgaaagtttggtgccagcaggcattttgcaaatgcatttctgatcagtgccatatatcatctggtgattaaatttttgatcaaacttatgattataagtgtcaaatgcatggggttggcgtagtgccgtgccgtgaatgaatggccacggcgtgccaaattatcccatgatttctgtaaaaggcacatttgcatggcattaacatttacatgtcataagaattaatataaggttttattcccaattgtacgttttttcccataaccatcacagttttttctgtttctaaaatcgctgaattataaaataaaattaaaattcataattttaaatattttaacgggggggggggctaagaagaaaataatatcaaatatacagtagtttaattcattttaaaataattgtttatttggcggaaaaataaattatatttcagcgttttttaaacgaatgccggtcatcaattcattagtcaatcaattaataattaattagttgtcaaatttgctcctcctcttcctcctcctcttcatccttttcttcactttcttctgttgttgttccatcttcggcaagtggattttggtgccgattgtcaacacttttggcaccatttgcggaggatgatgaggtggacaattggtgggcaggcattgagcgcaaaaaattgataggattcttaaatatatatatatatatttatttttttaaataaaaatttttttataaatgctaatgaaaattcgtcaatatttggtacggtaattaccaaccattttactgtgaaaatgctaatttttgactcaaaattataattcttcataaaatttttcggacttcaaaaaatttgaaaaatggacaaaattgttgaaaaaaaagagaaaaattttttcaaagagttgttcaaacttgaaaatgaaaattaataaatgagaatgctaatgaaaactcatcaatatttggtacggtaatgatcaaccattttactgtaccattagccgaaaacccaacgaaaagtaagaaaatgctaaacaaaatgatttttttcataaaaaatttgccgtacctcaagaaaattttgaaaaaagggacaaaattgttaagaaaaagcgaaaaaattttttcaaagggttgtccaaacttgaaaataaaatttaataaatgctaacgaaaattctaatgtttggtatggtaattagcgccattttaccgtaccattagccgaaaaattcgcgtattttaatggactttaaataattattttaaaaagtaataaaattctcacactggacgtccggcgatgggtcagcttgaaggtggtcttcacctccttcagtttggcctctttgtccgacagtccgtcactgtgcgcagcggacagttccaacgaacgctccaacgacgaaacctaattaaaaatttaaaatttaaatttcaaaaatcttttttttcgccataaccaccattgtggaggaggacagtaatgactcgagcagtgtggcggccatcgctgcttcttcggctgccaacgctttttgcgtcacgggcgaagggtcggccatttcggcaccgatcggacaacaactgtaatcaaaaatgatcaaacaatgatagaaatgccgtccgaattaaagtgccgaaaacctagaatgccaaaattttgagatttgtttggaaaatcaaaatcagtgtcaaatagctcaatttttttgagatttgatccataatttattcgagaaactgatagatgataatattgcaaatgatgccatcttgttagatggccaagagttatggcttcttaaacttggctgagacggagttggcccatctaaggttaaacaaaaaatgcttttcccaatgatcagaactgacagtgtggtgttgttctgctgcagttgttcctgctcgggctcgcagtccatggccataatatttttgttattgtttgttgttgttcatcacatttaatgccattgctttcacatccaaacgcagggtgatgaccatcacaaacatcaattttcttctgcttcgaaaaaattttttgtttaatttcttgannatnnttagaaaaaaaaagttcaaccgacgtttagtcattttctatctggngtttgatagtcctgggtctggctcctaatttaacatcttgatgaatttatantcagagaagtattctattcaaaaaatacctatcaaatttncaaaaaaa

SEQ ID NO: 7869 - DNA, 1448 bp, Heterodera glycines
gtcgggatccaaggataaatccggtttaggtcctttcccgtgcaaccctaagaattaaataattaattaattacccaatgcgccctgttgttcgagccgtcgacgactccgttctcgtcgaattgacggcttacgcagtgaacagttgcgcatgaatgttgcggagagttgggaggccaccggtcgatgcgcaaccccagcggcagaagcgggcggacgacgcctgcggagacgagccttggaaaaggacactctcactgattggttggaattggaacaagactctgctcagcaaagcaaaaaatgatcgggaacgaatgggcttaattagaaaaaaataacggatataaaaatgatcaaaatgggcaaaactgatcagtgattatgtgagcgtgtgatcagaattaaatagattcgagaactgattgggaaaaatcaatttttaatcggactaagtaatttgaataaaatcagattagtttggtgttagaaaatggctgatcaagaacagagttttaactgtaaaattaaaaacatatgtctcagctggaaggaatcacagaattttggaatcgattgatcggggaaattatgccattatagatcgatctggtcttactcacctctttatgctgaaaatgatggtgatggtggtggtgatcttttgttggtgatggccatttgttgtaattgctggtacccggtgccgttgtcgtcgttggactgcttgaatttctccggtttgaagttgctgttgttgtaccaccgccttggacacattggcacgtgttcggtgccaaacaacatgtttttgtgccattgtcggctgcactaagccaaatgttgttgttgttgttattgttggcattgccatcgacgcattcatcttcctgaacgaaaattttatgagtgaaaaatcaaattatttttgtctcaaatccgacaaaaaaattcagtctcgattaagttcattggtcaatttaaacagtttgatcactcgagaaggaattacaatagaggattttaaatcagtgatcagaaaccttggaacataatttcaatctcaagcaaaaacattgatccaaaagtcattgatcatctatctggattaaagtctcggaaagtagcaatgatcagaaaaaaccggattttgatcagtgatgaaagggtcatttcgttgatcacttggttaaacatgaggtttagcattcattctcgagtcaaaccactgatccatgtttcctccagctcggtaggcgagattgggtggtttttactaattgccaattatggatttaattgcctgacaaacgcccgaatcagcggacagtccggaggcacgggccaccgaatttcgggcaaagaattggctgatttgttgcggttggatgccaaattgacagttcaagcaggccatcatatttgttgaagagcaattattattatta

SEQ ID NO: 7870 - DNA, 3219 bp, Heterodera glycines
  misc_feature (59)..(59): n is a, c, g, or t
  misc_feature (2192)..(2192): n is a, c, g, or t
gaaaatacagcagatgaaaaataatgaaattttttgaatgtcgtgccgtaccatgagcncattctggcctcttcctgcagttgtccaacaacaactttctgttgctgttgtgccgtaatttgtggcaccattgccgtcgtcgtcgctggcaattgatgatgcaatttcatcatcatcatttgcatattccgtttatttgttttacaatggcgacaactttttctgcgtttttgggcatctactgcttctgctcctcctgctggtggtggttgggttgcgggtacttgttggtctcgttgttgttgggggtgttcattatcatcatcattatcttcagctgatgaacaatcccgagacgaagacgaacaggaggctgctgagcctagaattggtgaagaaatttgtggagaatcgccaggaaaattttaaatcgccagggttcaattttcaaattatatacctagacgatgttctcctgtccctcgcaaaaaatttaaggaaaattagataaatttagtttttttttttttaaattttgtaagaaattttagtactcctccacgtggataaaaattttgtgagaatttggaaatttttttgaaaaattagacgaatttaaacatttataagcgagtagagagacaaagaaattagggcaattttcgaaaaaatttgacaaataccgtttatttatttatttttttacctgcgaccatcggcgacgaaatttgttgacgtgaaattttcgaactaaaagtaaaaccatatataaatttagcagcaaaatagaagaaatagagaatgaaatatttcatcaaattttgtaatttaattttttccaaatttgtcaaatttaaatttgtgccaaatcctctcccaccccgaagattatcggcataatgttgttgctgttgctgcggttgggccatcactttttggccaatgtgccgtcgtccagtgccgtcatagtcatagtatgtcatgcgaagcattgccggacgagcctgctgtactgcttggcattgagctcgcccaacagttggcggcgattgactgaagaatgaagcgccaaattggacaattaagagagttaatttaacgggactgaatagctaattatgataattaatggacatcaaaatataaaatgacaggaaaagtttgagagtgtgaaaattttcgaaacaaaaactaaccgaggcttgaccataatatgcgagatcaactcttttcagccatgagaatcaggagaccgagaattttcggtaatttagtagttctcgggccacgactcgagaaaaatttcgggatttaggtcttggactggatctcgattttccattttcgagaccaaggccgagattcttttcaccccaagagctccaagataatttggccataaggatcagtaggagacggagatttggcgttggaaatttaccaagagttgaccctaatttgtaagagtcaggagggcaaatggatttagttattctcgatttttggaaatcccgaaaaatatataaaaaaaggaaaaatatgtttttttttttgcaaattgccttatgcatttgggcctttgctgtccaccaagtttgaatgcactgcttgctctcattggccattgttgttgattttgttgttcgacgggttcttcatgcccatgggtaagcattgccgccgttttggccgtttcggcacgtaacagaatatgccggagctcctccttgctgttgttttgctgtataataattaataaattattttataattaaacaatgccaagttcaaaaatggtaataatatttataaaatattaaaaattattttaaaaaccatttttttcaactattcaaaatgtatttaaatcttttaaaattaattatagaatgactaattttgaatgaattaattcgtcattaataaaacaaaaataaaatatgaaattgaaaaaatatttattattttttaaaatcaaattaaaaaatccattaaagctaaataaaaaaacactatacatattaaaaataaaattaaaatatataatagaatccatatgttaaaatataaattaaattaaaataaaataaattaaatcaatttaaattaaatttaaaaaaataaaataaaataatttaaataataataaattaaataaagtaaaattaaattaataaattaaattatattanagaatataagcattccataccagttttggaacgttcgtgcgcgccacggcatcgtcgccccgtcgtgccgccattgtcgccgcctgttggcgcagctcagcatgccattcccgcactcggcatgccactcgtgcagtgtggcgtgccaatgcgcgtcgtatgccaaccgctcgcgcgttgcatccgccacgcgttcgttgtcgcgctttcgctcgttcatcagttccgtgaagcggcacatttttgtgtgcattttgttcacccgttgcagcttctcctcgtacatttggcgaatctcttgcgcatgtcgaagctcgtgcatccgcttcttcaccagctcttgctctacgagggaagggggagaaatttggataattaatactaatatgagaccgagtagatttgggtgatcaattaaggggtaattagcctaatgtgatcgattaagtataattagccgaaatcgagtgatcggatcagaactaggcgcaaatttaatcaatgctaatgagcacacctgagatcaagtggattttggtgatcagtcaatcgcaaatagcgcctaaggtgatcaattaaggctaatagccaaaattgggtggtcggattatgctaatgaaataaagaacaaggttttgaatgataggacaaagccaacaatgatcaaatcacgttggacaaattctcggcacggcacctaaggaccggttaaatttccaaaaataggactaaaagtgtctacttttattaataaaaacacttaaaaatgtcaaaattccatggattttcgtaacgatttaaaattaaaatccctggaaattttaccccgctgctgttcccccataaaatccatgccgctgttgtgcagtttggccattttatcggtaatgtcacgcttccactgctcccgccggtagccccagccctcctcctgcaattcggccaactcagccctcacattgctcaacaaatcctcaaatattgtaaatatttaattaattagtgtaattaattagcataatggtta

SEQ ID NO: 7871 - DNA, 3699 bp, Heterodera glycines
ttggcattgtgcttttacgcaacttttcgcaaattgggctttggaaaagtacgcgtggtggtgtgccctcgtcatcttcgccctttttgtggctgtttgtttgttgataattgttttccgcgaaatctcttcaccggatcctcaaatttgtcgttttcacaaaagtctgtgagtgttcaaactttggaagttttttcgcacttaaatctctcctcacttttcccataatatttacctaatttattttattatttatttttcatttttttattaaacattcaaatatccacataatatcacttcgtcttactttgctgatatttcaaaatctattttggtcccttttcgtgccttgattttattgtatacacgccattattgtattaaaattaaataaattccactgacaaatgatttatcttaattatctttccgtaaaatttatttaaaacatttttgggacggaagtggtcttgttttttggtcggcgggtggtaatttggcgaagttggttcccaaaaaagattgaaccaaccaatcataatttaaaaataattatatatggatgggaggccgggcatagaaaaataaaagctaaagcagagaaactggccaaacaccaaattttgttttgaaatgacgtgatttataaaaattctaacctttaaaaaggaccaaccgggctaatctttaatcttttaatagtcaactcatcaatttgcagtggttatgaaatataaaaccaatccgattaaagccgattacaaaattggcaacaatgtgagtttattgtgtgtttgggtggcattttcaacaaattcacaaaaatggcatttagaaataattgacgaatccatcccaaaatctgattgttttgaggttaataaataatggcatccgtatttttaaggttcttggggtcggaatcaacggaaaagtggtggaatgcgaacatcggacggacggaaagaaattcgcattgaaaattctgcgggacattccgaaggcaaagcgcgaggccgaattgcactttgtggccagtgggcacgcgaacattgtgaatgtttacgacatttacgaggtgcggctggttttgccattctcatccatccaattgctgctttcttatttagaacaattacaatggcattccgtgccttttgttggtcatggaatgtatgacgggcggtgaactgttcactcggatacaggcaaaaagaaacaaatatttaacagacactatttttaaatttggaatcggttaattttaatttgatttccgttttaggaacggtctggcggtgctttcactgaacgtgaagcgtccaacataatccattcgatttgctccgcagtttcacatttacatcaaatgggaattgcccacaggtctcccaaataaattttgctcaattaaactattatttacattttacttattggcaaattatgcccaactatttcagggatattaagccagagaatctcctctacagcgaaccgagtcccaccggcactttgaaactcactgactttggcttcgcaaaacgatccgaagatggcgaaaaatcactggtcagtgactgttggattggactttgggcaactgtttccctctaaagttggcaatttcttcaggtcactcccctctacacaccttactacagttcgcccgaagtttgctttttgtgaatgcgtcctaattgtccgtaataacccattaaaggtcttcagctcacaaaaatacgacaaagcgtgtgacgtgtgggcgattggcgtgatctcttacattttgtgataattatttttgcttgattttgctcatttcaacgcccttttcagattgtgcggttacccaccctttttctccacccatggccttccaatttccccgggcatgaaaaggtgggttttcacaagagaaagcaatctttagaatgaatgaatgatgctttcgttttgtttagccgaatccgagctggccaatacaatttttcgggccccgaatgggaccgcgtgtcagaagcaggttccttccgccaatcccttgcctttttgccattttttgttttattctcagcgaaggacttgatcagacgttgtttggtcaccgacccggacgaaagggcgacgatcactcaactaatgcagcacaaatggatcactcactacaacaaaaatccggcgactgcattggccacccaaaaagtgttaaatgaaagagaggtcgactggtccaacttttcggtgattttttttctttttccgcaaacaattgctgacaaaagcacgtcgaatggatcaacttgagaatgtgaattgtgtatattagtacgcattttttgttgattattttaaattttggcgacccgaaagcaggaaaatgtcgattttcttccccctgtgccatttttggagaaatttaaaatctaatcttttgcctcatcgaagaaactaacaaaaattaccagcaatataaattcataaaaataggaagagatggaaaatgcattagcgacgatgcgagtgggcgacgtgcacatcaaacaaatgggagacgcgcgaaacgcacttttggagaagcggagaaaacggacaacggaggaggaagagcaaaaagagacactgccggaggggacaacgacggaagagggggactgaaaatgacgaaacgggaaagaatgccaaacacagcccaacaacgacgactaatcaaattgccagatcaaacaaacagctgatatctccatttttcaatttcatattgctaaatttttatttaatttaagaattactaactttttaaataaatttttgttttgttatcccatttctttaaattcgctgcgaataatttatatgcgaaattggtgatttaatgtaatcaaaatcattcacaaaatgtcaatatgtctcaataacgaaattcccatcggttggcattggcactcttttcgccgttcatccccccttcgcctttttcttccctttgtggtccactgtgtccactacgataatgcccgtgtgaagggcgaacagaagtgagatggtaattgaactgatggcgaagaacagaatgtggtgcatggagttgcgctccttcttctccgccttgcgcagttccctctcaattcggccctcttccattgtctgttgggcgtccattttcagcttttgccacttttttctcgccatcgcctgttccttgatcactttttcgggcagtggcaaatactgaaatggcaaaacaaatgctattacaaaattacctaaacttacaatactcaaaatggaatcgacgaatcggacgaggtttggggtggccgagaggtgaagctgaagccgatcattgggcagaggggtgcgcagcagcggagccaaacagccgaagacgagcgcatcgatagagcatggcctggggaggggggaatgatataattgaaaaacaaatggaattaattgtcagacttgtcgccacagaaatatttgttgtcggacaactttgccgaaagtaaattcattgcctaaaaataaacatcattggaaagtgatgggaattgacatttttttccaatgcctgaattgcatccaaagttagctgttgttggttctttctgatcgctctgactgttgtgtccattcgtctccgtctcctttccatgtaataaatgttgtatgggaaggtgacctgttgggcat

SEQ ID NO: 7872 - DNA, 900 bp, Heterodera glycines
gataagaatgtcctatgagaaggaaatagcaaaaggtaagaattcactttttaacacaatgcctggtcggggtcctcgtaggagagaaaggtttcccaaccgccatttgccgaatagtcgcgacgaacgagttcgacttggtaggggcggactttctcgtggatttcctgacaatgggtcgcttttttcgaaccgtcctttcgatttccccccccatcccttcttttcacctgaatgcccacttctcgtgtccgcacatcgcgacatttcactcccaactgtttcatccttgccatggcatgttctcgcaaattgccatattcgacaccgctcgttaccaatggcatcggaatgtctcgttgcactcggtaaacgcgtgtccatgggggcaccaaagagagaatttgggcgaccaaatcaacgaggacctgaagcagaaatcggatgtaatgtactgaagaaatgattgttaatttgcgaaaagcaagataaaacctgtggtgggtaactttggtatttgtttgctgaccaaagttcatagaggccggtcccccgaatgacgagtgtcgggtaaattttgaggccgtccggtcggaactcggggttttcaaacagttcaataaactgacaatgaaaacggattttatcaaattgattgttttgttggaatgacctgttcaatgtctcgttcaatgtcaacgtttggtctatagagaaataataaattaattaatattaatataaaaattaaaatttacaaattcggcatcatatgaataacactgaaaataaaacagaaatgaaaaaatgagaagaaaactcctacactttgtagcccgtgtccttggacatgtgaaaacattcgcaaacggcttttacctaaacaattcaaatattaaa

SEQ ID NO: 7873 - DNA, 1732 bp, Heterodera glycines
  misc_feature (648)..(650): n is a, c, g, or t
  misc_feature (1248)..(1248): n is a, c, g, or t
  misc_feature (1264)..(1265): n is a, c, g, or t
  misc_feature (1285)..(1285): n is a, c, g, or t
  misc_feature (1296)..(1298): n is a, c, g, or t
  misc_feature (1307)..(1307): n is a, c, g, or t
  misc_feature (1336)..(1336): n is a, c, g, or t
  misc_feature (1367)..(1367): n is a, c, g, or t
  misc_feature (1373)..(1373): n is a, c, g, or t
  misc_feature (1441)..(1441): n is a, c, g, or t
  misc_feature (1446)..(1446): n is a, c, g, or t
  misc_feature (1449)..(1449): n is a, c, g, or t
  misc_feature (1452)..(1452): n is a, c, g, or t
  misc_feature (1457)..(1457): n is a, c, g, or t
  misc_feature (1472)..(1472): n is a, c, g, or t
  misc_feature (1479)..(1479): n is a, c, g, or t
  misc_feature (1495)..(1495): n is a, c, g, or t
  misc_feature (1497)..(1497): n is a, c, g, or t
  misc_feature (1506)..(1506): n is a, c, g, or t
  misc_feature (1524)..(1524): n is a, c, g, or t
  misc_feature (1569)..(1570): n is a, c, g, or t
  misc_feature (1574)..(1574): n is a, c, g, or t
  misc_feature (1579)..(1579): n is a, c, g, or t
  misc_feature (1586)..(1586): n is a, c, g, or t
  misc_feature (1623)..(1624): n is a, c, g, or t
  misc_feature (1626)..(1626): n is a, c, g, or t
  misc_feature (1636)..(1636): n is a, c, g, or t
  misc_feature (1642)..(1642): n is a, c, g, or t
  misc_feature (1666)..(1666): n is a, c, g, or t
  misc_feature (1668)..(1668): n is a, c, g, or t
atgatctccgcaatgtttcatggtccaatccgacgtcacaacgcaacaaaatcaaaacaaatgccgactttcggagaaattcgtcccaactcggcctgatcagaagcgaacttcgcaacgtagaaatgttgttgaaagcgatgccaaccaaaagcattcctaaaaaggcggaaaatgaaaaaataagcggagaaagtgccgaagagaggtggcaaatgggccaaacgaaacaaatggccgacgcaaagtgcggaggcccaaaggacgaaaagggaaaaaagcgatcggacaagctgatcaggcacttgttcatcggtggaaaacaatgtcaaattgggagaagcgatcgacgaattgacgacgatcagaggggaaatgaaaggacgcgcgaaaagagcgaccaaagtgccgtagagagagaggagaacgaacagcgaagtgagcaccaaattgacctggcaaaagcttatacatatcatttctcataattctttttgctattttaaaatgccaagaaacgaatgccaaacccacttgtttattggacacaatccgagacaatttccccaacagaaagagcggcattttacagttggccgacctaaacgcgaaatggacaaatggatgaaaaggcaaaggggggggggnnnagggaggggggagttggcatttgtcaggggacatttggctaaaatgcagacaaaaactgagactctgcgtaaatgctagatattaattaattgcttgtcattactgactgactaattgcggattgtctcagtcgatctttcagcgccctaatggagagacaggcttaaagtttaaactgtctcacgacataaggcgataatctgtgggacgaacaaatggaggaactaaagaaggggaatacgtaactaataattggattatgaaaatgatagttgaaaatgcgtcaggataacaaactccattcttgaaataagatatcagataagtgtaatttgcctcaaatgaaaacaaggaaaataaaatataataaagaaaatggtcaattttgtgtatttttttgtccttttattactttgaaaatgcaacattttaaaaatatttttattcattttttcaattttaattctattttcgattaaatttcctttttcatttgtttggttttctttcgtttcttcttcttttactgcttttgctcagctgacaatgccccgtttcagcacattcccgtggttccatggaagcgaaatcggttgnttctgtttgttgtcgnntttgtgcctgccgttttccngcgtgcgtttnnnttgccttgntcgtttggttggtgccgctcggtccggtnttttgtcccctctgtgtgggggttcgtcctntggtgngggtcggcgccgttttcgctgcgtggttgccctgtttggtttccggtggttgtttttcttccttttgntttgnttnctntttgnttggtgggctctcgncgcgggncgcgttgtctggcccntnggtgcggtncgtcctttgggggcggcnctcctccgcggcgcgcctgggccgtttgtcgggctcccggggccnngtgntcggntgggcgntctcttcgcgccggttgtcctcgctgtcgccgctggnntncgtgcgctgnttgggntggctcgaagtgagggcctgcccncnttggcgaatgagtgagtccctgacaaatgcgggatgacggggtaattgccgaaccgcaagtgga

SEQ ID NO: 7874 - DNA, 3471 bp, Heterodera glycines
  misc_feature (8)..(8): n is a, c, g, or t
  misc_feature (3248)..(3248): n is a, c, g, or t
  misc_feature (3254)..(3254): n is a, c, g, or t
  misc_feature (3263)..(3263): n is a, c, g, or t
  misc_feature (3398)..(3398): n is a, c, g, or t
  misc_feature (3413)..(3413): n is a, c, g, or t
  misc_feature (3429)..(3429): n is a, c, g, or t
  misc_feature (3432)..(3432): n is a, c, g, or t
tttcttcngtttcttcttcttttactgcttttgctcagctgacaatgccccgtttcagcacattcccgtggttccatgcaagcgaaatcggatgattcaatttgttgtcgaatttgtacctaaaaatttaaaaagtgcgtttaaattgcattgatcgtttggttggtaccaatcggtccgatattttgtccaaactgtgaagggatacgaccaatggaaagggtcggcgccgtattcgctgaataattgccctatttaatttccgataattaattttcttccatttgatttaattactatttaattggagggctctcaaagcgggacgcgttgtatggccaataggagcggtaagtccaatgggggcggcacacataagcggagcgaatgggccgaaagacgggcacacggggccaagtgatcggatgggcgatcacttcgcgccggtagtcatcgaagtcgcagatggaataagtgcgctgaatgggatggcacggagtgaaagaatgccaaaattggcgaatgagtgagtgccaatcggaccgggatgacggggtaattgccggccgaagtggaacgaatgccgcagagggactgcgaccgggtgaggcggaaggagcggttcagctcaactgaccgatttattccgtccatcgccgaccaaaagcacagatcagtggtaaaaacgatcaaaaataactgttagaaaacaaacattcaaaagaaatacacaataaataaataaattgatcagtttaactttttaattttcgtggaaatggcgaaaagagtcaaaagtttcggttcgtttcccattgcaaatcgattgatcagcagctgggaaaagcggcggaacaattgttcgttcggagtgttcgccgctgaacagacggatgagagaaactccgtccgattcattgggtttaattgccacagccaagcggaccatcgcagcattaaaactccgattggatgggagggaagtcacacaaagccaattttaattgattttaattgccaattttaattgattttaattgtcaattaatggcatttgtttaatcatatcattaaatatcaatcaattttgaaagtttcatttcgggttttcctccgtttttcacaattcctcgtgttcctccgcctttgggtgtccaaatgtgcctctgattagattgtattcgccgtacgtctcggtcagtgcgtgccaaaacttcagtctccgaatgtccgcccgttctttcattttcggcttcggtccgtccaccagcaaatgtctcatcggttcttcttggttggccattctccaattggccatcatcagctcactttggggctgcctttgtccatttttgaattttattaattcattttgcctatttttaccctttcaaaatgaaatttgcgtatgcgtcgacgagcatttccaccgtccgtttgcttttctccgtaatattcgcgtgtttctgtgccggttttgtgaacatcaaattgtgatctgagccgtggaaggcccctaaaatgcttatgaaatgccaatgttcgctttaatttgatggcttttcgcttgcttttcactgggatttgctccgcaatgtgtgaaggctcaaaataggcattttcgtacagccaaattggccatcccaaattgattttgagccgcgactcccaaacacatggcattatgtagtgcaaatcggtgagcacctttggaattgttcacattttcgaggccaactccaaaacttcgctaaattaccatactgtaccgttccaaccaaaatgcattgtctttttcttttggcatttcgtattcatcgccaaaaaatttgacaattttcgcttggacttgtttggcgttctgtccaaagtattgctctttggccacaacttcgcggacgaatgcctcaaaatcggtggccccataagtgccaatcttttcactgggcacgacatattgagtcaaagaatcattttggcgctgaataagtgctgaaaaaacaaagaaattggcatttgaatactttgccaatttgcttactgtaaatgagcgattccaattgggaaaagccgaggagagtccgtttgggcggggattcgtggatgagttcggggaagtcgcgggggaagaaatggccatcgaaacgggggccaaatttgcaaaagttcacgtccgatcgagtcggtccctgtgaaacgaaaaattgaaaaacaaattcaattcttttcagcagcagaagagactattttttcgatcgcattgtgcaattcttcgacgcttttctctcggagacattcttttaattccaacgaatcgtctaaaattatttaattaaatactttttaattaaatttttgctcattaaattaaaattggttcgtctctttaccggtcgggcagttcagctgctgtgccaacactttcgtctcattagcgaccggtgctcctgtttttgtttgtgccaaaattgtgccactaatttgaattgcctggtgaaaaaggtctaaacaccaagtgccatgtttggcaattgtccattcgctgcccatttgcctcttgcgaatgggcacattccgagtgccgaaactgcggctgagccggcactgaaccccagcaaagtgatccgtcgcgggtcgcccccaaatgcttttgcctcggaacggacccatcggagcattgccaaaagatcccacaagccgagattacctaaaacgagaagtgctttcaaatattgagcgaatgtcaccagcatttaacccacccggcattgtcttgtctccgctggaggcaaagccgagaatgccaaggcggtgctgcacaaccaccgacataatgccgcgccggacgaacttctcgccgatgtccgagaagtcgtaccgatgtgccgagccaatttcaaagcctccgccatggattatcaccaaaatttggctcaattttgaagcgttcgcttcctaaacccaaatttaacaattgataagcaaaaagggaatatgggcttcgttttctggttgccttgtgtggagtaatcacattcaaataaaggcaatcctcggaaaagctcagttgggcgtcgtcgttcgcttccctttcggagggccgcgcgtggggcacacaagcggaagcggaacggaccgcggagcgcacaccgtcccacttttgaggcggaatcggcttcttcaatattaaatattttaaattaaggcgttctgggccactaaaggtcccaaaccccttcctaatgccnggcaangttgccgtnctttcccccccccccccatttgcttaatctgcgcatgtcacttcaaaacgaagcgcaccgacgggcggctcggcgtaaggaacgcccaaaaaaacatcgacaaaattcggcggagtcgcgcagagaatggacaanaccgcgaagagagcncgtaattttgtgtganccnaaaacggggaagaagaagcaaaacgggggaagtgaacgg

SEQ ID NO: 7875 - DNA, 1759 bp, Heterodera glycines
ggagtatcggcaaaatcccgtcaggagcaccggtccctgttcggtctctaattcttattgaaattgatcagagaatcgctagattcatgatgtcatggttccagataagatctgaatgtgatcaaaattaagaatctcaggttcgatcgtgcacgaaagaagaagatttgctctttttctgtgaccggaatccctagatcaaggttagatcctcagatcgcccgagtttctgcctagatcgagattaacgaactgataggcgcaactaattagtcccataatcaactcactcgccgatctcctcgaacagtgtgtaatattcggagaagcgttcgaccctatgaattaggatgccgtcatcgcatcgggaaaaacttcgcccaagattcgtcaaaatggttcaactcatccacatggaacgcatgagaagcaacaacggcgtcggtgccggtgccattgatttcggagcaatcgctggaccaattaatcccattccggacccgcaaaatgccatgtttactgaaaaatgatttttgtattaggcatggattgcgtagggcgctcaagcggaatcggcacggaccacagagcacgcaacatagcactgaagagccggaaacgacttctctcaatatgaaatattataaatcaagccgtatttttccactaagtcccaacccttcctaatgccggcaaagtgccgtctttcccccccccccccccccatttgcttaatctgcgcatgtcacttcaaaacgaagcgcaccgacgggcggctcggcgtaaggaacgcccaaaaaaacatcgacaaattcggcggagtcgcgcagagaatggacaaaaccgcgaagagagccgtaatttgtgttgaccaaaacgggggaagaagaagcaaaacgggggaagtgaacggagaggaaaatggggaggagaaggaggggaaagaggggaaaaagagggccaattggcatcgatggcaaaaagagggaaattaaaaggggagaaatgggacaatggcaaatgggcaaaatggcaaaatgaacaattgccattgaacaccagcgaagtgagtcccaagggattcatttgctgatttaacccaataaatgaaaacattgagaaaataattaattaaatttaatttaaaaatattcttttaagaaattttaacattttcacagcccactttggatctgtctttttatgattgaatcaaattttaaatttaaaaatggtaaaaagaatttgcttaataagggaaactaatcagggagagagagaagcatttggtaattaaagctgattaaataaataatcgaaaagaatttttcgtttttgtttaactcgcggcagagatggatttatccaaaagtttgaataaatgtataattaatttagcaaatccctccggctccccgccaaactcgtgcccggtgcacagcagttcctgcttatcatattcatattttacataatattttgaattttttttatctaagttttgttgtaaattattactttttcagaaggcaataatttttgatgagagaaataaaaaaccaaaaaataaattaattcaaattaactttttgtgctttttcggtttaaagaaattcttttgtttttcaataaaaacttagctccgtttattttttatcaacagaattggagaggaaatggaggaagaaaaatcaatcaaagaccaaattaattacaataattaggggggggggggagaaatgcatttttaaggaaataa

SEQ ID NO: 7876 - DNA, 5552 bp, Heterodera glycines
ataagtaaggaaatcaacgtaaggaagggaacacctttttgttgcttggaatacggtaaatcagttattagggttaactttttcgatgtccaatttttattcctttttcggtggagaatggtgtccgaaggaatggcaggctcatctgcgcaaaaagcggcgactcgggcgatttctagtctcagtcctgctgtcttctatgttcctaaaggcgattgcaagatgctgcatatggtgttcaaatgttatcagaagcggaccaatatgtcatcaatgtaggagatcacaacatcattgatcactccttcagtacaggcgtgtcataaatcgttgaaaagtgctgacggcgttagttaagtctaccggcataaccacgaactcaaaaagggcatgttcggttgtaaaggcagtcttttcaacgtcttctttatccatttttatcggagcattgaacggtcatgaaattcaagatacacaaaaacttttgaacccttaacactaagggggttttgtctatgatgttgaatccatgtggaaaaaattgaagaggaatttcaaacagcaatttgggaacaagactgaaacttacgacacctacttcccagaatttatttggcgtcagcgtttcggtgatcgtgaaaatgttttttataatttttggctgcatgtctctgagttttatccatgcgaacattgaatttttttttgtttttttttttcttttttcgtgcgtttggagcgattttgttggataaatgtgaatttcgaaaaatttgagttttcgatttttgttcgaattcggatcaggggttcggaattgggtgaaatggatgccatattcgtgctcagcgaccccgaaaaccttataataaatatttttatgacttttgaaattttttaaaaaaatttcaaaaaaggtgtgataccatcggtactattacccgaaaattttgaattttcgactttttgttcgaagttgggcccgagaatttattaacaaaatgcaagaggaaaaatgcacccctaatgatttttcatctccaaaatttattcatttattttacaacgagaattattgattttaaattattcaatactggtctggcttctgggaaacatttgttttcctcgaataccgcctggaaaggcccaggaatcgagtcgtttattgacaagtattatgcataacaactgaacatgtgatacagacttgcattacaatatattcactgtacatcaaatgtcaaaaatatcgtcctcattgctccctcaaaatcacaaccaactgcagaattgccccaagatgcccttccgtttcctagcagcattgtactgtgccaccacatcatatgccttgcgattcgcacgcgtggccattccgacagggaggcacagttggacggcggactgcatatcacgaagattcatggtcttgcggcggttatagagagcaatgagcgtagcttccgctgcaatgcgatccatcaaatcgttgaggaacatgaaattttgaaaaaattggatgaaaaaaattaaaattcattgcttgagcctttacggccgaaactcacgactccatgatgttcaacacacgcgttgagatttccttgtccgggtgagtttgcttcagcatccgtcgaacgtacagctgaaataggcggggggggggggagaattacccaatttggttgttttttaagcaagttgtgaactgtaccttgtacgactgctttcccgcttctttccttcgtcgtgccattttgataggtgttgttgagaatggtactgttgatgaacttgagcaaaactgtctgtttctgtaactgaaaaaaaaatgacaatcagaaaaaagggcctcagaaattacgcgtgtgcaattgacggtgctggcaaaagtgaatgatgaaggggatgaaaatgcaaacataattctctgcttttatagggcttgaaaatgagtggctggaatcggtaactaaggcataacaagttgcttataaatagcgcgaattttagcaatcattttctttgctgtatttattcaacagtaaatcaagttgccatacaaggaacattctaaaaaatattcatttttcattcgcacataaatttaaatattctaataaaaaaggtataaagtaaatactgaaactttttgaaagcatatcagagatattgagtttttctttcgctttttctcttattatgtatcagttgcagttgctcagttttctttcatcgttttcgcgctttctgtccacagcatcgattagaaagcctccacaaatctttgccgaaatgtgatttgtgttcttatgcagagaaattgaacactgagagtttaataactgaacccaaaattcgaccaatttggcaaatcgctgtcgacgctttgtcagtgcttcggaatctacagagatttgcaggagaacctcttcagtattaaaatccattcttttgttgctgttgtgttccccattttcacattggagcaataaaaaacggaaagatgatgaagtctctgacgccaactcaaattttttttctaaataatagcaaaatgaaaaagagaaatttgaccgaattaaaccaaggttagcttggcgctcctttactgacttgacccgatctttgatttggcctccattcactttaaatattcggttctttccaacgccgtcattctcataaagcatcagaaaaagtgcgtcacattccttgtggaactgtgaaatattctaattgaggaggattcatacaaatgaattcacggcccacctccccgattatttctttgaatcgtcgtgcgttgtcaattctgagtttgtacgcattcaatgcgtttctcagtcgataaattcgcgtttcgactttgtgcaaggattcgcccaatgttttaagctccttcggtttttcggagaagccattcgcttgacactttctctccaattgttccatttcgtcgttggcatttgccaattcgttcaatttttcctgaatttttttctaatccattctattcgtcctcatttgacctcagtttcttctgtcagtcttatcctttccctctcaataaaatccaagtaaaaaatttctccgctgaatttcgtccaaagttttttccagcagtcattcacagccgtaagtcccctttctccgtgctcgcctatccaatcaaggagcagtcgcaccgatgcagcaacacgagccacagagagttcgtcgacacatttctgtaagtcgacacgtagaaaagtttgatggaaaacccatctgaatgtctgaaatttttgtgtcgcacctccgccggccaaatgccgccgttccgttcagtgattaacccgacacttgagctgcacgtaatttcaaattcgcgttctttttgcgttttgttgtgacgtccggttgataataatgaattcattgaggaaaaatccgtaaccgaagaagaaaggccattgtaaataagcgaatccctttgtcgttgtgcgatggctaaaaataaaatgcaaataaattacaatctaaacaattcactcatttaattatttacaaattcactactttttgcttctaccaaaggtctcgcatttctcgcacatccaatatttgccaacaatttgggttgttcctccctttgttgacctttttcttcgaaaaaaccaccaaatttttcctgtgaaagcatttgattttgattctgttgaacaattggcatcagcgaagtcggagaaaataccgaatccaaatcgtgttctactaattcaattaggattgtacgatctgaataaagtggattttgaaaatcaaaattgactcaatggcctagtgctcacaagcatacgagttcattctctttttagacttggctcctcaagagctaccgaatgataaatttattcggtttcgatcgtttataccgtttaatcaacaattgttcctaaattttgttaattccttgctctttgaccttttctcatcaggcgcaaaagagacgccgttgaaacgttcgcggaaagacttcccaccgacaatgaataggaaggattggcagcgaaaaacactgaaaatgcctaaagcgactgttttagagcgggagagaacaatttgcctgcttttttttttgtttattaattaatttttttttcattatcacattgctacggtagccctgtcaatggtacggtaatgcaaagttagactgatgagaaagtgaattctttgctgttgtgtcggttacaaaatttgtctctgctttttccgctttgttcaccttcttcgcatcgacccatttccccgctcgcatttttccgcgtcctttgccaatggcgccgctttcgtctgtatcggccaccaacgatttgcgttgctgcctcctcctttctgccgttggcttttcactccaaattgactgtaaatcgaacagagtcgccaaaccgatgaaattcaaaagtttggagtggggacaaacgatcacctgacaaatgtttgtaaaggccaaccaacgaagacttaaaaagaaaatcacaactttttctcactttgaaatcgtatttctcatgcaaaattacgtccagcgctacgcgatgctgaataaaccaatcttgctccaacagaatgcattgccgaattttataagccaaagcgctttgacatgcgcgaagaacgagtcgtaatgcctaaaggcgcctccgtgactaataaacatcattaatccattgtgttttaatttataagtgcatgcacaacaacagactttcattggcactttgggcgcgtcgaggagcacggtgatctgttggtccatggccaaacaattcgcagggcattgaattcgctcagcggactcatcagcagcattttgagtgaattcgcgcgaagaaaagacgagtaatgaacaaatctgattgcatattgaagccgtggaatctgtcatttacatatgttggtaagaggttaactttaggtggccccgtttagcatgaacacctgccatgaaatcattggtctccgactttttggatcggaattccaaaaaatgtggaattttttaacagcacccaccgttaatttatattccccaatcccttcccctggtaattcacacattgtgtcacagcagcactgttgctacgcattatttctcgaaaacagccagagttaagcatcaaaaagatgagattatcacgaggcaaatcatcttaagtgttcttttccatttttatcaaaactaacaaattaactgctgataagcaagctgttacaactttgctggatatctctggcattttgaggctgcaaaaaagaaagtgatgctcgtttagagctgttattccgtaacgtgaacattagacgtaaatttgttttaaaagaggaaattgcgaatttggaggataaattttgaattaatgaatgttattatgggctgcatttgcttttgatgaatgataaatcccgctgattgtgagctaccgcaaatcccgtccgattactgccgcagcgaatggaaagagggcataggaaggaacaatcccatcccacaacaaaggcga

SEQ ID NO: 7877 - DNA, 2884 bp, Heterodera glycines
atttgttattcaagtgactaatgtatattttaggatcaagaaatgattatacatagaataaaaaatatattaatatgtcaaattatataggatttaaaattgtttataacaattaacagattaattatcctttgttacttttaaaacccaatttaaaaatccatgtccaggcctgggcaagccaggatttttgctggacctgggtttcctggatttttatgcataaaattgtggttcagttccaacattgaatttatgtccagcaagtccaggcttttttcaaaatactgacctccctcaagcaaatatttttcaaaattctttttttctaatttattttcttacattccttcctcctttatttcgttgtttatctgttccatctcttcaacatttcgtggttccttcgaagctggtggcgtggcaatcacaaataataggaaaaggaaaaaaatggtaaaaaataaaagtgatttcataattttcctggaatattattgttttataaatatcagagcataatcggggacaagaagacaaaaaaatgtaaaggaagcgccaaaaattttgggaggcctaagcggaggtttgtcttaccaaataccaaaagaattgaaaatcagagggtcaaaggcctttcgtggcaatttttaatttgagatttttaagtgattgcaattgcaatatgaaacattcatttaaaaactgcttatttgatgatattttgtaataaaaaaatttatggatagagtgaatgaatgtcttagttttcatttgccttttaaacaaatttttaaggaccaaattctcatgatcatcaaaactgaggacatcttagaacccaataatgccatttccaaatcaggacaagtttaaaacattgggacatgccaaaattggcaatgattcctcgaaattccggacatctcaggatacacgattgaatatttctaaatcaggacgaatttaaaatattgggacatgccaaaattggcaatgattcctcgaaattccggacatctcaggatacacgattgaatatttctaaatcaggacaaaataaaaaattaggacatgcaaatcggcattgcagtaatgactcattttttagatttgccttgatttggaaatcggaaaactgatgtcttgagatgtcaagaattttgaggaatcatacgaacccagaattacaacaatgccaattttaagctgatgtcctcagacgtccgaaaaaaattcataaactcgctattctagtgtctaaatttttcaattttgaattttagaaaaaattatttagtttaaaaatatagcataattgattttttccaaaaaattaaaattttccattccgtcacattaaatattaacattttgagtttttctttaatatagcgccaaaaattttctttcgaaaatgtttttgcaaagaattgaaaaccaatgggtcaaaggctgagaaactcttggaatttttgacagatttttaagagatttgcaatattaagcattcataaatagtaaatgccttttcactcataattttaacaataaaataaaaaattttatggatggagaaaggataattttattggcatttaattacaatttttgagtgccaaagtcttatgattctcaaaactcatggcattttgaaagattttaactatccaaagtgacaataaaattaacagaaaatgcataaaactgtaaaaaagaaaattaattaatcatttttcatgtaacagttttaatgagattttttttagagattttcatcatttttcatgtgaaattcataattatatttttattaaaaagttttgaaactttccgtctcgcctctgaaagctaataattaatccaatggttttttgaaaatagcttaacaaagaaaatacaaaaaaagtttatcatttaaaattataaattatacagaattaaacatcttaactggccaaaaaaacaattaaaaattcataaaataaaataaagtggaaattgacgtgatgaaagaaataaatgtaattattctttatttgtcttgctttttattcagataatttctacttttatatgcaaataaggcaccagtggagcccttttcagtgatttatcaattttttaattattcaataaagcaccaatagatagagccctattcagtgatttatcaattaaggcactaatagagcatttttattgtataaacagtgatttatcaattattttattttaaattaataaggcaccagtagagcgccctaatctgtgatttatcaaatgggcacttcgaaaaaattcatgaaaaataaatatcaaaataaattttagttaaaatttaatgctagttaattttttcggccttcaaaaaaaacatgaaaattttgaaaactttttcccttatttttttaatttacccaaatatccatccataaccgggctctgttaggtaccatgtgatttcgtcagtaagggatttcgtccgtgataataattatttttttacaaaaactaacttttaatatttcataaaataaataatctaattattattaacttaaatatgtagactcaaaataaaattctttgctcgattaccaacctataattcggccggtcacttacatatattaattaattgtatttgtgcctagtctttgctacttttatctcctgtatattgttaatttctagatggtctctagccattatcattctatattaacctcggaatttcacttctaaatttcttactattaattttgtctttccgcattttgagtttgttgattgccttgtcatgttttctgcctgcaaatcgaagccacattaaaagcgtaaatcagaatgagttcgacaggacaacaatttgagcatactt

SEQ ID NO: 7878 - DNA, 3228 bp, Heterodera glycines
tggtgctaggtcgtttcgtaaaaagtgccactatgggcgtttcgtaaaagtgccaggtcgtttcgtaaaagtgccaggtcgtttcgtaaaagtgccaagtcgtttcgtaaaagtgccaccttgggacttttcgtaaaagtgccactgtggtcgtttcgtaaaagtgccattataaaaatatggttgagtatagagttatgaattcaaaaaaaatttaaaggtgccaattcaaaagtgccatcacaaaccaaaactttacagtggctatttttgggctccaagtacatataagtttattatttatttagtaatcagaacgccaaaactttgcaaaacttaaaatttttttgggattttcccttgtaaaaaatagaaatagccgatctcgaattaaaaagcattttggtaaataaacaaagcattatcctataaatggagtaaaaatatgagcctgtgcaaaatttgaaaaaaatctgaccctttggtctattattgaaaaagttataagctaaaaaaaattcataaaatcaagggtaaaataaaatgtttaccttttattgttcggtgcatatcgattcagtgccgacgattcagtgccgacgattcagtgccgacgattcagtgacgacgattcagtgtacgttgaaaaaccgacaattcagtgtcagaaaatttggcaaaaaaattccaaaaaacccaaaaaattgcaaattttattaattggaaaacataaataacgcggtcggccagtgtaattgttgatgagggccggttccgtctcaaatatttttggactcaaattttttaaaatcaataactaatttagaaaaaaaaagtaaaaattcttttacttcgcagcctaccgcagcctaaatatacctggttttttaaaagttgtggttaattaaaagtatattcgaaaataaaattttttgaaatgaatttaacattgcaaatgtccagtaattctgctcgggattctcagtcttggtcctcgtgtcgggaaatttagcagccttaatgtgtccagcactttgtttgcagcgaatccggcacccattttggaccccgaacccggaatataaagattaatttacataaatttcgtctaattttcaaaaatacaccccctgagaaatgaaaaatttcctcaaaaattttgttattttatacgcctaaattgaaactttaacacctattttgaggtttttagaaccgaaaacctaaatattttggcagtttttagttttgaacacccaaaaatattaggcatattaaatatcagggctgccaaaaacatgcaaatgtatttttttcctgccttttccatgctataaataataggaaaaacacgttctttttttgtgtttgcgtagaaaaatcggtatttttatttgcatattttgcatatttcgagatttttgtgcatattttggctacttttcgtgcatatttttggcagcactgttaattatatctcaactttctgttcacattctgaaatttaaaaaaatttgggtccaaaaatatttgagacggaaccgactcttttactactaagacggaaccggccccagatttatttagcatagagtataacaatacagatcaggcagaatttctaaccactcaatttatattgtatttttagtggttttttgaaatttttttgccaaattttctgacactgaattgtcggtttttcaacgtacactgaatcgtcgtcactgaatcgtcggcactgaatcgtcggcactgaattgaccggctccgctgttaattaattaaaaaacaatttcattatgccaatttaaaatatttaaaacaacaactaacaaacgcaaaattaaatgccttaaaaacattgaattttctaaattgaaactaattaatatgtatcaaaaaagattttaaattgggcaattctctttaatcgccactgccaatgtctttctttgacgccgaggaattgatcgattgtctccgttacaatttgacactgcacgacaactcatcagcccatctcagtgcacaaataatccaacccccgcggaggttgctaaatttagggttttttcttaaattattattcgcctcattagcagtttgtgcgtcccatcattatagcgagtagagttcgacttgagacctgggtccccaggcctggggctacttggttttttccttgaaatgggttttcctggattttttttttgtccagaaagtacaattccaggtcaaacattgaacaagggccagactttttttcaaaatgtcgaaatctaattcaaagagaagcaaaaaaaaaaccaccaaatatttaacaagatagtaatgtgcgtttttcctctaaaataattaaattattttaaatttgtttgaatgataacgacgaatgtgtctgggtacaaaaagttggctaacaaaaattcattcggctcacacgcaaatgttttaggctttgctttaaagccccccagtgttatgccttgtatatgaatctgaggtttgcccgccctaaaaatacatacaaatggtggttaatagcattggtaatcgtccttataatttcttttttcactgattttttatttcaaaaagattttcgatgttccgttaaaaataatgtttttcctctaaatattgagacgcataaaatttgttgggattttaaatatgtaatggggcgcataatacagaaataaatcaaattagaaaactcgaagatttttttttttcaaattttcaccctaaggcgtgcaccagcggaaagtttgccattagaattggtgctgaagggaaaggcaaaaaatggaggaaatgatgatgatgaagatgatgatggatgggactgttggctggagcaggacgagaaacggcctttgttggtattttttaagagaaaaaaaattaatcaaattattttgagttaatttatggaaaaactatagaattgggtccgcaaaaaaaccgcccaaaaagggttccaatcaatctctaatgacctctaatcatcgtaaaaaatattcccgaggtgcggaaaaatcaaaaaaccggtttttgcgccggtttaaatcacgaaaaattgcaccaaaaatcagccaaaaccccatttaaaataaaaatttccaaacaaatttggtatcatccgaaagctcttgatgaactaaatctaaaattcaagaaataaaatgaacggatgcctgacaatgataggttttgaacggt

SEQ ID NO: 7879 - DNA, 1045 bp, Heterodera glycines
  misc_feature (1028)..(1028): n is a, c, g, or t
tctgtttctctgcttttcatcgttttctcctctttttcactgttattgatttattccctttccgccattccctccaacgcttttgcctttgtattttaaaagtgcgttcatttcatacacaacagacacatgtgtataaaccacacaaataggacagcaaaaggaagcatgcttttcaatttattgagggcattacgaaaacaatgagatggacgattaggacatcctccaccaaacgcccaaattaaaattcaatgcttttgctctattttaatggaatgtttagccatttaaaaattctcttagcttgcgcaattaatacaattttaagcaatttctttttcctgtgttttaaacttccttttcgaaacaactgatatttcgcaatggctcgtacgaaacaaacggcacgcaagtcgactggtgggaaggcgccgcgtaaacaattggcaacgaaagcggcgcgcaagtcggccccgtccacggggggcgtgaagaaaccgcaccgataccgtccaggttgtcaccaggaacattttgaattactcggtcctatagaagcgggctttacttggcaacaatccaattttggccattttgacccaaacttgaaaatagagatttatggacattataaaaacggcatatgattatgttacaaaccaatacaattgcatgaaacccttttctttgtagggaccgtcgcactgcgtgaaatccgccgctaccaaaaaagcaccgaactgctcatccgcaaattgcccttccaacgattggtgcgcgaaattgcccaggacttcaaaacggacttgcgctttcaatcggctgccatcggcgctttgcaggtgaaacagtttatagctaaagaatcacgccaaaatgagtcaattccagtccaatacttttgattcaatgaatcacaaaaatggaattactttccttaattttaaccaatttttgttttttttcatattatcagtgatcgcttattgtcagcatgagaatattgtacccggtgaattaatatnttccctattttaggagg

SEQ ID NO: 7880 - DNA, 2919 bp, Heterodera glycines
cttttattttatatttcaacattagtgtactaaattaagtaatattttggtgattttcccttcccggcacctttcaacacatttttttattaacataaaaaaacattagaaagagcacaaaattttctgcctaaatttgggaagagtgagtttgggtaggggataagagaaacgagagggaaagggtgggagagagagtacacatagagtaggattccagagaaatgagagggaaagagagagctaaagtaccattcgtgtaactctagccttgtctactcccattccaaatagtaataattattttcttcttgccttctccttgctgggcacacacccacccctcatgggtttgggacctctatgaaaaatactttttggaacggggccagtccgtaatggccctttaaataattaattatttcattaatgaagcaatctaaactttggaaatgaaacgatcattttcaatatccggcgggagtccaaataagaaattgattcatttataatgcagtcaaaattcaagttagtcagatttaaagcaataaaaaattttttcaccaaaataaatttaaaaaacattaaatttgctagttttatttcgtgtgctattcgcataaattgcgttcgttcattgacttttttggtctttgtaacattcgcaagggcccggctctccgtcttcgcccgcttctcccggcggtccggcggggccgggcggtccaatgcttaaattccaatatttttgttaggtacccctcaacccgaccgattaattaactcatcaatgagtttgaaaatagtgttgccaaatacaaaacaatggtctcaattttgcactttcggtactgtttcgcccacggcgatttgcccaaaaacgaacccatggcgcacaatttggcgtttcacttcggtcccctcctttgcagcattcagcaccgtctccccacgtttgtttctgttagccagttgtttgccatcgacgctttgcgcttcgcttttcatgtgcttcgggcatggcgccgggtctccgggagggcccggaggcccgggagtgccaggctcccccgggggacccggtggacagccccccttgacatggccacgtgcaaaatgcgtctttgcaacggcttctccttcttttgcacgtttgactggcacattcggttccaaattcgtcttaagattaaaaggtttgaacaatgattcggaataagataattagtatcttttggtactattaatttgattttccaactactgatggcattcatttgcccagttttcgctcttttaccataaactccttcggcactgctgctgcttcccttttgcgtttgctcgcattgtcgccgcattttccctggggccccttttgccccgctgggcccggtgggccgggaggccccggcgggcccggaacacaaccggagacgggcgtggtcgtctcctctccttccggcgaggtcactaaaaagggatgcggcgttaaaagcacactaattgtaagcaatattttgaattttgaacggtcgggcggaccgatgtcgtcagtgccccctcccccgcccgtcgaaggaggcgtttcagacgtttcttcggtgggacattcgcatgggcacaccggcgcagggcattctggcggaaaatgttcacattggaaaagcaaccaacaccaattttttttttttttgaaaaaaccggtgacagtcagaaaaaaggaaaagcaattgaaagcggattaattaataattgaaacccgttggggttgtcaattctgtcgtttctgtcgtcgtttcttccgccggcggattgtattttgttgacgctttgtagcgacgagcgaatccgacatcaatgaaatggacaaagaacagaagcaaaagcggcactaaggcccaagtcggtggcattttcgagaatgattaaaaaagaattctctttagtgatccttcgttttgagaataacttttcttttatgtttttgtaaacgatcaacggccttttaaatgcgtttttcgccatcttttaactttttgacattaaaaatatcatttttgggagcgtttaaaatggcaaatgaatgacaatgtttgggtgatcgacaagaatgattgaaatttgttcatgcttattcataaaaacatcgaaaaaaagaaaataacaaataaatggcggcgattgggcgacaaatgcccacacattcaccgaaacgaaacgatacaattacaaagcattttcaaatgatgaataatcctttctttcgctggaacgcaatgaatcattaaacaatattgcctaaaacaaaacaaaaaatattttttaattattaattgtaatatcgaatttttaattttgtttttcaaattgaaattgaacatttcgagagtctcggaatatttccaaagattctccgcctctgcgcgaatcgactgcttctgcagttgtttaattcaacatgtatttaatccgttcttttaaagtttttcagtctttggaattcaaattcaaacaattcactctcttacatacagtaggtataccatagataccgtattctttataaatgatgaattaaaaataaataaaagataatttttgacaattaaattcgtcaacattgaataatcacgctcatgctcttctcattcttcgcatgttcggccaaatgatcagccccacgaacccaaaagtccgccgccgcccggctgcaaaattgtgccgcttgagaagccatcggtgaagctgaattggcgcttctctcggggggacaaagcggcgaaggacaaaaatgggaggagaagaagcagaaacaggaaaagagagaaaagagtgaaaaggcggatgggggaaggcatcggagggttaatggtggaaaattattgaattaattcttaattagatggtaatggatag

SEQ ID NO: 7881 - DNA, 1370 bp, Heterodera glycines
gtaaaaaaatttcaaaatttattcaattttgtgctttttttataatccttgcctctctcctccactcaaatttatgaatttatatttttttaaatgtattatttttccattgctccaatggcttttaaaagttttattcctttttggatgaagtgattttggataattggatgacgatcaagtgaatgtaattagatcaataacaatttggtaaacaaagtcaataaattatgcacagagagagtaattttgggttggagagccgagaggaacaatggggcgggggagggaaagttggagcagcgaaagtgcgtgtgatgggttggggttggcagagaaaaagggtaaagaaatttaacaaaaattgaatcaaaaaataaattgaaaaattgtgccgtcgtcactgctctctaacacatccgttcgcatttcgctctttctctggttcacaatgtctcgttttctttgcgcttctctgtcccttccgcgtctgtgccaccgcctgcgccactcatcaacggaagttcggcggtgcctgtttctgaaaagggggagaaaactgttttggttccaaatctgactgatcagaatcggaatatttcgggattggattaacagtgcagcattttgatgatgtcatgtttcttgagttagaaaattttgggatgcgcaaaaggaacagacactaggctgatcagtgatcacttaaagatttcataactgactgatcagggaaaagtcaaaaaaaagtacgagtaatcagatcatcgttaaaggcagtaatcataatttttgagcctaaggatgaagataaagggggattatcagtctgatcatctcacaaaggagggggatgatcagtgagcatcttcctaagaattggttaaacctcccaaagaagggctttatcctcccaaagagggatgatcagtcttattacctccagaaatgctaatcgtttgacagttaaagctctaattgatcgatagctaggaaatgatcagttgaaggctctgatcagaattgaccgacctgtgccgcctgttgctgctgctgtggcacggcattgaccggtgccgtcggttgctgaaaagggaagaaaatgcgttgatgccaaatttgactgatcaggatcggaatatagattaatagcgcaatttcgatgatgtcatgtttctttataagttagaaaattttgtgatgcacaaaagggacagacactaagctgatcactgaaagcatttgataactgactgatcagggaaaagccaaaagaaaatacgaacaatctgttaatcgctaaaggcactgatcacattttttgagtctaagaataagggcaaagcgggattatcagtcttataatctca

SEQ ID NO: 7882 - DNA, 2710 bp, Heterodera glycines
aaccgacctgtgtcgcctgttgctgttgctgtggcgccgcattgaccggtgccgtcggttgctgagagtcggccgcctcctccgggaactccaactcccaaatgcgcttcaaatgtttgcccttcacgtcacgcggcgtgccaaagttggtcatcatcagcttctgcgagtcgccctcgttccagccggcctgggagggaatggtcgcctccgacttcttcatatcctcgttgcgctcgcccttctccgcctggtgctcgcccttctccgcctggtgctcgcccttctccgcctggtggtgcgtgccattgcccatgcccgcctggaggttcggcgttggcatctggacgaggaaattattttatttcacgtcagatttttctataaattttttcaaacttagaaatttcccaaggaaaaaattcttaaaaaattttttataagaaaatttcaaaaagaattgtttgttaaatttttttaaagtttttcaaaaaacagtaatttatcataaaattcaaaaaaattgctgaaaatttttcaaatttttttttcattaaatttttcttataaaaaaaatttctaagaattttctccttgaaaaagttttaagtttaaattttttatttttttaaaatttctgcggcgagattttgtcccgcccccccccccaaccctattgggtattaaaattggaaaacttgcttcgtagatgatgggaaacagcccatctgtaattggcgaaagattaaatattttttaatttttatttttattacgtttcgggaattcggcgtttgtatagctgaagcctctcaggccccatctgcttctgctgctgctcgtcgtcgtcgtctgctgtgcttccggcggcacttcggcacttttcggcttctcctcctcctccgttgtgcatttgtttctttcttaataaaataatcgaatgttatttaaagcattaaatatgtcaaatggatggtgtttacggcatctcttaacacaactaatgacgatccaaacaatgatcgctccggctccaatgcctccgaagatcgagccaacaatgatccatggcgaagtaccacctgctgaaaatgttcgaccaaattaaattttgaaaacaaaatttaaatatttaccaaaaaatcgtttaaaatgtttcaaatttttttcttggattgtgccatttccaatccaagtgccgccccgccatcccctgctgatgatcgcgcttttcccatctattaattaatattttttaccctcgactttttccacgtgcggctgctgctcctgttggcccaacgactgaaaaacatggaaaattgcatttaaatatatatttgttatggccacttaattcgccttcacatttacctgcgcttcggccggtggcgcactgctcgcgttgctcggcccctgtttttgtggttgtgctgcaattggtcctgctctgttctgctcatcacttgcgctgctgcctccgacgtcgttccccgccgacacctgccattttcaagaaatttgccatagaattaatagtaatgaatgagggatttttttgaaaaaaatttccctaaatatcctgctcggcacttcgcctgggcgcgagcaggtcatccccacctttctctacaacattttttaaaagtttaaaaaatatccatccgtaagaaatttaaaaaaaactcaaagattttaacgagagattaacgattattagtttttcttttggcacgagaaagtgtcgaaaacagtcgaggcattcccggaactcatattttatgactcttatcacatacatctaagtggtaagagaccctaaaaatgccagaaaagcgattaatttaaaaaagtattaacccacccgtggtccatccgctgcgctcggagcactgttctcgctgctcgactgccccggtttctgctgtgctgcttcggcctgctgctgctcacttccgccgctggtccctccttcgttcgccgccggcaacacctgtcaaaaatgaatgataatgatgtgttaatcgtttcatccatatcattttcatttggtgaacccaaaacattaattgttcaattagtgaaagggacaaatgtgccgaaaagcgccaccggaaaatctccaaattaggcaggcagttgctaattgttattttaaaattatttaaaaatggggatttctgctggtgcatttaaatattcccgtgacaaaatttttaactaccgtatttattcgattatatccaccccctcgattagaacccccccccccacctttcgaataaagccccccttttgaagggggttgaaaatagagcacccggaggcaataatcgaagaagtacggtattttgaaatttggaagaaaatttgattctatttcactttatgagtccaaatcttcagtttctttggccatacttttttcttacttggttaatacctatattcttggtatcaagcgaaagtctaaagcctatagaaatttttgtagacctaaattccgggctaaagcaacagaaaataaaattattcatgaatatattcaaaaaagctgcatccttccgggtttctccctgtaatcctttttttttgttgggggtcgcattttgcccctttcctttatttatgatcccggaccttaaagctttttgttcgaaaaccaaaaatggaaacattgaacaaattaaaaaaaaaaaattaaaaaccc

SEQ ID NO: 7883 - DNA, 838 bp, Heterodera glycines
aaaatgatttaaaatttatttaatattaaataaagtcgttagccgagattatttttaattttttgaatattttagagtttcaatggcgcctatactttccaaaataaagcctaagcatttgtaatggactttaaaatatttaagaaattcaaaagtaaatctggttaatgttttatttaatattaggtaaattaaaaaacttagaaaaatgtgtatttaagcatcaattaattaaattttaacatatttataatttaaaaaatataaaaaatcattggaaaaatcagatttttgatttttgcacttttttatgaatcgaccgacatacatagcaccgttacggacataaaagggggagaggacgcggtgcgcatttccatttggcccttttctttttaaatttaaactgccaccaaccctacctcgaaagtgcttttggtgtcatttttggttttttgttcattctggccgaattttctactagcatcggacgaagcgaaaaggtagtagaacatgatgaaaaaaaataagatgtatgtaaatttgttcattttgaaatatgactggaaaaaatcagtgattgaatatatttttgagtgttttggaattccatgaccgactgattggctgatcagcgatcggtatttgagcaccataccattgaatagatcagttgaccattgatctgtcaatgattagccgacctgacctggtttttttacttcttgtctggatcattttcggtctctgatcagtctatcattgacctagtacataaatcacagagatattcagggcaggagaggggggtggagtgatgaagaaacaaaaaaggaga

SEQ ID NO: 7884 - DNA, 6257 bp, Heterodera glycines
  misc_feature (22)..(22): n is a, c, g, or t
  misc_feature (3345)..(3345): n is a, c, g, or t
tcccattttctctctcttcccncggctcacttcgtccaattccatgccacccgtcgttgtcggagtttcgcttcctccttcgatgggttcgctctcaaagctcgtcgctaatcgcggctgtctcatgcgccttacgcttctgaacatgcctaagccgcgccggtcgcgctgcgaacgtctcgagaatggcagcgacggacttttgctgaccctcgcggcgaccgtcgccccttcgccgccgtcgccggacgcattttcgtcttccgcgtcctccaaaatggtcgagtcttggagagtgccggtcaaactgacctttggtccctaagcggagcagcaaattgggaatgagcaaagcaaattcagaaattcactcaaccccttgggagcgttcggcggattcgcccgatttggactgaatccagcggagtttgcccagtgcggtggagctaagtcgccgtgccgtggattcgctgcggttcgccgcagaagctccgcccagggaactgccggaatcgctgtgcaattcgccgccaatggtcggcgtgtgggagcggggcacttctgtaacattagttggctcattaaaggcaattaacttaaataattgcctttaatgaattaactcacccaaattgcgcgtgatgaagtcctccctgagcaaatacaattcactgtgcagtgaacgaagcattgccaagtgacttttcctggtcgggtccgatcggacacgcgcaattctctcacgcaattcgcccacccaatttgcatcgatgtcattcactgtccgttggttgagctgagaatggaaaaggatgaaaagcctaaattcgacagaatgccaaacccaaaaactcaccttattcagtacgatggattggagcagttcggtgaccggcagattagtgccgagcataaacttcagaaagggactcagcgcagcaccgccgcactttttggcgacgatttcgcgcactaattaaatagggacaacgaattgacgaacttatcatcattatcattcattaccaattcgcgcaattcgcatccattggccgatggtcaattgtttgtggaaagcgatcccaatgactttgattgctgggcaaaaaacaaatgccaaatgggccgtatttgtccatcaccatctccatctcactcacccaacatcaccgtcagaacgacagagtcgcgcattatccgagtggtggacactgtggcggagtatccgccgcggtcggtcaccgaaaccgacccctgacgacctccggcagtgtctgaaaggcagaaaagttaaatcagcagttttgatgggaaatacccttcataagcgaagttgccaaactgctgccactcattgccggcgccacgctttgcttggccaaagagggcggagaaatggcattttggagcagactcagacaaaagttcaagtctttgggccggaactgtggcgcttcttaatttgggtttgtgaatttgttaatgatgttaaaacactgccaccacctttgccgggaattgcggcacgcaaaaacattgggataagaaattggcacagaattgcctcgggacgttccgccaatgggccaatgttttccacaccgcaaatcatctcgagcgaaaaaacgagctgaaaataattgaaaaaacccaattttaaactcaattaattgctttgagattttacctgtcccaaattggtcatcagaaaagaggtcaatcggagcacgacgttacaaaacgaagctggcggagagtgggcactgagcacagtctgtggggcgtggacagaagacaggtaagcgccggccagggcaccggcactgtgctgggcggacagagtgaaaggcggcacggtttggtcgtccaaaatgccaaaggggtcgccgagggtcagccgcaagcagagcaaagtgatggtctgaatgaatgccaaatgcatcgcccatccctttgacttgggcacaagccgatgtgacggcttttcattaattttggcttttaaccctaattaccttcagagagtgcaaatgtgcaatgtacggcgagttgagcagcgtttggtgcagtccgaccagccaaaaactgatgacgccccaattggcacggcgtcgcgtggacggccttttggcgattttggcgatggttttgtccaaccgacggagaatgatgttaatggcggatcggtttgtctccacggaccagtcgaccacgggcatcacttgcgtgaagtaatggcgtagcccagcacagcccaacgagttcgagtcgtacggggccaacttcaatagagcaacggcaacttcgctgagtttgatgtggcatttgtggtccaacagctcgggcattacaccacgactgtagtcgagaccgaccgagagtcgaccgagttccttcagacgctcggagccgagctgaacgaacattgaacacaacgtgagcaatctaaagcacacaaactgaaacaatgatggcattttgtgccactcgcccgtctcgcggccctctgaactgttccttcatcgcttcgttgtccgtcgcggctgtcgttgttccgtcagcggatccggaaacggtcagtttcttctcagtcttcgctgaggcggtcgactgctgctggcgactcacttcgtcctccacaattgtcggcggatcaaagaattgcggagagtcggccccaccaccgccaagcgaacgaccgcgacgcgggtcagtcgcgtgcggacgatttgcggaggatggcgccagcgaagcgccaccggccgttccaccgcctccgccgctcgcggccaaatcaaaggaccgggtcggcccacgcgcgagcacgtcgcaactgttgaccaaagcacgaagttccacgctcagcgtggcataagcggacagctccaatttaagcgcagcgagcgcgttggccgcctgctgttgtcgctgatttgtctcctcttccatatgccggaccaaatggggaagcatcgattgcatgcacaaaagcatctgatgggcacgccgactttcgggcgcaaacgcacaaattgtgctgcaacaaattcaattcggcttaaatgtttaatggccctaacgagcaaaaaaaaatgccggggaacggaaagaacggcagaggcaatacccatttcaaatgattgaattcgaatgcctgtttcggttgggaaccccagattcggctcactcacacgcagctggccatggcatcggtcagaatgttgaaagtgttcggctcgtcgcggtagcacaagtcgagcgcctgtagcggctttgggtggggcaacatggccaaaatgtccaattggtccaacggttcgttcattcgctccatggccaacagcnaagcgaataaatacttgggccttcacccgcatcggattagcctcgaaaatgctgtcgctttggtccaaaaggtccgcgcaagagccgaacatttgcagcagaaaaggcttccgatgcaacacgtagaactgcttgcagacgaactccaccacctaacaaagaggggcggggaaggttaattttgaaaaacaggaccaggatttaggaatgaaccaaaagggtggcactttttataagccggtctatctgctgctgtccctagattatgcaataaaattccatgatgtaaaaattaaccggctcttttcggcttagtatttttctcatgaattgggggagggagtcgtacatggcgtacccccccccccccccacggagggcacctgagtgaacattcggttgggctgtcgctggctgtagcagcggagaatggtgggcataatcagggaaaatccctgggaggcgaacagcgagttgaaatggatgctcatgcccaaataggcggccatgcatcggcgtaggatcagcacatcctcgcagtgaatgatctgacattcgttggcattggcattggcaccccaaacgaaggctaaccgaccataatgccattgatcacgttgatgaacagatgcaagtcgccgaacatgaacgcattctccatcttctcgaacatgttcgcgatcagcttgctccatgcgaatttgtgcagtgcgtccgtcgtttgcagttccgctccgctcgtgttttggtacatgccgaaacacgtctccaccgcgcggcgtgggaaggagggcaaatgcgtgaattcgtcgtggaggaagaaaatgcgctgcggaatgaccgcctcgggcgagtggcgcagggcgttgtgcgtcagcagcactttgcccgtttcgatcagcttctgctggagggcatgctcgcggatgcgctgctgcgcttggccaatgtccaaacggaccaattgcaattggggataaaaggagcggtggaagaagtaaaagtcgctggaaaagaagggcacataaaagcattcatttgtcattgggagggacggaccgaacaaaagcgcttgggttgtgcagtacaaacgtcttcggatcgtacagaaagaaatggtgcgcctcgtgtgcctgtatgttgtagaattcgatggaatccgcgagcaaatgttggaattgggtgtcctccaacaccgggaattgggtcgggatgccgccctgttgcgagtcgggtccatgcacaatcacctgaaagcagcacaatttgccgatgctgcctttctttttaagcattccctgagtcatctcactttctttgcgcttggcacattggcagtgaccataatggcctggtcgcactgctccttcttcagcgtctgctttaggtccttgaagtacagtccgtggacgaacggcaccaccaaccaacacaaactcagtgccaatgccaacgaacggtcgctgccttcgccgggggttcgcacgtaaaacatggccaagccgaacaacgcgttcaaaagcgtgtgcgcagtttgagagggcaaagggtggaaggaaagcacaaggcgacggagcagagccaacagatactccttgaagacgggggggggcaaagattgaaaacggagagaaaaagggacggggaatgaaatgccaaagggaaaacggattgaaaatttaaatgcagttccagttttgcttcacctgttttgctcggttggtgagtttttcgaagaaatgccgaagaaaaagtgccgtgtcctccacaaagcaactccaaatcacacgtcggcacgtttcgccaactatttttaaaaatgcataagtcccggggtacaaatgcctttctttgctccgggcaaaattacctgagactccgcttccgtccacttgcgcatcgtctagcagttcgacgatggtcggcacaacgctgagaatcgcagaagggaacaatggctgcgcgacaggcacaacttgtcgcgcctggtgaacgggctcaagcagtgcggggtcatcagcttgggaagagtcggcagcggtcaattggtgctggaacaacgccggttcataggccacctgcaaaaatgcaagaattaatgtttaacggacagatagtgccgggggttaaccggtaggcatatcgagagtctctgtctcggggaatcgtaaaaagtaagggtatcgagtcacactttcatgcggctgtttcaccgccacttccctcccccgggcaatgccctcccgctaattgatcattcccaggtagcagttgctgtttgcccgctcctatgatcacctgttgcaccaccgccgtcgctcggagtgggtactgctcgcgcaactcgcgctgtctctcctccgcccgtcggatggccttgcgcaccatctcctgcttctgcttgcgccgagtccgcgtcatggtcatgatggtttggctggtcgactgctcctcctccttcagcgacagttcctccactttggttttcactggtggcatccatggcggatcaaccaccggcaattggctcaaaccgatggacggggacggcaaagtgaagtcaatgctcgggggcggaatctgtccaatttggcacaaattttggccaaatcactcaaaaaagggcgtgccttgaaaatcaattgtgcgccttcctccattttcagccacacgtgaaatcgttgccgccacagaacgaaaaaacgctggacggccgcatttcgaacggaagggtcggcggaagccaattcggcggacattaaatcggaacactctttgggacatttgacggcacagcaaatgaataaagcggctgaaacggacggaggcacaattaaatggaaagcaaaaatcaaatggaaaagtcaccggcagtggccaccaaatgggaatcatccgaagcgatcagcaaa

SEQ ID NO: 7885 - DNA, 2270 bp, Heterodera glycines
tcgattgtagaaatttaattgtaagggaaataatgatcgaaatgctaacctccgccttttttgcgcgactttcttcgatctcattcagcttttcaatgatcagtccgcgcagtgccattggcattctgtccacgccgctttggcgtaccgtcgcactttcgcgacgcggcggattcgacgagtggcgtttctgttcaaatataaattataaatcaaaattgaatattaaataaatgtttttggctatctctgcccactttcgcttctctctgctggttgttttgccatcgctcaatgaattgttgccgtctgtcaattcgtccttcgaccgttccttggccataaaccacagtcagtgcttcgaacaaacgttggcattgtctggtgaggggggggggtgccaatgtaaaatgccatttggcaattttccgtccattttcaaattgccaaaacctgcaaattctctcgaagcaccatttggtgcaaaactgttcgtggggacagtcaaagtcgactttgcggccaaattggagcagtgtgttgagccagggcatgcttctgcacatttcctcctcgtcctcttccgccacaacctccgtcaaatgcttctgctgctgctgctggaacattgcatttgccgttgcatttgtactgctcgagtatcgctccggcgacgactgttgctgctgctgcgtttgctgttgcggctgagtgacgcggagacggccgtcgccaccgccgccgacggcgccgacattagctgagaagcggaggggagacaattaagcaaacgaagggacaaatcagcagaagcaaaggcggaggaagaagcagcagcaaatggacagcgaaaaatcaaagaaaattcaaacggaggaatttgaacaaacgaaaagccatcgaaagcaaaaacatttcctttttattttgtcacagaaagcacaaaaaaaaataaaaataaaaaaaggtcaacaaaaaactaattgtaagaaaaaagcgaagaatgggagaagcaggcgacctttgcgggcaatgctcagcataaaaacgggcgaccgcggcgcctcgggcggcgccggcgtgtggcgttgggcgcccggcgcggccgtcgcccgctgctgcatctgctgggagtgcgtgatgctcagcaacatctcttcgctcgcttcatcttccacttgggtcgctgttcggcccaatcgcatcgaatggcgccaattgggcggacgcgacacgcgacttttgaatgaggcggtccgacggcggcgttgcacaaaggaaaccacgcgaccgcagccgccggcgggggacaccaccgcgtccaacaggcaatcactggcattggcatggccagtcgtcgcatcgtcggtcaaacgacgcacgacaggcggcactttatgggaaaggaaaggcggcaattgaagcaatgggaaaagggaaatggcgggaggggggaaggggtaaaagaggcactaaaggagagagaaaacggaagaaagtgatcaggcagggagagtgatcggaaagagtgcccgatcagtagaaagagagagaaagaaggggaaagggaatgtgccgaaatcaaaggcaagggaaggaaaataagcgaaagcaattcaatcactgcgaaagcaaaaagtgaagcaaaaaaaggcaaaagcaccgatttattcatccatttatccatgcttttcctctcacctgctgcattttccgccgttttctgctgcacttcgcccatttcgttctgttgcgattgttctgctgctgccatttgcgctttttgcgtttgcgagggttttcgaagccttaaaatttataaattaattttatttaaaatttagctctttttatgtgatggaccgaagcgatgcgcgcttttttgtcgatccaacagtgtccaccggatgttgcggcacagtgccggcggaggaaggcgggggcgtttgaatggcaccgccagagggcgaattccgcttcaaaaggcgtttccgcccctgggcaaggtgtcgtactgaactcaaataaaggaaaataggaggcgagaacggcgaaaataaagtgctagaaagaaaaggaaaaagagaaagaaaatcggaaaaggaaaaaggcagggaaagagaaacaaaagggatagaaacaaacggaaaaagaatgagaaaaaggaaaagggaaaaggaagggaaaacgagagagaaaaaaaggataaggaagggaaagagaaaaaaagggatagaaagaaaggaaaaacaaagcgaaaaaggaaaagt

SEQ ID NO: 7886 - DNA, 856 bp, Heterodera glycines
  misc_feature (764)..(764): n is a, c, g, or t
atcattagggtgcggatttttaggggcgaaaaattccaatttagggacttaaataggggcaaaaaattcgcgaaataggggcgaaaaagtttcaaatgtagaggtgaaatttattaaaattgccgttttctctatgtaataagttaaaattaaggcaaacatcatcctgcgtccctgcttcaagccttttttctgttgatttgtttcgttctcggcttctaggctaattggtttgcttcttcccggcgtcatgcttaaatttgaacaattttaaaagggaaattattttaaaaatatttttaaaaacctatttaataataatataagactcacattgaagaattttacaaatttctgaaacaaaataaacattcaacacgaggaaataacagtttcttaatttattttgattaaggcttggaccggatttttggcacagaatccggctgaataaaataaggtttattttaaaaaaggatcagtcgcttggtaattagcggatttttaacgcttaaaatttttttttttatttcactgccttaaatgccgtgccggaggccccaattatgactttttttttttaaatattgccaaaatcaaatccaacaacaaacctttggtgaagtacaaccacattctggttccgtgtcatatggacaaccatatggacaccctcggtcaacgcatttgccgctgtcccattggcacaaattttggccgattgcgtttggtggtgataaaagcagaagcaaaaaacacattgngataatcatttgagaaatttgactaatgcttttcattttaatttttttgaaggatggaaatgaaaatttaaatttgttttcggccttgaaaa

SEQ ID NO: 7887 - DNA, 6501 bp, Heterodera glycines
  misc_feature (32)..(32): n is a, c, g, or t
  misc_feature (48)..(48): n is a, c, g, or t
  misc_feature (93)..(93): n is a, c, g, or t
aaaaaaaaattttacatgtaaagataagctgntcatcattatctaatntatgcaaaatatttttaaaaaatgcttttgaccaatctatgcatntaggtaaattaataaatttaaaaacaaaactttgatttaattaattgttgatttattttaattatttccatttttataatataccaaattttgcgttttatcaaattatatttttgggtaagtgatttattgaatttatatgaaaggtaaatttttaaagaatcccttagattttctcaaaaaaaaacaatttttttcaatttttaaagtttttctttaaattctcaggcgctgctggagaaaaaaaaatttaaattttcttttttagttttaagataatcttacacattaagttttatccaatttatgcgaaaatacaaagtaaaaatatataattttcatcattaaatgcatttaaattaaaatacattaaaaacattgatttaattaattgttcgttccatccattaattatgttcaatcccggtaaaagcagtaccaaaatgcatgaatcattccgggaatccatccgcatatccacagaacaatgttaatgaccatgtgcagcaacatgtcgtgtcctgaacattttttttattgcgattgaattgatataaagggctcccagaaaatgtgtcagtatgtcagtaatacatattttagcattaattatggtattacaaaaggtacaaaattgtatacaaatttagttcagattctttaaaaaattttatagattcaaaaaattgaagtttacccaaatcccaaaaaaaaatatctactgtattaaattttttttttgaattgcatatttttagtaatgtgttattaattaatgattttaaaaaattaatctaatctaaataataaacatttttagttgccaagaaatgtccatacttgcaatattgtgatccatttgatcaaacatttaaccaagactttggcttgaaaatttttcgaaaagttaaagttttattttttttgtaatggcattactgtacatctacagtacctccgtgtatcagtacagcagcaggtggaatgaacacacacagtatggcttccaaaatctgctccatgttccaggaccgttcattctggaagaaccgttttgctcttatcagttggatgtcaactgcgtcgttgccatcgacgattggcatagtctaaaaaagtaaaaaattctaattttataaataaaaacatttataaaataattttaatttaattaaaattattaaaaatttggcaactaaaaagtaacctgtggtatgtatatttctgggtcataaagaccgacacaatgtttattacaaataaagaaaaggaataagaaagacgagaacagcaacatcaatttttgatgaatatcttttaaaaataattatttattttttaatttttcaaaatttgtattaattgagccgatttaataaaaaaaaattattattatttatatacaaatacccggaaatatttttttaaagttttttttgattattgtgctaattgaataaattattaattattttatacattgctacgtttttgtcattttgggttattttcagttttaatttctttatttggcaaagtaaaatcctcattttcaaaattttttttttgccattttatgcacattttctgtttgttttttattgaaaaataatttccttaataaatattgattgaagacgtaaaatttattgcccattttattgcccactttttgccctttttttgcgcaaatagcgctttaaatgttcatcattattgcctcaacaggttaattgatcatatgatgaattaatttttgaatttatttttattatttttctcaacattgtcaaaaatgaaaacgaatttgagacattaatcaaattaaaacgcaaaattgaacctaaaaatggaaaaaaagacaaattgattctgattgcttgcttttattaaattaattgatgattgaaattggttttatacgggaacctgtagaaatattttcacgaaagaatttataatttagttaattattaaaataaaataatattttttataaattcgaaataaatagataatattttacggaacgtcaaaatgctcaaaatttcaataagaagtttattaaattttttttaaattttttgatttacttaagaaaattttctttttcaattgtaaaaaaaagtcattttaaaattgctgcaaaaaattctttcttaagttagggattattaattagtttaccgagtccgggcgtccgggtctgacacccggccccgtgtaaccctaacattataagttgtataattaagaaggataaaaattttaattttttattatattatataataaagaaaatattattttttaaaaatgttttctaaagtaaagtaaatttattaatatttttgaaaccttttttagaaatatcagaaacgcaatttataaaatatcattcattgaaataaaaaaaaaaactattaattttttttataaaacaattaaaaatgctattactggctattaactattcttaaaacaatttatttaaagagaataaataaataaataaatttaaaatcattcccgctaaaatatttttttctaatattttattttttatttaatgttttgtgccatacctttgggcgctcgccaatgttaatgtcgtaaatgcatgtgccaacattgataaaacatgccgtaatcatgcaacaaaacagtaaattgtaaatcattattaccgtatcacactttgataaggaatgaaaacctggaaaattttatattttataaaataattccgcgtgaatttttcaataattttatttaaaacttagaggattattagattctgctggattatcccaggcgaatgggatttaacaaatcccaatcgtctcatttgtccgccaatttttgtggttttcattcacaaatgtcaaatttaattttgtaaaaatgggcgaagaacggcagcgacagacaaaaagtgctgaatcaccaaatggattattttagggcgaaattgactaaaattgccttaattgagtctaattgacatttaatttgcgttttgcaatgatcaaaatttgagtgtcctcccttttgccccaatttagtccgttttatttatttagtggttaaatttaactaattaacaataattaatcaatgcaagggtgattaaaaagaagtaatatgatgttgctcaaattgttggatcatctgcaacgcagcaggtagcagcagcagaatgaccaaatttggcaacgggttatttttaaagatttttatagtcaattaagtaaatggtttttggtctaattaaaactggaattgctgcccgcaggcaagagggggagaggggcaattttccggtcccaaaacaaaaacaataaatagagaaaaatcggcaattttcgagaacctttcattatttcttgttggaaacaatttttataatttttaaaagaaaaatctatgggaatgaaaattgtgcatttaattaattgaatttattttttgaaaaatgcatttttggctttttggaaattgaattctttttttaaatacgaataaatgaatggataatttaacgattaaaatgattttgtttatttcaattatataatttttaaaaaaaaatatatttttgagaaataaaaataaataaaatgatgtttccaaaaaataaattgtctcaaaatgaatgttcctgtttgttttgtggccaatttgtacaaccaacagcagcagcagtaagggaacaccaaaaaatgttaaggccaccaatcaattttatgttgagtcatcgctgattgttcaattcaattcatatttcacaatgtgatgattatttcatgggaataatacgcaaaaaaaaaacagcaaaacgccaaatcatcgccaaaattggtgcgagaggaacagcaagccaaaaagggtggctgggctaatgatgagtctcgagagtcccaaacagctttctatcttggagttgtacgggatcgcaattcaaaaaataaaacgggctaatccgcgaaatcccggccttccttggattagagcactaatttttttttagatcatgtaaaaaaggattaaaaaggggttttatgcaattctgcgttgtactcgagggaggaacagccaaaaatgatgcctattgatgagtctcgagaattccaaacagcttttttggaaatgtacgggatcgcattacaaaaaaaaaaaatcgggttaatctccgaaatcccgggccttcctcggattaaggcccaattttttttctggtcccataaaaaaaaggattaaaaaagggatttttttttgcaattctgcgttgtactcgggtggttttcggggatgctgaaacgaatatgacatcagatttgtcacttgatttcactaaatgcccttttagtctccgttaagggtttagcttattctataaacattattccgtaattgatgatagtaaaataatagaaaaaataattgattaaaatataaatttataaaaaatcataaatagatgcaagcatatgacaaaatgtaatattcgtaagcactcccgaaaatctccgcgccgagtacaatgcagaattgcaaaaaagcccatttttaattctcttttttatgtggccaataaaaataataattatccaaattaggcatttctggtgaacaagttgtctttttatagtgatttttggcgttaaaacatgatcaatttatgaattttttgacctaattttgtaaaaaattaagggaatggcggtgtcgattggtaccgccaaaattgctaaatctaaaaatttactgtaaaaattatataattttcgcattatttcaacaaacattataaaaatgctgatgggtgtccttgaattctcctccccaaaataactttgtccaaaaaaataaattagcaatttttacattttctgccctcgcttcatttggagcaattaattactacacacagcagaaaagagaattgtttttgaattgtttttgaagaattatttttaaataacatccttgaaattttgacggtattttcaaggacatttaaatacatttttattttttccacgaaaataatgtaagcggcgcaatttgacactttagaacttttcttaaaaacgaccaaattcaactttcttggcatcattctatagccctcacaaatcagtgtcctctattagcctgaattatttcaaaaaacttaaataaatttcaaaaaaaaaaaagttatgaccagaaatgttcgtgcaaccatgcttttttcgaagtttaataaatttttcgaaattttgcagactaataaaggacattgataatgagcgctatcgaattatgccaaatattgaatttggtctttttttagaaaaaaaatacaaaataatgttaaatttagttttttgaagaaaattgagtaaaaaatagaaaattttccattttggattatttgaagtattatttccactttttctaaagtcacattgtttaaaataattttcaagaaaataccaaaaggcaaaaaggccgctttaatagaggatttttggaaaatgccaaagaaatgcgacatatgcatatgaaacttcattttacacgtgttaatctatgctaaaaaaattttcttgtgttttaggcccttcacagttcaggaagaaaatattcgtgagcacttaattggaaaccctaggcaattagagtaattaaaaaacttcgcattaatgagtcattagaaaatccattccaaacaaataaaaaaatatatcgcatagggtgtagaactttattcattaaatgagattaaaaaaatttctataaaagcatataaaccaaataaatgagtggggggggggggcgacgagggaggtgcgaaaaagcaagcaaattgtttgaacaaatttaaaaattggagaaaaaaacaattaaaaaattgatggggctgatcgaaatcatcatcgggctttttttttgttatccaaatatggaaaatatgttggcgatttgttgttgtgttttgtggttgatgtataaaaagcataaaatgatcggaaaaataaggcggcaggattctcatttcttgggccggttcttcaacaatgatgggggtctcgatcggtgttgatcatcatccttcatcgatctagcggaagaaacagtaccagaaggcgtggatggtgccgggaatccagccgagaatccaaagcctgaattcagtgatcataaaattgttttttttaaatctttgttttaaaaattttcctttctctagctatgttttgaaaaaatcaaaattgattgatttagataaaatcggtgagaagaaaagtggttgtaatcagaataagcggagaaatgatcagataaagttatttattagtgaaatagaacagatttcatcgccgttaatatcaataaaatattttgtttttttcattagaa

SEQ ID NO: 7888 - DNA, 924 bp, Heterodera glycines
gacggtgggcaaagggagtcgggcctttgatgggaaaaggcggtccaatcggtgccgaaaatcgaaaattcactttacacaaacacacaatccatgcccgtaaccagaaacaaattagtgaaatattttcccaaaatttattgggcgttgaagaaaattgttttttttttttgcacaaaaatgataaaaatttcagagaatatttggtcaattttttaaaaattctcaaaggaaatcaccggtccatgggtgacaaataggcgcagccgggaaaattttggctaaattttaagaaattgtcccaatttaaaaatgggcctttgccccctgcttttgttggttacggctgtcccaattcgtttgtccgtctctttcaacaattcgttcattgtcctttcttctccccctcttctgtgttcggttgtttctcttcttcccccccccccattttttggcgtgtcccagcaaagtttttcagcttaattcgccctttttttgcgggtgttacactttttcttttcttttctctttttctgatgcggtgcttaatttttattcgaaatgatatttatggccatcatccattaattaaactcaaaacataataataattattattattttcctataatccccccccccccaattttctctccccttttttttcatatcattttttgttcattttgttgtgcttccgttataagattcgttttccaacctcttacaattgttgcgtcatttgctatgttgataaattgaattttattattttttaattaaaataaaatattgcttttctttttttgttattgtattcggcagcctttgtcctttttctttttggcaacttctcgccgtttgttctgcttcttttgctgattgttttggtctgtttcctaaaaatggaaaattcaaaaatgg

SEQ ID NO: 7889 - DNA, 5039 bp, Heterodera glycines
catcatcgggaaatggtcgcggtctttgagccgttcgatgacttgcgaaggcgcagaacgtattccaaactttgcgcattggtcaccgagaaaacgagcagaaagccgtcccttaaacatggcaattattctaaagaaatgctggacatccgccagagcttttccacagtttttggagggaaagacggcgcccgggaaaacgaattttagtccagggaataatccaggtcaagaagagctttcatgattccgttctctaatgctggaaaatggcatttataaatgtccgaattgaaaataattttcaattttaatttcaaattattaaattaattaattaatcctaattatctcatccatacattatatttgctctttccacattaaatttaattgtttgtgcttctttcttaccccgtccgaaggtgttggtcgcgcatcgccgcgaattcctcttggccggcggtgtccaaaatttcgacctgtaaaaaatgaaaataaaaatttgccaaaattcattcatcagcagttttttgggctctgaatgtgctcccccattcccactttgtaaagggcgtcgtccacgaaacaacactttgtgtacgaatcggcgatggtcgggtcgtagtcggacacgaaatattgctggacaaactgaaatggcattattatcattttagcatttattaaggccggatgggctgggggattatggcgagactcgaaagggatttgctagtgctgctcgagaccgaaaatttcccgagaccgagaccgaaaaaaaaaccgagacttttctcgagtcgagaccgagagtctcgagcagcactaccggcagttcccagataaaaattttcaaagccttatttggcaggcaaaaaagcctcatttttacaaaatttattcaaaacacgtttaaaatgttccaatattatatttttgatttttccatgatcaatttgagcaattttgttagaaataagcattttttgaaattttatttcagtgacaaaatcactgacgaaacattagtgagcaatttgaagaatgaatagatgcggcacgagaagaggaagttgttgggagacgtcgatgtccagggccaatttgccttttcattccagccgcgttacgcgaaaagcgtggggaggacatcattttgtacattttgtatgatagacgcaatttttatttatttaatttataaatttttttagaaatattcattctttaatgctattgccaccaggggccgtagcaaaataaggtggttatttgacgaggtcattttaccacgaacttattaagcgattaaaaattctaattttttagttagtccccttttttactgaacagggtctttgttaattctcatagaaatggtttattttcattaagctttgctccggaaaattgccaaaacattggtccgggagttgcatgccacctgcaaaactttcgtcacattttgtctctatcttattactttccaaagataggataaaactattaaataacaattattcccaaatctgttgtgaattattttgactatatttaagtcatttttggttgcatttgagaaaagatatttttttactattaaagatatttcggcattttactcttttaattttacaacatagctatgataaaaatgaaatagaaaaaatattggtacaaaattgaaaagactatacacgtacttataaatttactcaaccaacgggttcaaaattggtcgaaaaaaattaaaacaaggaggcccggaaaatgggttctgttctgaatttaaaaagaaaagatttatcaaaagttagaaaaagcgcagcaacgtgccgccggcccaggaaatttttggaaattctaacaattttaaataatcaatccttcaaatccttataaaaaattattctaatatttttaaatgacaatttatagaatatgattaactctgcttcaacaattttaattgtatttaatattactttccaatttttatttacgtgttcaaatgcaaatccatcggtgagttaattaattgggataattaatttaaattatcaattataattagggtgacgacaaaatactaattgcaattatgaaagggtatccgaaaattaaaattagtgaatattcaaagcataaatacgaagctcacctcggcattctttattttatcaaaacaaattggcaatgcgacaaaattgaagcggaatttgaagaacatgaacggacagaatgccaaaaatatcgcaaatatttggatattttgtacgaatatttgtgccgagaatactttggaactcccacaataaaaccaaaatttgtgtttaaaggccgaattgaaattgaaggaccaataattgatgcggtaaaatgcttagccaaaatttcgctgttttattttaaatctcattggaataaaaaatatgaatataaattaaacaaacttttcactgattattttgaagtaaaactgttgaaagaggagagattaaattatgaatttaagttaaaaaatgaatcaaaattagcaattaatggccatattttacaattggcaattgaaactagggttgcgccccgagccctcggggggcaaaaaatcgggggccggggacctcggggggcgacatgtcgggggtcgggtcgggggggagctcaattgtagggggtcggggaccccgatcgggtagtgatcaacgaaattttttgacgaaaaactcaatttttattttaaatgctcgtaaatcttcctttttttcactttaatcatcggatttcattagcgccagcaagagtgagtccaagctagcctttaaaccaagggttacccttgaaaatttcccgaaataagaacatcgctgcgcaaaaacaagattttagggtcaaaaataaggaaaattggtcatttttggtgaaaatctgtgggcaaaatgaactcaaattttcaaaaaattctaccggcgaagcctatcggcaccgccggccctaaaatttgatagcattttgatcaaataaattgtaaaaatttactgatttgaaaaatgttgctaattgatattatttttgactctaaaatcttatttttggccttgatgttcatgtttttaaaattaccgatcggcaccatggttttagggggctggcggtgccgataggcgccgccggaaatttttttgggtattttaatgaattttattaagaaaattcgtttaaaatttcaaaaattttcaatatttcccgcctttgtggatgaattaacgggcgccggacttttcgacagcggacctttcgacagaaggacttttcgacagcggacttttcgacagtaaaggacttttcgacagaaaaaatttttgtttaaggggaggacttttcgacagtaaatggtagttttaaaaaagacaatgctatttcatttagtaagcaaaataattatttttgtttcgaaattatttccgtttttatggaaaagttaaattgggtccggcattcgataggccacagctcttaaatattggtagggatggcgctgttcacgtgtgttgtaaagcgcgagcaaattttcgtcttgttcaacataaatttctttacttttcatgcctttaccacgaattccattcatgccaaatttgacggcatccaagccaattttttgcaaaatatttggccagttctcaaatgggatttaattttttttaaattcaattgttattattagggattagatttttaggcatactaaatagacacttaaaaaggcataaaaagtccgaaataggcaaaaacaatacggggggcgattgatacagcgccaaaattcgatccctaatttggggtttggacaaaaaattccaagttttgcaccttcttgaagtccgctgtccgcttcaaaggcatattcaaaaccgccgcttctgattaactctcggccacgcttgctttctgctagaaaaaattggacaagaccagctggttcctctgcttcttcaaaggcttagagttcggccccaatttcaccttcttcgggaccactagaaccagaagacatttttcacagcaattcaaaaatattttcagtaatagttatgaatggcatggtcactcttttttgggccggtcgagaaacggaggtcaaacaaataaattatttattattgataagaaaaccattcatgagaactccaaaaatgcagtgcaataaactaaaatgccttcttaaaccccgctaaattaagatattttataaaccagtaatttataaaaatatattttttaattaaaaattcttattttacaaataataaaataaaaagacaagattaattattagaaattatttgtttttaatgaaaaatttgatttgttagtgtactgtcgaaaagtccgctgtcgaaaagtccttctgtcgaaaggtccgctgtcgaaaagtcctagcgccatcggcaccgccggaccccattttaccagatttttgaaagaccaaaatggcaatttaattttttggaaaaaaacggtaaaaaactttgcaaaatactgaaaatacgttgcagaatttttacttttcgacataaggaaagattgataatcccggattagactgacttggacaaccaatgaatttttaaagtgttccacattagtctttttgaaaaataaaatatcatttcatgtcaaattaacgcaattttcgtagatccgaaattccttaatgtgtctgtatgtccactgtccactctgttgctccttgttttactgtttgttgccctattcctttttctaccgtactttctacaaaacccaaaaattatcggtgctggtcttcgtatttgagcaccatttatagagagaagtcaaatcatttttataaattttaatttttttttaaaacacaatttaatcattttttatttgttatactagggctcatattttaagcactaaaaactaccaaaataggtaggctggaaacctaaaaaaggcactaaaaactcgaaaaataacttaaaagcggcacctaaaaatctgtt

SEQ ID NO: 7890 - DNA, 4646 bp, Heterodera glycines
  misc_feature (4557)..(4557): n is a, c, g, or t
accaacaaagcctcggcaaatttttgacatttcaaacgcaaatatctgacattgtttaacaattattgtcttttaaataggaataaaaatactttttgcgaaatcgagaaagcttgaggttcagataattgaataatgcgcccaaaagaccgccaatcactccgacaatcataaaaaagggaagttcccaaattccgtaaacgttagtggcttcctaaatgcatattgtacaattagatatggaatacaaaaaacaaaacaaaaccagtcacatcgaaagtgccaaaatttgccaagccgttccaggataaaatgccaggctgtttgtagaaaagactcatgaagcagttcaacgtaaatgttgagatcatcgcagtgaaaacctgaaccaacttcaatttggcattcaaacaaaaacggaccattcgccaggtgagcgattggttccagaaactggccccctcttccaaactgaaaagcacgccaccaattggcgaggcaaaagccgcagaaacaccagcggctgcgccggcactcacaaaatcgcgcttttcccggtcatttcggaaatacttgaacaatccgaagtccacaggcaatgataagcaacgaccctgggaaataccggcggcgacaacagcgccagaatgaatcatgggaccttcctgaacaatggaaaatatattaaggtttaaagaggaagaagccaaacaatttgaggatttcgacctaattataagaaaaaaggtacagaaaaatttgtgagcaaaaattattaaaactcttttaatgatatttatttctaattacttttcctgcagccaatccgccacccacagaacatgcaacgccgactgaaaagatcgttgttttgtaaaaaagacgttaaaaatttcaccagctttggcaagaagtgtcttcaggcgcacaacgccaggtatttgtattccgttcaaaaaacatttaatttgcggaattccggacccaatggccactggggagacaaagataaccaaaaacgatgccacggcaaccaaagcgcaattgtataatgcccaaacccaaagaattgtccacgtacaacccgaactgccgacactgccctcctcacaagagtgaattactggaaaggaaaaatacaattaaaaataaaatttaaaatatattttttattatttaaacatgcaattgttgatgatgaggtggaattttagctttgaattgtaataaacgagcacgtcaatgaatgctgcaactgaagcggttgcaacaccaatcaaaaagcaaacgatccatcggtcgaccgtttgtcggaacaattttcgctgttttaaaactttgattgatgctcaaaagataaaaaaggaactcacctgatgccctttatccttttcagcagcacgataaagttcgttctcgattaattcatagtcgagactttcatatttctcggaaagtgtatgttccgatgcgccatcagaaagtttccgactgccactaaattgccgtctccgcacttcctcttgttctcgcagccgttcttctctccttcgtcttgaaaaaagggtcgatgtggaggaaactcgctctattccactgacgggatcttcatttgggtcgagactaaaaagataccaaatttatgaaagtaaaaaaacgcattaaagaaaaaatcacctgttgtgtgaaaaccttctgtctgttcggctccaaatcaatggacgctgatcagaagacaaaccgaaatttctcatgttatcaacatgaacatctcaattagaagtctttaactcatttgtcagtaaagcctttaggcaactttaaaattaaaaattttggcgctttgtatttaaaatttaatgtacaataaaaagcctaaaaaatcttttttttcaaactcaaccgtaacatgggaagtgggaaaagacaaaggattgagtgggatctatattttggtacagattatatgccttttctttcaatgggtttgttttctttcaaatgcatgcgaattggaatttaggttattattcatacaatgtctaccttttattcgttaaatgtttcttcgaattggctgaaatatttatctcttgggacggctttggtcgttggctatgcagtttacattgaccgtaaacgtcgccttgacccggaatacaaacaaaaaattcgtcaaagtaaatgggttttatctgatagtttgagccttctgtcttacaattagacaggaaacagaaacaagccaactttttctacgcaaaaatgagcggaggagttgattttcccgacccaagtgatccacaggcgaatgagatcttcttcttcagtcagatcactcttggagaggagaaaatgcagactggtttttatttatcgccagtccaataattacgttatattaaaggccacattgaggaggggattacgcatctgtcgaatgcaattgtgacttgctcgaagcctgacgaattgctcagaattttccaacagaccatcccaccggagtgtttcagtttgcttgtgcaggcaattcctggcgccaaaatggtaaattatcacgatttatggaagatgaaaatgaaaccattttttagcgtcggaatgcctcttcatcgtatcgccatgggcgagagccgattgatttagactgtgcaaagattgacgatattggtgacaatgcggtcgacaagaaaatgtttgttttgcaagatgacgagcttgaatgaaatggaatacgacaggaaagcaggccactccaaattatattttgttttgtttcgaataaatttgaaattttcttcatagttaatatttaatttggttgcgttatttccgaactatctattttcatttgtttaattttttcctttttttgtcagttaatctagaaaaagtaatggcttcacgaaaaggaaaggtcaaggaagagcagccggctgtttctctgggtcctcaggttcaagaaggtaagaatcaagcacctatttattttaacaaaatgtacttttccctaatgatggcttccacatacgttttacattatttttttcatatattctccgtttaggcgaaaatgtctttggtgtggcgcacatttttgcgtctttcaatgacacttttgttcatgtgaccgatttgtctggacgtgaaaccattgtcaaaatcaccggtggaatgcgtgttaaggccgaccgagacgaggcaagtccgtacgctgctatgctcgccgcgcaggatgttgcggaacgttgtaagcaggtccgcattttttatttagtttttctatttaagcctatcaaaacagtcccattgtgtttaaggttggcattaatgctcttcatgtcaaattgcgtgcaaccggtgggaccaaaaccaaaacgccggggcctggtgctcaggcagcgctgcgtgccctcgctcgttcgggtatgaagattggtcgaattgaagatgtcacgcctattccttccgactcgactcgccaaaaaggaggccgtcgtggacgtcgtctttgagttgattcaaatgcgtcccgatttttgttgttgtttgagttctctatcgcttttcttcaaataaactttttgttgaattcttcatttccttttttggggtcatgtaaatcccttctaaatttcaattttcatgctaggaatagattacctatgtgagtattcaggagtgaattcatatttatattatggatcgtttctgttcttttgcttttgtttcactctgtcggccccatacagctttttgttgtcgtttttccacttctcagcttcggtcaaattttttaaaatgggacttgcacaaccaatcccaccggaaatggatgaaatggttcaacatcgacacttatcttcaacctagaagaaaatttatccgtctaattgctaatcggtgactcgtcagtttcatttaacttttccgttgtctctgtttattttccctggttaatcctgtttagatttcacccggagcgaattttccaaatggggccggattttgcgtgtttggaatggttagttactctataggagttgcttaaatgtttttttgtttaggctgatgaatgcgggttccacttctgttctaatgtcggatggcacattgttaaaaagcaaaaagtatgtttttttatcatataataatgaactttttggcatcatttagagaaatgcagaattttttgtctcaaaaggggttcgacctgcgaaaacttaagacggttagtgcttttttgaggctatcaattgtcaattcgttaatcactttgtgtttctcaggaggcccccacggcgaaattgcttaaggatattcccttggccgatgcgttgcgtccctccgccagtgacttgctttacaatgaaaaatggcgtcacatttcgcccattcacatgaaagaagtgtccttccattttccctatctcccaatgttttactcttttagattgatgcttctgattcggtgatcaccgacgagggctttgcttattttttggaatgtcgaaacatagaaaaactgcgactgaatttctgcgattattttgnggacgaagcaatcgcacggcttgcgcaggggcggcagtcaaaaacgttgaaaggaattggtgagagcagaaatccatgtgcatctcaac

SEQ ID NO: 7891 - DNA, 2514 bp, Heterodera glycines
ccccccccccccccgccgtcgtatcttttaggttggttaggaaattaacattggaactaataaccaaactgtaactctgacaactaaaatattattgtgccgaattctgcaagtaaactaatactaaaaaagaaaatgccaatgaccaaatgcaaatttgccactccgtctgtctgaataatgccccgtttatcgatgattcgtttttgtcgttttgtgacggtttctcatgcttttttggcacaacatatgtccgaatgtcgtcacaaagtgtcggccattttccaattgctcccgtgtccagggccatccgttgtaaagaatcaaaggatttctttgttaagttgaccacctcaaaattaatgactttgttaattggctaattatagtgtttgtttctcttttcccactaattctgcggtgtccgtgccgcaaaggctgtcaatggccggcacatcgcagtgcaaagtgcagccgacgtattcgcaactttctcccaaatatttttcggcctccgtcgggtcgctgttcatcgccaaatgtttgaagttttgcatcagagaagtgaccttaattgctttttgttcgtttggcttttgtctgactgtccattgttttctttctctgctctcatcttacagctttgtgatgcctaaagggagagagagaaatcagtaattaaagcagccaagagaaaggaccaaaggaagggatttgggaaaggattaggattatggtaattaaaagggattattaggattacggtactcaaacaaatgaagcgattaggattacggtaattaacaaaagaagtgattaggtgtacggtaataaaaccataaaggaaattaacagggcatttatatagattcatagtttggtaaatatgaagtaagtcaaataaaatcaaagactgaaggttttaacgtcagattctttattagagcataaaattatcttaagaaaaatctcttttttcgggataatgggattttatgggggggggggggaaatactgtagtcaatgcctaagtaatatactaattaagttctaattgctcacccagcgcaggaatgaagacactttttggacatttcgcggtccaaagcgaccaaacaaccgaattttgtctttatttctgcaaaagtttgtcaattaaaacaaaattcttttaattttactttaaaatggagaatgaatattacaaaatgaaattgtaaatttaatttacctttgtaattccacacacaaaaatggtccactatttcggcacttctgctcaacaattcttgcataaatccttgtgggcattttgtgtagcaaaaattgaattgatgataaatacttaatttacaaaaataaataaataattatttttttaattgtttttttttgcgcacttgcaaaaggaatcgaagaaagacgaattggaaaaggcagccaagaattcgttgtaattcaaattcagcagtcccgtcgaatgttccgagcccaattgggagcgcatttgatcagtgaaaatcaaagcgcattggccaacacacgaatcggaagagggagccaagtggggactgacaaaagaaaaagggggaaagagaagggaattgagggggaggattgggaacactgatcacaaatgaagagaaatgctgatcaaaccgagtcagcagctgatcaaccctccgccgtcggtgaccaacctttgagtcggaattgccgggtccaaagttggcatttggtcaaaggcaaagagcgacgggggcaatgtcattagtgaaatgaacagaggcagaaacggagacgcatttgctgccggtgaaatcatcggcattttaatggagggacaaaagatggcactttccaatgattgcgtcactcaatcttttaagggataattgacatttgcctttaattgaccgccgctgatccaaaatattattatttggggttttgacgaacaaggaaagtgaaaagcaactcgtcacaccgaaaagcgggggaaagggtaaattgggaaggaaagcgattggtttgacaggcgacttttaagcagccaaaagaaggggagggaattggttggttccatctatcggagcaaaacggggcaacttttccccgtcccttctgttgcgtttccaatcgccgccattcctccctaaaagcaatagaactggcgacacaaacagcacaacaaatgtccatttctctgtaaacatttgtccaatcattccatttacgatcggcgcgacgctttcagaaaacgaagccaaccgaaacccaaaacatttgtgccgttggactggccataacagaagacactgacacgacaaaattcagtggcgattcgtttttaaaatattgaaacaaattattattttttaaatgttaaaagaatatttattgcctatcattttgttttgtgtgtcggtgtttgtttagtgagactggaactgcctttattactggacattgatttattttatttttgtattagaaaaataaaatggaaaaat

SEQ ID NO: 7892 - DNA, 2971 bp, Heterodera glycines
gcaatttgaaaggaaatcaaatgaaaggaatctgatcaaagccaaaaggattctgtgggaaaatgccaaaatcggaaattcatttacccaacgatgagaagggatgccaaaaatcgaacagaatgtattcgtccgtgtcaaagtgcacaaaaggcgatgacatgccataagagaaggcaccattaccgtaacccatcggcatcatcccattaccgtatccgccaaagccgtaaccaccgttcatcgtaggattaatgttaatttttcaatttgtttacttatgtattttcaaaaatttttttggtgcaatactttcggcgcgtaatgaattaataaaattgaagaatttgcgatgaaattgaaatgattctcttcaataattgctaatgttgaaattgtgccattgtctcctcacattgtcacctgtcgtttcagcgatggcatttgcagtcggcaattcttcgtcttagtagtttgccgacagaacgataatatttacgggacgacaaactttccattggttgacatggtaactctttgaattaagatgaaatagaacaaaagttggggataaatgaagggattcaccgaaaaaaagggaacggaacggcacggaaaaagaaaagggactgacaattaattggactaactaaaagaaacttactttgatcattggaagtgaatggtacggggattgtaaattaccaaaaatcgggcatttttttaattgtcgagaaaatatatcacgttttggcgttttaaatcagcctttctctctcctctcactccctccctctctcttccatctctctctctctctctctctctctttcgtcgccctctctctctctcttccatctctctctctctctttctttcgtcgccctctctctctctcttccatctctctctctctctctctctttcgtcgccctctctctctctctttctttcgtcgccctctctctctcttccatctctctctctctctctctctatttcgtcgccctctctctctctctctctctctctgtctacctctctgcccttctcactccctccctctttttctttcgtccctctctctcccttccctttctctctatctcccccgctctcccttccctctctcttttcctccctccctccctctccccctctctctctctcccttcttactcccccactctctctctctctctctcctgtctcactctctcagttccccctctaacccctccctctctcccttctcactctccctcactccgtccctctccctctctctcttccccgccctctctctctctctctctgttgtattctcactgcactttctcgtccccatcttttccactcttcccttcatagaatatgtgtgtttttttgtcctccccttttcattttcttcacaccctcataattatatgtgcatgagatgggtgaatgtgtgctcttttagcttcttcccccatttacccttttgtgctgtttcatctgatgttcacgtgccttcactttccctcgggggggggggggggacggcaatcgccgcacacccaaacatcgacagttgttattttttttatgaatttgtcgattggacggactttttggcaggaaataaattctgtaagcgcagcgcacttttccaaccaattgcatagtaattataactaatggcccattacttattatttgaatgttttggtttcggtttcagcatcaaataataattggtgataagggagagtatttgtcaaatcggatttacgtgaggaattaaaatgaaaaacggagaaagtcggccgtagttaaaacaaaaaacatcgtcggtctgtccgttttcagccctcccaaaattctcacattttgttttgttcgtatttaactgaattttccttcctttgaacggatcattgtccgtcgcacttactgttttcgactttcaattgaatgcgtcgagactctcgccacttttgggttgggttttatcttatgatttccctctctccacccttactcactcactcacccagctgcccactccgttgtttcccgcttttccaataacaaattgtaaacacacagtggaaagggccactttcacttcacgtgcgttttttatcatccattttaaattgtgatagtgttatttttaactaaaaagcagcagaacaacagattcatcggttaattaagcaaaatcccagtgacgatacagtagtagagtagccatttagtcgggcagctatatggtcagttgcatggttttttatttttaagtatttaatattaatttaaccgggtcggttcactttggcccgttttatgggatggccattgtcgcttgcctttttgaaaatcccaataaaaataaatttattgttttcattttttgtcaccgctgacgaaagacccaaaatgtaaaatgccgagagttggaatccccacaaggcctgcatttgatggtcaggttagggcctcaaaacttagtcctaccaaatcttggtaaattttggcaggttgttcaaatgttttgaaccaaatataaataatttttcgaaatttatcgacgcctcggcaccaaaaatcctacgcaaaaatagccgatccaaattgacacgaatttaataccggggatattgcaaaattcgctcaaaacgatgacgggcgaataggtgtgacggacgaccttccccttctttcattggtttgctcgtgttaattgaatttctgtccataataacaatgggtcacgtgggttgagtggaaggcacccgcggacatcgcctgataattgataatgccccaccctcaaaaacacattgtgacaatctcttttaataccctctgaacacgttcaatttttgtccgagggtgaggcgaggtaaaattatcgaatttcttaaaaaatacaaaggaaatggaattttgactgtctggacacaaagaacgagtttagtttttt

SEQ ID NO: 7893 - DNA, 2004 bp, Heterodera glycines
cagtttcgtaaatcgtacgggggtcattgcccattcctcacaaatcagttctcattaatgtcctcgccctgcattttccacccacccaccaaaatgattgcatttttccgttttaattttctccgcttttcccaatcgctgttcatttccctctcccttttcagtgccctatttgtcagcacctcactcccactcagtccgtcatgttggccttattcgcctcaattttcgaatgcatttttctgctctttagcacatttggcgccctggcttcagtcatgcgaccaaaggtaattaaaaataaatattattttaatggcttaaaattttcagatgaagggctttctgttgctcgcattgcttccgctggtcacatttttaccagaaacaatggcgaaaagtatacaagccgctgaaatgtcggaaatgaacgacgaattgtccgactaaaaagccaccgatcgcatcgcctgagggaaacacacagcaaacgcaaatctgcggacaccaaatattcgggtcttccatttctttttactcttcctttgtcaccaaataatattttcaaatgaaaaatgacgacctaattgattgtttttgtgtgtttcgtaggcaattctgggaccatatcgagaaattttcgattcctcagaggaaacttcccaaaattgtccatatttatttatttgtgcgtttgtaatttttgggtttgttcatttataattaaaaacatgtataatgcaaaattaaaacaacaggattaaaaacgctgttttttgagtatttcgggacgccacagcagcgggtgagaatcttctgactaaaagtggaagagaatcaaactatgaatagccaatcattccctcccacattttcttgccgctggttttgtaattaaaatataaatgtgaacatttctcaccgcttccgagtcctctttccacattttgatcgatttgtctgcctcccccgtgattagtcgtgtgccggatttgtcaaaagtaagcgcaaaaatgccgcgctcggagtcgatagagcccggctgtggtggcgggtgttccttctggaagcagaaaccggacttgaagtcccaaaagtgcatcgtgccaacatcgccttaaatgattaaattgtaaatggagggttgtggaggggaaaaggaaatttatgcagttaaaactaaaatttttagtattttataatgttttcttgttgacttatatctggtcgaaggatggattgtattatttatcggaaaatacctccagaaatgagcactccgttttcgttgacaaccaatgaatttatcattgtgttatgtccgctcaaattctgcacgaaatcgccgtttggaaatttccaaagtttgatgttgtcagtggacccagaagcgaacatattcagcgatggatgaagggccaaagagcggacacttttctatcaaaaacaccaagtattttaatcttttcttgtatgtatattcccgagactataatctttcgttttatatgccaaaaaaaaattcgggttgggaatgtcgttccagttgactacataggatatctgaagggaaaatttcagtttttgagggcacccctataactccgagttttcgccatacatgtgcaaggggtatctcggcccaagtgctatacgacgtatgattgggatagggggggggggggtgtctcgggaccgatttttcatacgaaggtccaaattttttctatggcgacgaacttttttttgctatcaaacacagctttttttgcggcgaccttttttcaattcaaaaaaacttttgtggaagggagcggtccggcggtgccgataggcgccgccgggaaatttttttgaattttttaatgaaattagctaaggaaattgatcaaattttaaattttccccccatcgtcgacgactcctccgttcccacgacgaccccctccctcttttacagccgcctcccttacgacgaacgaaggggggggggtgtccgaggcc

SEQ ID NO: 7894 - DNA, 2606 bp, Heterodera glycines
  misc_feature (802)..(802): n is a, c, g, or t
cggcactaatgtgtccggtcaacgacaatttcaaatgtctgcttgccaagtcccaaatctaaaatatttttgttttacatatacatgtgactaacatgccttgatgatgcgatcggctcctccgctggcgaaccattcgttgttcggctccacgtccaccgcccgcacccatcccgtgtgcccagagatgactctaaaccgatacagaactttgctttttaagggaagacagccaatgaatgacctgtacagcttccacggcgcatgccattttggcttggttatcaaattggcacgggaaggaagtaaagcgcgcaaattcgcattgtcttgttgaggctttgaaggaacagtggcgaccattaaattgccggtaaaatcagcaccatcgccagctgtgatagccaaaggggcatctgacaaggaatattattggagattatgtggacattttttaaaataaaaaaagaaaaaaatgccgtggacaataatgcagctttttctgatattttgctttcctcactttcattgcttacgactgctgcaattgcttctctgttgcttttcggtaatcgaagcacttccgccgcctttcgcttcttcgcctcttcgaccgcattcattacgtgtcgaaagtcacttcggattttggtattgcgccaaattcgctctctaaaaaaatattttgatatatttattaaacggagattgcttgattgtgagaatacaaagcgaaatgcggcggcatgagaaaatttttggaggtaatactggagaattggtaagaacttgatttttttanataaatttttatgtaaaaaaacatgtatctgtggtttttggagtcgctgatcacgaatatgaccttagttttggccaattccgaatccaggacccgaactcagacaaaaagtcgaaaattcaaacttgttttatgtgtgagaatttcgactattgttcgagtccggggttcgaaattggtcaaaattaatgtcagattcgtgatcagcaacccagaaaacctccataaatacttttaacgacttttagaaaaaaaaaattttttaatttatttttcgccgggacaccaattctcccagtattatctttttggattaagggcacttttttcctaacttttatcgaattggggtgtaatacctgctagcccttgcccacccttttagtttagtgataaaactgacgctttttcatcattttctgggaatttctcatagtcgtgcaggaacatgtcatgcgctctcttcatagaccggaagacgtaattgtgaagtgccttatccttcgcggttaatggctggtgatctgttgcggtggacccggcttcatcagtaacccgattatgttctgatgaatggttagccatttcagtcaaaagttgaaagcaaatgaaagaattctcctaaaatctatttatagcaagaaaataaaaaatggagaatttacaagacttagtcgccattctgacttggatgagaatttttaggaaatacataaatattcggggtgggaccctaggttgtgaaagtttccggaattcatcaggtcccataaaaatccataacccggaaatttttaaatatgcgactgcggtgcgatgcaagtttacaaactgcattaaaaatagtcattttgtgaatttttaaattattaaaaagagaatcatgatttgattagatttaggtaagtccaataaaaacaatgcagaagaattggtacttatcaaaaccgctagtttttaaaataaaattacggttcagaaattttaatcaaagaatccggagttccgccgcggtcctaaaaagatacggggttccgaacccggaatactgtccctctcctaatataaattcatacaagcgaaaaacgatatctgaaaattataaattttattagaaaaatggttatttctcaaattgctaaaacactatggtcacacaaaaagaagagcatttttgcagttattgctacggcttacggggcgaacgctttaagggcacgtttaaggtaattgattagaatggttagagttgggaatttcttctaaattaagacgttttaaaatcttagttaattatttaattaataacttttttaaataaatatttttgataattttacagagatgaccgaattcgatacagttttgcagaacgagcccgtaaatatggtctggtaagttttgggcccgcccagcgacttcgccgtgtcactgttttggtcaatcgcgagtcgggcggacgacgggcggccgaccttttcaagcgcaatgcacttcccctgctcaatttggccgggctgcaagtgaatgttgtggaggttgcgccaatttttactttccattctttttctttattttgaacgcaaaaattcttttaaactttttttggtaatagtttagatggtagcacacctttttttacaacttttttttaagttttaaaattgtaaaaacatgtcttatgggcttttccgggggtgctgatcacgaatctaacaatcaatcccggacccgaattcgaacaaaaaacggaaattctaaattatcaaaattcacttttatgttcatatctgtacagaatgac

SEQ ID NO: 7895 - DNA, 3102 bp, Heterodera glycines
ggaataggcgttcagaattttttaattacactggagaaaacaatttggctcgaagagcaaaaaaaaggtcttcactaggcaaaaaattgaaaaaatggtcgatcgtaatggaaatgggctctgaccccccatgggggggggggggtcaaagtcgatcgtaagacctcttggctgaccccttccccttgcacaggtatgccgttctgcttgaattcgatcgtcgtcctttcttttagggtcgcagttaccccccgcctccattcgcccctttggtcgccccccttttacgcccggcaggtgtccgccattcgctcattctttgtcagtcagaaaacggctgaacttttagcggaactgcgtcaaattgaacttcgtcgattcatccaacaaatcgaggctgaggaatcattgaagaccaaacgaaatgaaaggacgtcccatcgtccgtcggtggtgggacggcattttgcacacaatgaataaacattcattccctttccaagttggcactcgattacggtggttattcggaagagagaatcgaagcccatctttttcaaatatggccgcagggaatcggcccgggcgatttgcgacagcaattgaattttgaagacagcgaaaacgaatcgcagcaccaagtaaaagtgggggtggggcggggtttgggagggcgggacgctctccaatttccattttcaaatttgcaattgatagcctcggcttggactgaatgcgtctgcgtttgacactttgcagcatcgtcaccaagtggtctcttctcttgacattgcccttcccaaagtgtgccaccatttccctttgctgtattttgaatgcttttaaggatttgccaattccgcccccggaaatggtcaaaaaaggcgaaagtctttcgccttcgctaagtcgcaaatcgctccccgaaatttgccagtcgcaccgcaaagcctcccaattgttggagcagcccgtgtccagttgggtgggtgggtggacggcatccaattggccatgttttctttcgttattttgacattttcaggtttcggtgaccgccaaaggcattttggtaggagagaaagaacatttttaagacatttcgccaaataggtggaggatttgttcgatttgaactcgccactacccgccattggccaattggagcccgagtgttctgaccccgccttggaccccgtacttcgcgaacttgacagtctccccgcttttcagtacagacatcagctgaccaaattctacaaaccggagaaggccctgagaaatgtttcgaatttgtcgttgttttgccatttacaattctcagactctccgatcactcggctcctccggcaaagtcgaacagattgaacacgtggtggcccgtctttattttgccatgaaatgtgtgcattctcacaatcagtgtgtgttttgatcgctttccgtttagctgacgaagtgcactgggctctgagcactctttcggcgttgtattggcgggtgaagggcgacccggtgaatgtccgtcttttgtttttggctttctttggccaaatggaaagagtcaaattcaggccattaaatgccttcggcactctctgcacaaatcgccaaatatattcaaagtgccatttccaaattttgttcgcaccattttgccttatctaaggacgtccctttgatttcgctggccaacatttaccatcaagctggcttccttcacagtgccctaatcgtcggacgaaaaggtgccgaaacatttcctttggcgatggctctctctctttgacagcattggaagcgggcgtcgacgtggtcgctttgcacttcactttggccaacatttacgcctctttggtcgtccctttgcctctgcgttaatccctccgtccctttagtccgattttccccacgccctccaattttaccactccacactcgcacttcagtccaattttgagccggccaatttgaggattttggtctgtccttttgcatttgtttgcccctattccaccgattccttctttaggccgtccattgcgttacaaacggaacacttttgccctactgacaatattacggattgccaatcatttgttcgccaatttttcattccttatttatagagaacggatttatatttactaaaaagcgccaaatgtgtgcttatactgtaatatgtactgaattaaatccccttaaactgactgctaaaaaatggatgtaagcaaaaacaacaacaacaaaaatgccaaaagttgcacatatattaaacaaaatgactaaaaagcgctttttaaatattgtcagtctttcttttagcattcgaacacttctgcctttttgtttcttcttctcctcaatttttccccttcaaaaatgcaatttaataaatttaaattaaaatcgttcccctgcaatttcattcattcagtcaaaataataacaaataatttggccggtttgttcattggttcctttcctccttatgtgcgttcttcaacactcgtcgttattttggcgttcttttttaaattctccaatttcgcgcttttgcagtcgtatccaattgccttggggaggagagttttctttgtactctctctctccccccctccctctctgtccatttctctctctctatccccttcccatctctctctctctctctctctctctctctctatgtgtgtgtctctctttcactcaccaaacattggccgaatgatcagttcagcggaaacacgcatctgaagatgttgtgtccaataaacgattctttcccttctcacctcatcagtgcgtaatttcgaagtgactcgaaaagaacgaagtatctttgtgattaggcacttctcttccataagagcaaaacgttggccttgggggatttgagcatttgccataactgtcggcactttcttcccccccccccctcaaaatgccaaccgatgcaatttcgagcgcccgcactgaaaggaatatagcagtagggatgcttcagatagtcgaccttcaaaaagcgctcgggatcaaaaactgaaaggggcagaacaaaagaagcaaatcggcagaaagaagacgaaacgaaccctcggg

SEQ ID NO: 7896 - DNA, 3415 bp, Heterodera glycines
  misc_feature (806)..(806): n is a, c, g, or t
  misc_feature (858)..(858): n is a, c, g, or t
atatattaaacaaaatgactaaaaagcgctttttaaatattgtcagtctttcttttagcattcgaacacttctgcttttttgtttcttcttctcctcaatttttccccttcaaaaatgcaatttaataaatttaaattaaaatcgttcccctgcaatttcattcagtcagtcaaaataataacaaataatttggccggtttgttcattggttcctttcctccttatgtgcgttcttcaacactcgtcgttattttggcgttctttttttagttccccaatttcgcgtttttgcagtcgtatccaattgccttggggaggggagttttctttgtactctctctctcccccccctccctctctgtccatttctctctctctctctatgtgtgtgtctctctctcactcaccaaacattggccgaatgatcagttcagcggaaacacgcatctgaagatgttgtgtccaataaacgattctttcccttctcacctcatcagtgcgtaattttgaagtgactcgaaaagaacgaagtatctttgtgattaggcacttctcttccataagagcaaatcgttggccttgggggatttgagcatttgccataaccgtcggcactttcttcccccccccccccctcaaaatgccaaccgatgcaattgcgagagcccgcactgaaagggatatagcagtagggatgcttcagatagtcgaccttcaaaaagcgctcgggatcaaaaactgaaaggggcagaacaaaagaagcaaatcggcagaaagaagacgaaacgaaccctcggggttttcncaataattgcggtcgcggtggatcatcgacgccacaatgataatgccggtcnccgcaggcagcaaaaaatcctctgaaatgagaagcaaatctcagccaaacacttcccaccactcactgatttgcgtgtcctcagttacctttaaaaaggaaaggaccaattaagtgataagaaaatctttagataagattcggttggacctgtcgagcgatgagtggtacacttgggtaaaggctaaagcagataaggggacggataaagcaattggcatgcagcgaaagaccggagggtttccttcagacacgcttccaagtagcgcaactcgcccaattgctcgtagcgaagttcggcctcagggtcgggccccagcaattggtcaatttcacgctgaacgcgcgattggatctgcgatttgtgcatgagaaattccaattgcgcgaatgccgttgtcacctcgggattggcacccatcaaatgcaaaaaccaattcaatgctgtcgaagtcgtatcgtggccctacgggaaattgggcgggggggggcattggttcccaatcagaaaaacacctcaaaagtgaaggtgtccacttcctcctgaatgccggccaagtccaactggccgtgctgctccatgtccaacatcaaatccaacaatgccaatcggaagaagaagatgtattttatacgggtttcaacactccaaaaagaatctctgcttagtttcgagatttgcggaacggatttaggcattttctactggcaatttatattgtctaaaattgcatttgcctttgtcccttttgtccatttttatatgccattgccttcccttgggccctttcttctccgattacctcacccctttgcctccctccgtcactttcttcgccactaatttctcaatgcctcccgcttcttccatcgcttttttacgtgccaaaatcgccttaatttggcttatggcttgaatgacaaatgattctgcagggccttcaccttattagtaaaatcgtgtagaatttggacacatcgcttctgctctttgccagccccaaaaatgttgaacagaaattcgggataaaactgaaaacaccaattaaccttaataggcaattaagcaattccatgccaactgttaattaactggctacccatccaacagttcgcccattaatcgtcgtcccctccgtcggttgttcttttacctgcggtttgactatccgttggaaaatgatatttttgatggcgaacaccgcgtccaaatagtccgagtgaatggtccgttgcgcgtcaatgttcacgccgagtgccgcctcgcaaatgatgtccaaagtgcacagagtgatggtgtggaaaatgtccacaaattctccactttccgcaattttctccatcttttgcactaatgtggtgccatgccgattatacacctttttgaggggtgaaaagagaattttttgggaggcgacggacagaccggcacaaagtccttcagaatgtcgtagtgaaactgagcaaaaagagtgagtaagcggaagcaatcggacggaataaataaccaacggtgggggtgagcaacttgcgacgggggcgccatttgttcggcttactgagcaaaaggccgtcgccgatccaagcggacagaaaggagtagtggaacatcttgacaagcaggggtttggcaatggcagtgccacagtgggaatcaccggcttatttactttttttaagtgttagccatgggaaggggggacccgcaattagaagcagagggaggggtgtgggaggaccttcgtcagcagttttttgctgcccagcaccggctccacttcctcggcgccaaaaatgatcgcaagcggaatggggccgagccacgcccgcgcgatgcgtccgttcttctccccgaacatataagcgaggccctggacttgctcgaagaattctgaacaaacagtccacacagaacggggccctaatctgactaaccatcgggcttaagccggatttgatggagatttccgaccaaaggcaaagtggaagggcccgggattcgattgaccaactgagagatgcgcaagaacttccgactgatccaagcggaaagccaagcgaacagagaagcgatcagaaaaacaaccaaaaagcccatctgctgaaggggaatggagaagtgacctttgacggagacgacaaggtcgaggaggagagaaacaaaatgggaaaagtgggggggggggggaggtggcgaaattaaatgaatgaatgcgaatgggggggggggaggaggagcgggaattggctccacctttcaaaatcaaacaagaaaaaacgttttatttatgctcaaatgggtaattcaaagtccctaagaattcacaatttgtgaagcaaaactggaaaagagaggggaaggaaaggaaaatgagagcggggacacagataaagggagaaatcgaatggagtgagcgatgagcggaagaataaatggaaaggaaacgtaacagggcggtagagtcaaaaagggacgggggatgaggaaagaagaaagagtgacccgagcaacacgcgcaactgaaggtgtttggggagaaagaaagggaagacgaaca

SEQ ID NO: 7897 - DNA, 612 bp, Heterodera glycines
ttttgagttgtaattgtgttcccaaggtattgtgtttgagaaaaaacacagtttaaaattcggaatcaaaagcattcactgtgtgtattttccgtgtgttttgagttgtatagcgttctcatttgtaattgtgtttgtggaaagggtggaataaaaatacaaaaaaaaaacagtttaaaaacactgcagaacgactgtattttgagttgtaattgtgttcccaaggtattgtgtttgagaaaaaacacagttaaaaatcggaatcaaaagcattcactgtgtgtattttccgtgtgttttgagttgtatagcgttctcatttgtaattgtgttttggaaagggtggataaaaacacagtttaaaaaccggaatcaaatccatacaaaatctatttgtgttgtaattgtgttcccattgtaaatgtatttttgagaggataaaaaaaatacaaaaaatacagttaaaaaatcggatgtaatgcttaagaacgagtgtattttccgtgtgttttgagttgtaattgtgttcccaaggtattgtgtttgagaaaaaacacagtttaaaaaccggaaccaaaagatacactgtgtgtattttccgtgtgttttgag

SEQ ID NO: 7898 - DNA, 2694 bp, Heterodera glycines
ccccccccccccctaccgccgggggtgctgatcagcaacagagaagtgaatgcgttttttgctgataactgctgctactgatcacccgaactgtccatgataggaatgtatgaaatttcggtttctcattccctggaaaaggttgcggttatgcagtataaaacattgggatttgtaggctacaataacctgtgtatcaggacaggagccaatgcccaaaaaatattttcgggaatcggatttcccgaatccaaaaatgacgaaaacacgaccagcaaatagtcgggaccaaattccgcggattcaaaaatgccgtgaatcaataagacgactatataaaagtcagaagctgatgatggcaacggtcattcctttttcccaatttatgcatttatcacgactgggaatttttttctcccattttgcctgattactaatcaattactttctctaattatactgatgaggtgctatttgtgtattctgatcaccgattacagccctctgacagataatgttcattacggcctaacgaatgaccagcagaaaacaaaaatagttgcattaataattggttttcctccaccacgccgatggtggaggaagaagagctaaggaagaaaagtgtttgtgtattttttgtgcttttgcggtggtgaatcatccatatgcttcatccattcgtccctcatccatcattccaatattatttttattaatccggttttttttctgcccacgactgcaacacagcacagcaacacatcatcaaatgatgctggcgggcgctggtggtgatggggcggggggctaagacggccatcgcccgccgtccgacgaaaattgggcgcgacaagtcggcccatcggcccaccgctaatcgcatggacgcggccctaactcctgctccgccctccggaaaataatctccccaaaaataatgggttgctgtgatcagagcttaaagtgggatgaaatttagggaccataaataattttaaaaaaataataaatagtacttttcttttgagaggtgttgaaaaatttattaaattcgaagtgatctaccatttttcaaatgccaaaaattcatttccacataatcagagacccttttcaatgctttgacccgcttttgctgcagccggtggagacaaagaactaaaaaaccaacgctaatataataaaatttgtaaaaaaaatttcgtaaataaacttttaattccgcaaaaaaaattcccgtctatcagtgcgtttttgggtttcggcgaaaatttcacgaaatttgacccccctccccgtccattttctatggctgttgcttacccaatacattttttgtagccaccaaaattaaacaggacattgctcaaattgttggtcgaatttgcatgatttttcttctggtgttgaaccgccgtcgcctccccattttggcatcacttcaacaggcaactacatgaagagccattatcgtattctttcttcaatgtcagctttttctttggtccgttcattcaccaatttaaatggcacaattggcgttgacgcgtgcgaattgaagcaaacggtgtaactgacagaagtgcgggcacggacaaaaacccaaaacgaaatcaaaatataatgtcagagtggccaaattttttttttttaaatatgacaaaatgactgaaaaactaagattcggaccccaaaaataagatttttttaaaactaatagtagcgcgaaggaaacacagtcgtcgccccaggtgcgaggtaccaaaatttgaccctaaaatcttatatggactaaaaaggccgaaatatggacgaaaaagctgaaaaatggccaaaaatgaaccaaaatatgggctaaaactgcaataatataagtttaatttaaaccataaaagtgtacatatgtattcaatatttgaattaaaaaaaaacaaaaaaaaaatacactaaaactaccaaagatggatatcattaaaaatgccaaaatttattgtccgttatataaactccttcagggaattttgtgttccattgccgaatttaggccgaatgcgatttttttttgaaaaaaattatttttatttttaaaaagaaagggtctaaaaacgcaaaaatggcgaaatattgaatattcccggaaaccccccaaaatatgatttttataaaattttacttatctagcgaatatttaataacaaattatttaatttaattacataattattttatttttaatttttaaaacaattattttgcttttaatttgatcactttgcacttcgtacttcgtcatagcatcgtgcggacgcatttcttaaattccgtcaatgggttcggaaacaaaaaaaaagtgtatataacccataaaaattcataaattggctcaaattcaaccaaactaatatttcggctctattgcagttcacacgaccataaaaaaaagacatgaccaccaaatattattattttttaaatgcatctaaattaaacattcttaattcctagtatcatttgatatccctaataatcttctattattgaacaaaatttcaaaaatttcgtaattcttcaaaaaagtgtttattttctggttctcttctatatatattctttatttataaatacctattttccattttatatttttatcgtacggctgaaattttattttatatttaaaaatttaaattt

SEQ ID NO: 7899 - DNA, 2114 bp, Heterodera glycines
attaatccaatcttttaattgatctctcaagagcaatttgattgaaaaagaatgtgcacaaaaaatgccaaagaatggcgctaaaaatggcacaactctttggcgtggcatcaaagtgcgcacagtgccaatgccaacgcaaaaacacagtggaggaagcttcatcttagagacatcatttggctcacagaaatagttagtgtattttttaaattttttttaagcaaaaagtgcggaagcgaaatttttagatttttttaaagcaatttatacaaaattttagaaattaatgtatttatttgtaagaattctttaagcaattttgccaatgcagaacaacgccacttttctgttcttttctatttgaatcaaactgctgggccattcactcgcatttctttggtggaaaatggtgaaattagcattttgccttctccattttttcaaaatgccattctcagacatcgtcgctgggcgtgccatgcaaaatgattttcttggtacaaatggtacttcatcttttttggcagattatgccggcctttggcttcttggactggacatgttgccgatggcacaccaaaaagagcaaaaacaatggctgaagatgacgctgttcaccagccgaagcagaaactgcgccatggatgccttggtagaaaacggggccgggaatgacggggatgaaaaccccgggaatcatcccatcccctccggggttcggacaatacgtcagtgaagacaatccgtcagtaatggacaatccgtcagttgacaattggtcagcaaattttattatttaaaaaatgctcaaatttgctattgttcgattgaattaaaaaaatgtatggtattttaaaacattaccagttacttaataattcaatttaatttatgtttctatagaaattattttaatttaaaaaaaacaaattattatttaacttttttcaatttaaattcattttcacattttatataaaatcttgcgttttaaaattaaaatttctgttcatggcttgtccactgacggattgtccgggaaccccttcttccgtggatttctgcactttttatttctaaatttttcctttgtattacccatttttgatcaatttacctttgatcaaattttttccttttagtttatccaatcgacagaatccgttagtcctctcaaaatgccacacgtcgaccgttttggtctttttccgccaaaatatgtggacctaatttttcaagcccaattcactaacacggaacagcaaatgatcagcatcaaagcatgggccggtgccaaaaaatgtgactgtggaccttttgagtgccaaaattggtaatggaaccaatgagagtaattaattacggattaatcgatgccatttagacggtgtcaccaaaagggaagtgagcttcaaaattgggacagacagcgattttgaagtggaattgccaggagtaaaaataaatgacaataataattaattaaaactattatatttctttttaaaaattcggtcgagttagcctgagaaatttaatcatttagtcgtcacaattgatcaaaagtaatggagtgcgtttggctcgcggcagttacctgatggatttggacattgctgtggtcaagcgatgctttatgatcagagtgaacggtgctgagttcggcggcctcagttgtccaaccggtgacaaattggcatgggaggcgatcaatcggataaaggtgctgcacggacggacggacgagacccaatttgatagaatttttaggaccaaaaaataaatcccaaaaattgctgaccataaaacgctaataacgtaactcacaaatagagaaatcatcgcaattgatcgggattcggtcgggatcccgaaccgggagcagtcccgatcgtttttccaaaatcttcgagattacctgtcccttaggtagggaacagcgccgcagtggggagggttccaccctgctctatattttttttattattcctgagctaggactaccccgaggggactgagttaggttagggaaagtaatatagggtgtaaagtaggttagacggttagagatatctctacactatttctcttttactctagtatctctaact

SEQ ID NO: 7900 - DNA, 1072 bp, Heterodera glycines
cccccccacaccgtctcatagcctacctaagaggcacttgtgtcgtccacaagggtcacttaccttcttccaagtgtgatgccagaaggaacggagtgtgggagaaagtgggataaaggacctgagagaacctctaaaagtagcgcccgtagctcagttggttagagcacggcacggattgctggggtcgtgggttcgagtcccaccgggcgagttaccttttatgttctacacaaggcggcctttattggatattgcatcccagccacttgcaccttggaatggcgaactggtagccggctactaccaggcggcaagtgttcgggcgctacctcctccccttgaccttgggaaattcttgccgtgtcagagttgccacccgagtcccgcggatttatttatttttcccatcccgaatgccgatccacccgaaaattttgcccgtccccacccgaattccgtctcttttttcttggacactgttaccctgttcagtagatgagactaattaaacatcttaaatttggcaggtccaaggccaaatgttgctgctggacaaaccgattgtgaagcaaatggacgaccaatttggatgtgaagtgtgaaattttgtttgaattggtcactaattacactaattaatgcattttcacacatttttgaaaattgggtaacagcaaagaaaagagggctaaaaacactttaataatttttcaacaattattgagccaaagtgcggggaaaaaagcattaatgtttatttcggagaacgaattaattaattaattaattgccaatctccgctaaatttactttaaaagtttaaattaatttttgcacaaaatctctcagaaaaattcaaattgtggtgcttctggaattgatgtcgaatcagatgagtgcaatggtgaaaaagtgagtcgtttacttaattacacttaattactatggtcttgccagacaatctctgctggtttcaggggcgattcccacaaaaatggcaaattttgtgggttcttggctgatttttaaattttttttttttttgaaattatgtgtttgtcagtgcgga

SEQ ID NO: 7901 - DNA, 2433 bp, Heterodera glycines
  misc_feature (1795)..(1795): n is a, c, g, or t
  misc_feature (1828)..(1828): n is a, c, g, or t
  misc_feature (1854)..(1854): n is a, c, g, or t
  misc_feature (1877)..(1877): n is a, c, g, or t
cagaagggccaacatttcgacgtaaagcatcgcgagcggagcaccgaattcgtcgccgcttttcgagtaaacgacgacagcaaccgcaaaagcaatgtgaacgaaattcagtgccaagggcatggtggcctaaggcaaagtgagcggatgaggagggccaatcactgactgaccaggacgatcagactgcgcgtgatctgcttgttcatgtccacgatttgctgctggccccacgtcttcccggacaatgcgttcgctttcactgttttcatcgtccgatgtgcgctgacaaagatcacagaatagcaaaaggcgctgagcaacagtccgtaaagagaagtgacgtgccccgtgtcactctgaagcacaaaaggcacggccctaattagcactttccttgccgaaaagccacaatttgtgccacgtacggaaacggcgtttacggtgacaaaaattgcgggcgatgtggggacggtaagtaattgggcaatttgttcgttgtaaatcacatcggattgggactttgaggcggcgttgaagaagaggacgcacagaaccaagtcgaaaaggagcagcagcagtagaagaaaagcgtaacggaggagggtaattttaatttccctgggaatattttaatgaattaattcattaaacaaagacaaattaataattaacacctgacaatttgcaaatagcgcacataaaactgaacgcaaaggccatggacggaaaaatcaatgagcaaaatccaaaggacgagaagaagaaatcggacagaggccgaactgatcaaaggcatccaagggccattgaggtaaaagacgccggcattctcgtggatgaagaaaatcgaaaaacaacgaattaacgggaaaaaggaaaagcggaacaaattcaaagggtacgggctgaacgagagcattggccaaagacaggaggaggtccacaacggcggtttggagcagtattcggctgtaagagcgcatttctttggtcgaccggaaaagcaagagccaaatgaggacggaattgaagcaaaagccgagcaaaagacacaaaaaggcattccatcgatggatttggccgatcatcggatagaaaagtaaagcaaaggttggggaaaggtaaagccaaatgggaaggtgaagcagaagccgacaatgcatcgggcgaaagtgccaaaggcagcaaaagcatttctattttcccacgctcggacgaagaaaaaaaaatcataacgcgtgcgaaatgtggtaatttagtccattcgaccaaaaagcttaaaatatcatttttaaggtttcattcctcgaaaattagaaacacaactctaaattcgaataaaacttacaattagtatctgtaatgactgatcgaaaatagctgtgggagctcaaattgctgtgggagcaaaaagacaggggccaaaatgaaaagatggccccataacagtcttacaaataaaaattgtaaaacattgggaaagggtaccgtaagcttgtaccgtaatttccgcatccattttaagcgatggatggttcgggttttcctcgacaattatttcttttattgtcaattttcttcaggactgaaaatggggcgccgacgccgaaagcggatagtactttcaagtttggcaatcattgcaattgtctttgtcggtatagtagtaattgccttgtttatcgaaatattgagaggcgcttaagacagctgaaattttggagaaaagatgttgactttttctttttatttaccgtttattcacttgacattatttttttttcgttttttnagcataaacatttgcaaaaaatgtgtaagtttnaaacaaggcccaaggtatagggccgngagaggggggggggtaatttatntaaatgatcctctcttgaaccaatcaaaaattgaaaaatcagtaaataatacttttagcagaaataaaaatagtttatttttgaaaaatggtggcattgcactaataaatttacctcattttaacagtgaaaattcattttctttcccatgattagagtccacgaatgaacgacataaaattttgtcttaacattgtattgtcaagcaaatactactgaaatctaacagcacgcagaaaatgcgtcagtggaaaatttaaatgtcataaaagcaagttcattgggttttcgaggtcactgatcacgatccggtatctatttcggcaaattccgaacccgaattcgaacaaaaagccgaaagtcacaattttttaaatttagcatttttagttcaaaaaggcgtacctaaatgatctcttaatgaattattgatggctttcagtttgtttccatgtgattaaaccgatttttccaaaatgctaatttagaaaacctggactttcgactttttgttcgcatacgtgtccggggttcagaattcagaacgatttcttat

SEQ ID NO: 7902 - DNA, 4579 bp, Heterodera glycines
  misc_feature (1514)..(1514): n is a, c, g, or t
aacccgaaagtttatttgtcatcctttttcgggttaatacattcacaaaataataatgaaaatgtaaataaataaaatgcaaaaataattaatcggaatcggatgaattgctgctgtccacaaattccttcgagatgggctttttgctggggctgctttggctcttcttcggctgattttgggaactggtctgtcccgcggacgatggcccttcgcctgcttcctttttcttgctttggtattcgctcatctcccgttcgtatcgctctttgtcctccttcgccttttgctcgtaaggctaaaaagaaaggagtaattaattagtcagctaataacggacatcactttcacaatttatttatggaaacgtgttaaaattcccaagactctgtttccattttaaaaagtacggttgcccacctgtttctcctcagcgctcaaagccttccacatttgcccggcccttgccgccgtttccgtcacactgtcccccggcttttgatctgcggtcggtttcgatttgccagatgaaaaaggcggactgaattgaatggtttttaattggttctaaggttattattgcttctctcatctaacaataagcatattcttggttttgtttgatggctttaatgtttaatttgatgttatggtccaaaaactcatccggcgattttctcctaagtcggtcgttacccccctcctgtataatttttactttgcggagcaattctaacaaacttgggtacgactccgacccgtttttgagttccgttttctccctttctctccttctcttctctgttcccacctgatttcgtttcggtgcgttcgggtccttcttcttctcgcccttctttccctccttttccttcctcttttccttttttcccttctcttcctttccctcctccctgtccttcttcctctttttggctccttctttctctttttcctttcccttatctgtccccatcaaatcgtcggatacatccgtcccatcgtccgaatattcctcgtccggttctgagcccgacccctccgacgagtccttgtccgccttgcgcttcttcatctctttctccacgttgaagtcctcgtcctccgagtcgctttccgacccggccgctctctctcgtgcgtcgtcctttggtcaattaacaaattagcccaattcaaatttcgaaaacattaccttaagcttctctttgtacgggtccaactcttcgtcactgctgccagcaaatttgtccgcctctttgtacgctttctcgcccaatctctgcgcatttcgtattttcagtccctttgtctgtacgtagtcgaagagactgttatactcttccctaaaattgcattttaaaacttcccctttctttttgcgcttactttccgatgttactgaatatgatcgactgtccactcttctgcacaatttcaaagtcgaaagagcgcaaagaaacgtccgaccgcgcgaagtgaacattgtcaacttcttcaaaacgcatgtaaangcgccggtttgtgtacgtacacaaagcccttctccagcggataaagaaaacccatcgactggcgaacggcgcacgaaattggcgggagtgcccgaggcactaaaaaggcacacaattacacaaaggaatgactgaaaagccgaccccgtgaagttgccagggacgataatgcgcgaattaacaatcacacggaatattttagccattatttcaaacagataacccttcatgtgcatgtccaatttgttgttgtattgctgagcgagttgttccctggcgaaaaccattgtaaaacttacaagggaatcatccgaaatgtaagacggaaaatggtataaactttataccatttgataaagtttggtcgatttctttgtaacttttaataagcccttatcaagaaatcaaaaagttatgaggcctcaaaagtcgaaatttaggctgtgatttccttccagcaaataaatgattttttgggcctcatatttttttgatttattgctttaggggcgtaatattaaatatttaaaaagtgatagaccatgctctgccaatagtatcaaattgattcccactttaaccgacttattttcgagtggttccctagttataattataattgtgttcacaatctgtcactcactcagtgcagcctaattcgagctcaatgtagtcctcttttgagcactcgagcacaagaaaagggtatcgagtttggccctgccgtaccgctgggttcacctgaaacaaagacgaaataacgacaaacttcataaacaaatgaatatttatatcgagtctctaaacaggtattaaagtctcctaaagttcaaaccatttgtttctgcacaaggattgtgcccttatgccataaaaagggtttatttttgtggttttttcctttttttcctccatgattttgctccacttacgtgcaatacaaaatacatgtggcgtccgtctttgtgcggtagcaaaaacattcgtgttatcgttttaagcggcactttgtaatcgtaagactttccgtgaaaggataaatggttctgaaacactttgatttcgtaacgaccgcggggagtggcgagaagaatgtcagacaaagtggcaatcgcttggccggcttcgctttccacctctgcaaaacgcagcacttctttgcgaaactcctaaacgaaaaaaacaccaatcatttcaggaactcggcttgggaaaaccattcccgggagacgatgggttttggagctaaagaaaaagcccggcgcataaggtgtagcttacaagtaacagaatttttaccacataaaaagtgattttgttgagttagaaatatttagaattaagcggatttggcggcgttaagaaaattcagccaggattaggtataaaatatttgaaaaagttaaaagcttttttatccttgaatttatgcttgagtgaggggaggaattagggtatacgcatctcccgtctccgattcattcccctccgatttcctctcatctttcatagcttttttttacctcaactacatcttggtcctcattctcaggatcgtaaggaatgtgaaagcgcatttcagtcaattggacagggcattcctcgttaggatgaaattcgacgatcgcttccgattttgcggtttgacagcgcatgacatttgaaagaggaatttcaaacgccactttttcagccacattgaaaaccagattttgaccttaatcaaatgcgagtgacctttgttaagtgtttgtattaaattagcacatcaattgggaataaactgccaaatatcaccgattagataatgaaaaaaataaccttcaaattccgcgtcaccgtaattccatcctttcagagacaattcgttcttctttagagtcttttgccatttcgcattcgtaaaagcggaaaccctttcatagtcctaaattcaatgtattcaaacgcttaaaataattacaaacgttttctttgagaccgccaaaacgatggtgcacccctgaattggtcaccactttcaggccgggcttattccccagtttttgccatcccaaatggtcaatgtccgattcagtaattgtcaacactttcccagtgcctttattcttgaattgcacattctggcgtgataatttaagaaagccttcattctgagagggaaaattgaaatttattttgaagggaaaagggacttacgaatcctcccatctcttcctgaaaaatattggagaactccaaagaatcgcttcccatttaaaatccttttgactttgcttatctaaataaaaggtcgcaatttttagttatgaaaaatctcgaaatattaacataattaatgaggaaaaatgccaaaatagtgacaaaaggtccggaatggaaaataggctttataaagtctcataggagtgtaaaaattagggcggggaattatatggaaatccatattttttttcctggactgtgggggcctgaaatgcacgaaaaacatgtttttagcttggtttgaagcttctaggatggagttccatatcaatattttccatatttcgcgatttatgtccatatttgtccatattatggcatttttatccatacatattttatgtccatattttggcatttttccaaaaaacctctattagaacggcccccagtagctaaattggcctttttgagcccaaaaaccggaaaattttccaaaaaatcattttttcgccaaattttctcgggaatattgaataaatttaaattttcataaaaattaataagtttatgtcaaaaataagcaaaaaagataaaatttcacttttctggttgatttttcgctaaaaatgagtaaattttagttttatcatgtttttttcttctaaaatgatttttaataccatatttagccatttttgaagggctatattaacaaatttaaagaaattttgggaaattataccctcaatttaaaaaatttatgtccatatttttgccattttatgtccatatttcgcgatttttggtcgatattttatggccatattttgcgatttatatccatataattccccgcc

SEQ ID NO: 7903 - DNA, 2451 bp, Heterodera glycines
gctttcgtaaatcagaaccattacacaattaaaactgtacaaaaatgttaaggcaacgtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggctcacgacgcctttctttgtccaataataaaggtaattaattaatttattattattaattaatgccaaaagacaccgccacagacaaatttcatataatataggcaatttaatttttaagtagagtgaagcgtgaccgggacctggtaacggacaactgaataccaaggttccggttttgacatggacctggactagtcccggttttcccagccaaaaattaacggtttttcaactcgaaaaggtcccggtctggtcttacccaaattcccggttccgcttaactctattttttttttgtatcgaaaaaccggaaataataaaaaaatagggacgataaactggaataaggataaatatggcaaatgataaaaactctattttattaattaatttgaaaattcaggtcaattcaattcaaatcaaaggaagccgacaacgagtgtttactaacccaaaagattttcgatacaattggactcggattgaggttgattgttatgtgagttaggtttttctaatttcaaaaatttgtttaattgattaattttacagaaggccgatgcgggcaccgtaagcttttggggctacagtaacccggagacaaaggaaatcattcgggtggacgaagtacactgtttgacttatgaaactgctagagtgccaaaacggttcaaaagtttgcaagtcgaagaacagccgccgatgaaaaaactgagtccaagtccattcttggccaataatgcttcatcacttatccatgtgttcgtgccatttgttggccatccatgagagaagggcgaaatcagtgatcagtggatctgtctgctgagtgatggtgatcagttggccaaattccatcaataaatttttatctttttttttactttttaaaggggttcaatattttaattcctcgtatatgtatttttagcgcattatgcaccagcatgggctatattattttttgggtaaaagcacaaaaatatctctccactaaatagacataataattagcaaattttgtcaattaaaaatttaatttttgtgcctgtggtggtgtctttttgtttattttttttttgatttttccaattggaatatttgcatttgtttaataattcaccaatgtatttttattcatttaattaattattattttatttcttaataaaatccgtgtcaaagtcttttgaatacagaaaaatttaatgaagaatttaacccatgaaaaatggcgttatggaaaaattaacaaaaattgcttaaaaaaataatgtaaaatagagtataaatttgagaagtaatctaagactatttcaatataaaccctaaaacacatagaatttattttacttattagtcaaattttgcaacaagccttataaatttaaatttagtttattaacattaaaaaatgaaaacttgttcactttaaatatataaattttttagaattaatgcaaaaaatatttaacatgagatttaaagacaaaccaccccaaaaatgcaatttaaataaaacattctctaaagatataaaagtcatatgcatttataaaatatataaagcaataaaactttttttatttggcttaatttcaactattttaaagcatttaagtcatgcttattttaatttatttttataatattagagtgcctacggtatgtatgactggggcaccataatttttaattaaagtcatgtaaaattcattcacatataaaaatgtaatttaaaattataaataaattcacatattgatcagtaacaaattaatttaataaatcatacaaatatgcgtagaattatcaagacgaatacaggctaatgagattaaatgagcaaaaaaagctaaaagataaattaaattaatcttacttattttttcaaaatttatttattattcgattgtgttttcattttttattttgccatattattcgattttatgaatttattatcctatttcaaatattttattaataatttattgttttacattatataaaaaatatttttaaactatttaatatttttattttttcctcacgaataatttcccatgtcgtcgataaaaattctattaacagttaaatttaaataatttattgatgacaactaaaacaaataacttttatataaacaatattaaaaattataaatttattaataaacatgcggctattataacgaaaatattaagaatatttgtaagtttgcaaaat

SEQ ID NO: 7904 - DNA, 5086 bp, Heterodera glycines
  misc_feature (61)..(61): n is a, c, g, or t
  misc_feature (99)..(99): n is a, c, g, or t
ttttttctttaaaaatttcaataaataatcagaattatttttttaatttaataaatttatnaattacaaataaattttttgcttttaggcattaagtgnaatgcaataataagaaaactttatttgaatatatatttgcatttaaaaatccaaagaaaaaattataaattaaataattagtagaaaattataaaatatattgagtatatttagtaatttaataattttgattcttgattattgtaaaaaataatatatattctgtatcaaaatgaaatggtgtccttataataaccaaatataaaaataaagaaatttttatttttagtgaaatatggtatttatttttgtttaaagattgcaacaagagatttactttctaaaatatatgatttttttctaaatttttttttaaatttttatgcttattttgtgcatcatcaatttaaaaattgcgattagtaattgtgcttattaattgtttcttttattttttttttaaataattgtaaattagttttaattttatattaatttaaaaattggaattttttaattgtccaatataaaaatcataaattagttctaatcaatgttcacttccccattattttttgaaatttaattaaatataaatatatttgacatttcgattaaaataatggtttcggaatgtgactttatataaaaaaagtaatggattataaagtctttttcgcatgaaaacaaaggttttttctctcataataggcttttgaatgtctatttttatagatttactaactttatgataataaattcatcggaattgaatgtattacgatttaataatatattgtataccaaaaatttaatgcaattccgtttgtttatataatgaattaatattttttacttattgtaacaattaaatttgttttaattgaaataaatatttattaataagttttctgtgtttattttatgctaatcagtctatcattttattatatatttctaatctcttttcatgtcatattctctgtgaattacggctgattctggctgttgtttctatattataatgcattttttatctctctaatgataataaatattaacgaataaatctcacaataaaacgattactgttttttgttttttattaatttaaaagtttgtatcttacaaaattatctttttatgtttgtttttttgaaattaaaaatgttttactattgtataaatatctttataaattttttagaattaatttaaatatattttaattttccatttattaggtatttaattatttatttcattatttctttgaatttattttcttttaattttaataaaagcaaaatttaataataaaatattattcagaccattattatttaaaattttttaaatttaaatctcttgtttcgttatctaccatgatctcctatttgacgaacgactatctatatttgcattatttgtatttgtaagaattttttatgaatttatttttccctcttacaaattaattttcttttttttcaattctgtttctttaagttttgatttgactattaattttttaaacatgctggttctcattttacattttaatcagtttggatggcttaaaaattaaatttattagctaaaaaatgatcaaataaaaccccaagggaagtaagttttatattattttcaccttttaaaagaaacaatgtaatcaaatttatatgaaaagaaaagaatatttttaatttataaaaacaaaaataatatatgtatgtaaaaattattgcatatcaaactctagggtgggggacatttagtctggccggtatagtctgagccaagtttaaagcatcataaccttttctcagctggccaaattttataaattgagcatatttcgagagctctatgctaaattctgacgaataatcatttgttgtaattaatatttattaaaaattgcttgggaaatgatagaaatatgacttgcattcaattttattttagaaaaatatgttaatttaattattatttatttgattcaaataaaaatgaataaattttaattaaatttttgtcttcgtttatatgcaaagtagaaatgaataaatattgtatatttggtaaatgttgtaataaaaatagtataatgtcaaaagaaggcagactaatggattttttctaacttataaaagtataatatttaaaaaaaatggattttgttaaaattttaaaaaatattaaaattaaagaaaaataagtgttgatttaacatttaacaattaatattaatttatataaataaaaaatggagacaaaatggaatggaaatgaataaaaaaataataattttaggaattttattaccaatggggtcgtaaaatattgtgctatttaaaacatgaaaataataaaaattataacaattttattgaatgatataccataaaatcctgctgggccgtttcgtaaaactgccaagcttacagatttttcgagaaaaatcgtcataacttttcttaaccttacaaaataagtttttctcttaaaatctgtaaatttggcagtttttatgaaacgatctagcaacccataaatattaatttggttgaaaatgagccaatatacgaagccaatgtgatcataatatattcataatttagcttctaatttttttttgtttaaataatttttaatgaatactttttttttaaaattatattattcaatacaaaatttttctcaataggtatcaaaatttgagcaatattctatagagcgaagcgaatttagtttgtgcatttttctatcggcttctccatttattcatctatttcttttttaattttaattaaaatacaaaataatactaaagaatgcaaaaagaattatattaaaacaaatattaataaaggattaaaaatattcgaatggcaaaactcattagaaataaaatataaatcaatgatgacaactggtgaaaagagaagacaaatatttgtcatatctttaaaaatgttgaataaaactaatttatatttaaatatattttcaaagttaattttttttttgaaattctttatagcttcttacaaataatcaaattatatattttcaaataatatatagacttattactttataagtttccaaaatgttatacaaataatatttagcaaagttttttaattaaattcacttgcaaattaaacaagaagagaatttaattttcgatttttggaactattttttataaaaaaatcagctgccataatttgtatttaatctggattcgaaattaactgaggatattcaaagacaaaaaaaaattaaaagaaacaaaaataagatgcatttgtaaacccattccatcatacctatttaataaattttttaataaaataaaaacttattatttttagtttttatgaaaaaaatatacttatatgcaaatttgacgaaaagtagccaaaatattagagatcggtattttgaaaaaagcctggacctggacctggattccatgttggacctggatttcctggacaaaaatccaggaaaatccaggtctaggaaaaatccaggctcctcgagacctggatccaggcctggacctggattttttgaaatttttttaaaaagcaaacaaatgcctgaaaaaatcaattatttgctagaagcatctaaaaatatctaaataataataataatgtgtttttaaatttatttaatctgtttttgaaaacttgaaaaaacatcggtcacttgaaaaaataaattctaaaatttcgtccaggaaaatccaggtttttcctgttttgcctggagttttattccgtattattcatcggttgggtcccctttttggaagaaaaattctttttatatttatgcttgtttagtatgatagttaattttttatcttaaaaattttctttgcaaaaaatgaagggttttttctaaatataattatgtgatagtacaaattttaattattataataaatctatacattgaacttatttattttttaatttacattttttttatatttatagaaatgattattttttcaatgtttttgaaaaataaattatgccaaattttaattggtaaaatatacaaatccatgtgtttggcattagttttgtaattttgttaagaaataaatttattcttttttttctattcatttgaagtttcatgttccgtgggttgaatgattttatttggttgataagctgttttttaacaacttactatattttataattaaagttattaaatgattggacacattaacaaataattattttgaaatgatttcttaattaattatataatttgaaataaactgtcacctgaaaagcttttttactcattttaattttaaaaatttgcttattttccatattttgtagataatacattcctgaaatcaaaaaaacttcaagtttcggaatttataaatacaaaaaaaaagaaatatttaataaacttttcctggaagctgaaattttctagaaaaaattttaacaatattttttggttttttatttagtaatatatttttccagatttaaaattaattatttttatggcataattcttgcgaatttgacccatctacgatctgaattgttggcaatggatttgtacaatatcaataaatattagatattcaaatgtatttatttaaaatttttattcaatattttaattgtagacttattatttttctgatttacaagttcaattattcttttgataaaatttttttagaaaattaattgatttgttattccttaaaataattaattaaaataaaaattaaaaagcaaagcacatgattgatatttattaaaataaacgacatattcggacattaattttatatatttttttaataattatgacaattgctcaaaagagaattactcaattaatatgttttcaataagcaaaaatagaaagagataattaaatgaaaataataccaaaagaaaaaattaaaattaaattaatttttaatttttataaaaaataagtataagttaaaaatataatttttattattagcaaatct

SEQ ID NO: 7905 - DNA, 1933 bp, Heterodera glycines
cgtaaaagggggcggggaattgcggggggggggggcgtgagagagggagaagggcaggcaaaacagaaagtggagggaaacggacgggcaaatgagaaaaatagttagctggagagagaaacgagggggtggaaaagagtgtgtgctgttttgaggggaaaagaaaaaaaagagtactttaagctgcagcactttttccttcgccaccaaatttatccgccgatgctgtgtgccacacaacaaaaacagtaaacaaacacaatttagccatcaaagtacgggcaaacagcagcacagcaccaatagatttatatagggttcctccccgagtctcggggagcaaaatgtcggggaacggggaggaaattccccgaaagaatttgtcggggatggctggagaaatttaaaaaatgtcggggagcaacaccttcgtcggggagaaaattttcataaaaagtctaaaaaaacacaaaaagaaaaagtccagaacaaaaaagtcttaaaaactcatttaaagattcttccatcttatttcaagtgcaatttacgactttcgtaattccccgaaacatgtcggggaggaaccctagatttatacatagattgtgatggacacattattgaaatgaattcaaataaaaacggcaaaacatttccggggtagaaaattacaattgggtcggcacttccgtgttttgttactccccccccctcgaaaaattttaaaaattcatattttggggttttcaaagtagctgatcatgaagtgtcttaaaacttttcgggggggggggggatggtagcaaaacacggaagtacataccattgagttttgagtaaactcaacctccaaataaatagagaatgcagagaaaaacacatatctttttttctctaatttttctctccttttggcgtacaatctattttcattattgggaaaaacaacattcacttctctctaagaagcttttcttttttctagctcatcaaattgtttagcatttgctaagtaaaagcttttcctcatcaggagctttcaaatgatatcaagattgtccaatttggttggcaaaacccttcaaaaataatttctgaaaattttaaattttttgtacaaaaataaaaatacgtattcttgttgcacaacggactcgaacctccgtcccttgtccctttactatcttacaaaaaccacttcgccacacatttaaatcttttttggtacaggagctcattttccggacgctgtgtaaaatagcggaggtccaagtccgttcaacaacattaatatttttattcattttatgtccaaaaaataataaaaaatggctatcattaaaagatatttaattattttttgggccaaaaatgcacacctatacctaattctaaaacttataaatagaatccgataaaggtgcccaaaatatggatcatggcaaaattttaagaaaattggccaatacgaaaaaaaatttttcaagggcaaaaaattttttgtgtttgtatttgttcttttggctttctgtttttatttttatttagttacgaggacttgaacacgggaccctctttttgttgaccacaccgatgaaaaatccacttatttacactgggagcccaaaattgattgtatgtgggcccccgaaaatgggtggtccataaaatatgcaatggaaacgaatatttcagaaattctgcgcgtcctatgttgttgtttttaaaattcaaatctaggccccaaaataaaagtacaaaaagcagtcttttggccagaaagtgtcaaagaccaattggggagaaaccaaacacaaattttacattcacaaattcaaatattgggcgctacttgcaaagagcactatttttgaaaattttttcaactttttttttggtcaaaaattttttttttgtttaaaaaagtccctga

SEQ ID NO: 7906 - DNA, 2344 bp, Heterodera glycines
taacattctttttttcattaaaacaaattaaatttacttttttgtgctttgtttgtttccgccccaattttgtatcctttttattatttctctaaattggactaactttggaatttgtgaggaatttcgatggcatttttttgcctcaataatattaaattaatgcaaaacccagccacaaattttgaaaatttttcgaatttgaaaaattaacaattctcctcaaactttcgaaatttattcaaactattttttaatacgaaaataatttaatcatttttccaataataaaatcattttgcccttcttttcctcatttcaaattcaaatgccttcgttttgccgccttcttgcttcaataataaatgttgcaaagaatgtcatccatttatttatttattgttttttccttttgtcgagaatgcttttcatatttttatgattaaacctttcattttaaaaaatttaaattgcaaagttttgcaccagagaaatagaacttgttggactagaatgtatgaattttaaataagaaataattaattggtaattttaattacttaaataataaattggtttgacatttttgatttgataaattttttggcgctacttgcaaagagccctcttttgaaaattttttcaacttttttttggtcaaaatttttttttgtttaaaaagtcctgaaaccaaatacccgggggttttaaaggtcgctgattacgaatatgacaattatttgggcctattaagcaaatttggcgctagttataaagtgatagattttgtattttatcaaaaaccataggggggacccttttgttttgtaaattttttttttggataaaaatcgtgaatatacattttattcaccataattgtgctgttaatacttaatatccatcattatgtgtaaaaaaacaaaaaaaaattttgaccaaaaaaaaggtgaaaaaattttcaaaatagtgctctttgcaagtagcgccatattgcatacataaattcaattagaatatggaataaaaatttatgtcattaaaatacaaaaaaacgcattagtcaaattcaataaaggttgagtcattgtggccctaaaaaggacaccgtttgggatggtttttctttcgtctattgtccctcgtccatctccgctcattcactgacttcgctgtgctgcgactttttgggcagaagaaccgggttgatgttcggcaacacaccgccctccgagatggtgacgcccgagagaagctgaaaaatcacagatttcaaaaatagtgaaccgcccaaggcttctattacacagtttatgtgtccaatggcttttttttagaaatcaatcaattaaattaataatcattttttttgtaccaaatcctatatttttgtggtaaatatcggtttaaagtcacaagagcaattttgattttgggacctcaaaccataaggcccaaaaaaacaggatcgataattgtattgaattcataaaatggcattggactcgtaaagtgtgcaatagaaccagcgcccaattcgtcttggccatctcaacgcgggccaactcgcaaggtgcggcggactaattgaggtgtgaaacatgcgtcgagattagggatggaatcggaatttcgaggcccagaaatgtcggaatccttgccatccctggtcgagatggacatgttcaattaatcacaacgaaacaagcccgatccaaaaaacaaaaatcggctgctgtccgaccttgttcaactcctcgtcgttgcgcacagccaactgcaaatggcgtgggttgatccgcgtctttctgttgtcccgcgatgcgttgccggccaactcgagcacttccgccgtcagatactccaacaccgctgccagatagacaggcgcgccgacacccacgcgctccgcgtagtgacctgtgattttgaaaaatgcaaattcgaacccaattaaaaactgatcacgaatcagggcatccatttcgataaattccgaagcccggacccgatttcgaacaaatagtcgaaaattcaaatatccaaaaaatgcacctttgcgcagcaaccggtggagacgtccgacggggaattgaagtccagcccgggatgagcgcgatttgttctttccgtcctccgtcttcgcttttccgccctttcctcgtccggacatttttgttggttggagagcaaaaagcgaaacagcaaagaactttgagaatggagaaagtaagggaatgggtaaatcggagtgattaaaaggattttttctttctttttttgtatgggcgtggcttcccaacgcgccaaatgccaatttgaataaacacattcggttttggca

SEQ ID NO: 7907 - DNA, 1164 bp, Heterodera glycines
atgtgccttgtcgattggaaatgtattaatctgtgactgagccttttatgagctgtgttaactttctataaattagggtcatttacgtatttaattttttgcgatcttttggtgattttctatgagttttttagtcgattttttggagttttgctgtgggcatatcaaatcaaatcggagtttgaaattgtaatttctttaaaattttttgacgaatattaatgtttaaattaataaaattaaatgcttcagaattgatcaatgatcatttctgcatgttgatcaaatgatcagtctttttgaagtttttttttgaatgctcattttcaagattctgaaaaaagcaaattttcaaattttttcacatgagagccaattttcaagtatgtacgtacttgccattcaagtacaaattccatcactgaattataggccaaatatcagtttgaaatcgaatttattaatgaaagaatgtgtatatatgtacataaatttatctatttataatccaatgtttctcaattagtgaaaaacgcagaatttccggtgcggaaaaaccatttcattttttctataaaaggcgctgaatgacgccgaaatgtccattctcccagcagcagtattcttattttccaagcaccaccatcacatcacacacagccgcagcatcgttctgcttcatcattcattcattcatcggttatcgtccgtcacgcgacgcatcatgaggaagttcgcctacttcaaactgtgccaggccgtgctcacttccgtttttctgtggcaaattctctcaacccaccaattctgtggcgaatttgacgagcctacggtgtgctttttcggcattttttgatttctcaacccatctaattaaaatttcccatttttcccaggccttcttcaattccgctgtctcctcctcctctgctggcggccattgcgaccatcagttcacgctcatcggaatggactccaccactggcgaatacggtgccgtgccggacaagcagaagtggcacatgcaactgatggcgagcagcggcggcggacaaggccaaccaattgatgaacaacaacagcaacagaagaatcagatggaggaattttcgtcaaaattgccgactgttggacgtcactgcattccgattgcggtcaatgatc

SEQ ID NO: 7908 - DNA, 765 bp, Heterodera glycines
  misc_feature (57)..(58): n is a, c, g, or t
  misc_feature (60)..(60): n is a, c, g, or t
  misc_feature (64)..(64): n is a, c, g, or t
  misc_feature (72)..(72): n is a, c, g, or t
  misc_feature (98)..(98): n is a, c, g, or t
  misc_feature (107)..(107): n is a, c, g, or t
  misc_feature (111)..(111): n is a, c, g, or t
  misc_feature (136)..(137): n is a, c, g, or t
  misc_feature (190)..(190): n is a, c, g, or t
  misc_feature (608)..(608): n is a, c, g, or t
  misc_feature (620)..(620): n is a, c, g, or t
  misc_feature (638)..(638): n is a, c, g, or t
  misc_feature (682)..(682): n is a, c, g, or t
  misc_feature (726)..(727): n is a, c, g, or t
  misc_feature (752)..(752): n is a, c, g, or t
cttttagaacgaggaagtacaaaatgaacgttatgttctcacagggcccctcagaannanaggnaatggaangaacttaaaaattaatgatttttgangtaaagaanggangaaaggaaatggaggggaagtgaanngttgtgagttatgttaataatagagatgagtggatttttaagaaattaaatanttaatagaaagaatagttgatggatgggttaataaaaggaaaataatgagaaaattgaaaaaataaaacaaagaagcaaggatttaaagtagaaaacagctattaaatgtgggattgattatgcccatgaaaaaaatactgtattactgatttctattggagagagtacggtaattaattatagaatcttaccgaaaaaccgaaattttaatttaatttcttacataaatttttcgcttctttttttctttttgtgtttaatgaaaatatttaggcataaagcttgaactgcgagagggaaatgtaaacagaaaatagcgacgggaaaagagaaagagagagaattacagcaaatattattggggtggtggttggatagtgaggcaaaaatttacaaagtatttgatggaggaggganaaattgtttttntaaagatgaaaaagaatngataaatgaaagagtaagtatttggtaaataaaataattaatgntatttaaaaattgattgattaattaatttaagtagaataaaaannaaatttgttggagtttggttttttnattgagattattt

SEQ ID NO: 7909 - DNA, 6350 bp, Heterodera glycines
atacagtaatcctttgaaaatcccaaattcttacaattatacaaacatttaaactcttaccgtaatccattaaaaacatttaaaaaaatctggataaactatgccagcaaagtcagcccttgccaaaagccattaaatacgtaaaattaccgtaatccccgtaatcctaatcgaataccaatatgattaaatgaatcaattaaaacctaccgtaatggctaaaaaacataaaaattcaaaaattcccccttctccttgtagaaattccgcccatggtcaaccaggccaagcaggtggcgatgagcccgcgtgaccagggcaacagcgtgcgctggcgcgacgccaacgaccgcctgctggactcggtgcgctcggtgggcgacgcgatcaccggcatgccgtccgcgcgcggcacacctcagccgccgccggcgcagacgcgttaccaaccaactgtaacgcccgtgccggtggagcagtacaaccacgcggcgtccgcgtatcggccgccaccgtcgcaacaggcggcgtcgccgttcgactccagctacaatgtgcaacagcagcgccaacggtcgccccagttgccgcccagcacccactcggcgagtttctcatcccatggagaggggatcgattagaatacaatcgctagcattgggttacggtagtaatatagtgtagcattagagagttcgactttctggacggtagtgatgctcgtggacacctatatgcactcggtatcgggtagataaatttgtgttcttcgactctcatcagtggattaattctctaatgagagtgctacagtaacgaggagttgtggaatacggtagtaccgtagcataacgaaatggttacggtaccgaccccctttttttgtccgcgggtggtaatcaacaatttgttgatcaacctcatttttttgattaatttgtgatctcgactctcatcattggattaattctctgatgagagtgctacagtaacgaggggttatggattacggtattacgtagcataaagaaatagttacggtagcgacccccttttttgcaccactaattttggatcattaattatcaaaaattcaggtaatggagcagccgatgcgcgccccgggcgagccgctggtgcacaatcggctgattgtgcgcgaggaaatgccggccccgcgccgtccgacgccgcccgtcgaaatttcgcccgccccgcgaccgccgccgccgcccgagctggacgaggaggaggagacgcgcgccttctgggagcgctaccagttgcccaacgcccaataccagcccatcctgagcgcggcacacaacctccaccaggtgggcgggcggggcactaattgtgagacgcgcgggatggggcggaattcggcactcgagcatagtgccactggatgtcgatcggatggcatcccataattgccatgtgccacccatcccatgtcgggaatggtcgcattcgagaatagccatgtgccactcccaatgtttggaaatgcgacactcgagaattgccacataatctctgggatggcatattgtcactcgaggattgccaaaccattttgaccgggtgcttgatctcattcgaaagtcttgtttggtgcctgttagggtggggccgccgtcattcgagagttcggcactctataaaagccatctgccgcccggtctcgagaatggcactcgataattgtcatataatctgggaatgacacaaaattgtcattcaagaatttccaaataatttttttggctaaagtagctataccaatcgattcgtctcgagaagataagcacgaaaaaataggtctcacgcggaaataggtttaactcgatttttgaaccggtttaaaacccgaaaattgagaaaattaatgccatcattggccacaggaattgcgccagtggagctccaacgagaatgacattgtggcagctgccaaacgcatggccattctgatggcacgactgtcccagctggtccggggcgagggcggcaacaaaaaggatctgatcgactgtgccaaggtgggatcagacaagtggacaaaaacttttaaatttggaggacaaatggtcgacaaaaatgccgcgacaaatggacaaaataaatataaaactgtccttttttgtaggggtgggggggggggtgggggaatttcgtaattttttaagggttcgggttttaggactctgatttctgaaaaaaggactcggattttcaatttcagatttagaaaattttgatcgaaattggcaaaaaattgcctattttggacaaaggactaatctttttatggacaaatggtcgacaaatatgtataaatgtgcgacttttcacaggcaattgccgactccagtgaggaggtgacccggttggcggtccaattggcgcgcctgtgcacggacatcaaaatgaggatggtcagcgaattaataaatataaattattagggcttccttttttaggcaaatgcctaaaatttttgtgcacttaatacgcacagataagcacgaaaaacgcgttttccgcttggtttggggtgtctacgatgacttttataatgcatatttttgcctatttaggcgtttttgaagtgcctaattttaggattttcgaaaaaatccttaacaaaaatgcaataaaaacgaaaaacacacccctaagaattgaaaagttaaaaaaaaattaatccaaaaatttaatatatattttttcttaataaatatttttgatttaaatagttctttatttggaaaaaactttaaactatttaacaatttcatttacaactatttcgcaattttttgtccctaaaaaaggaagccctattaatcacgaatatgacacgtcattgatatctacggcttatttttactttaatttatgcgattcaaaaaaatacatttgtacgtgtcatttttaaacatgagttaaagaacaagtcggcagaataaacaatacaacgaccactaataaaattatcgtttatagcccaatttcttctttagaaattttcctcgggttttggggaagaagtgcgcggttccatcttaataataaaagaatattacatgaaagatgtgactgtaaactagcaaaagcgaactgaccatctgtgcaagagggtaaatggcggacaattgactgcacgaaaaggatcgtttacgagtggcgcgcttcatttcgccatctttgcgggaaggcgtcggctgctttcctccgattggattcagtgcgcgaggagcagtacgaccacacgaatttgtggttacgaatacattgcgtcgagaagcggacgaagtcgcgggacgattcggcgttgacggtttcaaaggagtcgaaaactgctgtaattagaggttcaaaaacaatcaatggatgtatggtaacgaagaaccttctgagccttttgcacttctcggtcttggtgataactttgcatcacagattcggcgtatttgtcagctcgcaatccctcgacaataatgtcgtttaattggaaatttttgacgtagtcgttgcataactcacaaagctcgttcagcaatttcgggactttttgttccacgatttttctttgctaaaagtttcatttgctcaaaattatgaatccgattaacaaaagggacatactctcccattagcagaggaaaaacaatttttggttgttttcaaaccgccgaactccatctccgtttcttttatccctatttccccattctacacaaaaaggaccttcagttttgtgttcagactcccagccctgttcttgtagaaagacgcacgacacacacgccgttcggtgtccaatttctgcttccaactggccatccattcgttcagtttgtcaaatacgggcttcgctcgctcgtacatttgctgacggattcgaacttcctcctccaaatttagcagttccttctcgctcagattttctgaaagattacatataagattaatcacgcaaataagcgttttgaaatttacaaggatttcaatgacttttactttgacaattgtcacttactcaaatttggctttgctggaaactccgtagaaggttggaaacattttgcggataactcgtctaatttaacgagcagctcgtcatagcggaagacgacctgttcagcccacaagtcgtgatggtctttcagctaaatttgtaggggcataagcaaacagagatcgttaagcccttcgttcgatcgcccttctttgaactcactctttcattgaatttttccatcttcttcagaaagtcagacgataacacggtggattggttgtacaagtcaacacgcaaaaaatggaggtcgtcttcattgaaactattgatggacgggcgaatggtctcaaagattctgaaacgaaatttgaaattaataaaatatgccaagcaccgtttgctctccgcttggagctgaagtgccttctcgagccgtttgtttacaaaagtctgcagcgcgtccacctcgcctttgagtttgtccaactcatcttcggacataatctgtaacaaatcattttagtgttgtctccccaatcgctctctcactctgtcgtgcactccttcgatttgtcgcgccgttgttcccaccctatcgcacaatgctttgtattttcccgtcagcctcgcttggctccccacaatttcctcccttttcgcttccaatcggtttttttccgaatcaaggactttcagcttaaaaaaatcagtgaaaatgttagaaaaaatttgaggtaccaatgcgatcgatttgggcgggagaagcgactcgtcgaaggaaggcaaccccaaaaaatccctcagaatggtcactgcttttcggcggatttccaagtcagaaacaatatcacggaccatctaaaattgcgaatataggtaggtaaacaaggtcaatgaagctaaaataaatattttaatagctccatatagtcgttaaaatagggagtgggaaaaccagactgaaacaacagttatggatttgggatttaatgtcttgaaaccaagtgtggaatggatttgggtttgacctagaaaagatcttaattatatttacttactttctcttctgattttctgatgtcctgtaggagattggtcataaattcgcaggcttgttccacgcggcattcccgggttggcaagtccatgtgaacagtgtcccagagttggttcagatacccaaactcatccctaacactgatgattacattctcaatggatttgtcaagactgcttttgaaatgtgggaaaagctattataaagatgtaatttttagaatagcaaactttttttgcgtgttggaagaatttgattcgcttggactaagaaatatcgttgactgcgaattaatacttttgttttttgtaggtgacatatgagatggatttatttaatattttgacaatgcttaaattagaattaattacaaaataataaaaaatgaatgagagcaaaatgtggtcgaacatcagaatctgcattgaattaaagccggatggatttttcaaaatttaaaatagtgctagttaaaaattttaaattgttgaatctgtggcgttacttttgtttgagttaaacattcattttttgttttaagaaaagttataaaatatatggacaccgaacacgcagaagttgattttgaagatgaaggcgattacgagcaattaaatgccaatcagaatagaaaacagaaaaaggccggaggatggcaatctatgggtaaaatttcacttttgcctattttggcattggccaatgaccccgcaaattttaaggtctcgaccattccgtcttcaagggcatccttcgcaagggttatcgacagccaacgcccattcagcgcaaagccatccctttgatgtgcgacgggcgtgacctcgtggcgatgtcgcgcaccggctcaggcaaaacggctgcgtttgttgtgccattgctgcaacgactgaaacaacgcgatgcacgcggcattcgtgcgcttctcttttcgcccacgcgcgaattggctctgcaaacattcaaaattgtcaaggaggtgaaaattcaatttaaaagggatctcgcttttctttgtttagccctctattatcgctaattaaccatatgtgattttatattgcagctcggccgtttcactggtctttactgtgcctgtcttatcggtggcgacagtatggacgaacagttcaatgcccttcaccaacacccggacatgtgagcaccacaattaattaaattacatacaaaatttagaaataacataattttaaacttttgttagtctcatcgccacgcccggccgtctgctccatttgg

SEQ ID NO: 7910 - DNA, 1122 bp, Heterodera glycines
  misc_feature (1027)..(1027): n is a, c, g, or t
  misc_feature (1067)..(1067): n is a, c, g, or t
  misc_feature (1072)..(1072): n is a, c, g, or t
  misc_feature (1111)..(1111): n is a, c, g, or t
ccaattcattatcatataatatataaagccaaggagcatttcatatttttgttttgaatactcactgatttgcatttgctgaccatttctcataaatgcaattagcattttatcgtctccctaattaaaatgattagacaaaattaattaccctgattgattatctaaccgatggatttgcagcagggatgggccaaattgaaaaataaaaagcgaaatgcgaaaagcgaaatttgcgaaactgaaaaatgcgaaatgaaaaaaaagcgaaatgcgaaaagccaaaatatgcgaaaatgcgaaaagcgaaatgcgaaaagcgaaattttttctacaaatttttaatagttaaaatcataaagcaaaaatcattttttaaaattttattccaaatttaaaaatcaataaaacgctttattgaggcgcgctttttccaaaaaaactttttgggaagagggggcaggcggcgccgggaaaatttttgaaaatttgattaaaatttgttgacagattttcaccaaaaaatcatcaaattttgtgatttttgtatcatttttctaatgagaaataagagttttggcgcgccgctgagaacagtttttcagcaaattaccaaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgatttgcagttgtaatgtgaattaaaaaatgattcataataataataaaagaaattatggaaaaagaataaaacattatttttcttaaataaaattaaagcccattaattattttttcaatttatttacgtagaagtgaatttaaaaatgtttttaataaatatgaacaacggagatggaaatcatacagccttatnaacgtagcaaaatttgtttgcttaatataaattatatatntttanaaattggaaatgatcatcagtaggattacccaatctatntttactttata

SEQ ID NO: 7911 - DNA, 3996 bp, Heterodera glycines
gcaaaatttagtttagcttaatataatttatatatttttaaaatccggaattgaatcatcagtaggattacccaaatctattttttactttataaattttcttcatataatttagtatatattattattattaaattatgatgcaattatttaaatcgacgatcgatcatcagtagaattatccaagtcaattttttactttataaattttcttcatataatttgtatatattattattattaaattatgatgcaattatttaaattgatgattgatcatcagtggaattatcccaatctattttttacttaaataatttattattatttaattaaaaaatgatgcaattatttaaaatgattaatgctcaccggaagagttttcccaatctattttacttaaataaatataccaaacgaaattgaaagtcttcgggaagaatttgagcaaaaatggaaaaaatgtgtgaaaatatgaaagaaaatgtaacggaaaaatgccaaatttggcactttcttttcgtcaccaatttcataaaaattctctttctaattgatttgcttttcatttcataactttgattttaaatgccgcttaaaaaatgtcagacacagtgtgacaaaacttgaatttactttttttttccaatcgaagcctattgaattgaataatgagctagttaatacaccgtctgaatgggaaccggccactttggcgcaggccattttggcgcaagactctatatcattttgatttcacagcaaaattaaataatcttggtatgattttaagtcgcttgatagtgcctattaacctgcaaagtttcaaaaaatttagctgagacacaaaaaagttatggccaaaaaacctcaaaaaattgcattttcctggccattttggcgcagcgcgccatatcttttttaaaacctaatataattttttgaaattttgcaggctaataaagaacatttagacctattgattaatatcaacattattttatttggtcgaattaaaaaaaagttatgaatctttaaacttgtctgcgccaaaatgaccccgacccatctgaattctctaccttctaaggagaaatgcacaaaaaattgattgcgcgggttttttttgtatcttcttacttatacgggggatttttacgggacaaatttggtatcattcggaagctcttcgtgagctatgtctaaaaaacagaggatgaaattaatctgacgtcaataaaccggtttttaaaccgattaaaacctatgaaaaaaccagcgcatactcgactacggcagccagtagttgaggcgagactacgggctccggaagaagtccgcgcgtgattgttgaatttgttttgtatttaattatcccgtactgcagcgtcttttttcagttgtctattgtcaaaatgacacctgatcaacttttaatatagctagatcgatttgtctcgtcgagagctgtcgaatgatacgaattttgttcaaaaaattttattttcacttgttttcgtttaatttagggtcagttttcgtgggtttaatcggtttaaaccaggtttgttgacgtcggatcgacttcatcctctgatttttagacttagctcatcgaatgataccaaatttgtcaggtttcgatcgttttgaaatcccccggataagtcaggagtgccgttttttattgaaaattggaaaattcaacgatgaatggaactcttgggagtgagagctcaaccactaggccaccaaacagtttggaggtagggagggaattatggaaacatttatttgattagaatgcatatggaatttccagatttgttctgtccctggagaaaattttatgccaaaaactcaaaatttttacgattttaaattgcatttcgtaaaattttttacgaaattcaatttcgttttcctattttcctttaataaaatggaaaacaaaaaaacattttaatttttatatgttttcgtttcaacaataataattttttatttatttttatattttttgatccccaccgccggtttctcccggtccggcttctcaggtaccccaaagtcgtggtcccggttttggcaaaaactctcggtcccgtgcaactctcgtttaaatgacccgcctactttaattgcaaactaaaaatggaaaccgggttttcttcccatttgaataaagaaataaatgaaagtgaaaataaggaccgaaaatttatatacaaaaaaacgaaataaaaagataggaaatgaaaaacgaaggactcgaacattgaggaaaatgaaaaaatttatgaaaatggcgccgaattaaaagtgacaaatttgtggaaatattcatctctcagatcgtcttttgcttcttcattttttgcgttttcaattgctttttccaattttgccctttctttcttggcattttcttttgcattttcgtgcatttttcatttcttcgtcaaaatgttttcggagtttgttgacatattctgttgatcgagaaacattttttgaaattgttttttaatataatacaaatccgtctcatttttcacctcaattttgcaagaattaattttcttaaattcaccacctcttttccaaaaacttttcgaaaaattattcagctttctgatgaaaccaattaaatttaaaaaatgttgtatgcttttaaagattggcttcagcactgcaattattccgaaacatccgaactttttggttaataaaaattaaaatattattaaattacacaccttgaacatcaagacggaataaatattcatataaatgtccaaatttttgtgattttttggcattctttccttacttcttaaaatctctccacaatttgatcacattgccaattatccctcataaactaatcaatgccaaggtgtgcctcgaattttcgcgctgaatattctgtaatttgaacttgctgattgcttttcgaaatgcaattggcaattatccttcccctaattaaaatagattagacaaattgattaccgtgattaaattgactcaccaatggaattccatttgatcaaatataatgaataataataataaatggaattatagaaaaggaataaaagattatgcttttcttagataatgttaaatgagcaaatgaaattaagcgcaataattatcgtttcaattttatttaaacaaaagtaaataaaaaatctttttttataagaaattaactaaatacaccccttaatatttggaaaatttaaaatattttttttcttgataaaggctatgatatgattgggtagttttttgtttgaccgtgcagaaatttgtttttgtttttttttgattaaaatccaatcaaatataatttctatgaggtaaatatccgaaaagtcaatgaatttcgtggagacgaaggaattttcatgaaaatggcgatgaaatgaaagtgccaaatttgtcatcatattctttttctagaatttttttttcttcattattttccgaatttccaattgctttttccaattttgccttttcgtccttggaatttcgtttcgtattttcatacattttgttcattttttgctcaaattcttgccgaatgttttcttcaaattcgtttgatggcacattttttggtccgttttttgtgccgttaattttttccataaaattttgtttaaatttgctaaaccaattttcctcctctttaatttcataattaaaatcaacctcatttaccaaaaccaatttattgcaaatgatattgctctgccaaaaacatttcgaaatatcattcagtgttttgacgacggaaattaacttcatatgatcattgaagtgataatgcaaaaatattgggttaatcgctggaaatttattggccaattcagtgcttttacctaaaatgaacattatatatagttaagaatagagtagagcgggaccgggaattttgggctaaagcgggaccgggaccttttcgggctgaaaacccgggaa

SEQ ID NO: 7912 - DNA, 4640 bp, Heterodera glycines
cacaatgatgcccaaagtgccctccgagccgagcaccatttggttgaggtcggggccggccgacagacggggaacctttaggaaaacccaactactatttagtagttaattagcgaaaatggattttgattaatcaatgaaaaggaatttatcaaagtagaacaattgaaaaactgatcaatgaatgaaaaaggattggattcatggtcagcttatctattattgaccaattaataaagggggataaaatttttgcggagataacataaaaattgacaggtaaattttgtggatctttagtttgaatttttaaatctgagggcttgcgctctccgccagggaaaatgttggcattttaatgagtggcaaaaaggattagacaaaattgcataaaatttactcctccttctctcccgctcgaatgtccttccttacctggcccattctctgaaaggtgcccttcggtgtgcacagcgtcacttggagaagaagatccttacaaaccggggaaaaattaatgagaggggaggggcggctcaagagtcttgaatttagccaagaaagggaagaagatcgccttgtggcttttcatcaattacagactttaaacaaagaaattgagtgatcaaatttgagatcggtaaaaaataagagaaacaaaacaatgcgccaaagtgttgctcacctcaatgttcccgtatttgttctttttcatgccagaagcacgtgtctgcaaagcaaatccattgttttgacccaacatttatccctccccggcccaccgatatccatccgcccaatgtgctgaactccatcgagtctggctcatgtccgcaggtgaagccactctcatttagctaaaattgagaaataaaatccctaaatttcttcgagactctctgtgttgcaaagccgagaaaggatttattggagtcgcaaattctcttcggaagtttcaatcaaaaaatgctctcttaccttcttctcaagcgtttgtcccaaaattcccttcaaaatattgcaattttaaaattatatttgtttattttttaattattgttaattaccgcttcggaagtgcacgtgttattgtccgtatcgattgaaatgattcgatctgtggtggagaaaataacagcttgtaaatttctaacagaaaactgtgaagcgtacttgaagaaaaaggacaaatcaaactttccttttttcgaaggaccttttcctcaaattgtttccgactgtaaagcattattccaaggatattctgggattttttaaatcccttcatacaacagtcgaaacaataatccttcaagggtttccagacagaagcagtaaatagtagtgccgttgacaatttaataaacaaaaaataataataaactgacccatcagtgccatgtcaacggagcagaaacatcttgcgccattttggggacaattgagggcattggacacggaagtgccaccaccgattggaatcaatgccacattgtgcgagtcggcagcacggacaatctgatgagggaggggcgggggattcaactttcaaatggacggaagcgagtgactttatcgggattaaaccaaacatgatggccaatccgctttttttccagaattacattatatattttgcaacatgatcgagattggcaatggttcaaaactctgattattattttcgaaactgatggtttaactaatccggaccaaactattgatgtcttttggcgatcaggttgccagataatgccggggagggaataattggaggaattgttctgggtaaattccaaatcaacacaatggcagtccaataggcagtcttaatgctttcctaatactctctcaccagctcaacgtccgcttcgctccttggccacaccaccaggtccacaattcgtccgacgttgcccatccgcaatgcctgcacttcggccagcgtttggccgtgcgagcggaccaagcggcgcatgccaacgctggagaaagggatgtgacgggagcgaagcgcctgcagaaacgatgacgggcacggcacaacgggcggtgggatgcgcaacgattgggatggcacggagagagtacggtgggccatgtcgatgccgaggttctgctcaatccaaggccggagcgagggcaggcatttcccgtccagatcagcatatctgtgtaacccaaagggggggggggctgtgaccaaaattagagcaaagtgtgggaccgttgaagactatgacaaattttgcaaaacaaaatcatcagtcccacatttttttgaaatttcgggattttgaaggataaatgtgacgagatccaatcccgtgaaaattgaattctaatttcctcatccatgaaaaactatacatatgtttaaattgggcatcattaaaacccacgctcactcgtcactatgcatcataatttggccgctggcagacagcgcaaagaatgaatggttgtagccccatccgttccatttcaactgggaatccctgaaaaaagttaaaattcagaaatgaggtccttgacttcaaggacgcccttaaacacaccgagtcaatttttggcactcagttcaaaattgcatgtgtggccaagcggtttttgtaagatagtcaattgacaaagggcataagttcgagtctgttgcgcaacatgaatattttatttgtttcttcggaaaattaaaaatttcaaaaattattttcgatttatcaaatcattaaatttttgcaccatttagtttttgcaatgtggcatttcttgttcattgatgagtttgggtttaatttgttgactcggtgtgtaaaagaaaacagctaattaattaatcaattaattaattgatttgaattaaaatgaggccaagcacaaaaatccgtcgaatatacctaaacacattttccggtacgttcaattcttcctctcccaccgctgctccattttctgttgttacattttgcattttgtccgttcgttaaaataaggaaatttcgcacaaatttatcgttaattgtaaacaaatagtacaaaatatataaataataaataaaatggagacggatcaatcaatgtgcgtgtcctctcctctcgtgcgatttccattttaccttatcaatcatcccatagataagaataatgggtgggggggggggagcagggaagttgtgagaccaaaatgaatgtgcgagaaagtgagaaaagcccaaaaggtgagaatgcgcgaattccaaaaaatttaaaaaaaattttaaaattaaaataggtacacacacacaccatttcaaaaaaagacatgtgccaataaatagagagcacgggtgtgcgaaatttcgtgtcgtccccttttttcgtcactttttgagtttcgttttcgagttttaaaattttgaaccaccgatgcctatcggaatcgttcgacacttttactttaagaaagttttatgtttttaattgtggattaaattatattaaggactctccatcattttttgtcacatatttttgcggaccattatcaaatccccgaagaccactttcttgagtctcaactggagagggcagggtcggtagttcagctggtagaacactggtccggaaagccagagacgccggttcaaagccggcccgccccatagtttttcactcaaaagcttccccgctcgttcatatgtttcaatcacattcctaaaatgtttttttttataaaaatatatattagggaacatacccaaacgtcctctacagtatatcccattgtttgctcgcaacttttaatttttccaatttattttgtgtcctatcataattctgttccgctgttaatccattcgcttgaatcataaaacccttataacattttttacatccatgaaaagcgcatccctataaattagtaattaattcattaattttgttttatttcccacctgaaattcaatgatctttttttggactccaattatgtaatcaatttttaattttttgtcaccaaaatgcgatatttccccccatttcctgcatgtctcgctttcacgccgtcccgatgcataatccattcaaaatattttatcgctatattactctgactgtcctttgtctcaaatccactctcaggaataatcggcaatgtttcactattttttaaaaatttggcacgaaaaatgctgaaatttatttatttagttatttttattttggtccctacttcatgcatgaagatgcaattgttgtggataatctcataacatcgatcccatttggtgtctctttatcttttgttatatcaataaaaatctttctcaattttatacgcgctttcattaaaatgtccgtgtcatttgaacaatattcatccaatttttcctctaaaatcaattttgtcacaattaaaatatttttatcttacctaaaataaatccattattgtaatttgcatagtaccattttttgaatttttcatactcttcttcatttaattcatccggaaaataatcctcaaagggtgggagggtagccaagattttgcctaacaatggatatttttattttttttatacctatttttaccgtaattttcttctttgttaaattgatggggaaaatataattttgattcacagtctaaaccaaat

SEQ ID NO: 7913 - DNA, 2909 bp, Heterodera glycines
cggcaaaatatttttaatcgtaaccaaaaaaatgtagcctttaagatcggaatcttctttcatccctgctagtaaatactttatagaaattattaaaatttatcaaataatactctttatattggggcaaccatttcaagataaaataacacttataacaagcgaaagcccaaaatttataccacataaatttaaaagatggaataatttaataattgatcacatttatgccctattaaaggcccaaaaaggcactttcattttcggcataagttggccccttttcgcttcttcatttgatcattcttttgaagcattgtcatcagttcttttttgcttggattgttttgcaatttgtttttgtttcaatttctttttatcttgcatcaaaaatttaaatgcgctttcggtcattagcgttccgtcgatgctagcaaattggcttcgtccgccaaagaacaattccatcggctcttcaatttgcggaggattgccgaacaaatctcgcacatattttgcccctaataaaaagaagcttaagcttaaatttttttgttgcattggtccaacaaattctttttttaatgttaatcagggcccgagggccctcataaagcgccggggcgctttcaacacgagttattcaaaaaacggactgaaaacgcctattttagatcgtcatgactcatttgttagaaagttcccccgtcggataaagcccattaagaaaagaaagagaccatagtaatatcatttatttttcttttcaaaatttttaattctaattgcagataaacgacagacgaccacactgacgagtcaaagtgtcaggggtggagcgcgaccgcgattcgcggcaattttttgcgcgatccgcgaccgcggaaattgaatccgcgatgcgcgatccgcgaccgcgggatttttcagtccgcgctccatcctgacaagtatctccgtctcattacaatattatttcctgctcctacagtattcctaccggcttttctttgtattatttcgattttgacccatttgcccgtgtcatccataaactcggcaattttgtcaaattccctggtctcttctgggcatttctctttcacatcaaattgtcctcccatttcgaggtgttcggcgttgactggcaattgaaaattcatccaactgtatattatttctgtcggatacagaatttctgtgccatttgttcttaaaaatcgcttcttcccgccaaaggacaaattcatcggctcttcaatttgaagcggatttccgagcaaatcacgcaaataaataaccactgaaataataattaaactctttagcataactttcacttttcaatttttaaataaaccgcgtaaaaaagcttttagaacggctaagttttgtaaatttctgcgatggtgtctcaaattttcgaattttaaaggtgccggttcgttactcaaaaaccgtcaaaattggcaaaatttagtacagaagcccaaatgtacgtttgtttttgtttccttcttccgctcgagaaagagattcaaaatgccgagattaacccttaggttttaatgggtcgagactcggcctctcccaattaatgctcctcttaccggcttttccttgctctatttcgattttaatccattttcccgtgtcatccatgaattcgacaattttgtcaaattcattggtcgcttcaggacacttctctttgacatcaaattttcctcccgctctaagctgttcggaatggacaggcaatcggagattagtccatttgttaattggcatctttggatattgtgtcggcgtctgattgtctgtgaattcattcattgataatggttcgattaacggcataattattaaataattacgataataattaccaattttaaatttaattattatttttttattatacaaaaaaacaaacaaattcgttcttggatgaccaattcatttagctgcttggcaatggcatcgctttgtgaaatgctcggcctgcgtgttcttcggcttttcgctacatttacattattttgtttgtgtgaatgatcattcgtttgggtactgcttgcaaaaatgagaatgtcacttctatgccttcggtgctttggtggtgacggctgattattggtgccagaaatgtcgccgtccatcggtgccataaattggcgcggcacagtgggcggcgatgcatgccgatttgtatccgatgattgtgccaaaaaaggaaagtacgcatcagcaaaaaggggaatggcactgctgccccttcgatgctttgactgtcttttggatgacgactgtccttccttcggcagattgatcagtggtggctgatcattgggccgatcctccgacgtggccagatcgatcaatggtgtttgatcattttgccgatcctccgacgccgcggcacaaaggcgacccctcgggggcgaaacgtcgaaaatgggcccacggcggtctttccgtggggaggccgacattctgttgaatgatgcacagaaaaacaaggcgtaaaataggaaaaagagaagcaaatccataggaatacaatcaacaaaataataattatttaataataataataaggaaatataaatggcgaaaaaaacgctgaagaaatttaatttgtttgccaacgcaaatataattttatgatctttgcataaattgaataaattctgcttgcgttgccaatgccaatatttgttgaagtctactttttaaaaaatcaatgtattttatgaaaaaaataacaattacaggcgaaaaatgttatttaatttttttgttattttgtttaaaagaaattacgaaaagcaaaaagtaaggacaaaataaaaataatccaacattaaagtaattaaaaaaattaatgaaatagaaatttgacattt

SEQ ID NO: 7914 - DNA, 3319 bp, Heterodera glycines
  misc_feature (3263)..(3263): n is a, c, g, or t
tttggttgtgccgttttcggttggatttgttgtgaccctatgcgtttgtggcagcggtggaagtttgtggcggttggcagtagcggaaaattttgcggaagaaagtcaaaaaaggaaattcccgctcaaacacttgtcgatattctttgctaaaatcaaattgattatttagaaatgaaaaatggctttaattgttcaaattagaataataggaagaggaatatttgaaattttaattcataattcggggaatattggcgaaagttatgtccgttaattgccgagcaaatttgcggattaattgccgtcacctgcaaacgtaaagcaccggtgcctgggctccctgggccacgtacagcaaataagcgaccgaatgggaatagtaaagcgcgtcaatcatttcgaagtgcaaaaatggcaaaatcagacggagcaaattgttggtgagccaaccgaacacttcgaggagcataatggcactgacggaacggacaatgcggcgcgatgagtcattctgctggactgaaatggaacttattagaagtgaaattaaaaattcataagtgccagttttgcagcgaaaggaaagccaaaggaacacataacacgcggcggttgcaacatttattgccaagttttggagcacgacgacggaattttgactcggataaatgtcagtcgtcccacaaatgacgagcctacacaaaatgaaaatggatttaatagaaattgaaatatgtattgcttaaaattgataaagcgactaattgcaaatacttctcggggatggccatcgaataattgtacgaaatgagcgccttataaaatgtgtaagtgtaacacgcgagggcgaccagcacaacaacgatgcgcttcttcccaaaataatttgaatagctaaaataattagtgccaaattaaaattaaatttaaaatttaaattttggaatttttacaaaaaggggaaaaacaatccgacgagacggtccaaagcgatggcgaagcaaatggtccattgcgcggtggcgccaatgtacggcccaatttggagcgggaaacagttggccagacgaatttgaatttggcccgtaaggacgacagtcgcactgatcaaagcggcgggaagctgaagcgacaagttgaagaagttcagtgcgatcagaaagttgcaattgcctctcaaaatcctaaagataaattttagtaatttttactttttcaaattaaaaaaattcaaaaatgccattcgacaaatgaaaatccaatgggagaagactcactttgatttgaaagtcaaataaattggcgtagtgctcaaaaagaaggccatcaccaaaatggggatctttaggccaaacaaaaaacaaagcggaacaaaatttgaactgatcacatagccgagctgtgtaattaaggactaattgcaattttaaaatggattactgttaccgtagtattcgtaggatccattgttgtgttggtactgttgttcattttttaaagaaaatcttttcagctttcggcttttgtttggtttaattttcgaatgtcaagaataataatttattattttattttttacaaattatgaacaaattgacaattttgcttctgtcttaggttttcccatggctttgcgtgactatgccaatcatgggaactaattaatgcattaagaaaataactaatagaaaatgctttcactgctttgaagtcgattaatatttatatgaccatattcaggcatttgttcaatgctgctcttaattgtggtttaatttgtcaaaatgaaagaaatttaaattataatttcctttttcttgcagtttcacttaagtgtgtaatttgattttttgtcttaaattccaaagtgataattaaattttcaattttctgcttgtcgaatatttagtaattattggctaatgttcacaaatggcgattaacttttaatgcgaaattgccagctgaaatgttcacttctaagaccataattaaattctgttgcgcaatgaaaaattggattttttaagagtaccaattaaagataaaacaattttaatctttgaattgttatataacacatgtaatgtttaccatcatttgtagaagcaaaaatgaaatatggacaaatgcactttctcgaaattttggcggttttcagttggtgggcattaataatgtcattttaattaatttgtatgtttgtaaaccaaacatttttaaggcaaaaaagtaataatttttgtacataattattcagcgttttttttaataaattttgctattcttaaaaaaaatcaaattaacaccaaaacaaaagttgaaaatgaaaatcacagaaattgttgttaatgatgaaattactttctctgtgacaaatttagcaacgttttaaaaagtgttaagttatgaatggaaaattatatgtacttttataaaggagcagaaaattaataatttatttcccatgaacattttttctttttgttttttgctcggtgttttatcggtccgattaattaaccgtaaacgattttaaaaaaagggaaatttaactttcacttggcaatattttgcaaaatttagttgtcaaaagtttaaaataaaaaaaagaattttgaaaggaatgaaaggatttttttccattggcacggcattcgctgggtcagccgattagcacgtcgttgggccggggacagtccgggccgcatctgaacgcgcactcggccaaatccatgcggcagttcgccctgcaatgtctgaacttcgtgccgtcccccgcggcgccgccctccgccgggcgaagcgtttggcacgaataattgcagaggacgtaagcattgaagcacacatcgcaacagctgaacaaagaaagtcaaacggagacggaaaacaaacgcggcatataaaagggaaatatcggtaattagataacacaaatcaattaggaaaatgccgaaaagaaatgcgaaaaggcaatgaatcggaaaacaaaacttactcctcacttttggagacggaaaggaaaaagacgaacagaaaagaaaggagaagcatagggaagaaggaaggcgtaatgaggagggaaaaaatgattaattaaatgaaaattaattgaaaagcaaaaccattaaataggcaaaatatttttatggaatttaaaaaatgggaccaaatgaaagtgaaaaatgttaaatatttataaagaaatattataatgtgagtattaaaatcatcatataattattattccttttatntggcggagtcatcacgagaaaaatgacaaaatgtgaaagaaatcgcataaattatt

SEQ ID NO: 7915 - DNA, 2889 bp, Heterodera glycines
  misc_feature (2716)..(2716): n is a, c, g, or t
  misc_feature (2718)..(2718): n is a, c, g, or t
  misc_feature (2729)..(2729): n is a, c, g, or t
  misc_feature (2737)..(2737): n is a, c, g, or t
  misc_feature (2742)..(2743): n is a, c, g, or t
  misc_feature (2747)..(2747): n is a, c, g, or t
  misc_feature (2753)..(2755): n is a, c, g, or t
  misc_feature (2764)..(2766): n is a, c, g, or t
  misc_feature (2782)..(2785): n is a, c, g, or t
  misc_feature (2789)..(2790): n is a, c, g, or t
  misc_feature (2823)..(2823): n is a, c, g, or t
  misc_feature (2825)..(2825): n is a, c, g, or t
  misc_feature (2827)..(2827): n is a, c, g, or t
ctgaaattcgtccggaattgtcattggggccacccaactctaccaacaataaacggtcgtcccgataatgaacaaataaacttaaatccacgttcaaacgattggccgggccctccggggattggggggtatctgaaaatatcaaaattaaaaaatccatgaagataaatccttcattaaagtttattttctctacaattccacaaaaaatttatttttaaaaaattttattaaataaatttctgtgaacatacctatgtaaggcattttgacaatttaaatacaatatttatagtaaacaaggacggaaaaaaaattccaaaaaaaaaactttttgtttttacctattttcatttagccacaacctttaaaaattgggttaagccccccaaccctcggggagagaataatcagggatcgggggggggggggaaatttcataaaaaatatgacaaaaaaagattaaaaacaaaaaaatttgatgggttctccttattagattgaaaaaataataattagaaaccccatatttttcgcgccttttttttaaaattttttccacaccctgaagttcaagctcagtgaccaggcgaaagaaagtgccgttgattgtgtccaacaaattcaactccaacgccgggcgcactgttcgatggtaatatttgaatttgcgtgccaattcgctgcgctcttccgctctgagtctgggcaaaaatttaaatttaaaaatacattctgaattaattgtgattaattaggcaattaattactaattagacccacccaagggccaccggataaggcacaacaatgacgacgccccaagcgatggtggcggcaacaaaaaaggcgcgcgcgaatcgcctcagggcattgttgcaacgcggacagcatgcggcggcgcgcgacgagtgattagtgcgcggcatggacaaatgatggacgcgtctctcatctcaaacacgacgcgctcgtgcgcgacacatttgtacagtgtttatcgattggggaagcgttttacgatgatgataaatgtaatctttttaaattaattaattctaaaattttgattgaaaagcccattagtcaattcgatagccaatgaataaattaatttacttaattaaatgaattaatgaaaagaattaattacagaatttttataattgagcacacggaaaatcatttatattagaagaaaaaaaggtacttatgggttttgccacccccccccccctccccctttcgaaaaaatttccaaattttttttcttgaattaaagtcattttaggggttttcacggtcggagaatccgattcttacatcgatttcgacccaattagaaccatgaacgcgaattcgaacaaaaagtcgaaacttcaaatttttttctatttttttttggttcaaaaccggcttaaatgtaaggaaacaactaaaaaacattttttaaatttatcactttttcaaataaaatgtcacgtaactcacgtaaaacacgttatggctaaaaataaacgtcagaatcgtgatcagtatcaaaaattagccaagaaaaaattattagaaaaaaattttcagggggggggggtgacaaaacctagtagtattattaaataatatttaaaaatatatatatctaagaaatttgcgttaattaagaggagttttccaaatattgaacatttatagaataaaatacccaattaaaatctaaaaatatccaaaaatggtagccaatttaaattattttgaaaaagaatgagtaaatttataaatagtgatttaaataaataaattctaatccaattttaaagaaatgaacaaaacgcagtaaataaatacatattaaatggaaacaaattaattaatacaaaaaagtaatcgcactttattaaacggcgacactttttttctgaaaaaattgttcattaaactaaatgtaaatggaaatggggaacaaacaatttgaaggtcgtttttgtcggaagaaattaaagaataaaaaacataacgaattttatttatttatttattttttgctattaatttaaataattaatatttctaaagaaaaatcaaatttattaaaatgaaaaaataaataatttaaaaaatactcgtatttttattatacaaataagtaaagaacaaaatttaatttgaattaaagctttaataaaaacatgaattcaaaaaattgttttttcaattttaattaaaatgtaataattaatttaaatatttattgtttttattttataaaaaataaagaacaaaattgaatttcaattaaagctttaaacaataaaaaaacacatttaataaattacattttggcgaagttggaggaaagaaaggacgtcgggcggacgggcggtaaaacaacaaaaaaagtggagtggatttttttttgaaggtcaatgcttttcggatggataagtaaattcgagaattgtgtcgtcaccaaaaaagaaaagatttcggcaatttgctgccccccggggcgacgttggcccaattagtggggcggttaagtgattcattcattcattcattcactcactcactcatttccatcaattcatttggcccacaaattccatttgcactcaattagtgaagaaaaaacattttgtaacattgtcgctgttaatgttaaaattttggatcaaatttggtcatttagtaatggagggttaacgattttctaacnantttttaaattntctaactnacatnncttnaaatcnnnaaaatttannnaaaaaaatattcatannnncttnnaaaaattttttcaaataaggttctttttcaaantnancttttttcattggaaacttaggaaggatagaatagcccctgcccaaaaaaaaaagaattctt

SEQ ID NO: 7916 - DNA, 1623 bp, Heterodera glycines
aacaggtgatcaagaaatgattgaatagagaatattttccatataaaagaccctcaaatttgtctgtaatcagtttcaaatcgtattttaattccaaaaatcaacaaattcacctcccatttttacaaaatgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaattgaattaaaggaaggttgcaagttgacataattcatgaacctccggaaacagaaaaagtgagaccaaatgtgacgagggtcataattaagatcgtgatcgatgaacttaactatcccgaaagcatttattgagataggcaatgaggttgagtaacaagaactgaccactaaactcttgatcgagaccgagactatcgatcatcccaaattgtccaaaaaataaagatgtttttcatttttaaaataaaatataaaatttcggagcatttaaagaagtttaaaaagcgaagcttacttatataaaccagttccaagtcaaaaattcatttgtttgctccctttttagtcaaacatataaatttatgagatgccaatcacataaattttaaaagtgcagctgaactgagcaaaaaagtaaacattgcaaatggaaattgttacaaaaaaagactttaaaaatgattaaagaatttttctatttaaataactattttgaattcaaaatgaaataaattattttgaattaaaattgtaaactttatatgtatgccgttgggttagagttaaatctgtccaaaactgacttcaaccaagttaggcttttcgaaaaatttcagctcaaatttttacgaatttctataaatattaaaaaataataataatttttttgtccctaaaacggtacatggcattcattgactgtgaattgcgcggaaaacgaagagaaattttttcaataaaattcttttaaaaaaactcgggttttaaatttttgtggcattccgtcaggttagcttggcatgtgcttctgctgaagcttttgacctatacactaattgctgcttcttcttctcctgtcactgattgataaatgcactcaatcttgtgtaaatataaaattgtgccgcttttccgcgatgacaaattgaatttaaaaatttaatgcccgcgggggggggcaaagatgtgccatctcgaaagtacaaagtaaagggcgcataaaggatttaaaagaggcataaaaaatacgggatttaagtcataaaaatcactcaaaaagacaaattttaaattgttgacagtgctgaaaggcatccagcaaaatttttttttgaaaaattaaaaaatttaggtttattccgggagcctcagctgcattcgagtgccgaatgtttgtgccgagtcggtgatgacgcgaaaagtgccaaacaaaagggccaacaaatgttgggaagggacggtcaaagcggtgacaattctaagaatggaaatgaaatgtattacttacaattacgattttaggaatgacataggaaaatcatgaatgta

SEQ ID NO: 7917 - DNA, 1392 bp, Heterodera glycines
tattccggcataaaaattgtgcaaaattagaatttccttagtagttcatatatttaaagtcatctttttgcgtcgagttttgaaaagttagaatttttcactaaatttctaagaaactcaaaagatagacagcaaatttatccgaaatttacgaaataaaaagcaacaaaaaaaaaatgtcaataaatgcggaaaaagaaaagaatgagagatagaaaacccgagagagatagtacagcgaatgacagcgccatatgaaaaatggagaaaatgccgtacgaagttggcacgagcaaaagcagatcattgacagcgccatggtttttaaaaatttgtcatgagagtacagagaatgacaaatcatatgaaaaatggaaatgccgtacgaagttggcacgatcaaaacggatgattgacagcgccatgggttttaaaaatttgtcatgaaagtctggcagcaagaaataagcaaaaagccatgaaaatgaacaaaatgggtgaagtgaaaatatgagtgtaatatgcaaagacaaaaaatgcaatgatcagcagaggaaacggaatgggatcaccgctgcgctttcggcgcctatgactaactttcttagcgtcggcactaagtttcttagcagcgccaccatttgccccagtcgaattcctttcactagcaaaatgttcaaattccaatttgtttagcacaaattcgaacaaatcactgggctttagcaattctttgtccatcagttcgtttactgtcgaatttttcaaaatttccggaaattccatttgaaatttttttgcaaattggctaaattcattcagttggttgttgcattcaagttcattctcgtcctccttttgcttcatcacttccaaaatgtgttgcccatttttcatcgctttttcaacaattgtgccaatgtcatttttggcataaaatgattttatggcattttgcacatcacttttttctttgcaaatttctgtcacaatttgtttcaactcattaatctcgggcagttccttgttgttgttgttgttgtaaatttcgatgcttaattggccaatatttgtgcacactttcgacagaatccaactgctaaaatttcatatatttttaaatgcgaaatatttaaataaaaaattattaaaaaaagtaaaaatgtttagcaaatatttttaaaaaaatcataaaatacttcaaattttcctttattccgccggatttcgtcagttctaaaaattaaaaatgcttgaaatttttttttcataaatttacctttgaattcctttaaaagcttttcatatattcttttccactaaattttcgtgtttttgtttcggcactttggcatcagcaaaacaattgttgaaaattaatggggcaataaa

SEQ ID NO: 7918 - DNA, 3889 bp, Heterodera glycines
atttgaaaggggtgtgtccaactgtgccaatagactgactttctaacgcaaaaaaacgagaaatttcacgtctaggggctttcaagtccggtacctaagcagcccaataaaatacacaccattctttgtagaatggcggtaaatttggtaacccaagaataaaaattcgcatttgtaagtaaaatttaagctggaaatttttatgtgtttaaatatgtaaggtaaaaacggtggggggggggggggaagtgccgcggaaagcaattaagaaatgatctgataaaaaatggggaaaatacgcgaagtaataaataattttgcaacatgagatcactatcagtttacccttttgacaaattaattcgagaattttaagaattactgaaatggaaacaatcactaattggataaagaaataccgtatatgctctaattatagcccatgggggattatttttcaacctcctcagaaaaggggggataattagtgactgggggattatgatagagggattatttttcaaaacacctcgtagactgggggataattggagactgcgggattaatagagactgggctataattagagcatatacggtaaataccaaataaaaatgatgtctaaaaatgaatgggattgactgacacctgcagattgtgagatcaaacaattagaggtggcagtttgtggcaaaattcaaaatgatatttatgttcaaccgtacactggtaagaatgggggtctgagtaaacatttgtgaaggaaattggtgggaaaggaaaattttttagaaaaaaaaattatgtattttttatttaattatttgcttatttgttttacctagggttcgagccccgcccccgtccccggggacgggacaggttttttggcctcaccccgcccccgtgactcagatccccgcatccccagcccccgcgggggcgcggggtgaaaatacaacccctaagaatggcatattctgggacaaaaggcaaaaaatttgtacaattttgaatttttttttaccattttgacaaatttttatggaataaagtaagttttgcttttgtttttaatatatttgtggagtagtggttagtgcttccattctaacagtattctttgttatgagtttgatgctggttgacgttttctatttaatttactttttttatgattaatagacaaaaacacctataaaattgaccattcttggcataatttgttaaaaaattgaactcaaatttaaaaaaaaattccgaaggcaccgccggatgaaaatttcgttgaaattaaaaagtccaattttccttgagtaaatcatgaaaatttaaatattttaaaatatttttacaaggtgctaggtcgatccacaaaaaaactcagtgtgggcgttccacaaaaaactcagtgtgggcgttccacaaaaaactcagtgatcgataaaattaaataaataaatttaattattcaattcacaaaacacggtgccgtccggttaatactaatgtacggcgggacgcaagtcattttcaaattttttaaatttttcaatttttgacatcacttctcgccaattttctccatttgtagtagacatagcctgacgccattgataccattttgtagagctcatcgagatgtacaaaaaagccgctggtaccggcaagcttagcttgggttggccatcgacagggtcgggggcgaggctgagggtcctccggcagatgtgcccgacccatgacgggctccaagtgaatggattaagaaccggacccggcctgggagatagcccttaaaaaactgaacaaaaaattgttcttaaccgggccggtccaggttccggatcaggcacttttggtgcccgaaagtggtgcgataggcttccggaaaatgaccaatcaatcactgagattttttgtggatcgcccacactgagattttttgtggatcgcccacactgagtttttttgtggatcgactcagcacgcaataagaaattggcaaaatgggacggtccccggatttcggtgttcactctctctgggtgggcccactaaaagaattgttcaaattttggtcccccatctgcgttttgtgcaaaatttgaagtttgctaggaatttgcacgaagggggctcacaaagtgaggacggtgaagcccattttggtgccggagaagccgcgattggtacaaaaaaaaaaagcagcggaaagggaagaaatgaagcgccggacaaaaatgcccggggaaaatccaacggttaaattccctgaccaattcggaaaaagggaaagcacaattatggtgaataaaagtttatttacgattttttatcaaaaaagtaaaattcaaaatccaaaatctaaaaaagtatctttttaaattttttttcactttttttcaatcattaaataacgtgaaatgcgtgcgtaccatatgttaaaaaacaaattctgaatcaaaaaaaaattagacaaaaaaaaattgtaaaaaaatttcaaaatgtaccttcttttaagtagagcggaaagtactcaaagatgtgtgttgccgaggtgaataaattggaattgaattgaaaaacggacaaaaggaattgcaaattgtccaaagattgatttaccgtaacgaacaataaaaaaaacactatctacaaaaggggccgctgatgagtaacacaatatactcacctgagagcataaaaacacgtgttaattaacctcggttcacttgtcaaaaggcgtctctccgaacccctgtggcgcgtgtcgcacaaacgaatttcgctgccggctgacccgtgccatgactgacacgttcgttgcactcaagcccatgcgcgagccgttcagccaggaacatgcccagtcgccgctcggtgttgccgccgtccagtcgctcaagcgtgtttttgtgccgcaacggcaccgacccattgccgatggccaattcagtacttccgtcatcattctctatagaccacgaatcgaccaactgaagttcaagctgttcagcagcagcatccatcgacgactgtggaaatgagcgatttgcttaatcaattttttttctaacatttcacattttttattgcaaattcattgtttatcatttttattaataaaaataaattaatatttaaagacggcccccggatttcggcgttcgctctgtatggatgggcccacgaaaagaattgctcaacttttggtccatccccatcccttcttcattttgtgtccccactattttttgcagcgttcgtggacccaaattaatcaatttaataattgattttgcgctgcaaatttcacagttttcatttgccctgctggctgtgtggcatatttaaatgttatttttttaaaaattaaattttcgcttttcctttcctctatcacttttcccttccctctcccctctcttttctctccccaatatttcttttccttgccttggtactagataaaccatcgggacggatcccgagtcaacatcccgaccgaatcccgatcccaatcaatcccgaagaatttttttcgggatcccgcgggatttgcaaaaactcaaaatttttttacgttttgacccatgaaatttttttagaatttttaagggattttttaaagaaaagtagcaatgaaaatattttaatttaaaatttaagatcttaattaaaaaatggagattttccgaaatattatcgtaacttcaatcccgcgggatcccgcgggattggtaaatggtcgggagggatcccgatcccgatcaatcccgatgaatttaaaaaatcgctcgggacggatcccgatgttgcgatccagaatttaatcccgcggattccgaagaaatcccgcgggaccccggtctcgtccggtctcta

SEQ ID NO: 7919 - DNA, 3793 bp, Heterodera glycines
ttttgttggatatttttgaaattttgaggtgtgtacgcaaaaccgaaaagtacccaatggaaattagcgattgcttaaccaatttaattttttcattttgacatttgccaaatcaattattttttacattgataaatcattgcgcttcggaaagataattagagcctgaatccctttttttaattttaaaataattgtttataattgaggcaatcctgcagaattttggtcactaatccaatttctaatgatgggcttaaaattagtattcagtggttgaggagctgatcactagggcgaggatttctatttacaaaaaaaaataacaaaatatttaagaaaaaagacaaaatatggttaataaaatattgatcacaaaaaaaagaaatatcttcggctaaaaatcataattttcgtgcatttcgaatcgaatcaaagctgcagaaaaaataataaaaactcacgccctactgatcacaaattgcacaaacaaaatgaaaatgtttttaaaaagaaaaattattcaataatttataatttttggactcaattaaattctgattggactctcataaagtgcattagaactaagtcatgaatgaactcaatcaaattggcatatttggaggcaaaaattaaaaaatcgccaatttattctgtattaccatatgaacaattaaaagcaattgcgttagtaaaaaaaaagcattcattttaacatttcattttgtttttaacatttcataaatgtctcgaattattcattttttccatttgacattttgctaaaatttaacatttcccgaaaattgcgaattattcatttttctgtcttcgccattccaaaattttttgtttgtctcattgttctgtttgtgcgtttgtcatgactaatattctcttcgcccacttttacacatattgcaattcattcattcacaatatttttcttttgtttaaaaatattaattattttttttttatatttttaataattttttaaatttaattttcctttttcccgtctcatttttttaccatacatgtagaatttttgcctactgcacttttttccgtgaatccaatggcatttttatcagtttaattagagtttatgagtccaaccaagtttaaagaagttgaaatttacaaaatctcagcgtttagcaattgacaaaaaaagatataataattaatgaattgttgatttttccaccttttaaatatttgcattcacttgttttctcgttacaaatttattgtttaaaaaattatgggttcttagttgattggactcatataaactcttaataatttttttcttaaatcttagaattttttattagcctattaaatttaacaaattttgttttatttctaaaaaaaaatatgaccaaaaaggatcaggaaatacagagttttttgaaggagccctcctcaaacggccgccgtaatcgagagaatgtgcactcgttttggcgcaaaagcaaatgtttgaatttgaggctttgcgaaaaacatatttttacatgctaataatgattaattattatttcggatttaattataaataaatgtgagcatgaaaatttattttctttttctttttttaaaattttatgttttgaattttgttgttttctcccaaatgaatttatttttacgtttcttcacttggcaaagattttctgtatttcctctaattacggtcccaaagggcggctattttttaatgcccactcggaaatttaagaaggaggtggggaggaacggcattttgtgaatgaaataaaggattttgtacaaaacaaaataaccacacgtgttcaaaataaattgacaaatatttttaatttaaattaaaaaatcccacattttggtcctacccaaaacaccgggtcaggcggggtcactgtggcagggcattttggcgccgtcaaatttaaaatgttataaattttttcatatatttcaatcgatgagtgtctatgtgttctctattaacctacaaaatttcataaaattattttaggctgaagaaaagatatggcggcgttcggcgccaaaatggccagaaaagttcaatttgttgaggtttttggccgaacttttttgtctctgttaaattttttaaaattttgcaggttaatagggagtcaagtgctttaaagcatatcaagcttctttaatttgggagacaaatagaaaggttatagcgtttgcgcaaaaaagggctggcgcgaaaagttggcggttccccaaaacgtcaccacccaaaatgccaccagatcagcagggcttggatttatatgtgtccactatttttggcatataataatgtaagagattatcagagaaattgtgaatatgaaaagtgcaatttattttgtttcaaaaaaatgctctctcaactccccaaatggctatatatataattagaaatcattaatcagtaaaatgccaatgaatttataaaagccgttaaattcctttttaatttttcccctatctactcccctatcttgtgatgtacagtatgcttttctcactaatctcacaaaaatttaatgcattatttatattattttattgcctttttaatttgttatttttcatgtcccaattaaaatgcaatgcgtatgtaaatggcaataaattaaattataatttatttagaattaatttttaaaaatggaaaatgtccttgacgttgttggcgaagaaattttggagcgcattcaaaacaatgagtttgaaagagatgtaccgtgaattgcaaaaaatgataatttgaaatttaatattttattccttcattaggttgaggggttcatcccggtgtcgggtgagacaccgtccccatcattcgcactgctccgagaccattggcttcaggcaataaaaattgataaaattataaaataaataattattttgctaatattatagagagatggtctttttgaagacccggagtttccagtggagacaattccaatgtacttcactgaagggccagtgccgatccgttggctgaggcctggcgaaattgctgatcacccgcagttcatcaaccagggcccaattgctggggatgttcggcaaggaagcattgggaattgttgggcgctggctgcggcgtcggtgttggcgcagtatgggcccctgttttacagggtggtgccgcctgaccagggattcggccaaaattacgccggtaaatttataaaatcaatatatatttaaattaaatattctacaaacaattcttttttaatgacatataatttggtagggatcaactgcgtcttgggtcaacttcatctgacaatgagccaattttgtctcggccaactccgtcttcgtatataatgggtcaactccgtctctgacaaaaattcaaaattaaatttatttgttttttttattataaaacgccattttttggcaatattattttaaaattaagtgataattttatacaactaccataaaaatgttcaattttccattggaatactgtagtttttgggactaataaattaaaagacgactaaattttgccattttggtagtcgaaaaacgaatttgattttgatttatttttgcaaataaaatggaatttataaaaaatattcaaaaactttatttgaatttttatctgatacggagttgacccattgagttggtagccgtagttggccagcatcatatggagttgacccgtttcgtttataattagagaccgatgaatttgtaggcaagacgaatgagtcaatcagtcccaattagt

SEQ ID NO: 7920 - DNA, 2650 bp, Heterodera glycines
  misc_feature (11)..(12): n is a, c, g, or t
  misc_feature (29)..(30): n is a, c, g, or t
  misc_feature (41)..(41): n is a, c, g, or t
  misc_feature (85)..(85): n is a, c, g, or t
  misc_feature (97)..(97): n is a, c, g, or t
  misc_feature (2434)..(2434): n is a, c, g, or t
tatgtgagtannggaattaaatgcatttnntagatgtgatntggagttcctaagatgacttttcaaatgctgcttttgccatttntaaatgcctatntaaagacaccactaaaattgaaaaattttcaaaaattattcactaaaatctttgatcaaatcttctaattttcaaaattttaatcattaagaaaaatattaaaatcttattattaattttataatacattttgttaaaaaaattagtccgttatttcaagttttgccaatttttgggattttcgcgtctaaaaatccattcataataaaataaaattcatagaactcgcacactttgtccattcaaaaatatgagaaagacgagcatttgtccgtgccaacattgaaaatgctttttatgggagtgcacattttaattccgttcatttttgtgccaactttaaaacatttgccaatcggaaaatataatgccaaacaaattgaaagaattgggaaaataatggcacaaaaaattgaaaatttaatggcaaaagacaatttggacgaagcacaacacaaatttgagtggataaagcgaaacgaaaaaatgcgagaaaagaaagaagcattgtcaaaagcatgtaaacaaatggattgattaattattaattagttgattaattactaattaataatggtaattaaagcgaacatttaattaataacaaattaagcaaaagaaaaagcggttgaaattgaggaagaaattagacaaatgctaagcattgaaatgttaatggaagaacacaaaagaaatgcattaataaacagagaaaaggtcaaagaaatgaaagcgatgctaacaattttatcgggtatttttatttttattattattagataatttttaaataataatttcaatgttaattttaagattacggaagtgacattaaaattttgaattttctattaaccaacaatgaaattggcactgaacaaattgccaaagaaagcaaaaagctgagcctatttctgcaagcaaatgcttatttagaacaatgggcaaaaagtaaaaaatgaaaaaaaataattaaaaaatggaaatgaaatgtttttcagataaacaaatttacaacaaggaaatgggatttttggacacgaaaatgctcaaaataatgctaacgaaagtgtttctgctttacccaactgcttcttcgcttcctttcataattcacaaattctgaccttcacaacatggtaagcaaaaaatttagttccatatttaattaaaatttaattaaattgtttttcaaactttttggagtcgaaaaaattccattccaaattccttaaaataggccaagtttcaggcattggccaatgcctgttcagttggaaatggtaaatgccaatcagaaaagcagtggtgccattttgatttggtcgccagggagagaatggacgaaaaagcaaactttggcacagaacggattgagaaaagtgttgaagagagtgctgacaatgccaataatagggccaatgttcccagaagagaatttgggccaagaaattaatttgctaaatgcgcaagtcatccgctggaaaatgcaagaaggtttttaaagcaaaaataatttaaatgtatttttctgggttatttaattttccgttttttactaattgcagcgataattcacctttggcacgggaatgatttgtcggcattaaatgaattgaacaaaccaacagaattcattgagacggtgtcttatacatttgtggcattgttttaaatataattttgcatttagtactccgattttattgcaattaaatgcgtcggctccgaattttttattggaaaattctgtgattttgttggcaaacgaattgggcacaaatttttaaattattctgaagcatttttggaggattcggtcgaacttttgcatttatatcccaaaattttgaaccttcagcctcaaattaaacaacaaaatattcaacagagcccaaaaaggttggaatcatttaattaatgtataacttttaatttaaaaaattttaaattttcaattaattaaagccaattttaaagtaatggccaatttgaaatgctgtggattgtcggaattcattttaaagctaatttaaaatacaaaaagatgaaagaaattaaggaaaaattgggggaaaatttgaaaacaaactttgatgttgaaactgtcaatgactttcaacaattcgcctttttcaatgtcaaattgcactcaacaattctcgagagaaatgaactcaaaaaactattgaattaatttccattttcgttctctatgtttagaaaatgtatgaataaacggcccttctaaactcagatttatttttattattacaaatttaaaaaaagtaaatctttgcaaaatattcaatttcatacccatttatttcctctgtnttttcttggggttttcaataaaccacttatttaaattttaataattttgaattgtctctttggtacttgtacagtttagactctgagatagagaagaagaagcttccccgagaggaagattaatggatcaattgaggcaacaattgatcctatatgatcgagcaatgtggggagctggagagggcagggtcggtagttcagctggtaaacactggt

SEQ ID NO: 7921 - DNA, 1208 bp, Heterodera glycines
gaacacgtttttattactaaaaatataaaaacatttctatggggtgtaaactgtacaagtaccgtctctttttatggacagtttttctcgtgtggaatgccctttagcttctgctcattgtcgttgaccctctcattcgtcctcttggcattgagaattttctgcgcaacgtacagcgataggggtggtaaatgatggcggtgatgaacggatttacgatcagaaattgaaaaaaataattgcaaattattttaaaatactaatttaaattaaatatctatccgatgcgttttcttgccggattcaatttgagcaggcaaaggaatgcccaggcgaagttgtaaatccattgcaaccattggcacttttcgacacagaaatgatcaatgtccaccaaatacatccaataaagcatcaaaagtcggaagggcagcagcgaaagagcggtccaaacagtggtggtgaaaatgaacaccagcgaacggagctgaaaatcggagagaaacaaaaaacaaagcattggcaaaatggcattgaaatttgaaatacggaaattaaatggatttaaaaaataaaaacaaatcttataaaaaccttgctatgtaaagagtcattaaactgttaattaaagaattttaattttcgtttggcacactttgttcgaaaatgccggtgcctgttggcacaattcaccaccaccagctgcagcagctatagagttgttgaagtttttgcgcattttgttcaggaattggcgttttgtccgcatcaatcggagcaaatagcagctgaccaccgcagacgaaaaaattggacaaatgcaaaacaaagtgatgaaaatggtgtaaaagtattccatgccgggagcgaattcgaaattcacctaaaatgattagacaaatttggaaattatatcatttcatgcttttccagcaccgtcatttcacatttgttcgggtcgcgaatgcgaagaatgccgaaaagccaaaaatacgttggcacactgaagggacacccggcaattaaagaaaaataaccaatatatgaaaaacactaatgagataaaaagggctgccaaatgttcttaattctgcttgatttgtgcttacgtgaagggtccaattttaggaaatttcaaagtgtttgcttatttctaatattatttcatcaaaaaaaaaaataaccacggggccccaattccacataat

SEQ ID NO: 7922 - DNA, 2032 bp, Heterodera glycines
  misc_feature (1121)..(1121): n is a, c, g, or t
aggattaaatgtaattaaagaattgataacggaacaacctttctttttcgttttgactgcccatgtattttaagttaaacttttgatcaatttccgctttaatttcaaaattatagacgccttccgcagctctacaaaaatgaggaaattttctctccccaatgaaactgtccaaatcactgcacacattcgaagtgcccttcgcactgatttgatcacgcgataataaatgggaaagtaaaaaaaagcagtttgtctccgttcagcaacaccagcgacaagggcggacaccgcgatgcccagacatctcaaaagatagacgcaaatgcacggcacaacgccaagaaagggacgccgactttcgaaagactcaaaaatttggcaaaacactaaattaaataagcaacttttattattcaaaaaaaaattgaagtccctaaacataaaaacacacctacaaccaaatcgccaaaggtcatgctggcaatgtaaatgtgaattgtgtcgcaattatacacaaaaagtcggcgagcgcaaatgatcaccaaaatgttggcgacaatcgaaatcagtgacaggccaattaacgagttgtcaaactaacaattagggaaaaataatccattaatttttcaaaaccccaccatatttgaaattttttcaaagttttactaaccaaattttgtgatgaatcttcgagccaacgagaagcatgacaatttgaggttgcattgcaatcttcgccatggctatcattatgaacactcattagtcattaattacagaaaaatggaattttttttctatttagaagagaaatgtttcattttatgtcttcaaataaaataaaattggtactggaaatagctgattcttttcacatatgtgaatttttacggcccttcaaaaatgtaggcattttacttattactcagtcatggaacaaaaattaattaaaattcgctggtataaaaaggaggattaattttggaaaacttttgcatttacacaaaatatggagtttattatcaaagaaaaataattcattatttaccattaatataacaaattaataagagaaattaatgcaattattattattttaatcattgtattattcnattattcagttgtcaattaacgcttttgagaatgttgcgaaatggtggcttttccctgcaaaaattgccaatgccataaaaaacttaagaccattttgagcttatcattgaaaattcgttccattgtattaatttatttattatacacattcgtatcgacaagaacaattacacgcgcattttgggcccataattttgtgtgtgactcggaccggctcaaatccgttgccgcaaacactgatgccgcaatggcacacgcaggggggacagctccgatctgagggggggattatgatggataaaatgaattagtttaattttaattaattattacatgatgaaggagaggatgatgaagctgccaatcccgttgtggcgatgccattgacacggaattggcaaatttccattttccacacaaaatcgaccggtgtgccgctttgattgtattggtgccaacaatgaatgcccctttaacaaaagtatattgttaattaaattaattttttttgcctgtaaatgaagtcgtctgttacgattgtgtgttcaaatggcatcagtgccaaatttagtcgttccgtggcacagctcaactgatcaacaattacctgcggcgactcacaacaaattgggtccaatctgaacagaaagttatttaacattgtggaatggttatatttttttcttttatgttttaatttttatttaaaatttgtctgccattcttcagtattttaaggatgagattgacaaatggtatgccagggttttaggcttacagaatggcatttgttctgttgtccatcacataggcattgaaaccgcccagccattgctggtcgctgcacccctccgcccatccgttgcattacggcgtcgtctccaatgccgaacatttcaccttaattccg

SEQ ID NO: 7923 - DNA, 1026 bp, Heterodera glycines
ccccccctcttccccgccgttttaccctcatttggggacccctgggattacgacaattagggggcccaacttttcaaagcaaaacgcatttgggctttcccaaaagtccagtccctaaaagtcaaatccgtcgctccatgcgagggtttttatgtaaattatttgacatttgggtgtattgtttctttttcttccatttctctcttctttgttttccccatttcctacttttaaatttgtttttcccgaggaaacaatcggttggcactcaatggcaaatgatcccaaaacgattccttttcgttgatgggcggaattcacacggcgaatggaagagatacggtagccgtgattgcacactgtaaaataaaaaataataaaaatgaattcaatttaaatccaataaacaacttaatgaaaaatctgaggatacgccaattaacaacacaaaaattatggaacagcaggaaagaaaatggtgaaagttgctcaaaataaaataattaaacggcataattatgcttaagtgaaaagtcaaagataattaattaagggatgaaagagtaattaaaacaaaattgggtagagattaaatttacattttggattatttggagccagttttaacaattatgatttgtcggcgtaaggtcagcggggaatcatcccaaaagaaatgaatgtgtgaagaagcgaagtgatcaatcgacgggattatcatcaaatgcacaatgaaaacaggattcagcttaaaaataaaaaataataattacaaataaagaaaaaaataatttaaataaaaatgatttattaattaatgcaatttaaaacgaaaatgatatgaatagagaatagaacaaaaagggttttttccgttgttttttggagatcaaagaaatttgattttaatttttttcgacgcaactgatagccctatttttgtacaaaaataaatataaaaattaggacgtaaaaacaaaaactataggaaaaaatcgaattttcaagagaaaaaattttactcaa

SEQ ID NO: 7924 - DNA, 2844 bp, Heterodera glycines
tgttgggacgaactcaaagaagccaagagcaagactgaatttaatgttggcctaatggacgtgtgggatttcggggcattggcacttttccacaaaattggcaccaaaaatgttgtgcttacacacaatttcccgatcatgtcacacatgtacaaatacatggaagaagcaggatggcaaactgagaatagcgaattatttaactaccaaaaacaaatattgggcaagggagtgccaggtgaaaaaattaattattacttattttaaaataaacataccgtatttcctgaaataaagcccccaagggctttatttttcaaccttcaaaagagggcttttttctggggtggggcactattcggggagggaggggactgtattatcggaaatacggtaagtaaattataaattaattaatgaaatataattaaaaattataaataaacaaataaaactattttacattttactaataaactatatttttacagaactgttctcagcagtcattaacgacaaaaatgttggaaaagctggtgcatacaaggaaaagcataacgaaagttcggatattttctcaaaagtttatgaaattgctgtaagtttattttaatcaaaattaatataatttatttttctttttaaggatcaaaaattcaaggaccttttcacggacaatgcatttcctactctggaacaattgttcagagatgcaaaagctttgttcgtcaacacaaggcctttattggattatgacattggcagtttgccaaaacgcgtcaaattcattggtggcattgatctgatgcagcccgatcacaaggatgtaatactatacagtagtaaaacagtatacacagattaagaaaatcccatatgaaacatttgaaaaatttaaatccgagtctattccttatttctcttaaattaaaagcaaataatttttaagaaattgaaaacagtatcataataaaaatgatttgaaatttcgaaaattttcagcaaatcacgcgatgccgaaaactcagaaaaacgatattataattgtaatatttaaataatttccctaaaaattaaggctttaccgcaagtttttgggcaacaaaaaccggtgatcgtgttcagcatgagttctttactagaaccatccaaaatgccattggacaaatttgaggcggttattcaaggacttggaatgtgtaaagaaaaggaagtgatttggaaatatgcgaaacaggaggataatggtcggaagtcattcttgcaaatgcatgctcctaatgtgcatcttgtggagcattacgatcaagccacagttattggtctgtaaattttatgtccatcaaaaaaatgccatggcatggttaggctaatctaggctaatccaccacggccggcgcaaaattcaaaaatttggaatttaaatttaccatttttattggcaaatttaatgaaaaatttcaaaaaattttccgatgggcttgggtcaaccgattctttacgttttttcaatttttagcccccccccccccgtaaaatacagtatggctggcctctgtctacggtatcatattgtaaaagtgtgccaccattttcaggcaatgaaaagacggaattggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtgacagtttcaccccggaggggattttcaaaagtatcggcgaagcattgacaaagcggtaatgtgcgcgcaaaatccttataatgatactttataggagagttgctcgagttttcggctctaaagtcgaggaatttctcggctttttagggtcgagagtcgcgactctcggggtcaatgactctcgggctcaatcccaagtcttggaaaattacgactcctcactctcgagcagtcctaataatttgttgtattagattaattataatttaattattttaaaacattttttagtcatgtcgtttcatttccttcaaacgagtccctgaagcaaacaattttgaatgcattcaaagaacttggtttgttcaaaaattaatcatttttttcataaaaataggggaaaaaatcatttatctgtttcaaattttctatcccattcagcacgcagtccaaatagatgagatttaggggaagataaaaaaacaggcattttagtacgagtagggcctatatacgaattttagggatgactcaaatatatctgtgatgctttgtgccctgacacagaacaatacgttgagaagttccagatgccatatatatacgaattgcacgtgctaggtacttttgcattctggaagcgtgcacaagcgcggcaaccaataatttttcaggccaactttccaccacgtaaaggttggccatctgaaagcccacacggtcggtcaacgcctcaattttgcgcttcaattcgccagtcaacagaggggaatatctgtcgaaaaggggcgctatgaattcagggcaaacgatcatcatcacccgaacacaactcaatttagagaaaaaaaacccaaaaaattttccgcgattttttctttttggaattctatgatatattatcatgattttcgaggaaacaccgtatttcacgaaagagaagaacaaacgtttacttctaccgcaaaaacactccaaagaacaaagctgggaaattataccaatagtttatataacacgtaacaaaagggtcaaaaaaacgaaagaactcccgcgagctctgaactccaaattttta

SEQ ID NO: 7925 - DNA, 1010 bp, Heterodera glycines
ggggaaattttaaaatttactagtatttagtacgttaaaatgagaggagcatttttctctgcgctctctatttattgggttcctctcgttttttggggggattttgtatacccataattgaatctgaattttttgaaaaaaaaataaataaaactttcttttatgtatgtaaaacacaagcaaataaaataagttttatattgtttatcatattaatatacagacattatcttaaacaaatatctctgaataaaaagcaaaattaatggaggtatgtatatatacaaataaatcatatttttgtgctgcaatctcaacaaagataatgatactaacaatggcattagcaaggggcaaaaatgaaggttgactttttagactaaaatctgtgccaacaattttaagtcttcttggcgtcgtcgcctcacaatggcaccgatttttgcattaatttcctcagcaggaaccataaaactctctttgtaagatcagtggagcgatgcctttttggcatcggcacaatttaattgtgccgtattggtgccgaagtttggtgattgagtggaggcaaacaccttgaaaatgtgcgaaaatttttattgaaaaataaaggtttatttaaaaatcccgtaaaagccttttggaaattgaaaattagttaaaatttgcaaataggagtggtgtctaaaatatcagtagctcattcccccgcggaaaattttaaaaaagacagtaatttcctaaatttttacaataaagtttttttctagttaaaaaacaaatttctatgaaaaatcttctcaaaatatttattaaaatgtagaattgggggggggggggggaaatttggaatgaaaaattacaaaaaaaaagttgttcgtaatttgcagaaattttccacattaaacttcccattgctccctcttttacagcccccttccagacggaaaatgttagttcacaaaaaatcaacaattaatgttgtaagctttttttatttgttagtttga

SEQ ID NO: 7926 - DNA, 1942 bp, Heterodera glycines
ccctttctttttttcaaagataatttgtatcagacagccgaatttgcctaaaataaatttcagtttttcttgggagcctaaaattaccaaaaaaaaaacaaaaagtttttcataaattgtgatgggagcagcaaaccactgaaaattttgaaaaagggaaatgagataaaagaagtggtgggaggggagaagggacatcggaggctttaatttatgcacgaaaccatcgatcgcttttacaaaataacattttgacatcctattccaatttttgggacaggaaatttggacgcgatttattgaatcgcgtgcagaaaccaaaatagaatcacattcatacatatttttccattattctcaaaaaaatgaaaaaaaaattttcatttgatagacaaagtggcatactttttaaccacatactttttaaccattttaaaaaccgatttacctaacctgatgctctaaaaaattcgaaacaattcgacaacgtatattactatatttttggtaacattcgaacgcaacaaagtctgacttgagacttttgaattggaaacagaaaaaatcccaaattgctctatcgccgaaatgcaaccaaattattttaccaaataaattaaaatgacctagtaagtatgtatctatgactttacgaaatacatatacggtaccatattacattattatttgagtcctataacaatacagtacaccaaaaaagccccttaaatttccattattttttagatagatttggccccgttgatggccaattttgatgatgttttggcactgtgcagtcaccataaggtggtgccaattgttcgcgcaaatgcgatgggtgcaagcagcaaatttggctcacagcaacagcgcggtttctaccacacactgttgcgcgaaatggccaacaaatatggcaaatcggcaacacaggtggcaacaggcactcactgattgccaattaagaaacaattaaaattttcttttagtataaatattttcataaaatgctatgaaataatgggtgaattttttgagtatcaattttcataaatttgaaattgaccggaaaatgctgtatggcaaatgagcaaaaaaaaggtcaaaaccaggaaagtgtgccgactccctcaaaaaatttcggcaatcggaaattgtgacgactgaaaaaatttcggccggaattccgagtcccaaaatgtcgtaaatcagcattccggcaaatctcgagttattttctggcaacagggcctagtctaattaatcatttcgtcagcaggtgttatgccgatggttgcaccaacatggcatggcggtagtgtgcagttgtggcccaacaactcaaattggccaacaaacgaacattttcgattttggcataagcaacgaagacatgcgacgcttgaatagcttgtacaacagaaatgtcattgcgcggccatatcagtaaattaaattcaaaaataattacttaatttcattttaaatcacaaattaatggaagaattattggtaaaatttttcgatttaaaatttcattaatttgcatccaatagcaaccgatcttttttgtggcctttaatgaatgaataatgctttaagaattttgagtgtattataagtcaacaatgaacacaatgcttaagcccatttatttatgagtattttacaaaaaaaaaaatttaaatatgtcaaaagaagccgaaaacaaattttgtattatttcatgggcattgaggtaataaataattagttaattaatatatgaatctgaaaaaatattgttaaacattttttaaataatatatttttagtaaaattttacaaaaccatttaccatatttcctaaaatagagcccccgggggctttatttttcaagccccctcaaaaggggggctttatttcaggagggggggggggttctaatttagagggggg

SEQ ID NO: 7927 - DNA, 3935 bp, Heterodera glycines
  misc_feature (3781)..(3781): n is a, c, g, or t
  misc_feature (3833)..(3833): n is a, c, g, or t
ttttggcatttatttatttaatctcgacagatcactgtgtctgctgctcggcttatggcccaatcgccagtgatccatcggatgttcagcacggaaatgcgcgagcagcagcagcagtcgctcactttggacgaattgggcgtcgacatggagcagttcaaggaatttttggaggccatcccgacaatcagtgttcagactcccacttttcccaaccgtaaaagcaaattattattattattattaatttaataataataataatttagtaatttagacagtttttataaaactctctattagaatggcgattttctcttaaagtggctggctcatttgagaatttgatatttcaagtgaccgatgttttttcaggttttcaaataatagcaaaaacttatattttgtaaattagacatttttaggtgttcctatgcaattaattgatttgttcaaacctttgtttgctttttaaaacaagttccaaaaaatccaggcccaggggagcctgggttttttctggacctggatttttgtccagaaaatccaaggtccaggcttttttcaaaatgccaatctctaatgttttaattctgtttttgttaaggaattttaagctaaaaaaattttcttttttctaatgtcgaaaaaatgactggaaatttcatgagccaagaaataaattcataaaatcgtaagcagaaacaaccatttttattttaaaattctttttttgcaatttctcagctaacaatgtgttggcgctgctcaaattggcccacttcttcgaggtgcactggctgaagaggcgctgtgagacgcatttgatcaattgcgtggaaattccgctgatcgaccgattccttctgatcgaacaattcggacttggccaattgaaagtgaatttatttttcaattaaattcattatttttctcttatttagaattactttttgcgtttgaatgcttacaaattgcgcgcttttttcaagtccaatcgtgctcaattgtcctccaatgtcttcgcgagcaaagaattgttaggcgaatttgtcttcaaattggccgaataatattttgaaattgatcctctgaaaagaccgaatttggtcagcctttttttcattcattgtttctttttatattccttcaattaaaaatgtcatttaaaaaagtgccggaagtattggcacgggttaaagtgaaaaataacggtaccactctatgactattgttgtaaattatatggattaacatattttttctgcgcatatactatgaagaaaggggctcaaaatagcatttcttaaaaaaattgcatttttaaattttaaatccatttttttgttggtttattgttaagaccgacttttgaggcatatgcctttttttctgcgcactagtttcgacatattaagcataaataacacattttccacttggtttgaggcttctacgttgacttttattatgccgttttttgcctttttcggggttttcatgccttaaatgccttttttggtattttgccgttttggtgcttttttttggcgttttccgaaaaaaatccatcaaaaattttcgggattttcatgcctttttttcaattttttggtgcctattatagtgcctttttcgcgatttttggtgcctttttagtcggtctttatttattgtattttttaagtttatttaagcaaataatgaatatataaaccttttttggaatttttgagggtttaaaacatattttgacagtttttagtccatattttggtccatatttttctatttagcttttaaatccatatttcgggcttttttagtccatattttatgtccatatatgacgttttttagtccatattatttacaactctatctataacagagtgtatgccatgactttatttaattattacagttgggcttttggcaaggcaaaaatttgaaaaaaatattgttgggtccggactatgcaccagttggtcaaataatgtgcacagttcggagttcggacccgtgccggtcgattcgtaaatccgccactacaagaaaatattattttcatttattgaaaaaaattgttaaattataaattatcatatttgtaaaatttttatctggtttaaaaaccgaccggtttaactaaattttacaaaaaaaaatgccaaaattttttggggcactgtattaagtaagttaaaataccaatgaaatgtgaatatttactcaacatttcggatgatttgatgatagaacagagttcccaagtgtccttttttaaagattatcctttattttaggcttccccaaactttttaaatttttttgtgcttaattatttatttcgctgataaaaatgctacaaaaaacccccaatttcaaaaaaattttcccggcggcgcctttcggcaccgccttccccccctatctccaaaagtttttttaagaaaagcgcgcctcaaaaaagcgttttttaaaaacaaaaaaaggagtctcctggctaaaaatcgcaaaatttgtcattttttagacaaaatctgttaccaaatcgcatttaaatattacaaaaatttcccggcggcgcctatcggcaccgccggcctaatatactatttttttttggaaaaagcgcgccgcaaaaaaacatttttgattttttaaattttgaataaaatcttccaaaatgatgattttttgtcggcaaaatgctgattttgaaaattttcagttgacaggccatgtttttacgctaataaaatgttgttttaaatcgattttcatgtattttattgcgtttctttctggctaatattagttttagaaaaaatctttttttagggtccaaatcttagtttaagtatcgtttgtcctttttttgaaaaaaaaactcggaaaaataattttaattttatattagaatgatcaatggactttcaataaagcacaaaacacagcgatttattcagcacatgcgacagccataaaaaaataatgtttttatggaaatgttttctcaggaatttcctctatttttcttttcaatgcttttgatttgcagctttgatgcaatttcgaacatccaatttggcatcatcatggccatctcagtctgaacattttaataaattgctgaacgtaaatcatcagccgatttgtgtgctctgctgatgcttttcaacaccaccacaaagtgaaaaatatgcaaataattttttacaaattaagcaaaaattttctaaaatttttcaaattggttaaattcaactagctaaatttgtatgaaaagcatttagaaaaacgtaattcgtagttttgaataaaaaaattgaatttttccattttttgaattatttttggcataaattttcaaatttaataagttaaatttctattaatatttcgagaaaatatccattttttggccttacaaattagagatcaaattgcaaaatatatatttagaaatacgtcctagaagcttcaaaaccaagttaaaaattatgtttgattccctaaaaataaccgacaaaataaaattgcctgaatttgatgggcaaagcatccggtagtttcgtcggcatgtcctactgtacgaagtgccgaattgacaaacttttcgggtgtcggactaaaaaagcccggtttttctaagtgtgtgacttcctgtgacattttagtgagaacaatgcccggaagaatctgaaaatatatgtttttctattattaatttaaaggctttttaataaattttgtttaattattaagaacactttanaattcaatttttcaaaataatttataaacaattattaatttattattaattntatacaaattcgattttatttattataaattgaacatttttcaatttttaattattttcttataaaaaatggtataaacgttaaaatctttacactctgaat

SEQ ID NO: 7928 - DNA, 2916 bp, Heterodera glycines
gaaaaattttgtaattttaatacgatttgttaacagatttgtccacaaaaatgggccaaattttgcgattttgagcaaattttaagaaaaataaaagggatttttagggtcccggcgggtgccgattagtggcccccccgggggggggaaaaaaaatagattttaaccatatttttagcagattttcattgaaaaaattcttaattttgtgaattttcggaagaaaattcgttagtttctggtttttatgaaaatttaacaaaatttgggagagattttcgttttgatgctcttttaaaaacccaaataattaaatgattgtcaaacattatgccaatttatcaaaataatcataaaatttaacagattctgacgattttccccaaaagcctccaaatttctcaaaaaaccacaaaaagcctcaaagcctcattttgaaaatttagcctcattgacctaacaaaaaaccacaaaatgaggctaaagcctcagatctgggagccctgcctaaaaatgaattatttgaaaaaattttggtccttagaggtcaaataatgaactatgcacaaataatgcaaatgggaatacatccaagaagctccaaaacaagctaaaaattatccgcttcaaatacaccaagtacaattggatgctctaagaaaaaacgacacaataaaattgcctgaatttgatgggcaaagcatccggtagtttcgtcggcatgtcctactgtacgaagtgccgaattgacaaacttttcgggtgtcggactaaaaaagcccggtttttctaagtgtgtgacttcctgtgacattttagtgagaacaatgcccggaagaatctgaaaatatatgtttttctattattaatttaaaggctttttaataaattttgtttaattattaagaacactttaaaattcaattgttcaaaataatttataaacaattattaatttattattaattttatacaaattcgattttatttattataaattgaacatttttcaatttttaatttattttcttataaaaaatggtataaacgttaaatctttacactctgaatgataatgccagtatcagcataatctttgcgcaagattgacgagaaccaagtgagatatttctgaatttatttaaaaaaaattatttaaaaatatattttaaattattttcgtactttaactgaagaatacagagctgtatgaaaaagtgggaaaacagcagccaccgaagcaatattgacaataatgcctttattgcgttcagtcatttgttttaaaacaaaagcggtaagaatggtgtgtggcattgtgttcaaaagctaaatttaaatttgtccgtttttaatttgtcaatgtttttttttgtagttgttggatgatatggcatttgatattttgtttgatataggtattcaaaaaaattattttatctttatatataatttttttaaagtaaataaaaataaatttttcgtataaacaaaaattaaggaaatttatgaattaattgaaaaaaaacatttaaatttaccaaatctttcgcaatacttcgatgtccaccggggagctcgtgaaaacgcattaatggcggaaaacttccgacattattaactaaacatatcaacaataacaataaatttttgctgtgctttttttaaaaattcccaaaaattttcctccaaatgatttcgatcgtaaggagccaagaaattttttttttattaatttttgttttttttgagagaattgtaaaaaaaaaatttggcggcatcacaattggggagacaaaaagcatggtattattttcatttttcacatttgaggcaccttttctgaaaaagtaaaattctccgattttggtctattcatcaaaaaaatccggatttctgctaaaaaattcccgagatccgaccccatatcgaacattatttttttctaattcaattatatttttcaattacccagcatgccaatgtccatttttgaaagctcggggaaaagccatttttcatagtcctcaatgtttgcgttggtcaaatcgaatgaaatccatttgacttcgggctgcaaaaattgttttggctgaatttcttctttcactgcttttaatttgtcagcggagcgcgaaattagcattaagttaaatcctctgaatttaaatgaaattaataaattgttttctaaaatttaataatatctaattttttatatttaagtcaattattcgatattggggtattaggattaatatatggtcaaatttcaattacatttatttctatttcttttttacttgtaaaaaccaagaaatttgaccaactaataattttaattcagcagatgtcgcataaattaaattgtaaaaaaacaataaaatattatcaaacgaaaaaaatttataggaaaatgtaaaaattaaataacattttagaattcgtcattttgaaaaaaaaatctggtcctgatttcatgaactcattttctggacaaacccaggaaaaattctaaagtttacccagaaatccaggtttttttttgcctaagctggacctggagcaggattttttcatattttgcctgcacccgtatttctggaaaaagccatgaaaattcaaattgccgaagaatggcctggatccatgtccaggtcgaactctaattattatattcaaaaattgtacttgttggccaactgttttgcatattctttgccaattccatcgctggcgccggtgaccacggcccatttggcaccgaccaaacggcgcaaatcttttggacgtgcaataaaataggggtaaacacaacgccaaattgcgcgaagaaatttgaatagcaaacaaagaagaaaaagcaacccaaaaagaggtagaattgcgtaaattacctcccatttagctaaaata

SEQ ID NO: 7929 - DNA, 1721 bp, Heterodera glycines
aagcggaccaaaaagaaaagcattggggcgccgacgacgccaattcggctgcaaatttggccaaaggagcaggacaaattgcgcactccggtggggaacagttcgctgccggccaatttgtccgagttgaacaaaatgccacaaaagccaaccgcagcgaccaaagagccgttggacaaaaaggtaaagttggcatcgaaacctaaaggaatgtgccgaagaaccaaagccatgggcaattttgaaacacctgtcaaacgcagcgtaacaaagagaccaagcgcagcgaggacgagcacttcggagagcaaatgggacaatttacggcccaaccatttgaatttgaggtcggcaaaggcaatggccaagttcatcgtgtatttgaacatgcccatccaaatcatattcaggaaaatgttgcccgacatcttctcgatgttgtagacaagggcataagtgatcagagtgaccacgaaaagactgaatgacactgacaaagtgtacatggtgaatttggtgttgtagaagaggtgcagctaaagggacaaagtgccaatgacggaaaagtggccatttggggatggaaattgaaaaatgttattgtcttttagtatgatttgtcggataactcacataattgtacttctttttagtgacggaaagttccaacatttgttgtagctccttttcaagcagtgcgtccaacgccttttcgtcatacggacgccctgaaaatttaaaaattgaaatttgtataaacaaataattttcttgccgtcgaatttatgcattcgaatgatggcctctttcgcctctttcattttacgtgcactgatcaaaaaacggggcgattcgctgaggaaaagaatgagacccatgcaaggcaatgcgaagagtgccaacacgcgttgaaggtgttgccaattggggatgaagctggccaaaatgccgaagagaatgtaattgggcgcctgtggggaaaacaaacggtaaaaaaagtgaaatcgaaatggcacatttggtgggggtggggggaaagacaacattttgtcgaaaagaaaagacaaatgcaaaacgtacccaagtgatcaaattcatgaggcagaaccgatgcttttttgggtacaattcggaggtgaaaacgatcaaagtgacggcaatgcccgcgttgaaaaaacagacgacgaaacggagcacagtgaaaatgaccagcgaagcggaaaaggacgtggccaacatggcgaacacccaaaggaccaacgcgctgagcatggtcagacgacggccgtacaaatcgctgagccaaccgaagacgaaagagccggggataatgccgaccaactgcagggactgactcaacttcaattctgtccttttgctgaagaaaacggagggtgaaaaaagaataatttcaatcacaaatgccaaaagagagaaagaaaaagtgtcaaatttaacaaaaattaaacaataaatttagcactttgcttaatgcacaaataaatcacacaaaaaaggcattcagaaaacaacatattttgtatttcatcaatgattcgaatgataaaacttaaaatatttttgtaaattatcaattagttaaaaatatattttgttaaatgaaaatttacataagtgattaagtggagtcgacctaattaaattgggttaaatgggttaattaatagcgaatgccaatgcaaataaatgccctaccaaaa

SEQ ID NO: 7930 - DNA, 4448 bp, Heterodera glycines
  misc_feature (4436)..(4436): n is a, c, g, or t
tttttgcgtcagcgatggttcattaaggaaaagtccaaagtgccgcacttttccaccgttggctccgcgccggcaaaagtcatgaacaaaaggtcgccgacctgcgggaacaaaattctaagcaatcattggcaaattggaggaattggcttttgctggccgacctcaacaaaaaggagcaattgagagagagtgcagacgatgagcatgtaccagcccatgcggaagcagtcgtccagcttcaggtcgtcttccttccgctcgtcctcctccgtcctttccgcgtcgttcactaagtccgcttttgctgtcccatccctttgggactgtccgtgaatgccttccccggcaatgccatccgacagaagcggctttgtttccgtcgcctcttttggcctctcgtcgccgctaattttgtcggccaaattattactcattcgaaccaagggaaaaatatatcagaaaattatttatttactgaaaaagagaaataaaaatgaattgaaaataaaataaaaagtgaaggtgagtaaaaacttattatttggcctaatttcgcgtttggaatttatttaattggttaatgtacattttacatatatatttctttatacatatgtatggaaaaaaagaaaattataaaaataataaattataaaaaaatcaattttttgttaatttttgttatgtaataatactatttatattttttggtgagagaaaatgccaagactgcgtgaaacacaacctagcacagtggtttaagttgagtttagtagtattcgagatcagaaattttttaaatttaaggaaaatgggagtgtcaacaaacatgaagtatttgaatttaaaatttattttttattattaaataattgcaaataaaataaaaatttatgcatcaaaggggttaaaacaataacaaattttaaaaagcaaaggccacaactgatcggcattcattcttttaggactcgcactgtgaggcttttaggctttgaaattggaacaaaagcctctaaacctcatttattttcattcaaaatttttcatttttgcctgacaatgagcggtcttaaggccctcaacctcttttggatttgtaaaatatttaacatttttgaggcccctctctttaccatttttatattgcggcaaaaaatgatcgaaagaatgaatccgttagcgcaaatcatagtcaactaagattttaacataatttggtcatttttattttttacattaggataattttttaaatgaagcttttgatagccaaaagaaattagggcataaatttcttaggattttgggggcaaccaaaaaatgtttttctccttttttataactttggcacactttggcccttatcgttcattagtaaaatgccaaaaaatgaatttaacggataaaaagggccgacaatatcgattattcgtattctttcccttttcaagcaatgaaaggaacgaaaatgggggaaaaagcgggggggggggggggacaaataaaataaacgcacacattgcaataaatggggacagaaagcgcagcggagcattcattctttggttggcatgtgatgaaagtgataattgataaggggacaaaagacgtaacaaattaaacaatcgtcgcaaaaattcaatttaatcgtacaaaatttttaaatttaattcaaaactaattcattaattaatggaagaaagaaaatgacgtaatattataaaaaaggaaagcggagaacggagaattacgctttatttgtgtttctttttgcttttcctcccaaatttctccgttttatttgccaaccaaagaacacacaaaagcacaaaggccaaaaagaagtgggcacagaataaataaatgtgccatctgctgcttagggaaagtgttgggatgcaaaggcattcttcggacggatgactcatcgcttttcctttcgcttttgctgtgccaatggccattcattctgtctctccctttatccctctctctgtcccttcctccgctttatcctccctttatccctccctgtgtctctttatccgtttttgtcctcccttttcgtctgttctcgaagggatggattttattattaatattaatcttttcccgccaacaattgttcgttcgttctttcgcttcacgtggggggacaccgattaattctgtgaccagcgcccaatgcgtcgctaatcgtaagccgtgacattcatcgctcatcgattcactcacttttgcctcgtgctttttatttgcacaataaaattacttccgaagttcagccgatgacgcggcacagccacgggttcattaattaattgattcattcactaattaattaactgattcgtcatcattagttaaagtgcaggcattaatgttagtcaaaaggtggaactaattgatcagcagaaggagagaaaaaaaaattgtaaaccaaaaaatgataaattaattgtaagtaattttatagcgaatgcgaatttgatcaattattaagaaaatagaataaataacttttaatacagcacattcacaaatatttatcattaataaaaaagagagactaaaagaatcaattggaaaatattcacattcaattttaaaaaatatttagtgcgtatttttatttattctttttttattgaaaaatttgaaaacaatagcaaaaatcacttgcaatatttttctttatttcttaaaaaaataaaaaagtttgtacaaatatattcattttaaatttattataaaaacaattaaaataataaatatattgcccgcttttgataaattcgctccttggaattggacgattcaattcattcattcagtggtgatggtgatgatggctaattaacttttattaagggattcacaaattgtttataccccgaattggtcagctgctcgtaaagttgcagcgcattaattacgaggaaaccgaggaaaatggcgccgagttggatctgatcagagggaaagtgccattcagttggttgcaaattgcaactgattaaccaaatgcgagtgttctttggccctttcatgcgcgagcacttccaaaaaagtcacataaataaaagtgccaccagccaaagactcgagaatgattatgatggcttcctttttgatctcgtccatgttcagagtcttaatttcaatgcttaattcatgaatatttaatcagttcaattaaactcaccgtaatgaagtcgccaaatatcgcccccaggggagtcattagagcgtaggcgctgatcaaacagcacaccaaactgttgctgcgcgacttactcaattgaaggccgacactgaatgcttcgatggccttgtggatgatcagcgaaaagaacaaagtcgtaattccggtgggagtttcctaaaaacagtcaatgacccgaaaaccatccgaacccacctgaaaacccatggccaacccctcgagcacggagtggaacgaaatggcaaaagcaaaggtgaacgacttcaacaagtccacctggagcacaaaagtggggattaatgctctccccagttgctgatcaccaaccttttccgacttttccgaactgttcagatatttgttgatcactgtcctgaaagcaggggatcaccccaaatatagccaattgtcacgcactcgtgggtgagcatgtccaagcaggaagggcatggcttcagcgagttgttcaccgattcgttggcggagtttgcgccgatggcacagtccggcttagagcaggcggaaagggcggcggaacggagctgctcaacattggccaaattggcaccaaatttggccaaggcttgcttctgtttgcgttgctcactgaacgggtggaaatatgcatttttctgaccaaataataaaacctggaggcgaacaccttcaaaatgagttcttccaacaaataaacgaggaaaaagccgcagcaaatgaaaaattggggcagagggaattcaatttcccattgggacttatcacggaaatgttcgtagtgttcactaaatttgcaaacatttgccatttcaaccaaatgccaatgccaaaatgactttatatgcgggaaaatgtcaaggaagcaagtgcccatgaacactccgcccgcgaagcacgaaagaagcgtcagagtccatgcggtgcttttccgccgatggctttccacggtcgatgactcatccgattgccttccgacgccggcggccaatttgagacgaagctaaacatttagcaaagacaaaagcaaaaaacaacgaaatgttaattgattgagcttttataatgaaggaagggcttgagtggtactgtactgagaaagatacggtacattaaaacaatgccaaagataaagcctaccaaagtagccttaaactgcctattagcataatcatcgctatcattttttcttattttttgttcactgatnttttctggaaaa

SEQ ID NO: 7931 - DNA, 2636 bp, Heterodera glycines
  misc_feature (2515)..(2515): n is a, c, g, or t
  misc_feature (2555)..(2555): n is a, c, g, or t
aaaaggatatgtggagagaagagtataaggaaaaaatatggaatcgaaattgaattggctaaagtgaagaagaatccaggattgcggtacatcagcaaattgatgcttaatagtttatgggtaagaaaattgaaaataaattacgataggtaattttcactttcagggaaagttttcgatgagaaattgtttgaacaagaatgcggtgatagatagggcgtcggagttttataaaatagcgtgtgaccataaaattgagatgtgtgatattgttgaatattcggatgacgcgattagattgatatacagggacaaggaggactttgtgttggaacacaagtcgagcaacataatcatcagtttatggtgagttcaaaaaattataaatttgtatataacataatttttaggacgacgagtatggcgaggttaaaattattggaattcatgagagaagcggagagccatggcggggaaattttgtatacggacacggacagcatttttgttttgcacgatagggaagtggagccgatcacgacggggaaatttttgggacagatgagcgaggagtacggtggctatgagattgaagaatattgttgcggaggagcgaagcagtacgcgttgaagatgaaaaacaagcagacgggggagactgaatacgttatgaaaattcgggggattacattcgacgtggacaacaggaaaacattgcactacgatacattcagggagatggttttgaattatgggaaaggggaggtagacccggcattcttcgtctacaaaaatgattttgggtacgttttaaaaattatttgcttcattaataaaccaatatttaggccaacgcgggattcaaaagtggtgacgagggagaagcacaaaatgtacaagccggtctgccagaaggggataatcgatgaagaacttaatgtgatgccatttggattttgttaatttgtattttattgtttttttttgttaaataaagttgaataaaaaaattaaagtgatattatgactagcgggggtggaacggtctaaagtgaaggcccactcctgttagccgttatattttttataaaaaatctaaaagttcaaggggaaaatagcacctatgaccattattctggtacatagttacacacggtagttgagggaattgtagtttgacccgatgtctagagtagaggtgctgttcgacagtaaccccgaggaaacctcggtaggcaaaaagtcgattagaaccgttaaatgcgatgtcatccggtgagataaactgattgtgcctaaggtgtctcgttattagggcgtgtcttctcaaaaatttcaaattttctttcttccgcagtcgtagaatttcagaaagttcatgtggttcgcattcgttaaaatcgcatagaatttcaacgagagaattcattttgagcacgagtaggcattttcatattcgttgcaattccttatataccattacctcaccactgtatgatgaatttttgccttttttctttatttttaaaattctgagaactgaaatacagatgacgaccactaccaaatctaaaattgacaaaaaatatacccaaatatttgaactcgaaactttaattttctcaaattctttaaacatgacaaaattaaagaattcgctatttgtctcggacacatacttgggaagtatctcatttgagtgaaatcgatctttgtatattttcttttctttaattagataaatttgcccctcaattattaggaaatcggtgtatgacgatggcatcgatccgatcggtttagtaaaaatttcggtttcattatgctctagccataaattctcgattgatctaatgtcaatctcgtctattcgatcgtctctgattacgaaaagtcgaccatcaatatgatcaaatcttaggtccccaccgggaaaattcttaacaaccttttcttgacaacctcttgttatcgaagtttcatttgtgttttcgttttgaaaaattaaataactatgatcgttgtaataaaagcatgctcggggctttaattgtctgaaatcctgataaagtttgatattaatagttccgctctttcctattgaatttatattttggattgatacactccaccctgaaatcggattcctatttatcatacatagtctcgagcgatcgaacccgaacagtctttcattgaccgaactctttgtcatagtgagatatttatcgtcaaaaaattgtgtatcagaaagaatctgaaccctttctccactgagttgaccgactatcgttaggagaacaattaaattaaacattactgacaaaattcttaactaataaatcggcctttgggcgaaccttatatagacggtcaatgacctcacaataagggattccgaagcatcgctgtgtcaagaaataaatgcaaaattgcccacacgcatctgagaattgatgttggacaatgcgatcattaaagagaattcgtttgaataggttaaggtatgaacttnaatcttcgttgggataatcgcccaatgaaatcaaatattncattacggacgacgaatttacaaaacaagcgacccagtggtcacctatcgtgctccgcacgggtcggtattcgcccacaaa

SEQ ID NO: 7932 - DNA, 2605 bp, Heterodera glycines
tgtctcgttattagggcgtgtcttctcaaaaatttcaaattttctttcttccgctgtcgtagaatttctgataattcgtgaggttcgcattcattaaaatcgcataaaatttcaacgagagaattcattttgagcagcagtaagcattttcatattcggtgcaaatccttatataccgttacctcaccgccgtatgatgaatttttgccttttctctttatttttaaaattctgagaattgaaatacagatgacgaccactaccacatctaaaattgacaaaaaatacacccaaatattttaacttgaaactctaattttctcaaattctttgaatacgacaaaattaaaaaattcactatctgtgtctgacacatatttgggaagtatctcgtttgagtcaaatcggtctttgtatattttcttttccttaattagataaatttgcccctcatttattaggaaatcggtgtatgccgatggcattgatccgatcggtttactaataatttctgtttcattgtgttttgtccataaattctctattgtactaatgtcaatctcggctatttgatcgtctttgattacgaaaagtcgaccatcaatatgatcaaatctaagatccccaccgggaaaattcctgacaaccatttcttgactccctcttgttatcgaagtttcatttgtcttttcgttttggaaaattaaataactatgatcgttgtaataaaagcacgcttggggctttaattgtcgaaaatcctggtaaagcttaacattagtagatccgctcttttctattgaattaatttcttggattgataggctccaccctgaaatcagattcctatttatcgtacataatctcgagcgatcgaacccgaactgtctttcattgaccgaactctttgtcatagtgagatacttgtcgtcaaaaagttgtgtatcagaaagaatagtaactctttctgcaatcacttgactggctattgttaggagaacaattaaattaaacattacttacaaattgcttaactaataaatcggccctcgggcgaaccttatatagaccgtcaatgacctcacaataagggattccggagcatcgttgtgtcaagaaataaatgcaaaattgaccacatgcatctgagaattgatgttggacaatgcgatcgttaaagaggattcggtcaaataagttaaggtatgaacttaaatcttcattgggataatcgcccaatgaatcaaaatattcaatttctgtcggcgaatttacaaaacaggcgacccagtgttcacctatcgtgcccgcacggtcggtattcgccacaaaacagtacggaaaatgtctgtccttcaatttaggcatcttgtcggaagcaaaaacaccgataaaatattttcgggttgtcggatgtttggatagaaatatttcaatctcataagaattcatcatatgcttccgtcgctactgagcacacgattagcattaatagataaaatcgaatcaaattcccccagaacgatcatctcataaccgccgtcctttataggctcattaaattgcaccttgatgctggtcgttccgtttcgaatcaattcaaaaccgggggtgtcctctagagtagaggtcatcgggatgacgaagaagcaccaaccgtttacaaatttttgtatattgatcgacattgttctttcaccgtcgtccatcccgagccccgtatacatgtcaacaaatgctcgaatgtatttgtttctatcaaaattaagagaatagggtgacccggggaatatgtttccattcgcttcgacaccgatagagcgtatttttgcatgttcaaaaacgaagggtgactctttaggatttccggtatacgcaccggttgaaacaaacccgacgattaaacgtctcggaacaatgcttgtaaaaacattgtgtgaaagatcagaagtgccacgcgggatgaaaagacttctgatctcaatttttctcataggatatttggccggtgtggtttgtagctgattgcttattacattatttaatgactgggtaacatctactgtttttacataaattctaatatcgtgtatgttaatacgatatgtgtgcgggttcgctatgactgcatttccggaaacatatggcggtgccataattagaaaatcatcggtattacgatgtatgctaaaaatcacgtcagagttattaagcaaaagattgggctgacggccgagatcaaaattaagtttcaccatggtctcacatttggccccatcagcaaaacgtgacgctctgtttttaaagccgctgtttgtataatcattctggtcgacatcatcgatctaatagcaggacgcttcacatagacccttttttgacatcttctgaaaatcccaattcagtcatcatatatgccctaaccgcatagtaaataccggaatcataagattcgacaccggaaattgacacctttaatgttttgacaaagctgtgcccaaaattttgaatgacaccgacgtgttgatcagcttcactgtccttggtaattggaatcccaattgcttttgtcttttctctctattgaagttgacaaatagagaaa

SEQ ID NO: 7933 - DNA, 1043 bp, Heterodera glycines
  misc_feature (984)..(984): n is a, c, g, or t
tatgtgccaaaaaacacctaaaatatgcgctaaaaccccaaaaaaggccaaaatatgtgccaaaagtttaaaaaactgctcaaaaaataaaggaatttctcaaaaagtctcatttttttatcaatttcgctagcacaatgctaatcaaaagtattatatcgttttttggcgtaaattttttctcgctctcaaagatttctcatttttcggaattttttcgctaaaaatcaaattttaccttaaaaatgaaaaaagtcatgaaaagcgccaaaaaatgcaaaaaaaaaaaaatgaaaaaattgaacatctttggggacattttgccatgaatttgattgccaaaaaagggacttttgtaaaaaaaattcaaaatttctcaaaaaatcgccaaaatatgtgccagaaactaccgaaaccccaaaatatgtttttattcgccaaaagcccaaaatatgtttttatatgtgctaaaaactcgctctgattgaaaggaaaacaggtaaaaatgctatttttgagcttttcatgcgatagcatatgcgcaaaaaaaatatgtaaaaacatataaatccgttccttgattataaggaagcattaggtattattattttatttaagcaataaattatctagcgtagatttatgaaaataacacacaataacacattttgttgacaaggcaaacaaaaaaaattgtttttttcgtttaattgtaaaaatgggggggggggggagacggacgacgacgacgacgagtaaatgctaatgaatgaatgaatgagaatgaatgatgggatgggacaactgaaaattggtggtggaagaatgtgctgctgctgctgctgctgctgctactggttgaactgctgctgctgttggtggtggtgatgctctgactgattgatgaatgttgttgataaaagtgcgtcttgcccaatgtgtcacagcgccaattctctcaacactctccgccgccgctaacanttggcggaggatgggcaaaatgaaaatgttaaaattgatctgaaaatgacaacgacgaa

SEQ ID NO: 7934 - DNA, 2230 bp, Heterodera glycines
caaagaaactgcctgctcccgaaagtgtgccatggcaccgttttccattggcacaagtgtcaaaaaacagctgagggacttgaggaggatgtgctgtgatgcggcaaaaacacattttgccgtaagttgctcacaaagggaggtggccaagtgttcgtgggatttcggaatgagattttttgggtagatagagcacacctgggttcttaagaaaaatgttttcaatttctgccaattggacccctgtgccgagataaaaaatgccaaactttttaatgatgaaataaaagaaatacttatttggtctcggcacagtgtccagtggtgtagcggtagtgcactcgtcagcatcctttaacccagggttcggatcccctacatgtaaattatttttttaatttttgtctattatgccaagtctattatcaaaataatttttgtaaaaaaaactttatttttaatttttttgaaattatttagtgcagcaaatactcaataaaaatattagacaaaaatttattttttaattcgacaggttttttattacatctttatgtttaatgcaatttttaatgggataaaattaaaacaaatatcttaattaaattaaaatctccaacagaccattaattcataattttaaattttggtgtttttcataatctccatctttgtttccatcttctttgcccaatttgcgaaggatggaaagggctaaaaatttgaattattatttcttaaaatttgataatttaaaggattagcaaaatcattctttaccaattttcattgggtctgtttcaggggtggttgtcggcgctggcgctgttggcaacggtgtcggcgctggcgttgttggcgacggtgtcggcgctgtcgctgttggcgacggtgtcggcgctggcgctgttggcgacggtgtcggcgctgctggcgacggtgtcggcgctgtcgctgttggcgacggtgtcggcgctggcgctgttggcgacggtgtcggcgctggcgctgttggcgacggtgtcggcgctggcgctgttggcgacggtgtcggcgctggcgctgttggcgacggtgtcggcgctgctggcgacggtgtcggcgctgtcgctgttggcgacggtgtcggcgctgtctgcggacggacatgtgtcggcgctggcgctgttggcaataatgtcgacgctgtcggcggccggacagggggcggaaaaaaatctgttaatcttaatccaatttggaattaattagtgcttcagtttgtgtaaagaaatgctattatgttaaaaaattctcggtttttttttagatccggatcgtttcggcgcccatgtttcggcgccagtccaagtttttttggactataacttttcatgggtagaactctctcgaatgacagttttgttggatttgattgacaattaaaaagtaaggccaaaaaagattgggcgctggcgccgaaacgaccatttcccgttttttttgttcccacttttttcaaaatttttttatttaagttaaaatctgttacaagattcttatttttagattagagctgcacgggaccgggaattttgaaaaaaccgggaccgggatttcaatttttccaaaaaccgggaccgggacctgaaaaaaccgggattttccgccccggtcccggtcccgtgcagctctattttaaatgcttttacttccgctctttcctcggccgatggtaactctgaaaaaaataacaaaatattttttaaaacttataattaatcttgaatatcttaattttaaaaaaaaatttttaaagacttacttcgttgataagtgccgtggcccattgaaatgaagccaaaaagtacgaccataagcagcataattattaattaataagcaattgaaagataaatgaactaaaaaaccattttgaaccaattaaaaagcgattaatttttttttgtaccatgctaacaaataagcaactcattagtaatatttgagagcgagaagtttccaaaatttgaggtcgagaaaaactcgtcattttctagagcagagctcgagagtctcgcatctcactagaacaaatcacggtttcttgctgcacaaatttgtttaatgatcattgcctacatttacttgcttttcagggccagggctaatttggaaaattcaaaaaataaatggaaaaataggccgtgaaaagatgtattaatctcatcattcatcagtgtccgctttt

SEQ ID NO: 7935 - DNA, 1887 bp, Heterodera glycines
tctaagtattttctactaatacgcttggtaaatttcaaaaaatttggctaagtttcaaaaaagttatggccaaaaatgtcttaaaacctggttcatcgtgtgcttttggccataactttgttcaaacttaacaattaaaaattttaaattttcaggctaatagctatcgaattatatcaataattgaaattttagttgcagttcggccaactaataataataagtgttcaataccgaaaattttccgaaattcgagaacgagaaattgaccacgaattcgtggccactaaaaacaaaatattcgtcacttccacgagcagcagagttcgagagtctcgaattttactagaactaatcacagtttcttgggcctctatattttttgtgatggttattgcctaaagtttcttggttttcatggccaggaggggcttaggggcacatttttttagtaaaatgcccaaaaatgactttttaatgatgaaataaaagaaatacttatttggtctcggcgcagtgtccagtggtgtagcggtagtgcactcgtcagcatcctttaacccagggttcggatcacctacatgtaaattatttttttaatttttgtctattatgccaagtctattatcaaaatattttttgtaaaaaaaactttatttttaatttttttgaaattatttagtgcagcaaatactcaataaaaatattagacaaaaatttattttttaattcgacaggttttttattacatctttatgtttaatgcaatttttaatgggataaaattaaaataaagattttgataaagaaataaaatttgctaattgaagtgctcataaaaagcaaaaataaaaattacaaaatggatttagccataggggattcgaacttgtgacccaaaaaaattctgactaacacattacctctacaccgaacaacacattgaagatatgtaaataattaattattttctttagttataaaaaattaaaaactttggcacgtcataactcggcactcgtgctcatttggcagaaaataaaaccatttttcttaagaacccatgggtgctctatccatccaaccaagtttcatttggaaatcccacggacacttggccacctccctttgtcagcatttttaaattaaattaatttttaaattcatattaggcttttctttaaaatatgtatgtatttcttttcttttcatttttttgtggcatttctgctgatgaacaaaaaaaaacaatgatgatgccccaaagcgccgttctaatttctgtgctctcttacaaattagctcttttttttctctgttcctttgtaagttttcgcagcattttgtcccaatgtctgccttttctctgttttctttgtcacatatacatatattttgctttctttttgtccctcttaaaagtgctacacattcactttctctctctctctctcttctctcattctctctgttcttctctgtctgtcttcccaatgttatttcttttctgttccgtttctatgcctcttttccctgcactattttcttttttttcatttctctctcatccacagcttttcttatgcttttacaatccctccgtccgtccggcctttttcgctgtttttggcgttattagtgcagcagagagagtagggcgattttccccacaattcccttaagcaatgcgtttatcaaaaaagcactttaaagcctttacaacacataaggcgatgaaaaatcccacgccatttcgtaaatgcttcttgttctctcccaaaaaattattgggacaaaatttatttttattgtatgcgaaatgtccgattttaagttagtaggcgagatgacgagcagttggcgaaatgtccttacgcgattaaagca

SEQ ID NO: 7936 - DNA, 4147 bp, Heterodera glycines
atgcccaggaggaacgtggagaaactgcgagactttctttttttgttggggcatgtgccattggtgacttggtcaaaacgtctttagggcctaaagggatggtaatcacaaatttacataatttatcaaattaatgttttcaaaacaggacaaaattctcgtcagcggtaggggcgaacaccaaaatgttcaagtgacaaacgatggtgcgacaattctgaaatcgatcggtgttgataaccctgcagcaaaagttcttgtcggttcgttgctaaaaatggccaaagaattaatgagaataaacgaaagcttaatttgtaaaaattactcattcggcataattatttattgccagaattaggtaatggttacttttcaatttttcagatatttctctgacccaggacaaggaagtgggcgatgggacaacgtcggtgactgtctttgcggccgaattgctcagagaggcggaagttatgattggacagcgaattcatccgcaagttattgtttccggctatcgaaaggctgttcgagttgcgaaggacgcacttgaaaatgctgcccaagcatcagggtaattagattgaattaacaattggaaagcaatttgaaaataatacatatcctacagagagcatttgcgcgaagatttgctgaaaattgcgaagacttcactgggttccaagattctttcccagcattccaaccattttgccaaattggcggtcgatgccgtcctccgactcggccccaacggcgctttggactccatccaagtgattaaaaaactgggtggatcgatggaagattcgtaccttgacgagggatttttgctggagaagaaggccggcatgtaccaaccacagcgaattgaagacgccaaaattcttattgcaaattctccgatggaccaggacaaagtggcaaatttacacagcattttacttttattttgtgtttagataaaagttttcggaagcagaattcgagtggattcagtggcaaaaattgccgaattggaacaagcggaaaaagacaaaatgaagcagaaagtggagaatatttgcaatcacggcatcaatgtgttcatcaatcgtcagctcatttacaattaccccgaacaattgttcgctgatcggaaagtgatggccatcgaacacgccgactttgagggcatcgaacgattggcacttgtattaggcatgtcccatataacttccatttgaacgggcctgtttcataactcaactttttctaaggtggcgaaattgcttcaacatttgacagtccatcggaggtgaaattgggtagctgcaaactcattgaagaagtcaccgttggcgaagacactttgctccgcttttccggtgtcccgcttggtaatgatggaccattatttgctttttcgtctattcctttccgtcaaggcaatgcgtgttccgttgtgcttcgtgggtccacccagcaaatcattgatgaagcagaacgttcgttgcacgacgcgctttgtgtgctgagtacgcatgtgaaagaccaacgcgtggtgcccggggcgggcgcatcggaaatgctcatggcaatggcagtgatgggcgaaagtcaaaaggtcgttctgaccaaacagaggctggcaatgaaacaatggaaattaggtggccgggaaggagtccatcgcaatggaagcattcgcacgggcactcgccaaattgcccacaatcatttgcgacaacgccggactggacagtgccgaaatcatttcgcatgtgcgagccgaacacagcaaagggaatcgccaatttggcattggtaagaaaaaagacccaaacttagaagttattacgtggattagatgttgaaaatggtcgtatggcggatgtttacgagttgggcgtgttggagtcgtacaacgttaaattgggcgtgctttgcagtggcgccgaagcggccgagcaggtccctccggcattgaattattgtcaatagacttttctttgaagcttctccgtgtcgattgcatcatcaaatgcgcgccgcgccctcgcacgaaggaccgtcgtccgtgctgagaaaacgcagctagcgaatgcgaattattgaagacgcgcacaggaaaaggaatacttcattgcttgctttaccgtactttgttattgttttttgacatgttaaaaccttaaaaaccgagccatcactgcgtaattaaatctcgtcgatttttctttcataaatcgaatgctttttccttaaaagttttgtttaatcgaaacattgaaagtgtttattaaatattttccatttgaatttcaactttaaagtgtcatccacctttttcagcttgtccttttgtaattagcctgttcgtaaatccgttctcaatgttcgttcccccccccaattcgaatgcttttgctccttttcagggcctctcttttgtcgcgggtgctttacgtcacttcgatcttcttcgtctttttgtacctcctggtgcctgcactgtttttcttcttccccacttttatgcagcacattttcttccttcattttggtcatttccattcccattgtgcccttttttgtctttttatgattccttttttagtttgctttccattcgtcgattaccacaatttggctcaccacggcgtccgttcccgggggcgtaacttttatttgcgtgagcgcgaccttaaaacggcaaagagtacagaaaatgttgcgaaagatgagccgaccatcggagtatggcacattttacccgcttctctctccgctgagaaggaacgatcgatggatgacgcggagatggagcaatcgctgaatgaagggcccaacgcattgttcatttacctgcacggaaattccttcgatcggaccacgagccaccggtgcgaattgtacaacattttgtccgccatggatttccacgtgcttgccgtggactatcgcggtgagtgggaaagaaacaaaagtaaagtgccattgcggtaagggaaaatggcatttgttaggttatggtgactcgacagggcatccgaatgaggacggcgtgaatgccgatgcgcatgccatttatgactacgccagactaaaagcgccgtcgaaggacatttatgtgtggggccattccatggttagccatgtcaaacaaaccgctttcttttttactaatttacactccattttcaagggtacgggcgtcgccacgcgactcgttgccgaactgagcgacgccggcagagcgccgaaagcgttggtactcgagtcgccgtttaacaatgtttggtttctgctcaatgcatttaaaagagcaatgataaattctcagctgcgcgacgtggtcagaaatcacccgttcagtttgcccttccgctttttgccttggttcaacacgaccattgtccacccgctgattcagtcgggactgagaatgaattcggacgagcgaatccaacggtaagatcgagggagtgtgggttaaatttaaaaaaaatgatttcaaattttttcaaaatatcatcccccttaaaagttttttttaaattttctcccaaactgaccttccatgcggtcttttccagggttgcttgtcctattctcgttttgcatgcggaggatgaccatatcattcccgtcaatttgggcaaaaaattggtcaagtcggcgagggaggcacaccgcgaagtgacctacttggaatttgagagcattttggagtacaaacacaaatacatccatcgtgcgcccgagttgcccgatgtgatcaggtgaaagcatttgaacacttcgcaatgggaaagagaaatgaatggcattttattttgcagagagttcttagagaggggacaccttcagaaacggagcaaaaaccgaattgagcagggaaacgaaggagtgaaggtggaattgtgagaagaggacaacaattggaatcaatggaagaatgaatgcttttaccatataataccaataattaggccagcttattaactcgatttcaattgttaaagtgcaattaacacaactctgtttgatcccttaattgtgaatgactttgaaattgaaagaaagtttgaacaaaaaataaggaagaaattgaagttgaacggatttcgttgccttttataaatgcggatgatttcattgt

SEQ ID NO: 7937 - DNA, 403 bp, Heterodera glycines
tctgttgtaattcattttgtcgctttatttacctccttataaaggcgtcaatcacttccctttcaatggagtcgcttttcggctgtcactttcttatgatgatgacatttctgcgtaatgttttgactgaacagcctgtgattgatcatcttttgcgtgctgttaacgccactcatttgcggttgtttcccccctccctcccccctccactcaatcctccaaattgcattttttgcttcttcccttcccttggtggaatataattaccgaagaagtgaatccgacgagcatcgcggcatcatcatcactatcagtcggcagtggacaatttcggggggggggggttgttttggggggaaaatgacccactataatttgctatactctcgatatatgccataaa

SEQ ID NO: 7938 - DNA, 2464 bp, Heterodera glycines
tttttttgcgtgttgcgccgacgaaaaggaggcaacgaacaacagcgacggaggcgcaaaaggagaggaggaaaagcaacaaacattcagcgagtgcgagcagtacacggcacattgcgaaaatccgccgtatcaacgcccttatcacccattcaacaataatggcctctctgagtgcggccctacagtcccaacacggcacaacgggcgctcatcggcactttcacactgaaccattcgtcggatcgaccattgtcagttgccaaaaaagcaaaagggcattggcattccttacgtttcagcgtcttcagcttagccaatcggccgcttccgccggcgttgtgccttcgccggcgccgcttttcacccctttggcaccgtccgcccattcggtcggtccgtcgccctcccaccaccacaatttggggctcaaccattttctgctttcgtccgccccttctacctcttcgtctctgttaaatgccttcggtcggtcctccctccggcagccgttccattcgccgtctccccattggctgactttggaagggatggccccgctaacgacggctcaattccctccggcagaaagtacacccaaatttcaaggattttatgagcaatgtttcccttttttagcatatgccgacccgtcacagcatcaagccaaagaattagctgaccaacagcttcagcaatgctcacaatcggtcggctcggatgccagcaccttctcattctcatgctccggcagtggggacagtgacgggcggagctgttcctccggctcattctcaggcactcatcagcaaaatgtccatcaacgcacatccaccgagcaaaatgccaacaatgtgcagctttcaaaagtcctacccgtcacgcaaaatgcacaacaaacggagccaaacggacaacagagacccaaaaagtcattagtccgtgacgaagcttattgggagagacgccggaaaaacaatgacgcggccaaacggagcagagactcgcgccggaaaaaggtcgctttgcttttccttttttggcttttccttttttggcgtttctttttccattttcacctttccccgtccattcacaggaggacgaagtggctgttcgtgctgtggtccttgagcaagagaatttgcaactacgttttgaagttgagcgacttcggacggaaattgaacgccatcgaatcgtagcatttggcgacgcattgatcgctgttgccaacgcagaaaatgccgtggaaatcgctgtgggtaaagtgccaatttcctcggctgcgatggcccaactgacgacagccgccacagcgatgggaatggccaaacaaattgcgaacccttagacgacgaggaagaagctttaatgatttaactccaaattcgatctttttgtcacattcttcctctttttctaaatatgtcctttggtttttaatcggtggcctttgaacgcattaaaaatttaacagatttaatgggcatcgatcgggcgacagaaatgcctttcacgagaatttggggtgggacgggggggaggaaagaatgtgcggcaaaggtatttttgccccttttcccccatccagcggtggatttgatgaaggagtgaaaaaaggctgccaacagttgttcaggcagatgatgaggaacagagaggggccggcggaagacggaggaatgaatgggcgggggggggggggacggcgcccctttcccgtccatcgtttgccctcataaaaagggacgtgaattggccctggaacatttcctctcttcttccttcgtttcattctcagcttaatttgttgttgactcttcagatggcccttttccctctctttttcgccgcttttgtcctttttggcactgtccaaaattgcgtgcacaacggaataacctacagaaatggcgacgaatgggttgagcccggggggggggcggcagcaaaaacccaaataaattgccctcacttttcagctcgaacggagtgcctttataatgcgatgcactgtaaagcaaaaaaaagatttcccgttcatttattaagctgctccgaaatttttcccatttgctcagattaatgcgaatggttcctggcggactgaagtggcggcatgtacaattccggacggacgacgagtggccgtcaattcagccatggaggacggaagcgacgaatggcagtgcaaaatggacgggtcgggaatggtcactctcgtacaggtgggccaacgaatgcgttgcttttccaccagttctgtcgtttagggcgccaatccaaacgcgcgatgcgatggtcgcccagtgggtgggccaatggcaattgaaatggagagggggctaagctcattgtcaccactcaggaagcatttggcaagagaagtcattcgaattggagtgtcggcctggcggctaccaacggtgttggcatgcatcaccgaggacggacagcgcgt

SEQ ID NO: 7939 - DNA, 1294 bp, Heterodera glycines
gagggggtgggcgtagtagtctcaccccacctgagaactgggccggcggaccccctccctggggccgacgacttttctctcttcggcggagggttcgtttttcgtaaccccctcccccagtgggccttttttccctaggagtgcctaaaattgtcaaattttgcaatttctatttttatttcagtgaacggaactcgagttgtgaatggtacagagacgagagagaagaatggccctatttaaaaactgcgaattaagggttcacaatggtctgccaacaattcggcaatgggacggtcattttccacgggacgaaaaacggtgagagagggcggtgggggggggagggaggacaattgaaagaagtctttattaaagttcgtccggcagaccccatttacagccgacttggaggaggtcaacagacttactacggacagagtaatggtgaagtgcgatgcaacgacgaaacgggccttccccggactgtcgggtaattccgccgagttttaaggccgaattcgcatattttttgtcgacagttccttttggacggagaaccatcgcttcaacaaaacatgccgacccaacggagcggtggaagtggtgaactgtgtgagcaaagacggataccaaataccgttgaacagccaagtgatccgtgccggagccaagtacaggtacagaagagacagagggagggcgggggggggggacaaaatgaattcgaggggactttggaaaagtttgtaatttagttgtgaaatgacgcctcagggcatcatccgtttcactgctgggccagcggatgaatgaacaatttgagggcataaaacgagtttaagaacacactaatgtattcatattaagttaacatcgccatttaattttcaatttttgtataaatgcaaattaaaatgattgtttttttggatgttttttcattaccaagtgactaattttgaccaaaaccttctgatggcacaaatctttaactattaaatgtttcactacacggtttgtatgcttctagtgtttatgagggatgagaggttattcttagttttttcgagccataatcatgtgttgagtgaattgacaattgttttgatttatttcattttggcaaaatgttttccttttattttccccttgggccttcaaaatgctaacttaaattgtttgacagaaaatgggcgttggttttctccttgtccaactaatcttgttatcggttctgacactttttttgttgaagaaatatgcccagcttcgcaatcaaagattgatcgtt

SEQ ID NO: 7940 - DNA, 3184 bp, Heterodera glycines
  misc_feature (67)..(67): n is a, c, g, or t
acaattaaataatttaaataaatggaaataaatgccttcgaattgtgggacaacaggtgcaaaattncgggagcaaatactcttgaaggagtcctaaaaaacgaaaaattaaattttgagagaaaaaaggatgagaaagcaattatgccaatgcactggaatatactttttaccagtcagactaataaataagttcatcctgaaaaaaaggaaaggaattctttaaatatatttttcttttaaaattctagaaaaaaaagaaattttcaccggaggtgcttataagtgtcatttcgccattcattgacttgattcgctttattttttcaacaaaattagacccaaaaatcctcaaaatttgtcagttgaaatgggtaagtgttataaaaaccgcgaaatgtccccttccatcatccacccaccatttctttgaaatgggtggtgaactgcttggactggccgaccaaattgcacaaaatgcacatgcaatagggcaacagttcggcggacgaagggacggaatcggactccaaactaacaaaaacaaaacgtaaaatttattttgagtcctccccataattttcatacatttgccgcgtcaaaaaaggcaacaattcgttggtccaatcgccaaaattgacgcgttcataagtgagcatctaaaaggggacaaagtgttcaggtggttgattaaaaaaatttttttaattttttgggttgaaaaaacggagaaagggaagagaaggcctaaatgtaccccttcaaattattcaatttaaaaaaagttgaattcccattctaaaatcacctggatgacacgaagtacgtcgatgagattttgggggcccaaatgttcgtccaatgcggccctcaaacagtggcaaattgccaggcaaatttgggccgaatttgcagcactttttcgcaataaaacattgtagagaactgaaaacggaatagagaaccgaaaaagggtgtggaaaaattctcataaatgaccatggatgtgtaactggcagaaaattttggatttcagaaatgtgaggtccaaaaaaaaaattgggagtccaaaaaattgttaaaaatcggttacatccatgggacagaaacaaacaaaaaaaaaattatgtgcccccacccacaaaaattggaaagaagcagtagaattttggacctcaaaagaggtcgggttgccggatgggtgagcagtgcggcacaccggtggagaaattcggaaagtgtcgaattggacgggtcgagacgagcggttgacgccagggaagcactttcatggaccaatttcttggggaaaaagggttgatatgaaaatggtcatttgaaaaaaattttgtccaaaaaatcttggtttttcgtgtctaatttggatctggattttttttcatattttgacctggatttcctggttcaaaaatccaggaaaacacaggttcatgaaaaacccaggttgttggaaactgaacattgggaaaaatccaggcctggatccaggtcggtccatcagaaatattttgtttaaaaagggacaaaaaatcgagcaaaatccacgttattacacataattgaatttagtaaaatttttgaatgaattctgtgccctcttcagccgggctctgtttgcgatcaaaaatttttgaaaaatttgaaactcaccgacaaaatttggtccggtgcctttgctggataatcagtcgctgagccgccgccgccaccactcgaatcatttaatgaggaggccaaaaagggcagtgcatttttgaggagggcatccaatggcattgccgttattgaactcataattggtgaacaacgaaactactgaaatgggattttttttttgatgatttattggcatttttttttggataacttcggaaaaggaaaccccaaaaataagaaatgcaaaacaaaaaaaaaaatttttttcaatgacatgaaagccggctaagtaaattttggaacttacgccaaacatgagaattcgctttttttctcgtgtttttcgacaaaaatgggaaagcgaaaaaaaaaattttttgggaaaacatttcgaaaattccattcattatttgtaaaaaaaaaagcctcaaaactccgcttcaatgcgccgcgcgtgttagccgctaatcgcaaaagcaaagcatgttaagtgaaaatggtgaccgacgggcgccgaggagggaattgtgcaatcaaaaaagaggcatcaagcaaatgcccttccttccccctaaagcaatttgatcgttttgtttgtcctttcgcttgcataagcatccccccacccctattttgacggggggcatgcctcacttttcctccgtccgtccgtttgttgttggcgatggcccaatgcaaacagacgacaataccaaactaaacaatcagcagcagcagcagcagcacacgaaatttcgtcgtcgcaaattccatcgtcgttggggcgaggccgacatcaaaaataaccatgactcatcagcagatcatttgtccgtcgtcctctgtgtctgtgtagctcataaaaacaccaccacgacaaggaaggagtcttttgtgtacaaggagaaatgttacattatttttttgcggaatgtgatcgatgactatagtctcgccttgaatgtcataaattttatgtttttgtataacagttgcgaaccgcgatcttatctaccatcaatataatcaaccaattgagagttccgtgtcaaacgaaggccagccaacaaaacaacaacaacaatatgtaatagtaactggacattgtgtcaccatatcatattaaaacaaaaaagttataataataatatcgcgcgcatttctcgtatatcgcttgtcgtcgtcgtcagcacttctccacaatgagcgcctccttgatcagcatcagagtgggcacttcctcaccattctcctgacggtactcaacaatggccacctgtccttcgcccttgccctcggccatgttttcgcctgaacaaacgggttttacgaaacgaaaaagtcatactagtgtacaaaaggccaaccgataaagaatgcgagattcttgaaacggtccttggccagcaatgagacaacccaggcctggatcttcttcttgaacgcagcaatgtcgtcagccgacttctgctccttctccattactcaagacctcaggcatcaagct

SEQ ID NO: 7941 - DNA, 2066 bp, Heterodera glycines
gaattccccccccccccccgaaatgaaaatttttaaaagttttccagcaaataatgcaaatttttttcgaattcccccccccaaacgaaaattaaaaagtttaattggcaaatttcgtaacaagtagcactcaaatttccaaaattttttcccggcggcgcctatcggcaccgccggacctacattttccactatttttacaagttttttgccttaaaacggccaaaatttggtcatttttagtgaaaaagtgcagttgttacccagcagtggaaaaaaagttattggttaaatagcaaaaaaaagaaaaaaaaaggtcttcaggtcggatctccccccccgaaaaatgtttctagatacgcccctggtaatgggtgaacatggtattttttcggggtttctcgaaaaaataaacaaaaccaaaaacccctcctggtttatcgaccctcactctaagattttttatcgatcccttttcttccaactaccgcaaattttactttttttaaattgatccaacatgtgtcaatgttaatttttgaacaaacctttttcatgaagtccttgacgtagcctttaaatgttgcctggttctaaacggtaaaaatataactgatgtcacacgcaaaatttaagcaatagtcccatcaaacctcgtaacaattcatctcctgtagtcgatggttgagcacaaagtcaatgccgcgttccaccgcctcttcagtgccctcgtcaatttcctccgctgacggatttgccccgctcatcgtaatttcgccctcctttcgcacgacatggcgacccttgaactcgtagatcaggtcgtcgaccaacttcatcgggaacgagtcagaggcgagctcatcgtctgaaattagggttgtccaataagcaccgttataaaaatctgtcaatgcccattttttaaatcccccttttcaataaaaatttaggtaatgtgaagggaaaaaagtattgttgctgcttttttacacttccaatttgcggccattggaaaagggtttgttataaacagcgtgtcaatttaccacgggatgactcgtttagcaccacaatcgccagccggcaaaagacgccaaactaaaggcccatgcacaatcagtaattcttattagcaaaaatgttagtaaatttcatcaaaatcacctattatttcattttaaatgttgaattttcaaattttcccctacaatttaaggtgaaaaaaatgagaaaaacaccttgcgactttcttcagaccgcgggtctaacatgttgagaagagcagccgttttttgaacggatttgtcaaagaaatcgtaggtggtcaaattccgtgcggtcgcatttaacagagggagatcattgggctgaaatcgggggaaaaaaatattcaaaaaaaaaaaaaaatttatcgagacatccaactgaaaatttgttaaactaataaataaactaaagttaaccatccctctaaaaatcaaacaaagcaattttcaaaaaaaagaagattttttagtaaaaagagaatattttaaattttattaaaattttttgagaagcaatctaaactaaacgaacagatgaattagtaaaataaaaacaattaaagtatcaaataagaaatggttttttaatttaaaaaagacaaatatttcatattgaattattaccgtttttggctgaccgatcaccagccgatggagcaaatcggctgcaatatgagtggtcattagcacatcatcgacgggcgaggcgctggagagaatgttgaaaatgcagaggaaagtttgggaaatattttggggactgtacacctgaaaatcaaaaaaaaaaaaaatttgtaaaaaaatttttcgagtttttacggtgtctcgagacttttcgtccaaatagccaacaaggaccaacgcactgacaacgacggccttaaaaaggaagaaaaaacaattaaataatttaaataaatggaaataaatgccttcgaattgtgggacaacaggtgcaaaattcgggagcaaatactcttgaaggagtcctaaaaaacgaaaaattaaattttgaga

SEQ ID NO: 7942 - DNA, 1080 bp, Heterodera glycines
  misc_feature (35)..(35): n is a, c, g, or t
tgatcatgttgtatcagttgaaaacaatgcaaaanaatggataccctggaaaagaaccgaaacataaattttcaagttataaaaaatggcgagatatttgtgagataggctttgattagccaaattccaagtgaatttgcttgggcaaagagaaagcaacaattaatcaacataaacaatggcccacgagcggacaaacaaatttcattaatcaaacagtccaaagcccatgtcatcgtcggattcctccttctcctcctctttctttgccggggcggcctcctcctttgcatcgggggcaccaccggctgccggagcagcggcggcaacggcggaaacaaatttggacggatcagccaaatactctttgacctaaacagttggaataagcaacagcaattctggttgcatcgctttaaagttgtcgaattaaatatgtgctattgttgacttaaaccgaaaaggcaattcttggggattttcgggatcgaactgattcatgaatactgcattcatttcgaccaaatcccaatacttaatcctaacacaaagttaaagaattagttttgggattctcgattttttttcgaaattaggcttataggttagaaattgggaaatattaaagccagccaaattattgatcagttcaaacccgaaaccccctgggaacatatttcacgatttccaaataaaaaaagaaatgtcgacttttgtggcgaaccagtttttcgttcatctaactaaaataagcacatccatccatttccccaaaccttttcagcctctttgaacgtcacgtccgtttcggcagcaacggccaacaagttcttgaaagcattggcaatcagatgaggcgccgatgccttggtcgggtagccgatgccaagtgaaagtgcggccacattgagcacaccttgttggaaacgtgcaagcagatcagccgtcgtcacatcaagcacatcgggcgagtaaacagccccattgtcaaaaacctaaaagcaatttaatcacaaaattcggtaacgagtctcgaaagatgagttttatgcccatgaaaatcggtcaccgattgattga

SEQ ID NO: 7943 - DNA, 3593 bp, Heterodera glycines
  misc_feature (2038)..(2038): n is a, c, g, or t
atttttcaattatgattttttgttcaaatttagattaggaaatcggaattgttgtgatagtcataaaaatttattctctggggcttttggggtcctcgatcacgaatccttcattttttatcacaaaaaaatttttgcaaaacaaaagggtccccccttttgaaaaaaatttcaaaactggtcacttttaatatagcgcccactcagtcatttattgaaggaattcttgcaaaaaaaagtaagaaagattttttcgtccagggaagtttcttttttattatatttaaaactaataaagaaaagggaatgtacaaatgggtcaatagaaactgaacgcggagatggacggcgttgaggtcaatggcggagaacgtcccgccctcccatggcggaagaaagaaaactcagtcaattcaccacccgaaacccaaaatgatgaattccaagcttcaaaaaaaacagtaactttgaaaaattgattaaaatacctcagccctagaaatcaaacttcttcacattgtgctctccgctttgatggacggcaagccatgaaaattttccgaatgcgaactataggatgtctctacgttatcttcgtgttgattgctgttagtttgattcagttggtcaaatgatagaggcgatttaagccttttggcacttaatttctcctgaaaacttagaaaattcaacataactctctctctaaaagacatatttctgtccgcaaaataaacagaattaaaaatatgtacacaaagaaagtaatatatataaaaaattgagcctgaaatagtcactgacgaaatcgttcactgacgaaaatattaaccacgaaattgccacgggttggggtcaattccctaccgccgattctctaccggccgattatgaccattcatactttctcacaagccgaagtaaaaaatttttaaaatagggttttgtctattttaccagctttatccagtccacggattcttaaattagatcgagaatttttttcccgaatttacaattgatttcaaatcactttgtagggcttccagggcccgaaaatttggaagtaaggcccggtttaactattcaaatttcacccagcaggtactgtaagaatccgaagtccctgaagctccgagaattttgagccaggtttcgggttcccggaagttacggaattgggtttaaacctatttttgggtctgttcaaaatttgaaaaattcagagatttgacacttctaacttactttaaaacgatcgaattctgataatttggtatcttccgaaagctcttgacgagcttagtctaaaaagcagtgaataaattttcttgtatgttttaatctcaatgtttatcaatattcaatacttttggtatggaaatggcccaaatgccttagtagggaatcggcggtagggaattggctcgatcccaattgccacaaagtgacattatgccattcacagtatatttgtcgtttgtcgtaaatttctatcaagttaaccgaaaatttcataaagtgcaaaaagcatgaaaaatgataaaagtgtctttttatgtgttttttgaggcgtagattctaaatataacatttatttcttcaaattccaatcatgaacacgaattcaatagactttgataactttatcaaaaatcattgataaaaacatagataatgaaaatctgagatcggattcatgatcagcgactaatttatccctaggaacataattttaacatgaaatacaattttttggatgaaaattatgtggtggtctttttgggacatttctcagacgacaaatttgaggggtggtgttgagcgccccccaaatatttggcgtttgtcgtctgaaataaaatcagaataatagaagacaaacgcctaattttagacgacaaacgacaaatttcgggagacatacgacaaacggcaaaatttttaattctgattgatgaaaaacgacaaacggcgtatactaacgacaaatatatcgtttgtcgtttgtctctgtcgttggtaattctgaaaggcnccagccaatatttatctgtcattgttaaaactgtcaaaaaaataaaatcacaaatgaaaaaatgtttcaaaaatgccgtggttctttgtgttgcctttcctctccataccgtaccccccctccccccacagtacgaattgaatggaaatgtttaatcaatcgccaaaatgttcacagtcaatcaaaagcaagaatatttctttctcttcacatgagtcgattatctctgctgagcagtgctctgcgtgatgcgttccacaatttgtaggagtattcgtctctgtacggctcgtaaatgcgccggtatatttcagtacggtcggacggatacctttgaaaaagacaggtaattagcgatatggtagagcagcaaatggttacagttcggtgcaatacgcccgtgaccaataagtgtacggtatggcggcgtaatcactgaaaaaaaattgataaaacaatggagcattatgctaaagcattgattgtggcataagttgaccaaccgacggtcgaatttttccaagaccggaaaagtacggtaggaagtgccgaaatggaaccaatcgtccgcgtaggacacatcgtcctgaaaaggccggtcttagtcacttctctaccagagtaataaaattaaccaagcaatttgttacggtaccaaacgcgactgtcggaaggtgcgccaagaccaagaacgcattttgtaggagagtgccgtattcggagagggggaactgtcgccgacagcaaaggatcggctcaagtcggcctttttagtggcaatggcatttcaacaaattggacataaataggcaaataccaaagtgcgagctcgcaattgcaccgcattttgacgaattatcggctgatcggcgaatgggccgatggcaaacgcactcatcgctacggtatacagtagtaaaaagggaggaacacaaaacaaaaagtacggtgatgggcgaaaacccaaaacataattttaaacatttttattattattatttcgcgttgcttgttctataaatgcgtttctctacagtatgctacagtatgctccgccattgtttttccgccggtcaatcaatgttcgtagtaatgcaaatcgaattccttcgagtaaaacgacggatttgcatagtcgaagctgaatagtgacttgaaatggcagcagcgaaagtgccaaacactcacagatatccccggtgacgagcccaatacgggtaggggtaagtccagaaatggttgttggccatgtaatccctgaaaatggaacgaacagtgaattgaattccgaatgggaaatggcacggcacgctgcactcacactgagggtttgtgcttgccgaacaaatcgaggcggcgcaatgccgagaattggctgtgcacgtcgtgccaaaacacctcgtgctgagttcggaagggactggttcagcagagggacggaaccgaaattcgaacactgaccgaattcggatcggtaaggtaacggtagggccagtaggaatacgggttggaggacgaatacaccgaccttagggggaggggggggggggggggg

SEQ ID NO: 7944 - DNA, 1830 bp, Heterodera glycines
cgttttgggaaggaaacgtcgccccggggggtaacgacgctttccttttgctcttgggacatacgtctcggtatttgccccagtggggcttataacggtcggacattcgcacatggcctgtcatgtcgggcaccgtccgcgtacgggcacagtacccttgcccttcgggaaagccctcaagcgaaagctgaacgagagaacctttggttgggagagagtgcagagaaacagagtcttacgtaagaatttggacgcacttgggacattctgcgacaaatgggaattcactgctggaaagcgaagaatcaaaagggatgaatggcagtgggaaagccaatgggaaaagaaaaatgggcaaatggaaaagccaatcaaagcaactgggaagcgaaggggggagagggaggacaaatgaatgacgaacacccacacactctctccctattacacacgctctcacactcacactcagacactatctctctttcacatacaacacacactctctccaccccctctcacacatctctcgctttctctctctctctctccgtctctttggtctcccacttctccacgctctcatcatcagaagtctcttactctgttaaactccctcgctcccttttctttctctctttcccttcccgtctctcctccaaacggataatcactattaatctttttaagcaaatttaaattttcacatttcaaaattcatctttgtgaagaattccgctgttttccttcttcggttcttcctttctcttttccggatttagccgttttgtccgtttcagtctttcgctgtgattaaaatcgcttccgtaccattccctcggggtaattgaacggatgagccaacgcatgggaccgataatggtaaggacgggcgaagctgttggttcgatggtcaaagtatggccgataattgggaggattgtcgtagtcgaacataaaatggcatcggttaatttgacattgtattggctaattgcccaattaattcattaaatgccaactgaccatttgccttggtaagggtatgcccaaaagctgttcgggtagtgccaatagttcgggttcgccttataatcgctaaattcgaattttggcattttccaattatttctcaaattaccaatgtttgaagcgaatggggaacatgcttcttttgtacaacggcgaaaagtaataataacggtcgtaccaatacgcatttgactgtaaaagaaaggcaattagaaaaggaagacagaaaaacaacggacgcaccaaagtgtacccgcggtaattacggtaggggaaatagccatggtaagtgttgtaagtgtacacgggcatcgacggacggtacggtccaattgcaccctgaaaagcagtcaaaatgccaaacgcaaaaggaaaataaaaaagggacggacgcgcaccgaatagacgcggaaattgggcacggagtaggagcgggtcagctgaagagtcaaatggatggaggagacaagtgatcaaaaacggatcaccactgaccatatttgtgtagccgggcgcgcggtttgtgggcggaagtgacgggtaaggcactccgtcgcgcaccgccacgtcccacagggacccggtccgctgcagtcggttcacttcctcgggcgtctgttccggcacaaccaccataatggtctagaaaaagccaaaatcggatgtatcaaactaacaaatttcaaattagcgatttgagagggattgaatcgatcgaatgccaaagagaatcccccgccctccgatcattcccctcccttccaagccttccgatcattccccgccctttccctccct

SEQ ID NO: 7945 - DNA, 3174 bp, Heterodera glycines
  misc_feature (61)..(61): n is a, c, g, or t
ctcgattagctcctccttttcctctcgcgttttcaccccatagttttcatcgtacacctcnttgctcaaacagctcacggaactccccaatattctgttggatgtgcgcggatgggttaaactcgggcgcctcccaagggagctctgagtgccagacacggtacttgtgtacagcattcacaaagtggtaatcatccgtttcgtgcagatagtgtacgtctggggttgggtctttgccgtgaaccagcctcatgtacccacctcgccaaggtctgaactctttgagcagctccaactctttttgctttcttatggcctgttgctgtcgtttaagctcttccaactgcttttcctccgcttgctttttcttggtctcgttttccgctctcaccgcttccgcctttgccgctctttcctcttctgcgtttgttaccattgccactctctccgcttccgcctttgccgctctttcctcttctgcctttgttaccattgccactctctccgcttccgcttttgccactctctcttcctctgcctttctttcttttgccactctctcatcctctgcctttctttcctttgctactctctcctcctcagcctttttatccttggtctctttatcgcctttcttttcttttgctattctctgctcttccttcttttcccgtgccagtttttcctcccttgccttcttttcacttgcctctttctcttcctttgccttcttttccttggctgctttttctgcagtcttccttctatcttcttctgtcttacgacgcctctcctcttcttctcgccgtctacgttcattttctcgctgctttctctgctcctcttcccttcgctttctctcttcttgtgcccatttttcatgccgcaacgtttcttgttgagccgctgattgcttggtcaaatatgaaagtgggtttaagggcgcttcgcccgtattgtcttcttcctcctcaacaaacgagacgtcaagaatctcgccctcctcctcatcgtcgtcgtcaatgttcccaaaactttcatgcaccggtgcggacctttttcgtgtcaacagccgttccacttcggcaatcatgccatgatgaattcccctctcaagctgctgtggcgagagaaaacttccctttggcacacggaaacggtattttcggccgtcgtgcaggtgaacaatcacatattgtcggtctgatgtacccagctttgcccaacttaagtcaaaaatcgaacccaatagccatgattttcgcccacctgtttgggtaaattatgcctgacaggccaaccatccacccggccccatcgaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgtcatcgtcgtcgtcgtcgttgccggttcatccttctttaggtgcttcatgatcagatcggtgcaatcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccgtacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttactttcttcattgcggaagcaatttcctcatggattttgtccaagcgaggcttgcgtccgctttttgagggccccggttgcaggtcaagcagtgtttgagtgttgttgtctccaattgtgatgacgtcatcatcattttgaggggaaaaattttcccgtttcgactcatccatttctttaaatttaaaattattataaaaaacccaaaaaatgattacttttgttctcaaacaccaattgatcattgatttttctcgggccattacgattaagaaatagtttatgattataattgttaaaagcataaaatgaacctgcgaaaaaacacgtaattattgattgatagtgagaggggtgttagcgcgcagcgacctccagacgggctgtcccttttaatcgataggccacgcccatccacaaacacatagacgagagtgtagtggttagagaaagatacaaaagggcgccaattcaaacacacagtgaaacccaagccaatttattgattttttacagattatggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattcagtttcggtctaacacacatgcgttcagaggttaaagtccaccagtatttctacataaagcaccggatccgcctactgtacccacagctgaagtgcattgttgagtaccacaacaagggccactgcaaatactatcccttgggtataaaattttgtccggaaaaaaatcaataatcattttcagagttgttggccgttgaggagggcagtgagagtgaacccgtcgaaagacctgccgctgaaaccgactacctggactacttgaactttcgcagtgggtggcaatcaacactctactgatcaatgaagcgtgtgcggcaatcggaaaagttgggcgaattcccggagattgagttcgccgtcacacaatgggcgtcacggtgtactgcccgcggcacctgcaaacgccctcggtttgtgccatgggaccagccccggggcggtgctcgagctgcagaaagcggaactgttgagctggacta

SEQ ID NO: 7946 - DNA, 3883 bp, Heterodera glycines
tttttggggcgattcatccactaaaatttggctaatttaaagaaatttgcataaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgttgttgtctccaattgtgatgacgtcatcatcattttgaggggaaaaattttcccgtttcgactcatccatttctttaaatttaaaaaaatttaaaattattataaaaaacccaaaaaatgattacttttgttctcaaacaccaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctgtcccttttaatcgataggtcacgcccatccacaaacacatagacgagagagtagtggttagagaaagatacaaaagggcgccaattcaaatacacagtgaaacccaagccaatttattgattttttacagattatggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattctgtttcggtctaacacatatgcgttcagaggttaaagtccaccagtatttctacataaagcaccggatccgcctactgtaccctcagctgaagtgcattgttgagtaccacaacaagggccactgcaaatactatcccttgggtatacaattttgtccggaaaaaatcaataatcattttcagagttgttggccgttgaggaaggcggggagagtcaacccgtcgaaagacctgccgctgaaacggactacctggactacttgaactttcgcagtgggtggcaatcaacactctactgatcaatgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgcccatcttttcgaatcggctaaagacagacggcgagaactttgtgccgtttgatgcaattggtaagctgcaggtgtatgtcagagtttgataagtggactttgccgatcgtgcgaaattccgcattagggcccggaacaaggtgttcacgctaccgctgcgacacccggaggtgcacgccgccggcccaagcttggaagacggcgtaaaagaacaaaaggaaatgactcagatggcataaacacttgtccatttttctattgttgatattctgatggactacccaagaataaatgaaagtgaactcgcttttcccatcccttcggggattattgtcagcggtccgtcctcatcgggcaagacccagctggtccttcgcctgttacggcatgccaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagctggccgatctgtacaccaaaaagtcccaccataacaatttttccgtgattttcctcacgcaaaacctgtttgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgccctcaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgagccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagaaaagaatgacgacgacgacgacgacattgctgagcggacaaacttggctttgtcaaacgacaagtgaccgctgcagtacagaagcggaagggaaacgtcagcgaacggaacgcaatgtacaaccagcagctgcgccggtacctaaagatgcgcaaggaacataaggagcggccgcccgtccgggtacagctcagcaacgtcgctcaactgctaaataaaacagtggagacgggtgtgcagcaggggtgcgacttgtctcagaaaagacgagagcgagagtttggcgagaggcgagagtccccaaaaagacgagagcgagagtttggcgagaggcgagagtccccaaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttttccatttttccaccttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaatttttttggaacattgggtgcggggtccggcggtaccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaa

SEQ ID NO: 7947 - DNA, 962 bp, Heterodera glycines
ctgagagggggggggggcgtaaggtgccgatacttttgccaattccttacatttgcttttcgttgggcttctgggacttggccatcgctttcatcatcctgtaggcgtacgcctgcacttccttgttcggctcgttcgcgatggtgtacatcagctggtccaccacgtgcggctccggctgcccgttttcgttcatcagattggcgaacgcggcgatgcgcacgtgtggctgttcacgcgtgttcagaaagactggcagcagtacgctctgcacttcccacggctcggtcacttggagacggcgtgtcgcgtgaatggccatcacgcggaccacgcgtggttcgcgcgggtccttgatgatgttctccagctccttcagtgagttgtccatgcccgcgttgccaagtgcgctcagtgcgactattttgtcgtaaatgcatccgctgttttggtacactgccagcattgcctggaattaacaaataattaattaattacccaacaaatttcattgtgcccacctccttgtacttctgctttttgtccattgggcattggcctttcttggagaagccggactgcgcacagttcgccgtttctccggcacattcttccgcattcttttccgtcttatgttggcacacttcgttgaccaatgcgccgaatgtcagccaacacgactgtttggtggtcggctgactttccaccggttcggagctgcacaactgctccatctcctcgagaatgttgtccgacggtgccggcagctgagtgagtgcgagcagtgccttcacagcgtttgcttgggacacttgctgaaacggggggtgcttttcgcttatttttgtcatggccaattgttcaagtacccactttgctcttgatccgttttgccagttccgccacacagtttttggtgccgcactccgccaacccattgacgaacatctgcttgcactgct

SEQ ID NO: 7948 - DNA, 2155 bp, Heterodera glycines
cgaaatctgcttgcactgctccttctgttgtccctctttccctggacattgcctttccacttggttcagttcctgttgtgtgcacatgcgcaacatttcgacaaggcgttgctgttggacaggcgcctgttggtcgatgcccttcagtttgtcctgcacgttctgcaccagtttgatcagtgcctgctgcgcctgctgcacttttggcacttgcgcaaaaggcgaaccctttccatccgtgccaaagtcgtcgtcaccgttcttcacaaaaaccaattaatttattgactttattcggttgccaacggattctgaccctgtaaaagcgtttctcatccacttccttgctgttggagtacatcagcgtctcttccgtgctcgcactcatcgccgggatttgctggtatgtgtgtttggagtccatcgcatgcaatgtggcggcaacgatcgtttgcatggcggcaccgtagtttcccacggcactcttcgagttacggtacaaatattgggagcgcatctcgcagctgtgcagtgtgtactgcttggtgggctcgccttggatttgacagcgaatgaccgtggaacggtccaactaaacgcgaaaagagttgttcagtttgctttttttgttgtaagctcacctcgtgctctttcacttccttcgggtcgcacttggcacatgggttctgttctccgttttgtgcgttgtccgtttccgagtcgctttgctggagattttggccactctgctgttgagcccaataccttaagttcggctttgttccattcactttttcatttgctttttactgttggcattgtgcacattgcgcctgcggtgggtccgtttggaagccgttcgctacgtccgcgatcttctggcacttcttgaagttgatggtctttgtgacgttgaactgctgtccgctccatgctctgttgatggtgtacgtcgtttgacatgcgccttccaatgtgatctgatcggggcattcattgtgttttgttttgcggttgatcagtttcgaacctcctgaatggtgaatgatttgccctgcttcgtctgccacgactctttctccgccgtgttttgctgtcgttcgtcgtttctgctcaatccctgcgcgttgttgcgcttcaggttcagcttaacacaagggaaggcagttcaaagcgaacaaacagagaatgaatgggtcactcacctggattatattcagcaccgacttcttgaaattcttggtccattcggtttcgtcttcttggcactgcacgcgttcgatgactccgtctgcgctggtgaattggcacggtttgtgcagctgcagctttgtctggcttggtatcggcgtctaaagcatttactgacatgccaaccgaccccacacacttggccaatcacctgctcaaacaattccatcggctgcacctcctgcgcttccgacatttgctcattttgctgtcccgcctgacactcttccaattgcaactgtccgtgtcgctcagaagcgaattgaatcttggccaggcattggatgcgcgtcaccgccttttgctgtgggttcgcagcattttcttctgactgtaaccccgaggcgatctgggcattgtagatgaatgtgtactcggtgttcttctgctggaatggctttatcgctgagttcggactgttgcgggtgccaaaattgaggaagccgactcttggcgaagtgttcgggaaggtgcgtcggccggcactcaaacagagaatggcggcgacgagggccaaaagcgcgaatgtgcgcattttcgatgatcaaagatggacgaggtcggaggtgaagtgtgttcggtgacttgaggtgtttctcttttcaatactccacaggaggggatggaattgtttggaagtgatctcttcggctagccgggcactatttatacggtccgattgcccccaaaggcgtcggacagtcgcccccgggaacgaaatgagagataacgaagcacaaaactccaaagggattgacagccgacccccccccccccctccattgactttgtctccaaattgacagttcctccgtttaactgatagaagagtccattcgttgttcattcactgttttgcctccctccctttccccaaagtggcgcctttgtaatttgaaactgc

SEQ ID NO: 7949 - DNA, 1089 bp, Heterodera glycines
taatttgaaacttgcccatccaaaaaggtttttattttggaaagatttaaagatttacaattttttatatttttttacattttaaatattatttttttattgtaaaaaatgaattatttttaattcactttgccaacaaaaaactaccgacctaaattcaaaaatctaatgatggacaaaaatattcttgttgcttttaatcactgctttaccttttgttttttgcttaccgggattttcctttttttattaagtttattccgttacagtgaagataaaactaattaatggacccttttcaccggaacgaggctaaagttgaggtcgccgttgagccaccaacggcgatagaccaacgggtggacgacataatgcaaacgggcagatttggagacggccgattggtgaagatggaagtggactatagcgctcaagtggacagtcagttgatagtggcagacaatttggccaaggtatttgcaatggccaagcaaattcagtgaggaaacaaagttttttcaggaggggaagactgccgaggcaattgagtccttggaaaagctggaaaaggacagtcgcataaattgcgacatgcgttccaaccagcgcctgttgtgccacatggtcaaattggcatttgacgcgaataattggcaattgctctgcgaaactgcgaagacattgtgcaagaagcgtctgctgatcaagtcgagcatcaagaaaatggtcaagagtcacgcaattctttcatctgaaccgcaatgacaccaaattaaggtccaagaatgctgcgaaatggtgccaaaagcgccagacgcgtcgtccaaatcgacgctcatcgacacactccgcgcagtgactgcgggaaaggttatgaaaaagcaaaacaccacggaaggaaataaggcattttattttcagatttacctagaggtcgaaagagcgcggctgaccaaacaagtggccgaaaagttggaagccgagggaaaattggacgaagcgcgcgaaatgatgatggaactgcaagtggagacgtacggcacgatgcaaagaaaaaaaggtgccattgggcaattcaacgaacaatgg

SEQ ID NO: 7950 - DNA, 2702 bp, Heterodera glycines
aagaaagtttggcattgtttaaaaaaggcaccttttagtttttttattattgagagagttacaattagttgtttttaagttgtggtcataataagtcgtgaaaacttccgctggattttcggggtcgctcttattgccggaagttcaaaattttttaaactttacagaattaaacttttgacattaactcgaaaaactcaaaaataacggcttaagattttgtaaataaaataaatgtaaaatcattgtttggttttgctacagattctcaagtgtgtcgtgttttacttgctgctttcggctcatgacaacgaaaaatgggaacttttgcatcgagtgaatgcgatgagagaattggaacaaatacccaaacacaaagtaaagaaatacctaaatatcaagtcacaaaaaggcaacatcatcacgttttaggaactgctggaactgttcatccaccaggaattgatcttttggagcaaaaccattgagtccgaattcgccccaattttattcgctgctcaaccgccggtcgaagtcatttcggattcgtttctcccgtccacccacgttgtttttcgcacatttagcatttattgttagtttttttaggtgtttccgatgaccaaagaggatggtcaaaagcgcagagaacgccttcatgactgtgtgggggaacatgtgagtgattggaaacccaaaaaacggtggcaccgaagcgttgccattaaaaaaagttgtcgagataaaacccgcctgaaaattatctaatagcctataattcttaaattttcgttttaaattttatcggcgacgttttgtcccggcaacatttcgatggcgaatttgcattttattatctttgaggactccccttagcttttgttagaatgtgcgaatggtggccaaatattactcgcggatcactttccaacgaatggccaaacttctcgaattcggaattgaggtatttattttgcattttgtttatcacaaaaattatcattatccaggaaactgagctgttttctttaaatttgttctaaaatgcaaacaaaattttaagaaatcaattagttgtctaattgtaagtacatctagaaatatttaattgacaataataatgctttaaaaccactttaatcatttttttgataacttgaactaaaacatggtcactcagaataacaaattctgaaatgttatccagaaaattcatcttaacttggatttcttggacaaaaagccaggttgccgaaaaatggactggacctggatccaggaaaaatccagcccaagtcgaactctgtttattatatttcagcaaatggaagcctttgtgtgcaaaatgattgtcgacggagtaatccccgaagtgaaaattcaccgcccttcgcaaattatttatttgagcccgaaaaagaacggcgcagaagtgctggacgaagttagaccattttatttactcattttgaaacattttctgtttagtgggtttttaacgttcgcaaattgaccgacacaatgaacaaagtcagtcagctgatcgcaaaggaggaaatggttcacggattgcaaatttctcagcggatttgaccgatgatatcgatacaaagaatcaattgattgttttattattgttttcccaaaaaaataaacgaattttccgtatttcatttttttaaacttttaattttgttagtttaatattgttagttttttttcttcattattttattttttgttcgtttgggtgatgaaaaacgttgacctcaaagattctcccgatgagtccgcggattcgatttcggtaggaaaaagcgggttttacaattagtcttttacgcgtcccatcattgggacgcgtaaaatgtgatgttttaagaaccaaaagcggaaataatcaaaaatgcattcagtccgagctgctgatcaacgtcatccgcacattgaccacgacggtatcaaatgatcagcgccaattggagaagcagcgaattgagcacggctacaaacagtcggaacaggtgggggaaatttggggattgacggacgatgagcaaacggacggaccatcccaatttagaacattgacaaactgctgaaaggtacgtgagggatttcacggttaatcggataaacgaaaaaataaacagaacaccgatcggatgctctccattgtctgaacactttccaatcggtgtccaaggagttgacgagttgtcgagaacaaatccggaacatcaagagttccctgtccctttgcaagtcttttcttcagtgtcgccgcgacgatttgaacaagtcggtcaaattttggctttattttggtgttgttttttcagattttggctcgaaaatgctcaacagaaaaaggtgtgcgacattctacagcaaatgttggcacttttttgtgtgccgtattttttatcgaattgccaatttcagtcagcaaataaaagaaactgagaaaaacatcgatgtccaattggccagcggagaatacaaagaagtgattcgagtgcttaaggatgccggtgggtctttttgtgataacaaagtaaatttaaaacatatttatgggtaattgcgtatatttttcagatgttttgctgaaaggaccatttgagaaaatggatggcatcagtccactgaaatttgtcgtctccgaaaatctgcagaaagtttttggccaaattgtcacc

SEQ ID NO: 7951 - DNA, 952 bp, Heterodera glycines
atgggcgaggactgttggtcggttgtttgtggatctcgcgacttttctacctgattgaatctctttctttcccttcagttctctcagtgcctatttgcaaacttttgttgcggaggccttcctcgagcagatccgtgtcgacctcgaaaaacagacggagtccgttctgaatgggcccgacatttggtcgtccatgtccgatgttccgcccccatgtccagcgcgtattaagctgttgtgtgcgtgtgtttgaactttgtgagcggatcaacggttacatcgtcagcatggagccgtacgcactgcggtaaatttgtggacggagcggcacttttaatggaaattaattattgtaaaggttcgcctctttttggctgctgatccttgagcatttcatcaaaggattttccgataaatattttcaggtgccaactttggggaaaggggaataaatggacaaatatcttacaataataataaaaattcatccaatttttatccgacctctgttctcattgtgacagattgttatgctgcgccaagttcactcggacggaggttggacggactacccaaaactcagtgccgcttgggtcgttgacgaggacatcagccgtctgctgatgagcttgccgagttggtcggccgtcaaaaagtcgcccttttcacccgaccaagcccaaacaccgttcgctgccgacgtcgtcaatttgagcagcattttgggcgagagtgaacaggaaattcgggagaggacacagcgcgagtccgaaattctgatcggaaatttgggcacccaaaagaaaccgaagagcagcgaattgatcacttcaatggagcacatcaaagtgttatttgggatcaaatgagaatgggagcaagcacctcaaccccctcccctgagaaaagttaaaaacaaatctttttactttttttaaaaaattaccggaga

SEQ ID NO: 7952 - DNA, 2554 bp, Heterodera glycines
ctgtgcttcattgctgtttatttcgtcacaggtcaacagaaaataaaatatgccaaattgttcctcaacccttatttctattttagcttaattttaggtgctttgtcttggtggacaccaaatgtcactaaatacgcatggcgagtcgttaaccgggacagtgtcagtcctgaatggttaaagttacacactttttgcgcaattaaccatcattttcaggttctcttcaatcgtcggtgtcattgtgagttttttgttccttgtaaatgcgttaaatttgattctcattatcagtttatgtttggcggtctttttggcgtcccgatgggctcttcgatttcaaaatgctgggccaacggcttttcatttcattgttttcgcgttccaccaaatccgcgtgccgacccgctttactgcgctgtcgggcttcttattgccgtgcctttcctttgggtcggactctttctgatgcttcattttgcccttcttttatcatgggtattaaaattagaattttttccaaattcgatctttcagatttgtacttttgttgttattctcttccttgcctctaattactcaataacaactgatgtcattttggtcacaccttaatttccgttccctttttaaatccccccattttaagtatgtcactccaccaatccgtcgttcttccgctaacgccatccaaatgctcatttcccatctttttggggtgaaatgtgtgggaattgccccacccttcatgtccatggctttaggatgccggctctccttacatcgttggaatcgtatcaggtcactgaaaaatgcatgtttcctccctaacaataaaaatcacagatggtctcaaagctagccgtggtcccgccgtccaagcggacatcttcgagttttacgcccttcgcgatgcgctgtttctcgtttcccttgtgcttccgattggcgccttcttttatttcatggctgcgctgcaagtcgaaaaggatcgtggcaagcttgagcagttggcggcaacaacacaagaaccgtcacaagaaaacttaagaatttgaaaatttcaacttttgtatttacttttgcattttcatttccaccaacacaaatcaaacataaatagggaaatattcccatgaaaaatttattgcaacaaaaatcggaaaacaattggttgaaagcaataagcgactaggacgatcatatcaatataatgtttcacctaggcctctttctcaaaatcgacgtgcgttagcactttgcttatttgctgtgccaattgcgacgtgctggcgcagagaaccttgcggctcattagatcgaattcagctcctaaaatgaagaccatatatcacttaaaaaaagagtaaaacccgtcgggtcggtgacagtccctcctgcttctttcactattacaactgccgcagccatatccctgaaggggaaaaacgaaaaaattaatattttaaaattatagcaaacacaactaaacgaaccaagaatggatgccgtactccacgtaagcgtcaagcgaaccctgagccaagaacatcttaaatttaaagctaaaggggagccgatgataggatgagtcagaccatgttgatggcagcggaaccaaaagagcgatgcctaaaaatcttttaaattgaagttcgtgaactttaaggtcctcatttataaccgacccgtgcacatttcgttcacccagcaaagtgcggaaattggaaacgaatgaattcatttgggcagacgatcgatcagagccgatctgagaaacgagcaaagcttgctcaaaatctgatgggtggtaaatcgggaataatagagaaacaacgaaagatttggaactattttttattatttattgttagtgtggggaaaattggtttttttgcaacaacgaaatgtacacattaagcgtaagtaatcgcagaccccctaaacatgcacaacttcagtgatcgtgaaattgatgactcaaaaatgaactaacgtacccgtgggtgcccgaaagaactgcggagcgcaaattgccgaatgcattgtccaaccatttttctcccttttctttgatgttatgctgaccaaaagtttgacaaataacagattgatcaagtgctaaacgaaacgatcaatgatgaaaagtggttagaaatgcataacagctgcgctcatataagcaattattgttgaaaccaaaattacctttcgcggatgaaactgaaattggaaagccatttttcaaggcgcctttcccttcaattgcggtgtatagctcatcagtgattggattgaaaacgatcccagcacagagagatttgttgatagcaagaccaacacaaattccgatgaatgggatgctttgggaataaattggtaattccatgtgattattttaattgtaaattaccgatgtacaaaattcgtcgtaccatcaattggatctatttaaacagttaaagtgaatgaattgaatcatcaatgtctaataacacttgccaataatccatgtcggcgcatcagtcaattcgtaaagtattcctgccgcgac

SEQ ID NO: 7953 - DNA, 993 bp, Heterodera glycines
tttttttcttttttttttaaaatttgaataaatttttttggaaatggagcaattttacgtgtgggaagcggcccattccagtgttgtccagtgtagggtcgacaactcgtcgttccatcgttgcttttagtttcgacagtggtgatctcgacagtgaaagtttgtttttaaaaacttgctctatatggtaaagtttcgatcaatttgaaaaattaaaatcataaaggacaggctctattcattgcagcggggtttgccgatttttgaattctactataagaaagagcttgtagatatttgcatcttggcactcaacgccagcatttgttagcatatttatcccacacgattcgagaatcgtatataagattttttaataaaaataatcgtacgcatctttattattaccacatgctcaattctagattttgctatatgctaattgtatattgatcgtaattcatatgtacaataaatcacgtagaaaatcaactacatagtctctgtcgaatccaaccgctgtcgataacagctgctactgttttatctaacttatccttgtataacttattaaaatcgcactaatattttcagatattctctccgggtgctgtacctcgaaatcctttaaatatttgaccgcatcgatagaaataccttttctttccattcgcatattcctatattcgctctctgcgttcttcatctcatttcacgcataaaagcgactagaaccataaagaataggtagatatgatcattgatcagggtacccagatggaattttaggcaatcatgtcgatcattggtcccgaaaattttttctttaaatttttttctgaaaattcttataacacgtttctaggggtgttttgaggcgctgagcacgaatcaggcctccatttcgaaccctaacccgaattcgaacaaagtcgaaaattaaaatttttcgatttttagtctaaaaatagtttaaacgattttgttgtagca

SEQ ID NO: 7954 - DNA, 1361 bp, Heterodera glycines
tctttgaattttcggacgggaccgtccctgggtctctaaactaaagtcttcctcagtttaaaaaatctgtgaccgctcaaaaacttttaaatttattttttggcaaaatgtttgtcattatgggcataattgtttcaaattgctaatggtgctatactttttcgtcagtaagcattttcgtcagtgaacgatttcgtcagtgattttcgtcagcggataatttcgtcagtgaacattttcgtcagtgtactatttttatttattttgctgttttccatttttttcgtcagtgttccaattcgtcagtgaacattttcgtcagtgactatttcaggctcaattttttatatatattactttctttgtatatttttaatagctgagaatttattttattcaaaaatgggcttaagcaccataatatataaaatttgattatttttcaccacaaaaaacttaaatatttaaatgcctatttactttcaaatgaattcgacagtggtaatttcgtcagtgaatttgtgtttttaaaaaatgattaattcaatttaaaagtgcaaatggtaagcacaggcccgaagatattcaagcggatcacggtttccaatgtcctggaaaagagcatttaaattgttgtcttgtctgacatatttcccctttcttgctgcgtgtggcccccttattccatcagcaggcgcaatctgataatcaataattcgctgagaccacatctcatcttcttcaatcattttccggacaaaaccgctgagtcgctgatttcctttaagatgggcattccaaatggcatgccagccttcaaggctgttattcgtgcgtgaaagtccaagtgccaaacggtaaataaccctgtagctcagctgttggattgagggttgacaccacaatgcaaaagtagttataaacgaggccaataggaacaaatgccaatgcttgcaatgacctacggtgaaataaggctactcataaacaaacaaattttacaagcgaatttttcccatttttataacagtgtttttgactatttataatattgtcctagccctgacctaatgcttcgttggaactcaatttcctgacggtattgggtgtgtaggttttggagcctttggatgcggcggtaaattgcctgcccaaagtgaaaaaggcagccatttcggattgcatttggaaaaacaattcgagcagaatgaatggctgccgattcaaagtcactcattagcctttgcggcgaccaattgttgccaatgctgtctctgattgcctcaaagaaacgtacatatgttgccccctccttatttggcaatagcccataaacgcatgggactgaacaatggtcgatg

SEQ ID NO: 7955 - DNA, 994 bp, Heterodera glycines
  misc_feature (13)..(13): n is a, c, g, or t
  misc_feature (26)..(27): n is a, c, g, or t
tttttgaaaattntttttttccaaanngggatgggggagcaaactacagaattaccattttttaattgatttttatagtaaggctcattttgatgtcttttgaataacgtcataacacacataaatacaaaattgacccccccccccccttgtccacctatgaaattaatgcttaaatgaatttgaattacttaatgcgaaggtccctgaagcgaattctgctgggcagcggttggtccggcaatggaaatggcacagtgccgtgtcccgtaattacggtcagttttggcacgtagcgtttgcggatatcgattggtctccaaattgtccattcgggtttgtcatcgaaatggttgtccaccagcgcgttgaaacggggcgaaagcaatgccatttttaagccgagttgggcatggtcaaaaaaaggcagaatgtccatccaaacgtcgctgcacagccaactgaaattgcggaaatttgtggataggtaaaaaaaaatttggtaattttttaaagaaaaatgccaaaccgtcggttcattttgtggcaattagcagtacaatttgcagttttcgaaggatttgtcacaaagaggtgaataaatgtgttcgaaatattcaaaaaaaggaagaatgtccatccaaatgttgaataacacgctgaagaataatttttgattttcttatatgtacattttcatgttcaattgcaaatttgccacaaaattatagccattggatggtattttcagggacccacgcgtttcggcgccagcatgtttttccactataacttttttctttggcatccaaatccaacaatcttggtatcattcgaaagctcttaacatgtataacttttttgctaattgtctaatcacgaagaaataacttaaaaaagcatctaaacatgttaagctttcgaatgatatcaacaatattggatttatatgtcaaaaaaaagttatagtggaaaagcttcgaaacacgagcgc

SEQ ID NO: 7956 - DNA, 4650 bp, Heterodera glycines
ataatatgtatatgattccgtaatttgatccatatttcgtgattttatgttttcgagccttagtgaatgtaatggatagggcccggattcttatgtttttgcttatttttcagtggctttgtttcggtgagatttgaattttcgcccctatcggcattgttgaaaataaataaggatggatctcttgaaaattttttatgattgtggacaaaaaagaaaaaaaattatctttatattgaaccaaaatgaaaaataagacgaattttctgtaaaactttttttttgttgttttgttttttttatttaaaaaaggattctgaacaacaatgacggcgaaaatgcaacaaattctgatcattgtgagcaaacgacaacaacaatgaacgttatgaagactggagaagaacatgacatcaccaatttcaaacttgggaaaactcaaaaggtatgcatttgtctttggtctgaaggtagaaacttggtaaaaaataagaaacattttaatctaataatttttttataatttcctctttgattcatttgcattttagtacctctttgccatgatacccgaccttttccgactttatttttgaagtcagcagaagcaccgatagacaaatggacgcagcgagatcagctcgaaatttcgtgcacaacatgcgagttttggggatcaaacatacaatgatgatgaaaaaattcgtaagctaatgacggctcttagtctccagttcgtgggaaacgcaataaagtaaaggaatatgaaatttggaagaacgaccattctttcccttagaattgttcattccatgttttttttaaatttgttattcgttcaattttataaatgttcattgttttttgcgaaattaatataaatttttttatttatttatcgataaagaaaaaattgccatcagaagggcgggaaccacttactctgatgactgatcacagtaaaatagtcacagagtaagtgaataaatatcaagtgagatcacaggttaaaaataaacaataacaaaaaatttatatgaaaataaaatcgaggtcaaagtcaataaaatgcctcaaaagttaataatttctttatacattggcgctttcagaatcaagagtcaattctaataattttttaaaggtgtttaatgagctagacattaacgttttatcaagggcattccaggccttgactgatctgttaacaaaagatttggaagattttttagattgtaatttaacatttaaccggaaaaatgacttgtttcgagtatttaagttagttcttttaaacagagaatttgggtccaaatgtgtaaaaccatgtaaaattttgtaagtagttaggaggtcaaaaatttttcttcgtttttcaagagtagctaatttaaaaaattggagctgttggtcatagggaatatatggaagacaacattttctgaaagcgattcgagtaaaatatttttgacatttttcaattttgataatatgcgatttaagttgcggattccaagattcaggggaatattccagaagtggacggatataactaacataaatatttttccaaactgaaattttctttgatttaataacacggaaaagtaaacgcatacggtagtaggcgttacgggtaattttgcttatatgttcggaaaaagtaaatttattgtcaataagaatccctaagtcacgaatagtttcaacttcacaaattgcattatcattaattttatattgttccctggggttattctttccgaagtaaatgataaaagttttattaatagaaattttaatataccatttcttagaccaatcagagagaatatttaaagcatggtgcatagcaattctatcattttttgttttatgtacggaatataatttgacatcatccgcatataattttatagaaatttgtttaggaattaattcaggtaaatcattaatatatatcagaaacaaaagaggcccaagaacagaaccctggggaacgccagagctcattttatactcagaagagagagtattatcaacccgaaccctaaaggtacggttcgaaagaaagtcagatatccagtttaagattttacccctaataccgattctatgaaccttatataaaagtaaattatgggggataacatcaaatgctttcctaaaatctatatagacacaatcgatattcttattattataaataccatcataccaattttcaagggttgaaattagttgtgttgtggttgatctgccctttataaatccaaattgatgttcagagaataaattgttctttaaaagaaaatcggaaatagcccaaacaataaatttttccataattttgcataaagaacaagttaaggcaataggcctatagttcatagggttacttttttccccttgtttatgcaaggggataataatcgattgtttccatatagtgggaagttttcctgtatcaagggagagtctgaaaatttcagtaacaaaaggagtaaacgaaagagaacaattttttaacagtctaaaggtaataccgtccggtgatgtgttatttctgttaggtaaagttttaagaactttaccaacagaaataatattaaattcaacgtcgtttattgttggagaagaaaaagaagtatcaaaatcaagagaataattatttacagtaaagttttcagaaaaaatttttgcaaaaatttccgctttagaagttgagtctgaaacaaacaaagtattatactgaataactggtggatcctctactggcttaaagtattttctaagatacgaaaataatctattcttatcaccggatagtattttattttctttacgggattgaatatttcttatttgagtcttaatatgtaaggagatacttttatataaaggttcatattttcctctattttctttcattagcttatatagacgtgctttttccctaattgaagccaataaatgcggtgggtaaaagtttttggcggacttaatagataaaatagtttcaggaatattaatttcaagatttcttcgaacagaactaaagaaaatagcatatttatcctcaactgtataaaatttttgtagtagttgaggaagaaatgaggataaatatgcatcgaatagaaaggtattagatttagtaaaattcctaagaataatttgtttcttggttgcattttgctttaaaacacaaaaatcaaaaagaattgttagatgatctgtatctaaaagtccaccttttacttctaccgcatttattaagtcagtttttgttgaaaggattaaatctaggaaggattgctccctagttggttcattaatgcaggatgtcaaattatatttattaaagaaatcacaaaataaattaccaaaattacttaaagggaaaggttttttattttttatagttaaatctttagttccaaggttaaaatccccaagtatacagcagttttctgaaatgtaaaggtcaagaaatttgaaaagatttttggtattttttaaattagtagatggagggcgataaataagaatcaaattaagtgaattgtacttttgaaactgtaaaactaatatttcacacccaaattttgtttcagaaaactttacaaaaaactgaaagctatgccgcctccacgcttattcaatctgttagcgtaagaaattgtatgattttgaagaaaatttgaatgaaaaggaaattggttttcatttttaccccaggtttctgtaaaacaaataaagtctaaatttaaggattcaaaaattgtttctatttgttcgcatttgttatagatagaccttatattaactaaagcaccttgtatacatttattaaccttatgaggacttttgaaaaatcttgcggtacctgaatttacgtttgtaaaattttttgaaattccattatgggtggtccccgcaagactttatgaatttgatttatggcaaaaacaggcataattaccagggtcatcgcgaaaaacagagacatcgtttcggggaatgacatgtccagcataaacaatgaaattgtgattcggaaattggtcgcgggctgtcttgcaacaattgatcaaattatgccgctccttgagttgttcaggagagagagacggacggacagatacagcttgaaatttggagtttttaagtcggtttttattgcggagaaatgattgtgtcatctttcgggttggcatttccactttgagaagtctgggtcttccttcctttctttggcccatccggtaaaccttggtcggcattgcctcgatttcacaaacgtccagaatgtccaacacctgctgttggtcagcaattgcgcgccgtgtggaggaaaggccactgtccgattcgggaacgcccataagaacgaccgaatgttctctccggtcctcctccagtaccgcgcgagtgtcctgggtcgacgtctcatgaagcatgtccaccgcgagcttgagaagtgcatccagttggcaaatgactgcacgaacgggttcagacacttcagtgctggttagcagtgctgcgatgtccaattgcgctgcgccgtccaaaaattgttgtcgtttcgttggaattgttgagagaggggatgttgtcaagtgtgccgcggtacgttttgctgat

SEQ ID NO: 7957 - DNA, 2329 bp, Heterodera glycines
gtctcactcaaaaaaagtcacagattcgatttctcgagggtcaaatctctgtctcgagtaaattcagaagtctcgaccatcgtggccttcccttcccttccttacgtgtcctatcctttcgttggagcccactctgtcgtagtcggacacaatcacatgcaaatggacccgctgcaatggaaaggggggcactttttcgctgttggcatggcttttcctttttgccaatttctttcgtttttttcgctcacttgcattttttcggggctgacttcgaatgaaaacgattcgttgtaatacgggttcaatgtcttcattttgatggtcgttttcttcttctccaaccgtttgttctgtgccatcaaataaattttgacgtacggatcttttggggacaaaggaaattttgaaaagaatggcaaaaaatcggaaaaagggacggaccggaaaggccgagcacatcctaaagtggtaattagttaattaattgattgaatcatttggaaatgtttgcttttaatgagtcacccgccctccaattttaccatttttttcaagtttttgcactccatcacaaccaccgtcagtttgtttttgtttggcacgtaacgcaatgccaaacaaacatcgccgagccgattttcctgaaatagaatttccacaaatgaatttgatacggtagccaaattattaattaactaattaggtttcaattaaatctccctaatgaatggccgtccctttattgtctttctttcattttccgtttctttatttttaatccgaccggcggtgcttcgattggtgccgtcttttctatggtcgtggccaagtcgattttgccgaggggaatcgaaatttggccgatttggtcatgtttgccgaaccgatctgaggaaaatgcataagcgaattgtttttgtgactttttgctggtcagaccgaagtcgaacacattgagcaccaaagtctgactgtttatttcgttgaagggcacctgaacaaagacaaaaatgccatttaaaactaattaaccaattaattcgttaattaattactttgaattgaaaggactcgttgaacacggggttcagcgacttcctttgcacctttaatttaatatacatacacttttaaatgttgtcttacccttgtttggaacttctttttcttgtcctgaatttgggtaattacggtaaaatataatattttttaaatttattttaccggtaacaaaaacaatttgacgtaagggtcgctggtgccgcccaaatccatcgccggcagactttcggcacttacaatgcccaccgtcagctgaactcgactcaatttccgttaaccatttcattttccaaccaatttccaattccccattttctcctcacattgcttttgtcaaagtcatattccaatttgtagctgagtgtgcccagaaatttcttcttctccttttctggcgctgcttcctcttttcttcgtccattgttcgccagtggcgacgccatactcaaaaaacggtctgaaaatggcacaaaaattgtgctaattgtcctaatttaccgatgctcgcctcaattgatagcattttggggaaggaaaaatggggaaaatttgaaatggaaatgaattttaacggggagaaaatcggcaggacgaagaaagaaagaaaggccttcaaatccacgtgggaaagagagaaaaaaactcaacgaaaggggcgcttagcagtgccaacccaacttataaatatgtatgaacagcgcccggggagggcgcaggtgaagcaacgaaaagtactaattaattgcttaattaattggggggagggcaatgaatgggcgcggcgatttcgcagatttgctttttctttcgttactcaatttggccattcaaatgaatgaagcatcgatcgatcgttctccgtttgccaaatgagtgttttaatggtcgcgtgtgtgtgccgtgtgccgtttcctcctattgcccctgggcatggttcttttgttgtccgcttacaaaataggcctttaattgtcactcccttcggggcacggcacggctcagcttcactaattagggaaagggatggatagggggggggggaagaggagaaggggagagagagagcgaaggcacttcgatttaggggggggggggaaattagattagtgtttaagggtggggtaacgttaaaataggaaggagggggggaggtaatgggttgtgccattcttttatgccattttgacgccccattttgggctgtgccattttggaccgaccgatgccctgtctctctcttaaacgctacctccgctgattaaaa

SEQ ID NO: 7958 - DNA, 3844 bp, Heterodera glycines
agcaatgattgcgctggaattgttcgaggcgtgggccttgccctgtttttttttgttgtcctccgccgatggcaccgctctgagagagagagagagagagagagagagagagagagccattctctcgccgcccccttctctttcactcggagtccacggttaattctcgagggtccctagaagggaatgccgtcgacccgaggcaccaccccctcccctccactcacccacccacccctcccttcccctccctccgcgccatcgaacggatgggaagggggaggcaaaagcggcacaatacccaacaaaaatggacgggataatgaatggcggaagaaagggaagcggagaaaatttgcagcaacaacggaagaagggtggaaggaaaatgaggagaatgaaaaaggaaggggggagaagaggggagggggctgaaaggggagaaggcgggggcgagagagggggagtacattgtgccgggaaaggggttgatgcgggaggggaaagaggagggcacagcaggccgatcggggacggtagggaggaggggaacaaggggggagaggggagcggcgggacaggcggaggggggcggggcgggggattgccgcagcccttaggggggtgggactaatttggcttctttctccatgcattttttgtccataattatattcatttgctccttcgtttttgatggatttaatgccaagtttaccaagtttttttattctcaataatttcttttaaatttgttttttaatttaaatgtttatttatgcccggtttttcctctaaattgcccacttcccttcccccctcccccgcccattaaaataattcttttaagggacccattggcacttttcgttgttcctccaaagtgccgctctctgatgaacagcgtgaaattgtttggcatcgattgaaagcaatggaaggcacaacaaatcctcccccccctctctctcctccccagtgtctctccccactctctctctctctcttcgcctcgggcaccaaaatcggggacgacggggaaaagcggaaaacttgagcctatgcaaataattaaattatttcatgattatttttttattttttatttttttgagaatgtgtacatttatttcaatagtttttggtttcgttttcgatttgtccatttgcaatttctctctctctctctctctttcaattcatttattaatggacaaattgggagggggggggaaacagaggggagacagccgtgcaaaatggacgaacgacctttcaggaacattggcacgctgaaattctccgcccccgggggcatgaaatgcatgggacggcactctccgtcccttctcatcctttggcacccttccgtccgttccatcgtctccccctttttttgcttctccccctccgactcatcagacgcggcaaattgaagcgaaagagcactttcgcctcgggggaattatgagagaaattttcgaactttgcaatgaaagtgaaaatggaatgaacgaaatcggcagcgataaattggcaaaaagagaaaaaagaaaaacgattcttttaaataaataatatttaaataatttcttagccccgccattaatttttttgttcaaatttcttttaattttatgctcggcttctcattggtaaattaatgaattttcgcctccaccgaaagagtgtgggacagacaaaggacaaaagcgaaagcgaaagcaacagctgatctgatcggtgccattcttttcatttcatttcccaaggcgattgttcatccgacagattggaagaagcaaacgaaccaaacaataaatcagtgccgccacctgtggtgggaggggcgggggaatttcacgtcccccggggggggggggggcgaagagtgcccccgggggtccctccctccctttccctccctttctctccctttctctctccctttctctctctctctgtccgccccccgtcgacggttccaccacaaaacaaaaaactcaaacagaaaatgaatgaacgaacaaacggaggaatatgcgaaggaataatcggcggaagagaacggcccattctctcactcattcggctgccattaatccgccgaaactcattttggaagagagacaaaacaaacagcgaattgtttgtttgcttgtttgtttgtctgtttcttctgttgttcatccgtcgccaaaggaaaatgcgccgaaaattatttattttatgcaacaaaaaacaaaacattgtccaattaattacccgcgggggggggacggcacaatctccgccgtccccttcttctctgggattggcatttgccatttgattagcatttgtcgtctcttttcccttaaatttcgcttatcaccttcattccgtttttccgttacatttcttttgtcattcgcttttacttcattttctctgttgaattaaccaattaacacaattaagtgttgcttttggtagttttggcatattattaccgatggattatccccccccccccccgcctcagaatgcccttctccgtccgtcctcgatgaccttggcatttggtcatccatttttctgttcctacgtccaagtccgtcccaaatgtgttgctcatgaataaagtcggaggatttgctgttttgttcattgatcactcgtcagtcctccgtccgtgggaatattacaattttcgtcattttcgtcgtccgttccgcggtgcgccccccccccccccgcccaatcagtcaaatgcgccgttcatccgttcattcgcagtatttaatcatccatcccattccaattccattcattcattcattcgatttgcaacagccaaacaaaagaaaaacagtaaaaagggcgacaaattgaaaataattattaaagaaattggcacaaaaaataattaaaatgaaaaaaaaataaatgaaaaatgaggacaaaaaaaacattggtaaataaacgacgcattgaaaagggagggacaaacagaaacattcactcactttacaatttcgcacagtgaaaaataggaaaattgggggaaaatgaaacgaacggacggacaaaagggaggaaatatttgggggatatttatgagacattttggaatcattttcaatttttctttcactttttttttgcctttccgtcccaattgtttttggcattgccaatgccaaaaacaatcaaaaacaaatgccaatgccaatgccgtcccctccaccgattcctttgccaattattaattttgctcctccaactcccccccccccgacaaatccatcattttctcccaattttcccccaatttctcccaaatttctttcttccgcctttccaattcgattttcccaatttattgtcaatttgacttttcactgtttcttcattcaattgccaattttgtctttcgtctgtccaaatgtttctttctccgttttcttttttcaattttttcttccaaaaccttctgctaaatatggcattaaatttgtacagaataatccttttttgcccaataaatttccatctgaaaaatttggcacatttttctgtcgccgggcgatgaaaagcgtggcattttctgctccggaaatcctttcatcagtctcaaaatgtttttgcacaattatttttaatacctaaaaaccaatttctgaatggaaatcgcaatttttcctccgatttttctccaatttttacatttttttcctttgacctttgaactttagttttcttttttgtttgctaattttatcaaaatacattcgtcttttccgcctctttccttcacattttccccttaaaattcgttttcatttttattttatcaattttt

SEQ ID NO: 7959 - DNA, 4883 bp, Heterodera glycines
  misc_feature (4875)..(4875): n is a, c, g, or t
ctcaacccgtccccattaatttccaaaacccgcggccgacgctagaggatgcaaatgcaaatgatgcctgcctcccctctctccccccccccccccttcgcctcattcattgccccgtccgtctcccctttccatgcttcaccttctcatcatcattagcctttccaatcaaaatgcaaaccttaagaagaaacaacaaaaggggcgccgcgccgaagggaaattgccttgggggccaatgaatgaatgacttgccaattggccaattacacgtcaaaacgcatgcacgaaagccaaacaacagctgagatttgttgattgttttcagcagaactgagaaaacgacggcggtggtcacaaaaaaacagcaaaaggagccgaagtgacgggggcagccaaagggaaaggaacgatgccccagggggaagccctggggcattcattcattgggcaattaatgccaattagtgacctcttctaattttgcatgttgctttttgaatatgtttttatttacatattattctttcaattaaaaaattaatcaccgtataaaatgatgaaatgtatcaattaatcatagacatttctaaaacacaaatacaaactttccaataataaagcagctaattgggaagaaatggcgagtggtgagggaatgcgaacatttcgcttgggtgagtgaatgtgcgagaagagagagggcgactttggaactgccaatggcattttggtgatcagtgccaatgaacactcgctgctgttggtccgtcctcgtcatctttcgtttcgtcgtcgtcctccgccccttcaaattgttttgtccgccgttttattttcgccctggggcgtaaattccgcgttgacaaaagtgaacccttcgaattcgttctgaaggcaggcaaaagaataatcagagaatgagaggcaaaagcgaacattggccactgacctggtccaaattcattaggaacaatcggtcgaccggcgtcaatttgggcgcttcgccagtgaattcggagtcgaaattggaagtgtcgtcggcggatcgctgagagaaaaaagggcaaaataaaacacaaaaaaggaaagcgaacatcgaacagagcgacgaaaagacaacgccaatgccgaaaatgagaaccaaaaaggcacaaattacaaaaaaggatgcttaattaggcaattaagacagcaaaactcattttattaagaattatgacgtataaatttgactttgaatgtacaatgaagggaaatgacagaggggaagagagagaaagatggggaaggagaggagagaagagagcgagagagaaagagagagagagagcgagagagaaagagagagagagagagagagagaaaggggagggattgggaatagcggaaggagaaaaaaaacaaaattggcaaggacacacaaaaagtgaggcaaaagtgaatgaattatagcaagtaaagtgccatcgaaacacaaaattgaggaaaacagtaaaagtctataaaaccgatggaaaaggggggggctaattcattcttggttggcttaacgaaaagaaaccgagactcaatggtcgggagtgatcggaagttgcaagctgatcgcgtcgtcgccgtttcggctgcagtccctctgcagcgtttcctccgcataagctccgctctcggcactcgctgcttcagcgaaatattgcgaattaaaatggtcgaacaaaatgaactcgtcgcctttcatcccctccaaaatgtcccattcgggcggcgtcaatttaagcggaaggcgcagaaaaagcgggtcgaaattttcggtggcgaatttgttagactgaaaatgcggacaaaacgaatgaacgaacggacgaaaaacgggacgaaaagcgaacgaaaaaattgaatcattgggaaaaacgcacaattttaggcttgaacggcggctgcacttggcgagtttcgattttgtgccaatcgatccgacggaaaaagcaatgctcctttgacggaatgccaaacaatcagttcaaaaccgatgtgaattgcttttaagctttgccaactcactttgacttgccgttctccgtccgcgctgcaccccaaccttttggagggcgctttgctcagaaatcctttacaaatcagcaccgattcctttgacatcgatttggggtaagagactgaaaatggccaatcaaatgctcataatgatcaattatctgatcagatcagtcagacttaccattgtgttcggtgatcgctgtgaacaattcgtcctcgtcctccccgtcaaacggcgcttaaagccaaaattatagcgcccgccaatcgaatggaattactaacgttgtccagcgagcatttcgaacagaaggacgccgtaagcccaccaatcgacagattttccgtacggttgatagagaattatctgaaagggtgcagcataatgccattttgatttaaaaaaagtgccaattgcagcgacctccggtgcgatgtaatccggagtgccacagaatgttttggtggtggtgtcgccctgaatgccctccttacacatgccaaagtcggtgattttgatgtgtccgtccctctccaacatcacgttgtccagcttcaagtccctgtagatgatgcccttggaatgcaggtagaacaatccgcaggcgatctcagcagagtaaaacacggcgaccggctccttgaacttgcccacctgctggatctgatacatcagatcacccccgttgacaaattccatcacaaaataaagacgatcctaaaaggaatgggcggggggaatcaaacaatggcacggaggacggaaatgccattggaagaccattgtttggaagcaggaatggagtgccaacaaaaagggaggcttgtcgggcagtgccagcactctcttctccaccattgtgcactccacgtcgtcgtcttggatgatcacgtcctgggaagagagtcaaagattggaaagataaatggaagttttgcgataaaaccttcttgagaattttgatggcgaacagttctttcaagtgcttgtgctccccaagaagtacctaagggaaaagcatagttgacaagggaaatgatcatagtctgatcagaataagatggcaatttgcctgatcaaaacagcggttcgaaagaatatctgatcaggtggcgtcattcctcctgattagttcgaaagaccgcctgatcagatcattttgctctttccatcgcatctcacctttccaaatgatcccttccccagcacagtgatgaaattgaagtcagccgccttcaccacttctttgtgtcgctggactcggttctcgagtgccgtcgcactttgccgttgtttcgtcactgatttggctcgtccctcttcgccaagtgcgcccttccgttgtccgtgcagatcggccattttcttctgcagccgctcaatgtccttctcgtcctcaggcggaatcggaatgttataatattcgcctgaaggaagaaaaattgccaaagtgagcgaagtgacggcggaagagaaaggcaaaggaaacggaccctcctcgtcgttcaaaagcttgaaccatccgttcatcggctctttgatcagttcgctaataccgaatgagagtgagcccatgaagtcgttgcggctcgtccggtcccaatcccacacttccaccgacagtcttcggtccttgtcggacggctccaacttgctgaagggcactgattgacaatcccacggcattaaaccactttaagccatcggctcctcacaattggaaatgttcatcccaaattgggttcagcgtcgcttttatcgtcctcgttttttgcttggcctttccctgctcatcttcgaatgggatcaacttcagcttcacataagggtccgaaagtccgttgggatccatcggaatcaaattccgtgcctgaatttctgaccatattatcagcaaaaaatgtattgtcaacccaacaacacacttctcgaatgtgtatgtgaagaacaccatccttggaatgggaatttcgctttggcattgtgtcctctttcccccgatatcatttcacctgaatgaaagtgccaaggtcgatccgccccctcttctccgtgtgatccatgccgcacatattcggcacgtatttgacacatcgatgatgaactgaaatgcgcctaattgtgcgagcttttttgtgaagggcaatttggcactgaccagaggtgtagcagcattggcacttcatgccctggtgaatgagcccgtaaagcaaagagccgcaatggtcgcaaaaggtgggcgacgaataagtggtggcctgaggggcaaaatgtcaatgagtgagtgggtcatcagcttcaacaaatccaatccgatcacctcccatcggtgctgctgtcgtgggtccttaatttcgaattataataattataaaattagttaagctccttcccactccaaactcacgtcactgtccacccctttgtccgcgccgggacacgcgaaactgacaaactcatggcatcgcttatggacgacctgagaaaaggggaaaaaagggaggggagggataaaaggcatggaaaaagagaggaaaatggacgagacgaacagagaaaatagaaggagtgattaagaaaaatgattattggaaaatccaaaaggaattaattcccttagatttggcgcattaattagttaattgctgctgatttattctttttaaagtgtccgttcgccttttaaccattccccgctgattggcatttgactccgttattaattaattatgcgttttgacccaccaaagtgcacacttggcactgaaagccttgtttgttcagtcccccagatgaaatctttgcaatgagaacaaaanggttggtt

SEQ ID NO: 7960 - DNA, 1274 bp, Heterodera glycines
gttaatgagtatttttaaatttgttatgtctttttcatttgccttttctctttttctcatcgctctctccgtttcttcctctccctccctcatctctatcgttctcttaattttcctttgtttctttcttgtccattttccctttttccccccgtggccacactctttctaatcttccgtccggcctaactctcctttcccgcccccattttcagtaaatttattcgtcccaagttgaattaatcgatttgccgtttcccttacgtccccaaaaattcattccaaatgagtcattcatttggtggaaaaggaataaaacgggagatgaaatcagctaataagagatagatatgataaggaaagaaaaaagcaggagaaaagtgtgtggggggggggccaaaaagaaaaggaaaaaaggggggaagaaagtgtccaaatttaataggaatcagtcacatcagcagcaagtaataataagaaacaaagaatgaatgaattgaatgagtgctaagaattggttatttgagatgagacggcgaattggcggcgggggaaaggggggggacaacgtttgttctttccttcgttcgtttgttcgatcggtcggtcgatcatttgaggcattttcttttcatttaaccttctcattatggcaattgctcattactgatcggtcgtctgctcgttttactcattaaaaaagtcattgaaaaatgacagggaaaaactgccgcagtcactgcactcaacgccggaggcgaggggggggggtgtttttctttcccacccgcccttcccccttccccgggggtctctttgtccattccttaggctatccctccccttcgtcccctttccccccccccccccccatttgtgcctttgttttggaaattcggccaacatttcctcaactgctttccaattgttcgccttacatttcgctcctcctctgatgctcgccgttgcgccgataaacaaccgcctgaaggagttaatgccgaatagtcccatgcatttccgtcggctgcccttctgttgctgtctacgccttctcggcgaatcgccgctcctccgctgcgaccgggcgaacacaatcgaatcgggcttcagcggcgtttccgtggccgcttcgccctcccggcattccagtgccgctccgtcttccgcctccgttccgctttccgttccgccgttcgtcgctgcctttctccgccgcccttccgtcgctttggcatcgttcggttgccctttccgctccttcttcctcttcc

SEQ ID NO: 7961 - DNA, 4200 bp, Heterodera glycines
tttttttcttatacccccccccccccaaaaaaaacattttagaaaggtcttgttcatcacgcgggcctttccgactttattttgaagtcaacagaagcatcgacaaacaagttgacggtgttagatcggctcgaactttgtgcacaaacgctacgttctgcaagacgcagtcattttgtctaacaatgacactgggtttgaggttttactcatagttataccacctgtccttttaaaaattacgaattagaaaataaaataggaaaatttggctcttatgcagtttaacccccataatttttttggaagacatttttttgttctaacaagtcgtgaaaacatatttaaagggctttctgggtggctgatcaagaatttattcaaaaataaaaatagccaaaagaaggaatttttatcatttaacaagaaaacatccccgcccccctcaacgtgtaaagaatgaatggtgcaaagaggtcgcggaaaaagggccataggtcgtcgtcgattccgaagggctcccccgccggcagcccactcaattaaaatgtcccccccccctttttaactgcttcggcagctcttttccgtttttttctcatttctcaataattctccgccgtttttgtcccaatcgaatgcaccacgcgcttcgctgctgctgctgatgtctgcttacgaccgaccacgcatttaggcggcggatttggccaattgtcgtcgtagttttgatgaaataaattaattaaattccgcgtttcattttgcgaaatgcagccaaatttttgaaacctgttctttcacgcagaagaaacattcattttgaaattttttgggttggtttaatttgtaaaatttatatgtgtaatcaaaaggactgagctgaataatcgacacataaaattaaaatgactcaggtattcacaacgagtggccacgtggatgtggtcaacagaattaaggcctacataaatcctccgtcccccgcaccgtccctcacatccatccaacgcccaacacgccattattcgtaatgtctcaaaattggattagcaaaataattttgatggcagcagtcggaaattgaaaataatggcgtttagtattgttgaaatgaaaagcaattcaaatacgctaaaaaatccaaacagagtcaacaagatcatattctatgtggattgtgatgatattaaggcgaataatactccaagaattttgccaaaaccggacctgagaagccgggaccgggaccaaccggcaaactttaaaaattcaaaaaaattcaaattttaatttatttcaagtgaaatattaaataattattatttttttgtttggttttttattaactcaaaagttaacggttaattaaattataatatatttaatcaatattttaaaccaacaaagaaggtgtgaccatctaaactgcctattaccgaaaatctttgtggattttaaggctgatagagcttatgtagagttttataatgatgccaatattctaggattttgtcgacaatgaaaaaatgtctcattccaaaaaactcgagctggcgcctaactccgatactgaaaagacccattccctgaatacttaaccgaatataaattgtaaaggaaatgaaatgaaagaaatcggatttgtataggcaaaaagtggatggttgtaaaccgcgagacgaaaaaaggtttaattgaacaccacacgactgagactgacaaaagcaaaaataggtttgccaagtcctatccgtgcaatagtcaaagcagttaaaaatgaatatacctaaaataatgagtagtatgaaattagtatgcactaaaaatgccaaatatgcactcaaaatacctcagatatgcctaaaacccgaaaaatgcccaaatatggacgaaaatatgcttcaaaaactaccaaaaatggctttgaaccctcaaaaaatacagaaaattatgtaaaattcttaattgactttcaaaacataaaaacaatggctaaagagagttttttagagaattacaaaaattttgggttttttgtgaagcgcttttcttgtaaaaattacaaaaaatgcccgaaatacatatctctaaaaaagcaaaaatggtaaatatgcatttattctcgaaaatccctacaatatgcgtttataagcataaaaaacctccaccaaatcaaaaaaatttaacgtagaaattcccttttttattgcataaatagtaaatgtgtgatgatcaaatggaaaagtaaaccggaaaagtgcttcttttatataatggaggatagagaagaagaaaatcatactcctttttttgctaaattttttgtttcttttttggtcgtcatcattataaaaggaatgcattttctcagtttcgaccattccattcctcattcaacaacaacagataatgttattcttattccctttgccccttattttgcttttgctcgtggccattgttttggtcagccagtgctgcggcggttgtgtgaaaaaggtgtgttcagaaaagaactttcgttttatcaatttaaaaatcccttttccctttttgcagaaaggcggcagcaaaacggacaagccgaccgaacaaggagaaggaccagcacctgaaggcggcagcaaagaacagccaactgacaagggagcaacagcagcaaccggcgacagcaaaacaaagacgaggccagggccaacgccgtgtcaagaaggaggaacgacttccaaaggcgacagcaaaacggacaagccaaaggcccaggaagaaggaacttcaaaaggcggcagcatcaacaccaagaacgcgccaaacgctcaggtagatgaagcaacctgaaaaggcggcagagcatcaataacccaacaaattcccaggtcggcccgacagcatctcgacgtccaaaacaaacatcaggcggcagccaaatggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcagcaccaagaacgcgccgaatgccatggtagatgaagcaacttcaaaaggcggcagagcataaataacccaacaaattcccaggtcacaacgaacgcgccgagtattgccaaaggaggaggaacgacttccaaaggcgacagcaaaacggacaagccaaaggcccaggaagaaggaacttcaaaaggcggcagcatcaacaccaagaacgcgccaaatgctcaggtagatgaagcaacctgaaaaggcggcagagcatcaataacccaacaaattcccaggtcggcccgacagcatctcgacgtccaaaacaaacatcaggcggcagccaaatggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaaatgcggcagagcatcaataacctaacaaattcccaggtctcaacgaacgcgccgagtattgccaaaggaggaggaacgacttccaaaggcgacagcaaaacggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaa

SEQ ID NO: 7962 - DNA, 6866 bp, Heterodera glycines
  misc_feature (6730)..(6730): n is a, c, g, or t
  misc_feature (6762)..(6762): n is a, c, g, or t
  misc_feature (6827)..(6827): n is a, c, g, or t
  misc_feature (6856)..(6856): n is a, c, g, or t
agcaatcgcttagaaaaagcttctaaacatgttaagctttcgaatgatatcaacaatgttggatttggattacatagaaaaaagttatagccaaaaacacgctggcgccgaaacgccagcgccgaaacgccagcgccgaaacgccagcgccgaaacgccagcgccgaaacgccggcgccgaaacgcagtggacccactaaaccgacagccgataaaacaaagtctgaaaaaaaaataaaacaaaaaatctatataattcagcaagaattttggaataatgatatagcttgaaggaaaatgtgattgctaatcagtgatcgcagatcactaaaatattcccaacaaattgatcaatcggtccattgcaggccaagcacgcgctgtaaaaaggagtagaaatcaacgagttcatcaatctgaaacaatgatgaaaagcggaattttcattgaaattaaattggatcggcaaatgttagttttaccaattttgcggtcggtgtgccgacaatctcgtgcccctggtccacccgtatctttgccaacacgggattccgttgccaactctcagcttgagtgcgcaataaatggtacagttgtgccgtatatttgagtgtatgtgccggcacaactcggtcctgaatcatttttattgttcggcactctgtcattgaattcgttgtgcattggcccttggggaggggggcgggggaatttgcttggactaatcggggattgatctcattggcactcgcaaagggaatttgttgttcattttggcacaccttttttgatttgtccccaatttagcggtattttttgtaaaaaaaaagtgccaaaaagcccacgtcatgatcggcagccgtcaaaagagttgccggccactgctgcccgggagtgatgctaagctgctgaagcggtgaatatctaaactcattgtcactaaatccctaatgattattgcttttttacttataaaggtacgaaaagtctgtggcattttccgggtcgccgaattccgactcccacgtggcgccaacggtgaatttgttgaagcggagcatgtccaacacgctgaaagcatttcaaaccatttttgatccgcctttggtcgacccacccgtattgagtgatcacagctccgaagagatcgggccgctgctgactgcagacggcggtcaacaaaccgccgttggagtagccagaaatggccagccttaaaaggcgttggttgttaattgaatggcttggactgattcaatgagaaaggattcaatgtaaaggggatggagtgatcagttgctgatcgtagcgaatacagtaaatggccaagaaatgacagtacagtacttcgagctgttggtgtactgtttgttgatgagatactcggcagccgcaatgaaatcgtcgaacacattttgctttttctcccgcattccctgttcatgccatttctcaccgtattcactgtcggtcaataaaacatttttcaatttgattttttcatttaggcatgaaaatgccactaaaatttcccaccctccgccccgaatgtttgcggttgccacaacgcctccaaaatgttgcatgaacatggcgtcagcggaggaaaagaagggcagcatggagtcgccgaagccgccgtaaccggtgagcagcacgggattatcgccggtcagcttcatgtccttgcgatgggcaatgaacattggcacctgatcggatttggaaccattcaaacagttggtacaatactcgcccaattaaatacttaattaattaattgattgttcctttaccattgttccatctttgctggcatagaaaacctgaaacttggcaattgaccaattcatggaccaattatcagaaactgcttgctcttgctgctggctgacctgttcttcgacgaaggcgtcggtgtccaacaccggcactttcgcctgccgaaacacttccaactgaacgggttggtccccaaattgggcaaattccgcgtggaaaatggtgaacggagaaatggacgactcagttttgaagaacacatgggaggagaatttggaagcaaaaaagttgttgttggagctaatagttgagtccattataactgagccgaatggcaacgtaatttggtaaagcatttggccactgttcaggttgtgaacgaagagagcgtcctgttagaggaaaaccgtatttcataaaataaatcccccataacttagaacccccccccccctccatgaaatccccccccccctttagaggaagccccacttaggttagaaaaccgatatttaaagtagaaaatgaattacaaagcaaagacaaaaatccatggaaatcattgtttaatgaacacggcttagagtgattgcctgatcaatcaaacagatttgataatgtcttcagaggaacagcgaataatcgatctgatcaagtgatcgaacccgtattatcggaatgatggaccggttttgggcatttaattcaatttgattcattaattacttaataatggtcccctggtcattagcaccttcacattgtccatgtagcaaaccaacagtttgtctttgttcacggggtaagcaaatcgcattcttcgctttgggtcctcctttatgacctcttgcggcttctgtgtcgtgctgccctcgagattcactctgatcaatttgtacattggcgcatctttgttggtgaaaatcagtgccgagtgttcgtctgagtccaccatctgtccatttgtatgtcaaattaattaagtgattaattaattcaaaaattgaattgaccattgtgctgttttgtgttttaattgattctaaaaaagtgattggtattttatttaccataatttcatttacaatatacaccatcacagctatactgtatgtatgtacttggaacaacttttgctcacttcataatccgcgtcaaattggtcaaacagcggcttcatcttcagtggaccggtgattcggttgttgtcagccggcagatcgcagtaaaacatttggtcgttcgcattacccccaaaagacacaaacaaaaagcgaccatccgatgacacttggccatagctaaaaaaagaattaaaatgaattaaaaataattaaaatcacatcagcaaatccgactgattgcgtccttgcaccttaacgtcatcggatggaatcaactgacaaattaaaattgtcggccgttcttaccaccaaaatgtccttctccgagtcggtgcccattttgtggaagaaaagcgaatggaaattgaattcctccgtctccaattgttttaaatatttctgaaagaggccattttaaaatttaaatcttttttaacaatttattaaattgtaccgtgccattaccgaataaaacagtcccgtgccgtcgctgagccatgaaagtcccgaaaatctgacgtcagcaatttgatcgggcagctcatcaccattgctttgtttaaactaaaaatctgtgaatgaacccaaaaatgcttcgtttggcccaccttcacagtagccgcatcgctgcccttttctgagataccgtatgcgaacactgtgccgtccttcgagaagctttccatggtcactgccgtcgtgccgtccttggaaagcgtgttcgggtccagaaacactttgcctggctcgtccatggaattggactgataaagcacactttggccttaaaagagaaagaaaacattttccacttttagggcactaaattccttcaaaaatcacaaaaggcatttcaaatataaagagaattgattaacagtttccgttttccctactctgtaagccgctgttacggtaataatagaacaaatcgccatggaagcttggcttgaagaattctgcgtaattccacatgttggtgaggctgaattgagaagaattgaaagaaaaacgagaagggcatcgcatctttatattttaatttttagaatttttaagccatcatttaaggcaaattcaaatggcaaaaaaaaaaaaattttaattcgaattatttaaaacgaaacgaacgtttgattcattttttgccgcaatggactggcctcgaggaaaggctgcgaaatttggttgagttggctgacaaattgccgtgtcacatttgcgtccgggttctccagggcgcggtaagggtcggggacctgaaaaatgagaaaagcagaaaggaaataaaataattaagaaaaaaatgaaaatttaaaatataaaatgaaaaatttaaaaaatttatatattaaattaatgtataaagatcacttcaatgccatggtaattatccgccacatttcgccgcggtgcctgcggatattcccgcggatcaatcgccgtccccgcctttgtcccattcgcttcttcagctgctgctgctgaatttgtgctcaattttcgtttggagtgctcggagaacggagcaaatggtgccattattgctgaaacagcacaattaaaacggattttactaatttgccattcttcggagataaaatgtttctgctcactttttcccatttgcgccatttttgccacattggcactgcgatggccaaatgggaaggcattggcattggcatgcaattcattgaacgcaattgggcgcacattctccccaattgttggcacaacttgacattttttggtggaattataaaacatttttattttaaacacaaagaattttatttgtttcctttttagcatctcttttttcatttattcacatttttgttggttttgattcgcattttccgtgccggtgccttcgtgccaatttccgtcccttggcgatgccaaccgtgcgcctaatgccgggctaagggcgctttgctaaattttaaatctgagaaattctatgatgaccaaaaagcaacaatagacggaccaaggcaaatcccgcagttgccgtaagggcaatggctttgccaagtttggccacaaaaccccatgccgtcctttccgtcctttgtttgtcttggcacttcggccgcaccattcgctgggaccaaataatgaattaattaactattaaatgctttttcgcacaaacagaacaccaaccgtttttgtcattttttgtgtttgttggggttgaacatttgactaaaaaggcaataaaaaagagacataaaatagaaaaattcatttttataattaataatgaatgatattttattttctgacatttataatgatgaagcagaaacagccgaaaattaaattgccgtgtttttacatgacactttggcatcgttggcaaaaaaaaaagataaaaattgtaaaaatgcaattgatttttattattcattcaaattttacgtagattaaatgagaaatttttaaattaaatttcccccattaaattaaattaaataagtttatttgcatgtatattttggcattttccaaaacattctctattaaagcgactcaatcaactcaattaaaccttttttacctttttctgtggttattttcaatatttttcacttcattcttcttctcacattccaatttgtttatcatttaaatttattgcgtaatttttaattatttttgtccctttcatttgattatgcaattttctcaaaaatgaccgaaattggcgtgcaattagcaattgttggcgagtccgtccgtccgtcgctttttcctttcacaatttgcaattcgcattcattcgtccgtcattagtccgccgtttttgcgctttagtccaccgaggggatggacgagcaaagaaagggagggcgaccgaccgactgattcggtgagaggagtcggtgagtgagtgcttcaccgagggtcgagtggccggcttcacctcccccccccctactcgcccaatgtctcccgccttcccttaatttatgtaaaacaaaatccggtccttcccaaccgtcgatcccaaccaaagtcatcagctgctggctgcaccagtcgccggccgacgcccaacattttcatcatcctccaacagcagagggggcaaacgaaaaagcatcgaacgaaagcacaaagacggagggcggggggacaaattgagcaaaatgagggggggggggcacaaaagagggcggcggaatcgtttgatcctctcacagcctcgggcgacaaaagccaatcctgaaaagccactccgtctcaccaaaatgaccacaaaagccacacaaaatgttgttgttttgttgtgttattgttgtggaccggggcggaggagagactgacggacggacggaggtgggcgatggaagcggagcagaagcagcagcatttgttgtggaacctgtcactgttcgatgagtgggagggtccctcccccgccccctttttttgttgctttttctccccgccattggctaaggaatgttgcgtgcttactgctgctttgcttcatcttctgccgccggttgcttcttgcgactcattttttgtgtgtctgtaatttatgcacagacagcggcgtatatttgaggggggggggcggacggacggcgcccgaggggcgtggcgggggatggacgatgggtcggctgcctaatgaatgaatgggtgactcatgccgaacacttatgaccatttatatacaggggattctgtctgattgcttatcagacatttgttggattaacagatgagaaacttacttacgatggcttttcgctctttgttaatttattttgcattggctttgatgcttttcgtccattgcncatttttgttatgggacaaggggatttacaantatattacattttaaaaattattataaataaattttccaaatttatttttcctttaatccgacanaatttttaaatatttatctcttagtaacnatcacatttt

SEQ ID NO: 7963 - DNA, 1678 bp, Heterodera glycines
ttcattgtcaggcctttctgctttgacttgtaacatcctttcggttggaacactttgattcgcgcgccgccagcaatttgtgtgtcgttcatcgaccgaattgcgtcacgacaatccttaaaaattttgttcgcaattgaattgttaaatgcgtccatttgtgagttgcccacctgcgaagatgcaaatgtgagaagaaatgttgagacggtgtcgctcggcttcaccgtacacttctcggccccgtctttgttcaaattaaagcgctcgaacagcgcaacaacttcgttcagctgagtgaccaaagggaagccacgcgcaacgacggaaacccggtactgaaaaggaacgaaaattgaaatggaaaaaagggaaactaattcacccaccatttcccggatgattatcatattctgacggattgcgtcggccatctccgcccgtttcagctgcgtgatggcaatttgatgtccgttgagaatgttcatgttccgtattgccgcttttgtggccattgcttcgtttggcttaaaatttacaatacttaatttagtttttataaaaaaatgtccgaaatcggcaaccaaaaaaccgcctaagaaaattaatcattttaagagaaaaattttgccaaatgggagaaaatgcttaccaaattaatgtaaaggacgccgttttgcatccgcgcaatgttttcatatggcgcatcgaattggacaccgagaaattcggcgagttgttccgcgtaaaccattttgggaacattttccaaacggatgctaaatgaaataaacaaataaataatgtaattgtccttttttatttcatgtctcaccatgagttcgaatttgggtcctctcggtaccgttccaagaaggacaaatggggacgcaattccaattcgtggggagtaaattctttgtttggtgccgaatcgaaagcacgtctgtccatatttgagagtttgacttggtgcaatgacaaaggttcgttgtccggctccaacaaatcaagcggtggttgttccgggattccattctgatgaccggacgcaaaagccgtctttaacattgggtcggtttttgctgaatcggtgtgaagacgggcctaaaaagcgaaaaaattggcatattcatcaaataaaaattggattttggctcagactcggccttttgtccgcataactgacaaacaaaaaatcacaaacagttcggacaaatcgctaccaaaaagtgtcatcatagccaatttttttttaattttcaaataaatataaataaaataatggttttcaaattaatcaaaaccaacatcattgtcactttcggcttcgtccattgaatagtcctcttgaatcactaaacccggagctgttgacccaacggaggtatcaatcgacccaaccgaagcattgaatggaacattgctcgttttggcagcagtcgacggtcggacttgggcggagttggcaaaagacgaagcagtgactagaaaatggggtattattatagtaatagtgaaaaagcaaatgtttaaaaaagggcatttcaaaaagtcatcgaaaaacgaacgctgctgtcgattggttccgagtggcaatgcattgttgaccggtcttggccaaaacccattgttcgacgagcccggtctgatcagtgaagggatatggctgaccatc

SEQ ID NO: 7964 - DNA, 5352 bp, Heterodera glycines
caaaaagcaacacttataggactcaatttacttcatttgctttagtgaccatttgcgccgcagaagcacccccgggcctcggccgatagttcgccttaacgaagcaatttccactgctttaattatgattttttttgttgcaaatttgcccatacattattggcgtgattctccggaaatgaaaacgctccaaaaacagctgcatttgaaaccaaattcagtgggcccatcggattggccgagtccgctgccggcggttgctgctgttgggctgggcgttgtctctgctgttgttccttggcttgtttgtctctgtcagtctcttcctctttcttctcatcactcggcttcgtccgctcctcctttgcccaaactgtcgttgttgctgctgccgttgatgatgatgttgatgaggtagcagcccccttctccgatcggctttggtcgtttgaccgtcctcgtccgtttcgcccccgcggggatctgctccgattggtccctctgtcgcgctccctctcccttggcctgtctctgtccgccctctcccctcgtccgcgctctcttctgctgttgggatcgtctgaagaccttttgtctcccctgtccttatcgtccggctccatgaccgcgtattgctcgtccgctttccgtgccgttattcgttccgtcctagaaattttaagtggatatactcgtggggaagaaatttaaagtgtgcaaaaaggtctgaaaagccaaaaagcttcactgttttttcactcaccgaattgttcggttattaatctcgccatggtatctgatcactgatctggcgtccctctcgttgtcaaattcaacaatccaacggtcggaataatttcgatcaggctgatagacgcgggtaactttcacacattcagcattcgtggttgataaatacctttaaattttttgcagtaaataatgtagcatgtatataatgcacttactgtttcacgtcgaaaaaggtggctttgtatggcacatttgacaattgaacacaaacgcgttccttcaccaaaggctccgattgaaaagcggcagaatttggagaaaattgcgcggatggcttgaattcattcccatgagctgatggtccctgataaaaacgctttcttgggtccatcggacccgatggtgacctgaaattttgtattttgtaaactgcaaaagtcaattaaaaaaagcaattacctgctccgttttcgttttggtccattaatccctccttcaaaacgttgctgataatgagtttgtcggggttgaaagtgctgttgttgctgataatgagctccgcccatcggtttcgactcagaataggcgttaggaaatcctccaactccatgcgttggtccaccaaattgctgttgaacggctcctccgtgtgcgccacctcttcgtccaaatggcggtcgagacggacgatattgtcctgcaattggcccctgatttggcatgccaaactgagcttgatgatgagaaggagctgcaaaggaattatgatgaagcaaatatcggcctttcatttccccaccttgtcctgttggtctattttgttgctggttataaacttgaattggctgattaggagtctgaaaacgttggttgtgatagcctgccgcaggttgctggttgaaaaacccatcaccggcataagatggattcgaaggacgtggctaaaatttgaaaaagtcacaggctaaacggcgaaaagtcccaattcttgtgatttttttaaaactttttaaggtaataaacattacatacctaattctctttggtcaacgaataaaaaataaggatcggttcaatggggagtcagctgagcgaattgtctaacaatgagaatatctaccattttttatacatttccagtatttttcaataaacggcgcccggtactcagttagtaattcagtcggtctttatgccaaattatcatttaaatttcaaaaaaaaattttgtgagaaaaataatgtcttcagctgtattcaaaacatgacaatattattatcttcctgctgcttttctgtatcatgtaaaaacaaaaattgaattttgatcaaaaaaggacctgcgattgttgggcaacaccagccgcttgcaaaggctgtgaagggacgttaagaggaggaggaaatcccggaggctgttgcggtatgtttggcaattgctgttgtgttttgcttggtgaaccgagtaaacggcccaacgacgacggagggactccgccaaaagacggctgagtggagccgggaaagaccgggacgggtgccgactgagaaacgggcggagcagcctgctcatggaacagcaattgcgagtgcgacccctgccctgaagcagctaattgttgagatggcacgttttgtggcagttgaagttgaggattcttccacgagtcaccgccaaacaattgttgatacaacggggcaatggtttgttgtggagcaaaagccgtggaaatggaaggcgaagaagatacagcaggaagcgcaactgaagacaaataatgtgaaaatgtaaaaaagaacgaactcctacataactgaattgaacagaaatattcaattttctattgtttttgtaatttttgtctgttacaattttgattttgtcgttcgacaacttaaatggctgtcatgtgatcggtgaatacgaaaacgctgatcatatgttcagtggaatcagtaactacgtaaaatcatttaacattttttgtggaacattaattaaccatatgtaagccattcgcttttggctattataccacaattgacaaaaattctgtcatgctcaaataagcatgccgtttggcgcgtagcttacaaataaggcataaagcgaaggacagaaaagaacaaatgggagatgtctggtacttaattatatattaaggcatgtcaaaatttatgcgttaacaaacattaaaatttacatacatttaagacaatgttcaaggtggggaaaggtgtgcattgaaagtaaattaactccgatgctttggatggagtagcatttgaatttgactaataatgtcgtttaaatttaaaaagcgtattacgcttaaggacacgatgtgccaaatgataggtggccggctgattgtacaatacattttttggaataacattgtgttttgttctccctccccctgtttttgattaagaaattgtgaaaacgtgtttccgtggcttatccgtgtcgttgaccacgaaactgacacagtaattgatgttttatttgttaaatctcgcatcagaaatctaccccgaaaagccccagaaatgttttcatcttttaaatgagagttgtatatcaactgggagggggggggggggggggcgacaaaccagcaattattggtacagtatttactttttctatttagaaaaatcttaggtacttaaattcaacaatgtattgatttaaaaatccaagggtaaagttcgtaccataggaaaggagtgtcaaaataatattaattcgtcagtaaaaatggcgagtaaggagaaggagcgcttcacttatggagacgcagacatgagacattttgattgaatgtcaaaaattcgtatcgggaattgagtcagaaggttcgaatattcaaaatcttttaacaagttttatgtctacaaaaacggcgagtgcgagcgattttaattctaattgtgggtacgcaaaaaggcagattaattttcaacactttatgagatgttgcctattttttttctccgagattagatccaaatgacaaaaagagggtgtggttggcagttcaatgaatacctcgcggtgcacggcgagagagggttttccttatttctgacaatttcgaaattcttcattcccaacccccacgcccaaagaccgaaaatgaccttcactttgaaatttccattgtgctccatccttggccgattggtctgctagtttcgctgacttatcatctgcggtgaatttcactccggccgtttgttgctgccccaaatgttgaacagcgccacttggtgcactttgctgttttgcagcaccggcgagagcttgtgcatcggcaatcacttgttccatttctctcctcgaagaaagcatcagccgaatttttgattggtgcagtaaacgtccgtccagcagcatagccagcctagcgtcttcgtcagtctgaaatcctatgaaggcatcgccattcgaacccccgacaatgttgactgatcccttagggattttcaaatccccaaagaagtctctgatatcatgagcttttgcactaaggggcaaattttgtaaacgtattattattgcggacattaattatccttttcaatacttgagaaatgagctaaaatgaataacgaattataaaattggaagtattaatgcttttttgttttaaagtttttgcgaagttcatggtgattgaaattgcgcagatagaagatgggactcaagttgatttaatacatatttttaaaacaatcaaaaaattgttggagactgcaaattcaaaaatgccgcacaataataatcagcctgtcatcaggcaacaagacagttacaagggattggatttgattattcttttactttgggtgttggaaggtggaattggatgatttaaatgcaaattcaatgcaacggggaaataaggaatttttcaccatttatttcaaaggaagttttaagtttgtgcgttcatcgttcccaatttgatagaaattcaaatgaagttgtagactcgctaaacattcctctgttgccagaaaatcaaacttccctgctttttgaaagcacaaaattacagaataaaggaaggtaaaaaaagagggaatgaataaaaactttaatttgctatgaaggaagtagaaacaattcagacacaaataaatcagagaaatggcgaagaaagaaacaaacgcaaggcaaaaggccgccattattcagcaaattgattagaaaaaagctgccagacacaaatattcagaggcatattttaacgaatggaagtcagacacaagcaattaaacatttcgccatttaaaatattaaaaatttaaatttgagaagaaggttaaaggtttacttccgtaatttttcttcctttttttctacttttctttgcttttatttatccactgaaggatggtcaattccacaaacaaaacctgcacaaattctcttcttcttaaattattgtcggcactttcttatgcgctcagttcaatcgctgttatgtttatcaataaaattcttcttacaaattacaggtctttttgattttaattctttttttatagaaaatttgtttgttttttgggttccccatcttttcttta

SEQ ID NO: 7965 - DNA, 1426 bp, Heterodera glycines
tccccactcttttacctcctttccctcttacttctcccactttcccctcatttttcggtaatcactttacaaattacttttgcaagagtctctccccgcgtcgatttatgtgagcccaaatcagagtccaatgttttattagccaataccacgcattgatctcacaaaccctttgataattccaccgttttttgagtttttcaaatctaaaattgaggtcgaggacaatttggcgacgaacatccgcaatagaagatgaaatgagaagtcaattttaaattggataatgacacaattcgtggtcacttagttaattatgtcatccattagttaattgtccaaagtgattcccttttcctcaatcatttcgtattcattttgtgttcgctatgatcagtgccgtgccgagtttgattcagtcttggcacattcagtctcgagtcagtctcgtccataaccaatgcttcttcaaatgcttcttcctattctttgtcgtcacttcgttgtgccttaattttacctcgaatttctaaacggctgattgcctttttgtctttcttcgcatttcaaaaggagcaaagacttccaattacaaattggaggaaaggcgaagtggcggtgggtgacgcggttattttggagagagaggccgaggaaatgagcaaaaaatgcaacccaaaaagtaatcccattaaattcaattagtgccttaaatgaccaaataaaagacaaaaaaaaacattaccgagaaaagcaaagggccgaaaatcagagaaattcccttcaaaaaaaatattggaggagaaaaaaggaatgttttcctttcggatgactccgaattttcggctttttctgatccatttggcttttcctttttgctttttccttccccccccccctccgctctctccgttctgtcgagtaacccctcaaccgcgcgccttcgtcccttcccctcttatcctccgatatccctctcaatggttgcttcatcccccgccttcctccgtctcctcccgcgttccacttcaccaattctcacacccacacacattgctccccgtgggctatcatctccctcctccctccctcttcgattcgtcctcacttccctccctcatttccttcttcacttctttcctcacttccctcatccgcttctcatccgccagacccccccccccccccctacgtgagaaaggatattcgaacgagagacactaatgagagggacaatttgcgaaagacatctttttaaattcacaccgaattgtcccaatcgctgcccacgctcagtgccagagcgaaacaagggaccgaacacatcccggcattgcaacagctgcacagcgaaaccgacgtacgagttgggtatgaggctaaagatggaagcttgggaacggcagatcagaaagaaagagggggg

SEQ ID NO: 7966 - DNA, 2147 bp, Heterodera glycines
ccccccccccccaacaattgatcatattctttcctctcattgaaaaggcactaaggaacaaaagccgcgcaacaacaaacaaaaacaacaacaacaacaacaaaaaataattgaatttaaaaataacttcaaaaggcacaaagggcattcagagaacaggaagaaagagaaagagtggcaagtgaagaggagcagacagtcagagaaagggcagagagcaaaggcaaaaaacaactgaccgatcagagaaaggaatgcttacatttgctgaacaaattagaaaaaagtgagtggacatcccaattgaaaaagcattctttgttttcccaaatcgtggcctttgtttttttaatgtttccaattcgtcccctaaattactaattaccccctctccctcctaattacccccccccccttttacagtttcctctcccattttccgtccttctcccaccattggagaatgacaaatgtttcggttctgtctttggcggtgttcgcctttgctttgctcaacagttcgtttttgccaactccctattaaagctgatttcccttcagtttgctacgcccaattggcccctccgacgacgcgaaactttcgctgcttttccaacggctgctgtgaccaacacggtgagttgggtttggtcatttggagtacgaagttggcattcgttttcttggcatgacataatgccattataagaatcgaagcatttgatgagtttcccccccccccctcccctcagaatggtgccgtttctgggcatccatcggcgaatgcctatcgaacgcagattggatggcaataaactgtcagttggcttgttcaacttgctcccgcgcgaattccgcgtccgcccctccgacgcgtcctccgccgcctcccgcgccggctgcgactcgtccattcatcacagaagtaatcacaacggcgacaatggcaagcgtaacggcgagaacatcggcagagaggaaaaatacagtaaggaggaaaagaacgaaaatacggtaaccagaaatggtggaagatacggtagcgaatagaaagaaaaatatgggtataaaagtcaaacaaacttaaaatgtgaatctgtttgctttggctttccattgttcgcctttggcagggtccaatcgcgggttcctgcgaagagatttcacgcaatccgtccaccgctgccactcaactggccaagtcggggctgctgaatccgatcgaagagtcgcgccagagtctgtccctggacgacatcacccgcgcggtcagctcgggctgtgtccccgaggtttgtgccgtggcacgtcccccgccccccgtcgctattttgccaatcttcgtccgttgttcagtcgtcccccggggactgttcgcgttcgctgtgttaccatctctccttccgaacaatggatggaatgtgcaacaacctcaacaaaccgttgatgggggcttcttttcgcccttatttgaggtgagattggagaaaagaacaaaaaaataaggcagaaaaagaaacgaaaatggacaaatttgattaaaatattaaagagatgagagagagagaagaagaagaagcttccccgagaggaagattaatggacctattgaaacgacaatgatcatatatgcttgagcaaatcgggaattgaatgttggtagtttagctggcagaacactgtctggaaagccagaaaaagtcggcttaaagccgctccaccccatagtttttcccttaaagacttcccatgatcgctcttatattcacggcttttggttggaatgggaaaagcttttcgccattctcttctttttccgttgccattctctttctctttagacatttgccggccgaatattccaatggcttctctgagccgtccggtcggttctccgttcggccttgcccccatatttctccaatgttcatttggcaggtgtgggcaaaccgaacgcgcgcgaggcgtcccgtctgattttggcgagtgcgcaagtcgtctcccacgaccaactgaactcgctgctgatgcagtggggacagttcatctcccacgacatggccagaacggtcagtgactgtcctccttcttcccctcctctctctgatcactttttccgtcgcttcccccactgaatgatcgctttt

SEQ ID NO: 7967 - DNA, 1583 bp, Heterodera glycines
tttttaggtttaaattccgcgacggtcgcaccggcttcctgaagctgtcccgcttcaacaatatgctggtgctgccgttcgacgactcgcgttgtgccagtctcagcacgtgcaccgcgtccttcgtggccggcgacatccgtgccaatttggtccttaattatgccaattacccatcggcgactgtttaaactcttcccccaaatttcagttcctcggtctttcttcaatgcatattgtttttgcacgggaacacaacaggtcactcccataatcacattaattcatttccctattaatggcatttactcgcccatttctcccattgaatccttcccaaacagcgtgtttcctctctctctctcgctctctctctctctctcgccctctctctcgctctctctctctatctcgctctctctctctctgggatttattcccccttccctcccgaattttttctctcccctcccccgtaatttgaaaagatctccgtaattacgggttaggattttcataattggaatccttgatgtccagccgtgccccttctttcctcttctctcccgttcatttttgttcgtttccctcacagaatcgcccgttctctccagtcaatgaatcccggatggagtggcgaccgtctctttcaagagtcgcgcaaaattgtcggggccgagattcaggccattctctacaaggagttcttgccccgcgtgctcggctccaccttcgaccgactgatcggtccttacaacgcttacgacgccaacgcggacccttcggtggccaacgaattcaccacagctgcgtatcgctttggacatggaatgattttggtaggacactgttgatccagagcatgagtcctctaattaggagcaatacgctcgactggccgagaatgggccaatccctgcgggccctttcccatttggcgaaggtaagccgcgacacggcacagccattccaattcgggcactcacaaggtgtgttcaagtcgcagaagctgctctttgagggcggcattgatcccgtgctgcgcggcctgtggagcactgcggtgaaggtgcaaagggaggggaaatggaaaggagtcgttgctaattaatgatcactaatggattggcataattaaaagggataaaaagggacaaaacggactcacacctcacttccaaatgctgaagcacctcctctgtgccattcggagtttacttttgtttgtgccttttaagaggccccatcggatgactcccgccatcaccgaaagactcttctcaacgttcgcttttccttcccttttccgctttcatttgccattattctctcttccaattagcactgatctcggctcattgaatataatgcgcgggagagaccacggcgttccttcgtacaacaaaatgagacgtttctgtgggctgagttccgccacttccttcgacgctctctccgatcacatctccgacccttcggtccgcgccattctttcctcaaattacgcttctccaggtcagcccctgaaaaacggaggtgctttgttgcagctttttgtgctttgttcagaatgacgacctgca

SEQ ID NO: 7968 - DNA, 2261 bp, Heterodera glycines
attgtcggcgaagtgcgacgacgcaaattgtccaaatgttcagcatttgaaatggtcaaatgaccaatgtttggcgcaaaaatgggccaaatttcacgaacaaaaacatcccaaatcggctgctcatccatggtgtatgataatggaatccacaaatgtaaattggtgcctcttttgtcgaaaatttggtgatttgaacgaagaaaagcgatgacggagtgatcgatgtaactgagaaaatggaaggaatgcttttattgtcatagctctgctttttaagtactcaatctgaatagaatcaaagcgaattttgctgggcaacggacggtccggcaatggaaattccacaaatttgtcaccaatttgtacataaagtttcggttctggtcctttgtccttgcgacgaatttcgattgatctccaaattgtcaattcgcttttgccattgaaatgcttgtccaccaacgcattgaaacgtggcgaaagaagtgccaatttgaggccgagttgggcatggtcaaaactgggcaaaatgtccatccaaacgtcgttgcaaatccaactgaaataatgaaagtaaattagggcaaataagaatttttgacttttgaaattcttttaccgtcggttcattttttggtaattagcataatttggccgagttccgaatgaggtcaaacaaatagcagaataattaattaattgcgttggataaaacctggtttttagggttttcctatttttttacggattgtatttgatgaagaagcaccaaaatcacatttaacgaattttttccaaaaaatggaaaatttttgacagaaaattattcataacttcacccaaaatgaaaccaaattttaaaatattgatatcattcaataggcccaactgttttctattagcctataaagtttcaaaaagttccgttaagtttcaaaaaagttataacttgagaagctcaaaaaaccaagttttttacaacatttttggtcgtaactttcttgaaacttaacgaaacctttttgaaggcacgatgacatttcgcctactaagccaagatcggagtttcgcctactaagccaaaatctgacatttcgcctactagacatctcgcctactgacacttcacctactggacatttcgtctactaagccaaaggcttcacatccatggaaaacaaagagtgattaagaagctaatggagatgcgtcactttctgtgttctttgaaaaatttatttgctttttttggctaaatttcattagcattataaatatagcgaattatatgtcaaattagaatatatatttggtgaaatttgctgtcgaaagagctaggtattttaggttagcaggcgagatattcaataggcgaaatgtacagtaggcaaaatgtcagattttaggtgagtaggcggaacgtccgattttggctgagtaggcgaaatgtcagtaggcgaagtgtcagtaggcgagatcgtccagtaggcgaaacgtacgcacaccctttttgaaattttgcatgctaatagaaaacaactagagctattgaatgatataaagaattaaaaatttggttgattttaagtaaagatattgaaaaaaattgctacaattgatggttttttgaccaacatcatagcaccgaccgaagaaacggcgagcagaaaaagggaatggcacagtgaattggaatggaacgcaacagaggagaggaggaccactaaagagaatatttttcaaaattatgaccatttgccgggcgttttaccttatccccccacccacaaatcaatcaatcaaataatcaattggacggatagagagagggaaaggatgaaaatagcattggggaaggaggagagacggaagagaaagagaggaaaaggaaaaattcgaagcaagaagagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggaggagaaagagagagagagagaaaaaggaaaaattcgaagcaagaaggaggaggagaaagaggaggaaaaggatgaaaatagcattggggaaggaggagagacggaagagaaagagaggaaaaggaaaaattcgaagcaaggagggggagaaagaagaggaaaaggatgaaaatagcattggggaaggaggagagacggaagagaaagagagga

SEQ ID NO: 7969 - DNA, 3197 bp, Heterodera glycines
agggattcactttcgcaatttgcctcgccggccaagcgcgcggtgcgcacccattttgggggtattcagcttttcctttcgaaatttgccgaattcggttactgtcttttcattgatttgttccatattaggacatagatccatgcctacgtttttccgtttcttactttcaatgctttttttaactgcaggataggcttcctcctctattatctccgcatttccgctccgatttattcggatgatgacggggattgagagaacttttgacgccttatatgtgccattctctccatatttatttgctgcttgctttttgcccgcggagtccccttgcctccctcgtgtcattgagtctcttcgactattctcatcgatcttaaccaattggtttcaatccattcatttggtcggttgcccgctgcgattggtgacgattttgatgggccaaattcaacaatttctgctggccaagcattgtccaaatggttgcactctccgagaaaagatggccaacccaagcaattgcattgcgaagatcacaacgaacaaacgaacactgattggatcaacaatttcaaggaggtgtggtccggggggggggacaaaacgtagccgcaaaattttattttaattaaaaaaattatttaaaatttagttatctagcctaaatcaaaaaaaaatagataaattcgaaaaaaattattaagaaaattcaaggaaatgtaaaaaagtcgtttttttatttttggaaattcagaaaattagtttttatacgagacggcgacgttttaggggtgtacccggtctgtggatggcattctgagttattttctgaaacccgaccccaaaaaagttataaatcgaaaatttctgaaaaattccgaattttatcaaaaatttcggaaatccgaattctgtgccatccctgctggtgtggctccacatttttggcaaatgactgatttttgttttccaaattgtttagcattttcttcgtgccaatgccatttcttccgtcagttacgaaattcatttttctgttcgtgcgccgtcaatgccaatggtgccatatacaaaaatagttataataaaaagaaataaaaaagtacataaaattattattatgattattaaaaaattttaagctaaaataatataattttttttgactatatggcataaggaaaaaaattgaaaaaccccgaacgatttggtcaaccccgaaccccgacttttccaaccccgacggtcggggtcgcaaccctagttcacatcattggtcccataattttcgactttttgttcaggtccggtgtttggagttggtcaaaatggatgccagattcatgatcagcgacaccgaaaagcccctaacaaatttttcatgactttcgaaaaccaaaaatcttcaaaaaggtggcactagccctactattaccggcatttgattttgtacatatacaaatttgaattttgcgcttaattaaggtcattgtctccgccaccggaagaagtggaagaagaagcgggacaaagcatcacaaaaggatgttctgacaaatgagtgacggacaaacgaacaaaaacaatgattcagcagcagacgaaatgaattaattgagaatgaacggccgatcataatttatcagtagggttataaattatatggactaaaaaacgcaaaatatggactaaaaagctcaaaaatggccatatatggaccaaaatatggattataaactgccaaaatatatcttttaaagcctaaaaaattcagtaaaatgtatttatattcaatatttgctaaaacagactcaaaaataagcgaaaaactgcacaaaaatggatttaacatttaaaaaattccaattttattaaattctagcttcacaattgcaagtcaaatactttcaaaatttttgtaataatctcattctgtttgcagcgaaaattttcggaagtgtggacaaaatagctaaaaaaatttcaaaatttcgaaaaaattctctttttaggggtgtattttttatttccaaaacatagatctttagtggtgtatttttcgctttttttgcatttttcttgtgaaaatttgctaaaaacggccaaaatatggactaaaaatgcaaaaatcgcgaaatatggatttattcccgaaaacccccaaaatatggatttatatggactaaaaactttcttcaaatcaaaaaattttaacgtagaaatgctatttttgagcccctttcttcatagcatatgcgcagaaaaaatatgcaaaagcatataatttataaccctaatgattattcatactacatttagttattttcgagatttttatgcttcaatttaacaaatttgaagaatttgtgaaaattttgcccccaatttggaaaaatttatgtgcatatttttcactttttatgcgcatagtttaagattttatgtgcatttaattaccagccctagtaatatcatgattcattttcagatttttatttaaaattttcttattttaaaaacaaagttgtgtcaaaatgtttccatcccttccatttttggcaataatttttcgtctcccattggcacattgtctaacccatcggtccattttcgtgccttttttcaatttttgatgcctattatatgtaaatagtccttttttcgcgattttttggtgcctttttagtcgtgtctacaaataacttattgaattaataatcaattcgaccagttcacgggaagcggttaaattctgaaaatggggggtgtcctgattttaatgacaagcactgtactgttattggaactataaattgcgtatgaaaaacttcacaccctgaatttttcgtgttaattgatacataccagggatggcattccgaggccctaaaaattttcaaaaatcggaattccgaccccaaaaatgtcggaattccgtgccatccctggtacatacccatgggatgcatcgagacgagagagaaaatttatattttaacggaaaacaacacaaatcagagagtaaaaacgagcataaaaaatggtcagatcactcttattcatcaccataaatccaaatgatcgaacatttctcaaatgcattaaatcaccttcaaaaatgtggcacccatttgcgacgggggacaaaggcctaaaaattgtggaaccgcccccctcgtcgcgggcaactc

SEQ ID NO: 7970 - DNA, 2809 bp, Heterodera glycines
  misc_feature (2749)..(2749): n is a, c, g, or t
  misc_feature (2769)..(2771): n is a, c, g, or t
atgcctaagtttataatgactaaataacaagaaataattatttacacccttcctcagtggccggtggcgtagtgggtttcgcctctaccgcaccttttttctgtcctaggttcaaatccccgttatgtaaatattttttcccatttatttttgcactttatgcaaattatttggccgaggaaaattgattcccgtccaataacattttcattcattttttcaaatgtacgttaaccccaaaaatattctttttctactccaaaaatattttgaaaaatataatgaagaaaccccattaaatggttctgaaattgctattgccaaaaattttgcttctgaaattgaacgatgcctcaaaaacaatgaagaattggactttatggaagaattggtgtttgatcaaaatgccgaatacgttaaaattgaagggcaattgagcgattccgattttgattataattccgaagaggaaattgatcaaattaatagttctttcggatcaggtccattgataaatatcttatttaaaaactcaaaattttaaattcagaaaattcaagcggatcaagtttttttacgtctcctgttaaaaaagtgcctcgagatgattttgcatctttttcggacaagaaaaaggcccttcaattttatcgttcggctgataaggggcatcgttcattatcatgtatgaagtcgacttataaggccaaaaatatatatgcagtggcgaacaccagtcatattatgaccaaacaactgatggttgaatgggtggacaaagttctttgtcctgctcttcgcccaaaccaaaaatcgcttttgatcgttgacagttggactgggtggaacaattttcatccaaaaaatggaattgaattggctgttaaacaaatcccaaagcatggaactggaatttgccagccattggatgtctatgtttttcggtatttaaagggtcaattttcaaatacaaaaaaatttagaatttggaaagaatttaccagaaaaattacgcagtttgtttttgtttatgacataaatatcaatctccacgaccgcgacaacattataaaattacagtcattaatacacaatcagctccaagcaaaaaaatttaacaattggcttaattttgcatggcgcaaatcagggttttatggtgatgagcctttcccagaattcattcacccagtaaaatattgttttgaagtgcccaaacacaatgacgaatgccaaaaattaaattgtgacaataacattttgctccgttgtgctttttgtgaaatttttttatgctttaaacatttttttaatgattatcatttatgtgaaaacgaataaatttaaaaataatctaaatgggaatcaattttcctcggccaaataatttgcataaagtgcaaaaataaatgggaaaaaatatttgcataacggggatttgaacctaggacagaaaaaaggtgcggcagaggcgtaacccactacgccaccggccactgtgtaagggtgtaaataattatttcttttatttaatcattaaaaactttggcattttttatctcggcacaggggtccatttggcagaaattgaaagcatttttcttaagaacccaggggtgctctatctacccaaaaaatctcattccgagatcccacggacacttggccacctccctttgttagcaattttttgtataaattttgttaataaattgcactgaaaatttcaattatttccgggcggcgcctatcggcacgccggaccttaaaaatacttaatcttcttgaaaattttgcttaattcgcaaaacttggtcatttttttttgacaaaatctgttaacataacaaatcgcattaaaattacaaaattttgccctgccagccgcgcctatcggcaccgccggacggacgcctctccctcccatgttctccaaaagaatttctgaaaaaagcgtgctgcaaaaaaatggcgtaatagtccttttcccaaaaatgttctaaaacaatgtaaagtgacatgaaaaattgaataattctttcaagcaaatatagaaatatatcaaaaacattttgaaatcaccttttacttggctaagaattgacctcggaattcagatttccgaaaatttttggggcctcggaatgccatccctggtgtgctgcgccaaaaaataataaaaattcaatttgagcctttttggccctaactctgagaaatcgcgaaaagcaaaaaatgtctatttgcattgcttgatccttttcacaaaccgcaaaaaatttaaattattatgaaactgccaaacagccatcctccaaaattcgataaaataagtgatgttcaaaaagccttgttttaaatttagaggatttgctaattggccaataaattatcacttgttaggcttaactgatttttaaaggtttaaatggattggctttccatttgaataaaaaaatttatttgcataatttatgtcatttaaaaatttgcatgaaacgaacaaaaagcaaaaaaaaaaaaatcaaaaaaatagataaatatttaaatgaagcataaaagaatataaaaacaggttataatcaacattgaaaggcattataaattcaacgcaattcctctaaaagaataaaaatataatgtaataaataattccaaaattttacatttttggcaattcatcgcgcctcacaatttgcgaatttaattgcacattgaaaaaattgaaatccgaattgaaatcccttancattgacacattgaaatgtnnncgtcatttttcattgattttgttccatataattaactc

SEQ ID NO: 7971 - DNA, 3320 bp, Heterodera glycines
  misc_feature (26)..(26): n is a, c, g, or t
  misc_feature (29)..(29): n is a, c, g, or t
cccgaccggtctctaataaaaacctntanccagagagaaggggaggggcagggaagttagtgcaaattgctgtggggcaatgacaatatccattcatttcttccggtgtttttttttgcataaatttatatcatatgtggtttattcaagttaaaccgatttgtaacactttcttgaaataaaaagcgctttatttgtgtccatcgagaaaaaagccaactagcaaaaacaacgtcggaataaaatgacaaggtgtaagcaagttattaaatttgatcaattattgcatcggaagttctcatatacggatgatgagagcatcggtggaggaatttcatgagtttagagggaatgaataaggactttggttttagagtcatcacaaaaaaaactatggctgtacgaatggtcgaggaattataacaaaactatgataagtatagagagagggagaggatttaatgggaaaaacacgaatagaacagctaagaaacgacttgatcgctgccataagtctgctctattgaaaactcgagtttgttagccttgcttatgcgcataatgaatttggtttgtaaaattcattttgaagttgaacctccgaaaaaattactttccaaactcgaatcttaccaaaacacagtattaaagagaacgaaaaatctacaagaacttatcggtcatatacacaaaataaaattagattaggtatttgggaaataaaatgagatatttgggaaatttaattatttgggtttgaagagttcggccaattgagagaattggttgccaatgttgtgatagaaggcggattgttgtgctgttaaggaaagagcaaatatcgtaaaaatatataaacccatctaatgtgattcacagaaaaaagagccgaatgcgatggcgaggtccaagtccctctcttcctgttggtgcgtcattcagcaagcctatcgaagtgattcaaatcataagaaggccaatttaattattcacatggcataggcgcacacgtccacccggcccacgaatagcataacgtcgccatcagagattttgccttccttttgcagccgtttattttcgtgcatttttgtgaggacagactgagagaataagaaatattttgcacaatgccaaaagatcattcagtcactttgaaaatgttcacagtgtccggaatggacgcgtacacgcctttgctgacgtagagaaactccaaccaactgctccaagtcctttttgccatggtcttcgtgttgagagccaatccgatgcaaattgttcgcactgacttttatggccgattttaccggattattcgctaaagtgtcggaattgcagtgaaaagtgtcgtcggccttgccatttcgctgtgattggtccatgtcgagcgattgccccaccaattcgaaggactgcgccaatttctgccaattgcttttgtgtgcttaacaatacatatttgtaaatttaaatgaatgctcaaatgctcttttacgtccgattagccgtttctgcgcctcagtgattcgttcgtacaaaattttgcaactttcttccaaacttcgcgaacttcgggcgaagttctcaatttgttgttcgctaaaaacccgtattttttgaatttcgtgtgggtctttcgtacaaatcttgcaaattcagctgctcagtcggtgctgtgatgcaattgaaaaagttacctccaacatattcgtctttttcagccaatcgtttgcctttcttccattggttctcaaaactatcagattagttttaaaaagtcaacttcgaaatgcctcatctgtgcagctaataaaatgacgccatactcccgactgaaaatgagtttaattaggtgattccaacaataagttttcaatttgttgccccacttgactcaacacggggtgccgacagattttgttgacccaaagttggaggaccgaacgacggtgttggatcaagtcgtcctcgtaaaggccttccaataatatatttttattacagttggcctggttctaagccacctgccacttgtttctctggcaatggtgggattggaattggcaaatatttggctgacaattgctcatggagccaatcgaaatgtttgtagcgacgagcgacttggatgccggtcaaagagcaggtgagactgtacgcgatgaaactctgacgaaaaaagggcggagggaatagggaaagaaaggcacaccttcagccccttcagcttggattccttttttggcttcgtaaccatgcaagtgtagccataatcgtcggcacatttccatttcctttcagcaccaacctaaatgaagggtaataaattattcagggcacactcacaaaggaacattccgagctgtgaaggtcctcttgtcagttcacaacaacatttatttattaatgaagaacccaccaaaattatttcatggctttcccccggttgtccactgaatttcgtagtggcgagaatgtacgattccatgccacttttcacgaaattggagaatctaaagcaaaacattgaaaaaggagcattggggatcaggaaaagatcagaaaatgctgaactgttaattcaaatgggtttgaattgaattgctgtaattcgatccattgagtcgccccccccccccccggagccaacggtgactctcgacctgttgatgtttttcatcttggccgctccaacagaggccgcttgcttctggctcgacattgaagcgacttcgggccccgtggagcgactgcgagtgacagcaccggccgatttttggacggagtcaaaggaacgtgcgctggtgaactcctgaaaaacccaaagtcaacgaaatggaaaaaaagagaaaagaccaaccaccaacacaagctaaaaattaatgaaagggaaagccgaagaattacagcaacaaaaatggaggacaaatggacaagcaaaggacgacgacttcactcttcgaagttcgaaccttttccgcgtcactttttgaggatgcaatttgctcagtcactgcttccaattggctttgcgcatcgaacgaagtttgcttcttcagttcaaccacagttttctcatccaattcggaattcgcaatttcttcaccttcttcagacactcctttcagtggctgacgaccgtttgaagcctccgatgaattcaattaattaacaatgcccaatttggttttccaatactctccccatgatagaataattaaacaaatgagaaaaaattacagtcacttcctcgtcttcttcggaccaatcggtcgtcgaagtcgtcgtcaatttgttgcgctcccctcaccgtcttt

SEQ ID NO: 7972 - DNA, 1248 bp, Heterodera glycines
atacattggcgcggaaggattggttgggagggcaccctttgtaaggcggcggagccatcggaggaggcacggaattctgaagcaaattgaatttgggattaattgtgccataagattcggcctaggattggctttggcctaaccaacagagcaggactaagggtagccaatgcaacggatttggccatatttgtcacagttgttttggaatgggaacgtgaaaggcgcctctgtgtggctgcgcgtctcaacgatgaagcagacggcttggatcaaaggaaaaagttttcagggacggaatgagtcgacaagagaacagtgaacgggacaaaaataccaaccccaacaacacaaatacttccccgcggggttgtcacgagagatttaacggccgcagtttgacccccgaatgggacgagtagcgcagtttgtgccgccagttttgttgggtccaacacggagcaagtgtgacgacggacaagaagcgaacgacgccgagaatggacatccgaaagtcgcgaatctccatcgccgaacgccgtattattactattattagaatggttggaacatttttccaggccccgacgtaacgaagaagtgaaaagcatcgattgtttcttatattttcagaaagaaatttgcattttgttagcaaaataaattacctatatgaaaataatatgtttttaagatagaaaatgcaatttttctttaaaaaaagacatggaaatggtcgcaatttgctgaacaagagaagggacgaaatccaataaacttccgtttcctaccaaattggaaaagcggaaaacaagccaagtaaatggaagaatgtcaagagaaggagacaaaactggggacacgcaaagaaattaattgcgtatcagcagaattgatgaatgaatgtagggagggaaggaagaaaatgaaaaggatgaaaaagaagcaaaaacactgaaacagaaaaaaaattggagtggaatttaagcgcatttaaagtaaaattaggaaagtgttttcaaaaaatgtttatacaaaatttgtagggaaaaaataaacaaaacctttatgaaagttttgttcttatgacttttatattttgatttttatactgaaaaatctcaaaattctactttacaagtcttttgtggaaattttatatttttgtgtgctgcgcaaattcggtctcaaatttaccttttaataagctttatgaaaataaaatatactcgatataaacacactccc

SEQ ID NO: 7973 - DNA, 1841 bp, Heterodera glycines
  misc_feature (1829)..(1829): n is a, c, g, or t
ttcatggatatctcttgaaagggataaatccccttcccctttaatcactttactgctaaaaactgccaaaatagttagtttttaggttctaaaaaactcaaaaataggtgctaaaatggggaaagaggtgccaaatagtttcaaatttagagggatgtaaatcgtaaattttatccaaaaagtaacaaaattaagctaaattaatatattaattagaaaataattttatttgaattcttatgaaaatgtgaaatcgttgtcaaaaaatgcgaccaataatgaaattgatcttcagtaggattaaaaataaataaacaattatttggtaaatttaaaaaagaaaggcaaccatattttatttttcgaattttaccagcataaaatttttttttattaaaaaaccaaaaataatgaagcgaacaaaaaaaaaattaaaaatttattccgaggcgcaaaaattaaattctgtgaaattttgatgaaatcaattgcttaccaatatttaattatttatttatcaaatatttatttgtttctattaaagatcagtctcaccgattggtcgtattttttgccaacgctttctccactttcattagaattttttatttttcaaacatacagagtttgaaatccttattttttttaaattggatcaaaattgcaaaattaattttaatcgattcttaaacaataaaccaacccaacatcagcagaggtgtcacgattttcatcggatctgctatagaaacagtaaaaataactcttcaacaaaaaaaatttgaaaatatgcctttttctgccatatttcaaataacaacaacacaaaaaaaacataattatggatttataaatactaaaaattttaattctttacaaaaattttctccataatttataaaaaaaaattcccaaagtgccttttgtttcatcgaaagagaaaaaaattaagggaaaaaaacgatttcctatgagacaaattgaaaagctaacaaaaacaaaatttatttaagaaaatgccattgatgctgcatatagtagtgccaattcttccgctgactccgttttgagggccccacaaatttttgctattccaaggaaaacaacatcgtcatttcataaaaatggtaatcttgagggttgtaatttgctttatttagcccattgatttccggccacaaaagaagagagagagaggaaaggagaagatagaataaaaaaaggataaaactacgagagagagagaggagagaagagaggaaacgataaaataaaagagaagagaagagagaaaagatagagagagattgaagagaggagagattagaggagagagagtgaggagggagagagaaaaggtgaggagaggagagatgtgaggaaacgacagagagagagagagagagagtgaggagagaatagaggaatggttaaagtgagagagcggagaggagagaataaaagaatggttaaagtgagagagcaagagagagaaagagaggtgagagacagagaaacgagaggaaagaagagagagtgaggagagagccattaggcctagaaaaaagagctctttcgaatggtaccttcaaatcaagtgccaaaaattaattgaaaatattaatttgtattccggttattcttccgtcaaaaatgacgccaccttagctacttggaggccattaaatattttatgcataaaatccttcaaaaaaacacataaaaactattcactgtgcccatacctcagcgggtataagtcgtagagtagaccattttgtactctttctaatgggcccacttaaaatttcctagaaaaattttcccanaccccactagga

SEQ ID NO: 7974 - DNA, 1814 bp, Heterodera glycines
tctctctctctctttatcctgtcctcttcacattaactctcttgctctttatcctttcttctattctctcctttcctctatctctcgctctcctttactttcttctctcctcttctctctctctctcccttctttcctcacttttctcctcagtctctctccctaccttctctctctctctctctctctctctattgctctctcactttacatttcttttaattcctcactctcgcctctcctcactctctcttctttccggaatttaccattaaaattggcaaaagtaaatttaatttgaatttttaattttatttattttattattataggtggaattcgattttccaatgaagaaaagatgaacaaaatgaatatttattctaaaatgaagaatgaaaaaccgtctttaagttacaaataaattgctcaatttttgagagtctcattagccaacagatggaaaaaagaataaattcgtaaattttcttaatttttcaaattcgtctcaaatctgtgatttaatgatgttgttctttctgttgttgtcattttttattatttttttttcaaccattatttttaaatgcccaattatttggctgaggtttcagttaagcgtatttttgaaattccaaaatcattaagattatttctcaattctgattcgatggctttgtgaattatttttggttagcgcaatgccttttcatatttcgaaatgccattcaaaaatatttttaaatttttgtaatttttacatagtgatggtagtagagttgatcaatatgaaattctgtttaatatagtaaaaattttttaaaaaatgagtaaaaattaattattctttaataagtatttttcgtttttattgcatttttgtttctaattttgggcaaaatgccaaaaaggtgcttatttttgtataaaaccatttgaaacaatagaacaaattgctcattatttgctataaatttttttttgataaatattttatttgtatataatttgtcattttgtattcatatcccttacaaattttggcattttcatcataaaaatggattatatatatattatttaataaaaaaaattttggcatcactgatttttcgatgaaaatgtaatcattataattgtgaaatcatgaaatttttttgtattttaaataattatttccgtgaatgacgaaataaaagcgaaaggcatggacaaatatatcaatgaaaattcaggtccacggaaaaaccaaggtgccgaaaatgcgtgctgtcgcgttttataaatccgccacttaacaattcgcgttttataaatccgccagttgcattttataaattcgccaatgtagtaattattttttacttatttttaaattatttttctttaaaccctcgttttcttgactactaaaggtgttttcagtgctttgactttttgcactttttttgtttatgatatcagcgagaacttgtccgttcgtaatttctttttctctaaaataacgatctagattgcttaaatgacaatttacatctttgattttttggtcctttcgagttgaaattcctttatcatctaattgtaatataacagataagacagacggtttaaatatgtttctgtcgtttgtgaaaaatcattttcggaaatttcacccttatcgaccatttccttaaatgattttttaaattttattaatatcatttagaacaaaattgttaatattttaatatcaatctcttcataggttttatcccttggtctgggatttttgagccagctaagagattaaacattctttcatcattctc

SEQ ID NO: 7975 - DNA, 2124 bp, Heterodera glycines
  misc_feature (2026)..(2026): n is a, c, g, or t
ccactttttctgtttttgtttttgtgcacatcttcgatccttatctcgaccaatttccatgccttctcaaataccgagtttgcatatttgcattagctcttatcttttttgctacatattaacataaatgaacatgagggtcattcattcgttgcaatctcaccaaaaatggccctggttcgattcgacgaagccaaatctaaccgaggaaaaattctgctttctcgccttggtttcgagtattccttcgaaaacttttcccgtcttgaggaaggctgggagtattggaaatgcccacggcgtccgccatactgcccgggtcgcgcgtctgtccaaattccatggcttgtcgatgaaaatggaagtcgttataagatgggccgcataactgccgaacacaaccatggcgcaatctttggacaacttgctgtgagccaatttggcactcttataggaagggttgctagaactattattttaggagatttcaaaaattaatttgtatgtgttgccttgaaaatttattttaaccctgggtcccctggtttggtcctgatgtaccctacataatttcgttctactttgtgaagataagacaagcaaacaagcaaactcgggaagaggcccaacgcgactttcccacgacgagtcgcaatattgtgcgcaatgttcgggcgaatctttcggttgatgctcgtgtgaacgcaccaagtccagtcaatatgcgcaataactacaatatagcaaaacggagacaccaagaagagctcacggaaaattaaaatgattgatagggagggaaatgcaccaaaataaagtgaaaaataatataggtcggagatgttggccttgatgttttgcctgttgaaaacatcgtactgcctgatgctcttctaaaccgcgtcatttgcaatgaaatttttaacggccatcgaatgattgttttctgttctgcatctgctctcgaaattcttcgacaatacaacaccgaatgtgccattgatggtacattcgaagtaaatatacgggggattttggggtcactgatcacgaatatgacatccgtttttctgcaaaatgggggcagacaaagttttacccaaaattgttaggcaaagaatccttggtactattttaaattggcccgcttaagtcatgcccgcgtggatttgcacagttatacacaatgagcgctatcatcgaccattgctcagttccatgcgtatatggtttactgccgaataaggaaggggcaacatacgtgcgtttttttgaagcaatcagagacagtgttggaaacaattgggcaccgcaacgtctaatgagtgacttcgaatcagcagccatcaattctacgcgaattgtttttgccaactcaacccaaagtggctgcctttttcattttggccaagcaatttattgccgaattcaacgacttccaaatcttcacactcaatacctccaaaatgttgagcttcaacgaaacatccgatcacttcaagctttggcatttgtacctgtcgaccttgtttataactacttttgcatcttggtgtcgacgctccatccaactgctgagctacagggttgggttctttgcaaaattctaaaaacatcgccctcccccaatttttcattgatttttaccgcttagaattgattctttacttcctcatgacatggattggaccacgtcatgtcattgagaatgaagagccgcttgttgactaagacaacggaaatatgggcgcggctgcggacggctggatccgcgacagaattgaagcaatgaacttggcacagcgagatgcactttttcccattcaattgtggaatataactgagcgtttggcacttgggttttcacgcatcaacaacagcgtcgagggatggcatggaatttggaatactcttttaaaaggaaatcaacgtttgagcaatttagtgcgcaaaatgatcgaggaagacgaaatgtggtctcagcgaattgtggactttcaagtcgcaccagctgatggaataaggngggcgcatgcagcaagaaaatggaaaatatgtaggcagggaaacattttgatgcactccttcaggatatcgaagaatcgtggtgacccacttgattac

SEQ ID NO: 7976 - DNA, 4069 bp, Heterodera glycines
  misc_feature (3715)..(3715): n is a, c, g, or t
aaattgggggctgtcgacggtggtcaaagcgagcgtaaagttccgacaaagggacggaacccttcggggagaggggataaaactttggcattttgagtgccatggaattgggatggttttaatacaccagagtctcgacaagttttcgctcaagagcacacgcaccaccagtacagtaaaagttacttaccgtatcattggggtccattttccggaacacttcctccaccaattctctccgttgtgctttcagagggggcttaaataaatttataaaaaaccgaaccgatcatggcacttttagcggcacggaaaaggccaccccgcccccgggggtcgtcgcccccggccacaaaattcaccgtaaattcctccaccattttggtaaccgacagaacaccagcagcagctgaagaagtgccaagacgaacggacaaacggtcgaaaatttctttcgcttcactttcggagagggaaagagaagggaatgagcgaagggtttggacaaattgggcacaatccatcgtcgtgacatttttggaaaggaaatgacttaaattttgaaaaaatattaattaggtaattaaaattgggaatttaccggacaagctttttcccagtggcaattccaaccgccaaacatttgagctgaagacgcaccaacggatcttcacagcgatcctggcaattatttattttttatttgcaaaattttattttttttataaatttatttaatatttttaaaataattaattttattaaataatatcttattttccacttttcttttttgatttgctttttctcaccgcttcttttgccgctttttggcgcaacatttcttcgcttaatatttccgcggacggcacaatgttcaaaatggataattctttaaaattttcaataatatgcatagttccggctatttttccattgtttttattttgtttcggcttacgtgaaacgggctgaaaacaggcggaagagttgacgagggcattgccggagggcattttgacggtttaaacaatttatttgcaattcaaatataattaattgatagcctcggattttattaggctttgaattcacacaaattttttaaaatgtattttaaatttgttttaagcggattaaaatgaattttcgtgcattttttcttgttttctgtccattaaaaggcattgtttcggcgaatttgacgaatgttttatttattggctgtgttttagctcccgagggcattcagacggaaataaatatgtaaaaagagcgaatgcccccgggggagcggacattcccaaaaattggtttcctttcgctttttgggcgtgtggcggcggtgcatccctttttcgggggctcgtttttgtggcatcatcggcagaaattgttccatccgcgagagtttatttaatagaaattaaaaaaagataaatcaattataatgattattgcgaattttgtcgaaccctaaaagtctgaaatttggcgtttgtcggagtgagaaaagttgggagtttgcgatgggtaactcccccaaaatgccatggttgaggtatcagtcaaccaaccaacagttaattagaacaaagttcagcagattaattccaggtcttccaattatgttaggataatttgactaaaggaatcttaaggactcgagaaatacgaaaaagtaaatgttttacccattttataccatggaatatacgaggagttcgaaatgcacgtgccaaatgaaaaaagaaggaaatgaatttaaaaagagggaaatgaagctaaagctgtaatgaaattgagaagcaaataaaaagggcgggggggggggggggaaagcttttgggcggccacccgagcaatgaaattggccgagagcgcttttcccgctcctttttttggttagtgggacagaactctttccaaacggacaaaattaaaatcgcatcgaatgatggcattggcatccttaattaatttaataaattttatctgacacaaacacaaggaagtgatacatagaagaaaataaataataataatgcgactgaatttgatggaaaaagggggggacaaatgcttacaattaggaggacaaacagcacaaattcggaagagattcacaattcagaaattgcaataaaaacaaatcaattgctgctgctagcggacgattgtgaggagccattcccaacagaagcggaagaatcagcgcgagaaatgggacggacagccgaaaagtgttccttgtgaatgaacgtctgaaaaattaggtaaatgtttaaatttatttgggagtcgaacaaaaaaaaaactcactaaaaaaagggcaatagctttgccggcaagcgcaccacaaacgacgtccacgttgtgatgtttgtggtcaaacagacgcgaaatggccacgaaagaggcggcaccgaacaacagaacgtacagcacaacaaaaaggtcggtgatgaacagacgacgaaagcagggcaaaatgcgacaatggatgtaaatctgagtggaaagacaaatggactacgaccgtacgaatactccaacagttcgatgctaatattggtacggtatggcaaagcaacggtaatgaaaaagagatacgataaggaaggtggcgaaaaagaaggcggtggaggcgtgtcctgagtagaaactgcgacgggagtccaatattttggcgttgttatcgtccagcctttggcaggtgtacaagtagaagaaatgggtcgagtcgttgtttgtctgcagccgtccaccccgtttttgtacttcaagtccgttgggtaacactgctcgatgaagtcgggtcgcaatccgcccaccgacagcttcaccaggttgacgcaaaacaggtcaacagcaatgccgagcagccaaattgctaaaaagttgttcatttaaactacattccatttgacacgaaaaaacaacaaaagcacacaaataaatcgtgccatttggcagagcctccgatcgaaattccattggcacgcagatttgaagccaaggcgttcatccgggtccatgtgcaggcacatttcgccgattgtgacctgaacaagatgaaaatctgtgtccatgtttgaattaacgacaacaacacaccacaagaaatgtgaaaggaatggcgatcaaatagaaatatttgagagggacggtctctttcgaaattgacgggaggttaatggacaggtcgccacaggaaaagcctcttactacgggtttgaaaatgaatttcagactgaaaccgatcgcacctgaacagaacaacagtatttgttttgctattggtaaaaagagtctcaccaaaaacaatagcaattgcaaagcggatcaatggcagatcatggcttctttctgttttcagcgtcataattagctgactaaccaatgcagaagagaatgtttaaatcaacaaagtaaaattaattaggtcggttaaagaagagataattttagcacggtttcgtcgtttggaacttgttccaaactctgatcggagcttctctcaacattttaattttaaaaaatagcaaaaatttgtttaaaaaacatttatgaatatatggccaaaaatgcttaaacaacagggtttaagggtttttccggggccggtgatcacgaatctgacttccattttcgaccacttcctgaaccccgttgctcgcgtagcttcgcagcctccaattgtgtacattgattnctgaccaactggagttcaccgttgcatttcaagtctggctgcctaatgtgaacatcatttgggctaaagagagtaaaggtaaataaaacacttaaaaatacaaatttgtgattaaaaaaaaatagaaaacagtcagattaagataaaatatttttaataaattcgtgacaacccataataacgaaaagtcgttgctttcgtattttttagaattttatattatttatttttgcacgagttgcctattgtactaattgtttgtacgagttgccatagacccattagttagcaaggtaatttaaagacaaatttgcacgtttgtccagtaacaccctccccgccaatttccctcac

SEQ ID NO: 7977 - DNA, 2580 bp, Heterodera glycines
  misc_feature (63)..(63): n is a, c, g, or t
  misc_feature (94)..(94): n is a, c, g, or t
aaggcgttcatccgggtcccatgtgcaggcacatttcgcgatttgtgatctgaacaagatganaatctgtgttcgtgtttgaattaacgacacnacaccaacaagaaatgtgaaggaatggcgatcaaatagaaatattgagagggacggtctctttcgcaattgacgggaggttaatggacaggtcgccacaggaaaagcctcttactacgggtttgaaaatgaatttcagactgaaaccgaatcgcacctgaacagaacaaccagtatttgttttgctaaatattggtaaaaaaaaaaatctcaccaaaaacaatagcaattgcaaagcggatcaatggcagatcatggcttctttctgttttcagcgtcataattagctgactaaccaatgcagaagagaatgtttaaatcaacaaagtaaaattaattaggtagattaaagaagagataattttagcacggtttcgtcgtttggaacttgttccaaactctgatcggagcttctcttaacattttaattttaaaaaatagcaaaaatttgtttaaaaacatttatgaatatatggccaaaaatgcttaaaaacagtttttgaagttttctggtcataatttttgaaacaaaaggaattttaatttgcagctaatacctagactcgtagagctatcgaatgataccaagaatgtccaatttggatgcttctacatagaaaaaattgccaaattattttatggtcgtgtgaatagagcccaacttcgacaaggattttttgttctagttgttcatttttcgagtctaaaattgggtttctcaaccgatgtgaaaatttgaagcggtaattggggggtgggcaaaattaagttttggaggggtcgattttcaagtcgaaaattttgtttttaatggtcaacggcataaaatgcaccatgcacatatatttttagctacaattacacatgcaatacaagacacagtgaataagcatatacatcggtgaagggtatatatatacatacaacgatttggtagcaacaattcgatgtgcaaaacggtgatgacacaaatatacacatgggtacatacacacaacattgggtagctacaattcgatgtgcaaaacgggggaggcgcataaatatacaatatatacagagcacacaaaatgtatcattgtcgtcagggctcgtccgttgtgagaagcacacgtctacaggttgtagatgaccggcagattcttgcggcgcaccattccatcctcgccgaaccactccagcttgaacacggtgtcagacgggccgggcgtgttgcaccattccacgatcacgcggtcgttcttgatgtcctcgttattcgggtcgaaggttgccacggtgatgatcacgttcacggtgtcgccgacgcccacggtgccgcacggcgggttcaggaagatgcgcttcggcttcgtcgtcttgaaggcgaacccaatgcgctttgagcccgtgttgatcagctgaaattgcacaatgattgatcacttagcagagaaagcctcccaaaccgacaaacgtacgcggaagttgtagatggtccggatgttgaatggcgcgttgaggtgcagctcatgtgctggaattgttgcgatgtcttctggatgttgccccattgttgtcgctgttgttgcggttgttgggcacgtcgatgtgttgctgatgaaacaagaacggaataggcagaagtgtgtgaaaacgcctctttatatacatacatttgagttccgtttgttactgctaaaaatttttttttgtgaatacagaacgccaaaagaacaaatacaaacataaaaatagacattttgttttaccattttttatgaattttttttagcttttctttgtcaataatagaccaaacaaaaccattttatactcattttgaagggaaaatttttaggtattttcatgtctgaccatttctgggacgaaaatgtctttgatctggtcgctgaactcaagaaggaaggccgccatgtacggcttgattggccgtccggtcaaatttcacaaataattgccagcaatggctaaaccatcgccaattgtcaagcacttttgcttttatttgttcctttcgccttatagcttcgaccataacaattgccagaatcgattccgacccgatcattttgtatttgaatatcaaattacttttgttactgtagaaagatttcccaaaagtttgtgcatatccaatcataaaaggcttttaattgaaaaagataggtttatgatataagcatatattgaagatggacggagtgcaaagctgggagtaagggaggagaggagaacgtgatcgagttgatttcaagacaaaatcaaattaaaaacaaatacagacagacaaaatcaagtaaattgtattcaacccgatcaagcaaaaaaacataaaagaggggggattattcagcagatttaaataaaatcaaacataaacaggtggaattgtcagacaaaaagatcagaagagtgtgttggcagtgatattcccgggcaataaggaacctcgctaagacaaaaatttaaggtatcttacggaat

SEQ ID NO: 7978 - DNA, 5049 bp, Heterodera glycines
attaataataattattagatttttaattttaatgaaatccacacatttaatttattggaatatttaaataggtaaatgtttgataattaatataatctctttttttatcactcatgcacacaaaaagcgatcaccataaattgagatgggataattattttaatttttttatattattaaatcacataacattttttggtaatttctgtgctctttattttattcattttgatttataaaaataatttgcttatataatattaataatgaaataagttttaaactgttaaaaagagatgattatcatttgtttcgttcattttgtttaattaaataatacacttcattaaatgtattaattattagtcagttttaattgtaaaatggtgctaatttctcactacatttttacaaaggttttatatttttcaatttattgatattttctaggtttttaatttatctaaattatatgacctataaaatttaatgtgctgataagaattaattttagaaaaaaaatatatttttaaattattttatttaacttgtctcaatccatattcatttttgggagttttataaaagcacacattttttaatttatttatttaataattttaaaaaaattatttttatttaattttgaacattgatctccaaaagttcgttggcaatttagagcagacatattttccctaacattttttaatttttccaaattttatatagccaataaataattaatcaattaatgtttttggtaaactttgccaataaataactttataaatttcttcgtataaaagatattaaaaaaaaagtttttaaattatttttattgcaacaataaatggcaaaatgttagttgaggatctgtgagttgtttaacagtttttgattattttcattatctttttacttttttgatttattctaattctatcaaatctcttcaagtgcaatgtttctaacttatgttcttttattgtttatgattttttctgccttttttattaattatatacaaaataagttttttaaattatttgttgcgtttgcatactgatgaaatggtgggatcacatttcagtcttgtttcatataagttttacaataatatttttattatctgtttcaagatgcaattgtcttagttatcaacccaatccaagagtgtacattagcaaagaatattttaaattttcaattattcaaaaagaaaatataacaattaagaacattattagtgaaattattttttaaatttatttttaattgtcttttaaatgaattataaaaattcatgtgtgcgacttcatgtgccgctgttagtgcagttagtgtacctgttattcttcaaaccaaaatattgattagaataattgatagaataagataaaaaaatttatttatttatttattttcaataatttaatcgttgctaaattatatgattaagtttcaaagtgtatatgtaaagttcctattttaatttttaaatttctttaaataattttatatcaaaagaacttttctttcatcatcaatttttttttaaacaatctgctgtagtaatcaaattatatttgaattgttctcattgttatatgttttaacattgttaacaatattttgattattttacatttaattggtcaaatttaataagataagtgaatgaatgaattaatatttgctttaatttaatcaatttttgatttttattttgttattatttgtgtataaactgttattttttaatttcatggtgtgtttcccactcgaattgaattcatatgtctttgtgtcgaattgtattgataaaattaattatatatttttttatttcattttattttaattaataaacaactcactcaatattttggattttaatttattgtattctttcttatatcttgcattaattaaaaattattattttttataagttttacaatttagaattttaattataaaaaaaaattaatttttactttaaaacgagtttttgtaatctattagataatttaattttattatataaaaaacctaaacattaatttattttatttttaggaaaaatgtttaaacccacaataaagttatgcgctaaaacacgcaaatactccaaaatagggttgcaaccccgacgtcggggttggaaaattcggggttcggggttgtcggggttggaagtgtcggggttcggggtcggggttgccaaatcgttcggggttcggggtcggggtcggggtttttcaatttttgccttatgccaaatagtcaaaatttttttaatattttttcggaaataatatttattaatttccataataatatttgtattgtttttatatttttttatttctttttatcagaaattttgtatagaattaattttttttttcttgaaattttaaaattttttattacttttttgttttccaaaacatcttttttcacgtcgctcttttctaaagacttaaggagaaagggtacggcgtccggcggtgccgataggcgccgccgggaaaaaatttggttagatctgttaacagattttgtccaaaatatgctaaatttttgcgattttgagccaatttttttaataaggtttatgactttttgggccctgtgatgccgataggcagcgctaaattttggaattaagctttattttctaagatttttcaccaaaaaaatttatgaatttcggtaaatttttgtttttcttcgatatgtattttgtcaaaatatgccaagattggtcgatttctatgagtatttaatttaaaaaaaaaacaatttgtcacaaagaaaataattaaagaagaaaacgtcaaacggtatcgaactcacgacagaaagtaatgtcaatggcactaacctctacaccacattccaaatgtccgaaattgagcaaatcttctttatttaataaaaatttggcaaatggttaaaaaaaattcaaatttcgtctaacttttttgcattttctcccacgaaaatgccattcttaggggtgtatatttaaccccgaccccgatcggggttaagggtcggggttcggggttgtcggggtatgaagcgtcggggttcggggtcggggttttccccgaaaatggccaaaaatgtcggggttcagggtcggggcggggttgcaaccctactccaaaacattgccgacttcataattttgcacttttctcagtattcgctcatcggttccttgtaccttggcctttttgatggaccttcctgacctctaacatattcttcataatctgatctaaacctttctgaatttttcttaaatcgtcaataaaacgcaaatatgtgggtgagcatagccaaatccgattttcaattttcgattgcaagcttctgcatagttgttggtacggtcgctgccttccaaagtacgctgaaaaacagttcacatatcataggaaaattttggaggtgcccttgttcctcttccaacataagtgttagtaaaccattcaaaaatagtcgcaagttccggataatgatcaagagtatgatcttcgagttcctgtaaggaccgaattatatcctcttccggaatgaatgcaatcgcagtaatcattcgagaatgaagtgcaaaatttgcatccgtattgtaacgacctaaaagatgtgctgaagacaaatgtttgcgtaagttttgtatgaggtgaaaaaacagcatctaatcttggtgtcagcaaattcgcagattgtcaaatgaatgctgtgctcttgaattgtggccaaatatctttgatcatttggaaaagtttcgcatatgtagctagctgcatctttgtttcgaagaagacaaaagagaacaccggaaaaacgaagtcaccacgtcgagaaagaatgaaataaatctgttgaaaaagcggaggagaagccgaaaatgtgccgtccatgaaatgctgtatgaatttttgccaattcaacgtttacaggatcgccggcttctgaacaaatatgttttccgtgctctgaaactaaagagccatcttccaaattcgtccatatacgaccacgacagccacgaatttcacatctccaaaattgcaccattccacttgcactgattttgtttcttgcttatgtttttgtctttttatctatacggcaaaattaaaatttcgtttaaaaaatttaattttctttaaaaaattaaaataattcttaaattttttcttttaaaaattaaaatttcccagaattttttttgcacaatttatcggcgtcggcgagtcgtgttgtcggcgagtcaaccatcggcgagttggcgtcggcgagtcgaccatcggcgagtcggcgtcggcgagtcaaccatcggcgagttggcgtcggcgagtcgaccatcggcgagtcgggagtcaaccatcggcgagttggcgtcggcgagtcgaccatcggcgagtcagcgtcggcgagtcaaccatcggcgagttggcgtcggcgagtcgaccatcggcgagtcggcgtcggcgagtcaaccatcggcgagcgagtcgaccatcggcgagtcggcgtcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagt

SEQ ID NO: 7979 - DNA, 1812 bp, Heterodera glycines
ctttcgcccctttgtcgcctttcgcccatttgtctccctttcgcccctttgtcgcctttcgcccatttgtctccctttcgcccctttgtctcctttcgcccatttgtcccgctttcgcccatttgtcccactttcgcccattttgtcccctttcgcccattcgtctcatttcgccttttgtgccactttcgcccctttgtctcctttcgcccattttatcattgtttcagtttttctgtccctttttttgattggtatgcttttgatttgttttgttttcttccaatcattgccttgggcactttttaatgcatttgcttcgtatgaatattttcagctgctcattcgcttccatcatccaattttcaattctcaaaacttttcatcaatcccttcatttaaataaatttaattaatttatttgtttataaatttaattaatttatttgtttaaatttcattaatcccttcatttaaataaatttaatttcattttaaattttcgttaattagcaacaaaatgccgaagaaaaagccgaatgagaacaatttcaaagccaattatgactttagcacggccaattctaagaattggttaaaatagaaaagtcgacttgcgttgtcacgacattaattgggggggggggggggaaggccgcgcgaaaggccgcgcaaattaatgacaaattgtgtataaatttcattttcccattctttgctcaatattccattctcaaattacgccgtcccccaaactttgccattcattgcgcccattgaaaaattgcccgatttcagtcgtcattaatttaaacaaattggagatataatataaatatactttattaattaatgggcagattctttctaagcccaagcagattcttccttaaatgcttcgccaaaagttttgttttttctttcttgaactaattaattgatcaattaattaattatattaactaattatagttgatcactttgtttggcttcatacgcttaatggccaattcctttgaatgtcaaatttattttagcaaattttcactgctttcatttaaagttattaaattcaccatataaaatgggcctttgccaaagcgatgagtccaaagaacaacaaaaaaagaacaaagccattgacaaccaaatcagagatgaacaaaaaacggaaaagaacaccttcaaattgttactgctcggtgggctaattaacgaaaatcacaaatgaatcccattaatggctcattaggaagtctctccctttttccgctttactcaatccaacatagaaaaattattaggcctgattaattaattaacttcatttggcatggaaaataaaacatattttaattgctaataattgctaccttttattaatcggcatcagaattcattcacgtcatactatgtccattttaggcgcaggcgaatgtggaaaaagcaccataatgaagcaaatgaggtcatttctttgagttgtctatgattgttgggaatggatctgacctgtccgtcgttaaacatcggctgatcattgatcaccggctaatcgatcgatactcgaacatttgccgaatttccccccccccccccgggggatatttctgcgtttttcaattttaaatttgtcatgcttttaggtttattcacaacaaccaatattcggatgaggtgagacatcagcagagccatcctgaataattttgccctttccaggaattgctgcaacaacgggcggtcgtttactcgaacacaatccacgggatggcacaattgctgaggggcatggaacggttcagaatcaca

SEQ ID NO: 7980 - DNA, 3210 bp, Heterodera glycines
  misc_feature (3193)..(3193): n is a, c, g, or t
tcagagcgcaaaaaatggatccactgtttcgaaaaagtcgacgctattatttttgttgcggctgcatctgaatacgacgaagtttatttgaagacaatgaaacggtaaaagcatttgggagggacgggaaaagaaacggtcctttcctcttcggtagtcatactgtaacagttattgtgtacattagagaccggacgggatcgggatcccgcgggatttcttcgggatcccgcgggattaaattcgggatcccgacctcgggatccgtcccgagcgattttttaaattcatcgggattgattgggatcgggatttcatcgggaccccgaaccgggatccctcccgaccattttaccaatccctgcgggatcccgctggattgaagtcacgataatttttcaaaaaatctccattttttaaattaagatcttgaattttaaattaaaaaatattgtcatttgctaatttttcttaaaaaaaatcccttaaaaatcccaaaaaattttacaggtctccaaaattccactaaaattttcaaaatttgacgcaaaagttggccattttgtgacttttatttcttcataaaaataattttttttttaatttctaaaacattattctaatcttattaggtagttttatggcacaacgatttctaagaattctgtccaataatcagaataaaattgttgtctacgcatttttccttcggtgccaatcggacatcaccagacccaagaacccattattttcttataaattagttcaaaatcacaaaatatggacagtttttgtataaatttttcccggcggcgcctatcaaaaccgccaacctctccccccccggttcccctaaagtttttgaaaaaatttgcagcaaaaaaaatcttaaaaatctgattttttgattccgtttctcaaaattattaaaaatgatcatctgaggcgaaaatacaaaaattgatattaattgattaaattgtaaaaaaattatttaaggctatgttgttaaatgttctcatttttgaaaatctgattttttgggcatgatattccaattttgaaaaatttctataaaaatctgatataattcacatccctttttttcttcaatcgaattgatcaattataaatattagataaacatttgaacaaaacttggcacaaaatgtaaaaaaaaaaattgggtttgagcaaatcccgataatcccgcgggatcccgaaaaaaatcttcaggattgatctggatcgggattcggtcgggatcccgacccgggatccgtcccgatcgtttttccaaaatgttcgggattgatcgggattaagtcgggatcccgactcggttccctccgaccccagttgtctggtctctagtttaaaatgaaagaaaaaaaaattttttttttaaattaaaatttcattaaaataaagaattttatttattaatttctatttttcattaaaatgtatttgttaagcaataaattgttcatcgttgttccgttttcttatttctcatgtgtgtgctataatttgttattaatccagtaatttttcgtaaacaatttgtcatgccattcaattccgtatttgttgtcatatgcatttaaatttttttagttttcccaattttttcgtatttaaataaattccctaaacgaagtcactcaaataaataattgaaaaaagaaaagctaatcgtttgattttcattaaatgttgcctacttttttgctttttactacaattccattgttcattttcctgcattctgtccttggtaaggtggttgagagttcctggattaatattaattgctctaaacacttttaaattcataatacatatttagccggcgttcttccgggatgcggagatgacgagcccaatgagtacgattgcctgaaaaagggggtgaatatgtgtcatttattttaattttttttcaataaaaaccccaatttagcggggggggggggggtgagaattgaaaattgaataataatgagaataagcataaataatatttagtgcgacttgattaaatgccctaatggaaaagtgtgcggttactttgtcggcattgccaaattaggcaaagggccgtttgaaaagaatgagtacccaaagtgtgtgagtgacccttccgaattgaacgtcacaacgccaaatgatggaaatgcgcacattgaagtggatggaccaggagtatgagaagaacccctttatttaattaacaaaaactaaaatttaaaagccatttttacaaaaaaaattagtgtaagtcggtggagtgtgccgaagggtttcaatgccaagtgcggatcacaatcgacaaacatggcgatcgaccatatgcacagataattggaggtcggttccgtgagttcaacgatttgcatggctttgccttggaaagattccctaattatttatatggaccaaatgagaaaataaataaatgggtaaaagcattaggtttgacatcacagcatctgctcagaaaaagatattcgttctgtcttggaaagatttatacggtacccattttgacagtacaggtttcccacaatgtgtgaatgccactggtggatcgtttcaagagccaaattatttcattgttggaggcccaggggtaaaaagaggcagtttaatgataagaaggataataaaatttagtgtgaccaattgccttctccctgcccatcaggcacaaaatgtgttacaattgttggaattgcaaaatatggcaaatacccatgggcccaggtccatgcatattttataaaagtaaacaattcttaaagtttcagttttttgagcccgtttgcacaaaatgaattggcgtgggtcgttgagatgaaaaaagacaaattttgttttacattttacctaagcttaattgcagagatcatttgaatgataaatgaacagttctcaaaatttgagacccgactggaccatttttttaaaaagtataaaaaagttattgtcttaaaatttaaaaattttaagttaaaattttttggccatgacctttttgaaaactattgaaatttttgaaattctagtgttttatattatacaaaaggttataaaactccaaaaaaaaagtcactaaatgcaattcaggcgatatttttagaaaacttcatatttttaaaattattaatattatttaattttaccggangtttttatagtattacc

SEQ ID NO: 7981 - DNA, 6076 bp, Heterodera glycines
caaatggtgaacttcagctaagtcttgcttaaaattggctaaccattttttgtcattagcattagtctgaacagaaaatatgaaattgaaaatttcaattttaatttatatatttgtgaaaacaaaaaatgttgattaaaatggacggcggttagttaaaaaattaaagcattaacaattatttaatgagaaaacgagctctgttcgcccccccccccaccctaatcgttcgtcgtaaatcactttcggtgtgtgaccggaaatgggccggtggaaaatgcggagttaatcagaatttcttgaaaaaaacgagatacggtaatggaacaaggttacacgaatctaattacagtatgtattgtttatgcattttggtaaatgcttattttttaaaaaaccgaatcaccaatccaaaaatgaaaactcttattcaattttgagtttttgtattaatgtgttaaccacgacgccaggcgcccagctctcgatccccatatattttgggccttctctttaattttcaaagaaaatttagaattttttctaggaaaaaatcaaaatattattagaaaaatttaaaaaaaattttaaggttgattttacaattatttttcaaataatctttttgaagaaaaaatcaagaatatttgtttttctagcagcaaaactaagtctgttgttagagaaacaccatggttaatttgaaagaataaaaaatttcaccggctcccaaaaagataaataaataattggaatttacatttttgtggataacattttttcgctaaaattggttccaatttttggaattttcctaaagcattagtgtggcagtgttaacactaagtgaatgggcgggaaaggttaattaattaatacaaattaccgattttctgatgcgattaagtcgtacgcattcctttggttctttaaatgagccatcatcattgagaacggcgcaaccacccaatgtcgtcatttcgcaaaagcatgctacgttgtcttgaaatgtttttatgtgctgatcaagggaccataagcgacaaatgtctctgtctcgaagctgatccatgcccattggctaaaagcaaaaaagcaacaatctcgagaaccaatcattttaagcggtactcaagaccaaaagttgactccgaggcaggggcatataatttggaaaaaattatataattttaattcgtccaattaatttaaattaaataattataaccctttacatttttattaaggtaattgttataatttactttcaaaaataactgatttaattttgaatattattttataattttcaaaaaaatttttcccgagaatattttatttccaccggaactaaacattggcaattcctctcatataaatgtccatttaaacaatataaaatgataaaaaatattattgttattttcttcatttgatcatttaaaaagggttgaaaattatttttataataaatttttttaatcttaattgttcccctttaatgttttgaaattgctgaaaaattcaagtgtaaaaatttttcatttacgttataaatgaacttgtttatttattgtgacgttttttggatttttttttaagttagacgactttgaaatcaaaatcatttgccagaggctcagatattatttaaataatttattaaaaatattaattattttcgtcctgattactgtactgtcttcagactgtcaactttttttcccacaatttcacttaaattgaaactggcctgatattctttccatgtttcattgagtttgttcagtttttgcaaaactttactaagaacgaagttacttgcattcgtattgtaactcaattgtgatacggcaattactgtttttgtcatattagcgatggttgtgtcaattgaattatcgtaatacttaaagaaaatcaaccgcttaatgctttcgcgtttttcctcaggaaaatccgatggcgcaagaatataatcggcatacagcaagtcggttgaatctaaattcgaaaatttttaataataattataaattattttaaaatacaaaaataaatggatttttttaatttttgaaataaaatacaaaatttaaaaaatttattaccaacttcagtcaaaactacgtgaactgaacaaattaatggcaatatgtgaataaaataaagtttcattgttcaacctttgaaatttgttaaatcttttataatataattattatttttatattatacaaaataaaaaaagtaataaataatggaaaagcaaattcaggcaaaaattaagcaacattttcaattcttcataataattacacgaatctgaatcgatttccacaatcaatataacaattttttaatttaattattttcgttttaatttatgaaatatacaattaactcttttctttattatcaatttttgggattcacaaatttaaaagttggtaacaaaattaaaatattaaataaatagaataaaagataaaatatcttttttaaattttattatccaaaatgcgccttaacaataaacaaaattttatgagtccatttttgaataagcaatttatgcaagctggcggcggtttggtgaatgattacggagggacagaaggtaagaacaataatatgtttgacgggattaattaatgaggatatgtacggtaattttgaaaaaagtcagaaaggctttgaaattaattaccctattatggtatcaaaaatttagccaaatgcgtaacataaattgtatttttattgtccgccaggaatgtttgatccatttggtggagatactggtgcatacccatcaggtaacgacagctatatacttttatttttaattaagccactattaaaaatagggttctgctccgacccctcggggggcaaaatttcgtgggccggggaccccggtcggaaaagttgcatttttttactcaaaataaaattttggtcactacccgacctggctaccggaaaatgtgtcagtgcatttttcttggaataaatacaattttcttgggtttttaaagtcactgatcttgaatattgtatatatttcggccaattccgaccccggagccgaattcgaacaaaaagacgaatacattaattacccaattggggtgtcacaatttagccaaataagtaatataaattatattaaattgttctccaggaatgttcagcggagaagatgatgcatacccaccagcaggtgacgacagctgtataccatttttatattaatatattattaaaaggcctggaacaatactaccaatacggttagggatacggcgctgatccgatatacagtgtggacgaaccgtagggtcatgaaggtggattttaattttgatgaccagcagatgatggatgatgatgatatatgatggcaaaatgtattattatttgtatctacaaattaaaaaaatgataataaatttattttaaatgaattctacataatttgatacttaaaccctttttgttctgccatctctgttttgtttttaaatttttttctatgctaattttcggcgctgaaaatgaatttaacatttattttaatctaacattcatttgctgtgaaataggcacaaaaagaaattcaaaataggcactaaaaaacctcaaatttagggatgtataaatgacaaaaattattgaaaaatgaaacaaatttcgtaggggggtatttttttaatatttaaaaataggatttttaaaaaatttttgagcctcttaggctctaaaaataagaaccaacaaaataggcaataataactcaaaaagtaacttaaaaccaccaaaaagcacttgttaaatgttttattaaaaatcaaaattaataaatccatctttttaaaattttattgcccgaaatgcttaattataaacaaaattttatggttcgaatttggagatcagtttttattgtggtcttttattaccaaaaaataaataaatattttgttattaaaaagctataaatagttaagaaatgaatgataaagcatttggaaattctttcatttaaaaaatattcaaaactgataatttcccatgaaaaattttaaaatgaattctttcttttttttcatcacaattcttcccacaatggtctgtcaaaaaaggatgagttttaatggctaagcgttttggacccatattaatttgactaaaatttaaaactcaatttcgagaaataaaattttataccttttttataataaatttattttaaattgtaccaacaaaattagtaaattgtttattgtgcctttattcttgaattttttgggattttctgctacttttgtcgacttgaacccaatagtgagatcctcgaatagctagctgtacaacaattcacgcttattcagtaaaaagtgccataatttaaggcacatttgtccttggcacaaatttttggcgacgccgatgccgtgccgaaactgtcaccacccatccagctgtacgacttcattgctccgagagcgtatgctaattggcctaaagtggttggccaagcgcttaacaaacggaaacaattgcatgaaaagattgatgataacgaagataaagagcaactgcaacaaggggagcgtttcatcaatattccgtcaattaaaaacatatttaacaagggtaagtcagaacgtaatggatcataaatttaaaaattacattggaaattatttgaaaaaaataggcactttaatttatagttatttttggagaaaaattaattaaaattaagagcaaatatttcaatttatcctattagaacattaaaattaattcaattttatgacagaaaaatcggagaaaccccaacttgttactaatttgtaagcgaactcgtagtgcctcgactagtattttttcgacaaattcgttttaacttttgtcaaagtcaatcaaatttaactctaatttcattagagttcttaattttcttgcaaaattaaaaaattaaaattttttttatcatgtttcaaaaaaggttatgaccaaaaagcgtaaatttttgcccatttttaaattggtcaactttgacctaatttaggacattttttcggaagacattacgagtcgggcaatgcgagttggtctggtacgagttgggtttaacgaacaaaaaatcatatgtttaatgacataaaagatataaaataaattcaattattttaataatttaacaaattttatagctcttccttatttggtcaaagttatgccaaatgttgcaccaactctctgcgcgctgaaaggttgtccgccaggaatgcttggccaattcggcggaattggtggatttcctggtggaggtggatttcctggtgcataccctggtggaggtggatttcctggtggtttccaaggtaaaaaatatcctggtatggcatacgatccctacgcttaaggagcgcccgggtacccaagcaacgaccaaaacggtggagcatggaatggtggtccgcagtacggcggctaatacgccggcgcttggcggtttacaaggataaacatcgaaacaaatgttatcgtgaacaaatccatgaattttatctgactaaaagatttgaggatatttgcatttaatattattattatttgcttctatttaacaatctaaggattcaaacaattaatgatgcttattacggaataaaaaattaatttgttaattaaagctttatttacataattattttatcatttttgttttatgagaattccaataagatcttgtgtaaacatgaaacgcattaatcttttttagcgccgagtaaatatataaaaatttaaaaaacaatgggctaaaaagaagtgctttccatttttgaggtattagacgattgccgagataaaaaaatgtcaaaatgattgtgctacactgaataaaacgccgtggtgcgaagcagaactcgcagtgggtatgcaaataattacaggaagaaagaagggttgcatcaaaaattggaactgtaaatgtttgctggatgaaacaggaaaagtactcaattgcaattttttgcaaagaaaaaatgatacagag

SEQ ID NO: 7982 - DNA, 4407 bp, Heterodera glycines
  misc_feature (1180)..(1180): n is a, c, g, or t
cccaataaatatgcacaggtagtttgacggaatgagaaaaatggggattccggtttgggtgcactaaatccaccccgtatcgttttttgataatatttgatagagaaattttgcaaaccatttaaaaaaattatggttccagctccatttaattttaaggttggcttttgagacatatgaccgtttcgcagcaaatacctgtgaatttgcgcaattatatctcaaagcggacaacgactggtggttagtgttcaaaaggatcgaacggcgaattttggtgttgtttattttgcaaactgtgactacgtcgatcgttgacattgaattttacgtggaaaatattgtgaattctgctcctttcaagattctctttttcccttaataattcataaaatgacaaattattcaattggatttgcttccgttgtctctgagactttcgtttgttaatatttggtaaaattttagatgattttacaattaattttttaattaatttgacaatgagtgatgacgaggattacatgtcaagtgctttcttggcaaaagtggaagatgttaagccaggtgctgtgacccattcacccatgaaattgttggtatttgatttttggtaaaataattcccttaaaggtgtcggcaccggaagagaggggcgtcgaattttgcgaattaatgccaaccgagaagaggcgattgaaagacagcgggtggagaagccaaagtcaaaagccgaacttgaaagggacagactaatggagggactaaacgatccgatccgagcggagtcaaaaggctttcaattgttggccaaaatgggctacaaagagggcatgcgaatgggaaggagcgcagcggacgaacagcagatggacagtcggacgaaggagcccattctgatccaactcaggattgatcggtcgggcgtagggatggacgagcaccgaaaggagaagcagagggatttgtgtgaagcgcacatggagcgaatgaagcgacaggcggacaatgaggtgggacgcaattggaaaatgatgggcggggaatcgatttttaaaggaagaattggccatcgatttccgaagacgcaaaagggcagcaatggaaatgaagcaactgatctcggagatccaaaaactgagaaagacgtgccaagagatggacatgcggtgggcattgngagggagttaagcgaaacattggatttgttcagaatgggcaaaacaattccagacgaattttggttttggccgatttattcgaacaataatgaattggtcgacatggtggaagtggtcgacaaatcaaaccaatcgatggatgaaaacaaacggacaaaacgagagccttcagaaggagcggagggccaagtcgagcgatacacatacggcaacggggaggaggcaccgatggcactgaatcttaacgagttggacaatcggcacttggaagagaggtgggagatattgttgggcttcgtctagcacggcattctcccattattcaatacggtgcttttctgtcaattgcaacccgtgggaggctgaaaagtgaaatattcaaaattgcatgaaatagttttcccctttgtggactctagtttttctctgcttctcctgggggtggtttagtatattgtactgacaatgaatcagaggcttttgcggttaagtcaatttaagaaacattttagcttgacaaaaatcattgcgtacatgcggaaagtgcacttttattgtctgtgtgagtgtatgggttgtcaccaatttgcttctcccattctcagattgcggatgcgcattttcttcttcagaagagattgattttgagtgtccgggaatcattcgcgatgatcatgaataatttattcgtacaataaaattttttaccaaaataaaagtagccaatttttttattgctgaaacgtcaactgattcttagtttttatttaattttttggctagtcattctaaaattttaaagcatgaatacgaagacaaatcaaaagccgatcaaagttttatgtgcgggcgatgtcaatggaaagtttgcgcactctcagcgcgtgttaaagcggttgaccaaaaagtgctttattatgaagttgatccatttctatgtgtttgttttttcagtgcggccctttcgatgcacttttttgtgttggcgaatttttcggaccgaacgacgagcagaacaaatccgttttggagggagagatgcagctgccgctgcccacttacattctcggtgtgcgtacttacaattagcagggtgcctaatgtgccgttctaaatgagttaattgccaatttgataatgcttccgattcccaagcaggtccttcttgccagttcaccaccgtttactttccgtctgaaagttcggagctttcccaaagtctcacatttttgggtagaaaaggcattttgacaacagcgagcggaatttctgtcgcttatttctccggcgttgaagaaagccctggaggacaccagcaggacgagacgaaaccatttgaattcgaccagaaagcggttgatgatttacttttgccactctccgccaattcgggctttctcggcgtcgatttgctgttgacctcagtttggccagccgatgttatgccttcccttcttcatatgttacctaatccaagtgattttcaggtttggaaacactcctccaatcagcccacttctccgcccaatgggtccaaattgatctcgcggctggcggcggggcttaaacctcgttaccatttttccggttactttcaatgccaaattattcatttgcattatttaatgataaaaaaggtcatggagtccattacgaacgctcgccttacaggtgcttcttctttctgtttaatattctgttggtttttgttaaggaatcaccgcgttctgcttgaagctgcacaacacgtcacgcgattcatcggactttctccggtggacaatgcgaaaaaggaaaagtggctttacgcctttggcattgtgccgatgcgcaacctcccccggggcgaattggtctctcagccccaaaactgctcggaattcccttacatggaaatccttcaggtaacttttctcttaatttggattgccttttctaaagtaaaatattttaggattatcttcggcaaaaggctgaggaaaatgaacgacgaaaagccgcggaaggggcggcggtgcaattcttttacgatatgcaaacggtggaggaagaccaaacggacgtcggggaaggtcgaaagcgacggaggggaggcggacggccaacggacggacagcggaggccacggctcgacccgaaggcgtgttggttctgtctgtccaacgcggaagcagagaagcatttaagtgagtgaaaccagttgaggaggaattgtgagtacgttttcacatttcgtttggcaggggcgtacctagaaatttttttcggggggggggcccgacctgatttatttattttttcttttcaacggttgcatgacatttgcggcctgctgaaaatcggacatttgcggctcaactttttcgttcccaacaattttccatccaatttaaccgatttttatgctcttcctaacaagctgattcaagtcttccataaaaaaatcctaacccccacccaactggaagcaacgaagaggaggaaaagaatatcagcgaaacaagtcccaaaatgatggagaaagtatgaacattattagggaatatcagatcgctacagtatcaactggtggccgatgcaagtgttgatagattgattagcaaattccaagctcttgtgggggtttgacaagtccacttttggaaaaagaattataagattgaataaagttcggcgtaaattttaagaggaaaagtgattttcgataaataaccctattttggttggggtcggaaaagccgggccgcatttggaattaaaaagtggtaatttggcgttccgttggccgcaaatgtccgaccgcttttgtcgggccgcaaatgtcttaacacgcttttcaactgagacttttttttttttttgctcttcaactggacattttttatttaccaaatataaaaaactttgtttcccgctgctgggcaaaaactcctctttttcactaaaaattacccaatttgtccgttttacggcaaaaaacttgtaaaaatagtgcaaaattgaggtccggcggtgccgataggcgccgccgggaaaatttgagtgctatttgttacgaaaaggcttgcctttggcatggtttccctcactcaccaattttctccttgtttcccgccgtttgacatgggtttcccaatttgtctctctcttcacaatcagttgtttctgtggcttctcacacttacgccgcaatgcccaaagggcctttgaatgatcgccatttgct

SEQ ID NO: 7983 - DNA, 2125 bp, Heterodera glycines
tccctccctcttctgttttccgcgtgggatggctcgccagtgatgtgaagatttctgcccgtcattttctctcatttttccctttagcatctccaatttcaatttgttccaattccaaaaacaaaaagcaaagcattgcgcagtacgtttctcaatttggcacgtctcaagaacattgaattttcatttttaaaggatgaagacaatgtgagttttatttgtgtccgagtgttaatctctttgtttttcttggtttttgtttcatttgtttttaattaagtgaatctctaaaatttactcaatttcaagctaaccaaacccaaagtcgaaagaaacaaaatgatactacgagccataaaatactgttactcttttccattttacagctttgggatctcgtcggagagggttctccctatttttatgccgaatttcccgacggcagcaaaatgttgagccgttcaatggcacagtttcccctccaatttgggagagaggtaaaaaccagagaaatatctaaacatattttttatggctcaggtttttgccaacaaggcccttttggactgtgaagaaaaggtggattggaggaactgttcgctaggcaaaaaggaagaagagaagctgacaatagcacttaaagagggatttaaacctttcgcttttacgggcgatagttctggagatgaggattgaaattgccatgtttaacttgattatctccgtttaataattttgcatgaattgataaattcctctgttaatcacagtaatcttcattcaacacttctcacttttgttcgcataggtcggtctttttccattgtgtggcttcggtttttgcgattgtgttggtatttattagttattccacttacaattagtgctcatttatcagtttattctgtttctcgtcgaatggttctcccttctgttctaatcattggcggtgtttgtgggagtgggaaaagcacaatcggaaaggaattggccgaaaaaattgcttacaccttcgtcgatgcggacgattttcatacggaggaaaacaaagctaaaatgagcagaggggaggcactctccggtccgaatttacttacagaaaaacgaatgggggggggggagtttaaaattaaccaattcatggactaattaacatttttaattaggtgtttcattaagatgtcgatcggatgccatggttggaaaaggtttctaaaatttgggcgaacggagaaaaagccgaaagattcgtcgtcgcctgctcagcgcttaagagaaaataccggcaagtacaaattaaggcaatgctatagattactgcctcctcttcctcctcttcttccgatttcatttttttctgtctgcctgtgaccaattcctccaattcccccgtcccatcgcccaattcgatcaattcgtcgcttttattcattcgttttgctttaataaattcgtgctgaaacggcttggaggactcgtaaaggagggaaaagcaccctccacactccatcacattcggcaaattctcgtgcggggccaaacggaggcgcccattcccgtcttgacccctccctttcccgacagcgccctcgtcgttctcccccaattctccctatcacaattcctttccttttggcattggaggatccgggaattggcccggagcatcagcgaatttcaagcagttcagactcccgcagccggagtctcgcggatcggtatcagtctcccgctagccggagcaaccgtagggacggggcaaattcccgtcgtcgacgaatccaagcaggccagtgaaggaaggaagagccgggcggtgccaaatcgtccaacgaacgacagggccgttcgtcagcgcaactcccaccagccggagaagcgcgcagtgggcgggagtcgaaacccgtgatcgtcgagtcgagaacgaagcagcagttcaaaggggtccgacaagcccttctccaaaccttgtcggtggtgccgttaagcaagcagcaaatcgctgcacaatccatcaagcacagtccattttgtcacccctcccccctccattttcgtcccctttggcgccgatcggatcggtcggcagcatcaaaccatcagagctaacgccaaagggggcgca

SEQ ID NO: 7984 - DNA, 2558 bp, Heterodera glycines
taatgtcaattagttttaccatcaacaaatattgactaattaagcgtggataaatgacgaaatgttgagggtattgaaaatttttacaaggttttacttggtttgctcaaaagtcacataacaaaattttgctggataaatttgaaatgaaatggaataggaaaatgatgtccaaaagagatgctaatttcattaaataggattacttttccaaatttattggattttttttttgctcaatttctttcagaaattataattattatttttttaaatatagttgagtttttttctcaaaataatcaatataaattgtttttcacttatgtttgatttaacattatgcatatgttatgcgcaaaaatgtttgtttataatttcaatttccgtaaaaatttccgcagaaaatttattaatattattttgctgttaaatttataaactatttttttttgttaatattattaaatttatataaaataaatgtaaatgcattaataatttttaatatttataaattagtccctttaattttataaacgtttagtaagtagagttgcacgggaccgggaccggaacgggaattcccggtcccggtatggtcgggaccaacctggaaaaaaagaactggtaagaacggtggtctgatggaaaatttgtaatgtaattgggagaaagaaaattttgaaaaaaaaatttattctcaaatggcctagtggctattcttcctggttttcgacttgttgctcttggttcgattccctcctaggaattaaatattttttcatttactatttttgtctgtgtaatacatactatgatatttcttaactaactttctatttttgtgtttaaaaattctgccaaaatacaaaaattgcattttttaatgcaaaatctaagccaaatcatggcaatattttcaaaggggaattctacgatgactttataatgcctatttctgcctatttcggggtttttgtgcctaatgtgcctattttaaggatttcgaaaaaatccttaacacaaatgcaataaaacgaaaaacacacccctaagaaatggcccaataaaattttagaaaatacacccctaagtttgaaaatttttttccaaaaattaatcccaaaatttaatattttattttcttaataaaaatttttggtttaaaaatttgtccttattcgaaaaaagtttgaattatttaataatttcatttacaattgaaatatttaagtttttacgtgttttactacctaaaaagggttaataaaaattttttttgcctattttgtgattttttctgcctttttaggtgcataattcgcgattttttgtgcctaaaaacgagccctaatcataaattccaaactgttgaatttttgcgcggtttctctggcataacaaatgccatattacacaaatcaattttataatttcattttatagaattcctcaaaaatctgaatcgactttcgaaatctaaaaaaactctgatcgagtctttcaagtcgtgaattgttaaatccttctccacctcccatgtcctttatcccactttctcccacccgctttctttcttttgcaacatagggccaaattggtaatagtactggcttttgaaattaaaaaattggcccgatttacagaaccaggagcaaaaccctagcatcttttgaatcagtattgaaaaattccgtattgctcctcgaaattttcacatattgatagagcgatgaaattgggtaattcccgatcacttccccaaatcgcataaaaggcatctttttcatgtgcgcggctcaattctgcatttgtatgggatgggatggacagaaaagcccttttccttctcagaagacggagggctcagcggatcgacgggcaaaaccttgacatttagtgatcagactgtgatgcttacgatgttttttcaccacttacagtgaaatttcggaaaaaatttgccgtgaagagaaataattccatccgggccagcgattcgcccatgcaaactctaaaagataataaagaatttacacttttttgcctcgttttcgacagcccaagccaggcatttgcagtaagcctgagtttggcgacagatatcagaaatttaaaaaaactggatttgtttatttaaaatttgagaatccagggccctccgagccggcaatgtgaacaggcgtgaagccaacaaccttttgccaagtccgaacggaatcagctcctcaaatcgctccaattggcccatttggttcaaaaagcgctccggaagaaaccgacgagcattgggaaacacctttagaagaaagcggaagtagataaaattgaaggataaagccggatgcactttttcatcaaacagaacacagctgatctgagggacaataattgtgccacggccgagacggaaattggcgcctccgcccgccgcaatttgcacgtcggccattgtccgatgggtcaaattcagtggcaaaaggttgcacagccgctgcgtttccttccaataaagtaagaggggagaaggtgaaaagtgatcgaagcagtgatat

SEQ ID NO: 7985 - DNA, 1350 bp, Heterodera glycines
ttccatttgtaagaggggagaaggtgaaaagtgatcgaatagtgatattcgagtcagagttgagctcgagagcgagaacggtctcgacttggttcaattcttgtgagattaagaagaaaaagccacccaatttgctcgatcatatggatcaaaagaataaatggatgacttgagccgacaattgatcctatcagctctatctcagtttgatttctagtccgtaaacaaagaattgctcccgagacgcgaaaattagctatttttttttgtttttgaaaagagctccgctgagttctgacccaaatatcggaattccgttaccccccccccccccccctctctcctttcccatctcttacattgatcactgcgtttacgtagggcaatttgggccgatcagccgtcgtgatcatcattttcgcctctttcccctccgtctcgtttctctcttccttttctatgcataactcatccaactccttctgcattttttgttggacccgttggtccaatagcaaataaaggacgagaaaactgagggtgaccgaagttgtctcctgtaacggcacaaaatcaatttgggacaaatgagcacaacggatacagacaaatgatcataataatgggcaatgggtgaccaatcatttaccaattttttgccgtatttttcccgtgtgcctattctgaaattgtctgagacatcattaaaatcggaattgtccttctctctttaattaaaataacatttcaccccattcaaactttgaaatgaccaccctttaaaatagggttgcttcccgcacatgtcggggatcgggtctgtggggcgggggggggggctaaattgtcggggatcgaggaccccgatcgggtagtgatcaacaaaattttttaaagaaaaaaccaatttttctttttaaatgctcgtaaatctaccatttttttcactttaatcatctgattcaaattcattctttggtgccagtaaaagtgcgtccaatttggtattttataacaaggcatcccaggccccaaaaattttcagaaatcggaaatcgaattccgaggctcaaaaattttagtctcaaaaatttgacaattttagcggtgcgcttttcaaaaactttttggaaacttggggtgggaggatgtggtccggcggtgccgataggcgtcgccgggaaaatttttgaaaatgaatatattgttaagagaattttgtcctaaaattatccattcgagccaatttttaggaaaaatttggagttttggggggccggctgtgccgataggcgccgccgaaaagtttttcgaattttttatttaattttattaagtaattgttcaaaa

SEQ ID NO: 7986 - DNA, 1274 bp, Heterodera glycines
gattgtggagccgatcaaacggttaatgtgcaaatacagctgaattccgcttgtatcttcctctgctgctgcaaaagcgatctgttgccgaattcgcccaaacattgtgttgatgtcgctcaaatactataataaatgcacaataagggcttatgtcgctgaactgcttaaactttcgccactattgcccgtactgtttcaacttccgccattactccccggactggttaaacttctgccactattcctcttattgcttcaacttcgtcactattcctttcttcaacttccgccaatattctatttactgcttcaactcccgccattattccctgtactgcttcaactatcgccactaagcccataatgtttcaatttccgccattattctccttactgcttcaacttgcctcgcttccgcacccccctcctcaccttttgctccaaccgcgcctttcccatccccaaattgcgcatcgcaaatttgcgtgtcactttccacaattcgccctcggttctgatcactccgtaacattttccatgggatgctaaacggttaatcaattgttatatgaattgggcggacaaaatgccattctttgccataccggcgcacactttgaaaagttcctccatgaaatccctgccagcaaatgtatcaccgtccttgacgaacagttcgcgcatcagttggaagtcggccacgaccacaacgggcagctcgccaagccaaatggtgtaaatggggccgaacttacgtgcccattgttggtagatggcataaggacattttgaactgtttgatgtaaacggggggaggacattagaatggaagaaaataatggacgaggaggagggaaaggaagtgagaattggattaagaggagaaaagggggagaagtggaatggcagaagaggaggaggagaaggctctgggagagtaaaaatgagagaaagaaatagagagaatgagaaaagaggaaaggagaaaaagagagggacagaaaaaggaagaggaaaagcaaaaagaaacggaaactaaaagaaaaaggtagaggaaaggggaaaagggaaaaagagggcgaggggtagaataaagaggaagagaaaaaacaacagaacaaaagaaaggagttatgggggagttttaatcaagtgaaaggatgaagaagaaacaagagcagcagacggacaaaaaggaggcagaggaggaagcgaaagatgaaaaagaaaagaggaggtgaaaagaggggaaaaggagtaaaggggggggg

SEQ ID NO: 7987 - DNA, 982 bp, Heterodera glycines
cagaggcaatggcacggcccggggcggcaggtctcgtcgcttccaaacaaaatgccaaaagaggaaagcagagaggaacagaaggccaagcagtggcagcatcggctcacaatggcaaaatttaatttaatttaaaatattaaaagagccgaaattcaaattttacaattcaaattaccccagagaacaaatgcagagaaaacaaaatctcgtccacatttacccatatgcggtatttcgcaaaaaatactaaattataattcaataaaaatggaaatacgcccctaaataccgaaacttttctagaaaatccgaaaattaatcagtccatccctttttgtaggacgataagagtaaatattttcaaaataaattaatttgtaaaataaataatggctcaagaaaggggctaaatgaattaacggagagagtgaaagagagaattatttgttaattaggcaattagagagagaaagcgaatgcaatttgttgaaagttggtatagtcttggtttgtgtttttgcgttgtttggtatactttgaaattgttaagactgacgtcgtaccggttttccctttggtgttgcccattcaaccattagcgatttgcatttgttgtttatcaatttatcgccgccaattacgcatttatcaattggtcgatgaaaaaaaaatcaaataagaaaaaataaaaaagtgtttttacaactatgtagagtccatattcttaggcactaaaaactgccaataaataagtaggcccgaaaagacacacaaaataggcacgacaaatgggaaaatggtctccaaaatttcaaatttcggagtgtaatttaatataattagatagaatagcaaataatatgaaaaacaataataaaaactacctcccttcataatatccaaaaataatattccggcgttttacaatttgccgtaaatacgcgttttaggtggtgttttacaatggaaataatatctc

SEQ ID NO: 7988 - DNA, 1062 bp, Heterodera glycines
tgctccaatgacatttgtcggcttttaagccaaatgggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaaatggggacttattttgtaattcttccgcaccggtttcagttctcactaagatgtcagttttcgagaatcctgaaa

SEQ ID NO: 7989 - DNA, 1521 bp, Heterodera glycines
  misc_feature (1413)..(1413): n is a, c, g, or t
tttaagcccaaatggggacttattttgtaattcttccgtaccgttttcagttctcactaagatgtcagttttcgagaattctgaaattccagcactacatgccgaaaacattgctccaattgacatttgtcggcctttaagcccaaatggggacttattttgtaattcttccgtaccgttttcagttctcactaagatgtcagttttcgtagtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggcattttaaacccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttatttttaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggcattttaaacccaaatggggacttattttgtaattcttccgtaccgttttcagttctcactaagatgtcagttttcgagaattctgaaattccagcactacatgccgaaaacattgctccaattgacatttgtcggcattttaaaccccaatggnggacttattttgtaattcttccgtaccgttttcagttctcactaagatgtcagttttcgagaattctgaaattccagcactacatgcccgaaacatttgctccaattg

SEQ ID NO: 7990 - DNA, 6785 bp, Heterodera glycines
agcgcttgatgccgaaacgattccgacccatttttgttaggttttcgtgtggcaaaattagccaaaaaaaatttttccacatttggcgttgcgcttttgcctctgtttaggtgtcattcaaaaacatttaattgcattttttatttgattaaaacaaaacttttttatgtatgtataaacttgaacaattgctaaaacttaatcattcactgtaaattaattaattatccaatttgttaaattgtttatctatgtaaattcttccatttttttttacaaattgatttaaaatttagcattttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagaggtacgacgaataatgaaatttgaacttgtgggcatggttttcatggtaaaacgacgaaaatatttccaaacttttgaaaattacaactgcttaggctgggcctcccaggcttaaattaacaaaattctgtacgttttgcaattgatgcgttgcttttagcgggttgggcaattcgggttgtccgcaaattcaggctgatggccagggggttgggggtggtagaacccgggaatttcgaaatttgctgacctcggtgcgctgcatgattgaaacccaaaaaagggttgcgattttgatcgaaaaattcgacttttgcagggttttttttgggggggggggaggggaggggtccgtgccggattattgagttttttgacgggtttactgggtttacaaccagagtttttccttcctcataaaaaaaaccttttttttgcagatccgagaaatggccaaacgcatccgcgagttggacgacaaaaacccgaacaagttggtgttggcacggatgctgctcggcaagctgttcgacatgggcgtgattccgaccgcggacacgctcgagcgatgtgacaaagtgacggcatcgtccttttgccgccgtcgcctccctgtcgtttgccacaaaatgcaaatggcaccgacggtaaacgcagaccaaaacaagcaattgcaacatgcattttcatatgcttgctttgagtgatggaaattagggtccatttttatacggaaaaattttcaaaaatgggggaaaagtatttttgtgaaattcaaatcttgttgggtaaaagccttccggtccacaaaattttaaggcaccgcctgaaaatttagggtcaatttgtttgaaaattgagtaaaataaaataaaaaatatccatttttcctggattttatagggtaaaacctttgtacgcctacaatattttctgtttatggacacttttcagttatttcgttttcaggttaggaagtccagccaactggtggagcagggccatgtccgtgttggtgtcgaaatggtcactgatccggcctttttggtcacgcgaaaccaatcggatcacatcacatggacgcgggaatcgaaggtccgaagacatctcagcacttacaacaacgaattggatgactttgaggggtgttgatttgaagaagccaatgaaataaaaatacatgaaaaagacgcatataaaccatttttttttgtttcactgcaatttgtttgttttgttttttgctttttattgttgttgaactgttttctcatggacggtaaaactaaggaaccataggaattttggaaagaaccagaaaggccggcagaaaatgcattttcaattggaacctaaaaatttgttttttaatttaagataaagtttgccatttttcggcaacatggtttttaatgatttcggaaaagattctttttatctaaagctttcgaatgacacaaatttagttggccataaacctttaaaaattaactttcaaaatttttaatgttttgaagaaaataattgaaaatattgttgtcgtgtagcggattcgaacccccacccttttccctttactgtcttgcaaaagccacttgaccaccatacaaacgaatttttcgccttttcgggatgccatttctagcagggatggcacggaattccgacatttttggggcctcggaattctgatcgaaatttttgataaaggtcggaatttttcggaattttttttgagtttttttttcaaaaaattagcaatttttgtacaattttctgttaataaattgcattgaaatttttaaaaatttcccagcggtgcctatcggcaccgccggacctaaaagtccttaattttcttgaaaatgtgctggaaatagctaaatttggccattttcgggtacaaatctgttaaccaatagcatttttccggcggcgcctatcggcggacccctccccctattacccaaattttctttggataaagcgcgcagcaaaaaagggtgtaactgtcccaaaaaaaaaaatcaaaaataatgtaaaattacataaaaatattttgaaaatcattaaaaaaaatttaaattaatatagaaatatactaaaaacaatttgatatcacctttacagggttaagaattttaaaatgtagcctattaaatattaaaaatttttttaaattatattttatattttttgaaaaattccgacttccgaaaaatttttgagcctcggaattccatccctggttcattgtcattggctctattggcgtgctagaaaatgccgccattggttcagttccggaacaccgaaaatcttttttttttttaatatttttatgcaatttttatgcccaccccaaaccataattgtgcaaggagaaaatgaaaaaatttgccaagtgacctcctcccaacccaaaacgtcaccgaaagattttttgtcctgaattttcatccgtaaaaaaaatattttttttaggatttacagattaatagctttttcaagtgctttcaagcaataccaagaaatgtttaagatgaagttttgtggttttttactgacaaattaaaatttaatttcataatttttttcttactttggaaaatgttttatttttttaataaatttccccccccccccctccctccgattactcacttggagtgccgattggagatgtctgcgcaatgtttggtgcatctgttggggctcgtccgcccggcgacagagcacggcatggcaccgcagttcgggcttcatccgcttgccctcgtgctttacaaaaaacgaagtaaaaaaaaactattcccaattttaaatttgtttgaaaaaaccaaagctaagggttcaaaaatcaatgttttacgtgccgaattaggacttgtatctgggtttcatatttggcctggttttctggccaaacaaaaatacaggaaatccaaggcctggaatcaaatttttaatcaattatttttgtgatttttaattgggtcccaacttttccatttaaaaactccgagaaaattgttttttttttgtttgaaaaaacgaattaaatttttttcattgaaaaaacgtttagaaatggagaaacatagccaaagcagcaagcaccttgtaaatccagcagaacacgcgctaaatttaggggaaattaaaaaaaaaaatttttttttgcacttttaccgggtattgactgggcgccgccgaccaagtgattcggtgcgtaaaatattcagtgacactgaaaagtgtgggaaaatttaaatttgaatttcttacatataaaaatttacgaaaaaaaattgctggtcgttaattaacataaaaataattttttatttgaaattttagattttcaattaaaaacaatcaccacggcaatttttttgccgtggttctcaaagaaaaaaaagttttcaaacaaaaaaataaaaataaggagagggagggtagtgagaaaggcgtcgccggtgaaaactttgaaatttttaatcaaattgcaccaaacaaactcacccaatgcacgtctcggccctgagcccagaccggcacacgcacaggcgcatcgccaactgttgcgcctgttgctggccaaaagtggcgccggcgctgtggcgcgtcgcgcctttggcgacggtggcgccccacgcgcgcgtaatcactgccgaggggagggggaggaaagtgttaaaaatggaaaataggacacaaaaaatataatttaaaaaaagcgccaaaaaacgcaatggcaaaaatgcaaaccgtaatttttgaaatctgtctattttttgcaaaaagccgctacaaaatcggagggtgggcaattgcgcttttaaaatttaagggcctttttaagtcgatgaattgaaaacggaaaaggcttaaaacaatcttctttgtctgttgggccaataattttcatggtgttagaagttaagagaaatttcaatgaatgaatgccgcggaaaaagcccaaaaatcagggcaatagtaacgaacattggtcctgaatttttttaaaatttatttaggtaacccgaggcgctgagcacgcattgccttattttggctcaattactaacccgaaccacaggctcgaaaatttttcgagaatttaaaaaaaaatttttggaattgcctggctattattattgctcacaaccagtttcatccaagatcccctgcgtcattttccaaaagattgcaagattcgtgctaattgtaagaaataattttcttaaagcaaaaaaaaaaaaaaagattttcgggacaaataaagagaagtaatattgaaaaaaacacgaaaaaaatctgaaaaattggttggaagactcttttttccaacgggtaccccccaaggtcagaaaatcctttaaaatttcaaccaatttcagtcctaaaaattcccaaaaaaattaaaaccttccaacggacggtcaatggacgtgtcgcccttgcccatgattgtcaacatgttgccgagatatgtcacctggaagacggacaaatgtcaatacaaattgaaattgacctatttcgagggtcatattccccctcccccccaaaaaaaaaattagaatttttcggtaacaaatggcaaaatctaatgataacgaaaaactgcaaccagatccgttgaaaaattgggcacatcccttccaaggccttaattttcccaagtttaggattttaggaacgtggttgctgtcagttttattaacgttgatcaaatggcagagattcgaactaagcctttagacagtcaactcaaacaaaaagtttttttccccaaaatttgtccccaaaaattttctaataaaaatttacaaacttgatgcgttggagaaagggtgtatattcggtgagggactttgggatttgctggggttcgggttgagattttggggtcaaggaaagatttacttaattttcaacaccactttactgacaaggaattagagaataaggtgaattgcaattagaaactcaaacaacagtaccaattaagcctttgggcgtttgttgttgttggatgacagtccacggagaaaagcaccaaatttttgtagttttattacaatgattcaaaagcacaaaatatataaaaacttgagagaacacgaagacaaagacgaagaccaaaaggaaaattaaatgaaggatgcaaaaatattttaaattaacgcgaaaaacaatcgttgcaaaaaacaataaaataaggataaatcattatttatcctacgtcccccgccgtttgaagaccagtgtcctcacggtctgatcgccgcgcacctcccccggatcagcgaaagacgagcgcctgcgagatggtgtcggtcgaggcggtccagcagtgaaattgtcacaatggaaaaacattctgaaaaaataaaaaaggggatgattgtggggggggggggtgatcagaattgtggcaacggatttcggccaattggagaaaaatataaaaagaacaataaaaatgcaataggccatgtatgagaataacattatggtccgaagctgaagaaataataacaaaataagtaaatttaagtcattgcgagccgcttttccacattttaaattcttataataacgaactgggggcatttacaaggataggcgaatttttgatcaaaaatgggcgagagaatttaattgataataggcttgggagaagaattttttggctattgcttggttggcgaaaaacatttttgtacttggaattaacaaaaacacgtcgtcgtcgttcccgtttggtctgtttttgatccaaatcctcatttttatgacggattgcattaatggctaatttgattggtgggctcgggatctttttggggattttttgaagtttgacaaagggggtttgatcggttttgttggaagcaatctttgaattggatgaaaccttttgaatgaattttatgcgtttgacaggggaaattgatttaatcacttcgttggaaatgattctcgattgtatggggcgcggtacaatttttagggaggagattcgaccagagtttggcaatgaattattcgaatgttttggactctcaccgaaattaattatttcatttgtaattacatttccgatgtaatatccaagagaacttaacgcattttgtccaagaacaaaatcgtaagggaaaggttttttggtgaccacacaattaattttgccttgccaatttcctttttccatcggcacattcagtactccaatcactggtactcttccacccgtaaaagattcgacttcaaaagggatctctgactttcctt

SEQ ID NO: 7991 - DNA, 2959 bp, Heterodera glycines
tgcaaaattccagaaaatgttttatttttttgcggcatctaaatctaaacaaaatcattttttgttacccattttaattacttatttatttttgatgatgaataaatatggtaaacattttgattgtgatgcacatgtaccagggatggcacggaattccgactttctgattcccaaaaaaattataaatttacaaaaaaatttgtgaaaaagaggagcaatttaaacaaataaatttgaagaaattttgcacccaattttgaaaaatttatgtccatattttggccatttatgtccatattttgaccatttttgccatttatgtccatattttgcgatttttggtccatattttatggccacatttcgggattttatatccatataattttacaccctactaattagctgattaaaatgaaatttaatttaaaaaaaccgagatttcattctaaacttttttatttccatttctcgaccaattttgataaaaacaaaaatatattttaatgctcaaatttgagggacaaatttttaactaaagcattaagcagaaagttactaatccaaatttcgattcgaattttgttccggcaccgaaaatgatgatggataatgataaaaacaaataaatgtgaaaatattatcaacaaaaattttttaaacaattttaatgaatcgattaaagtcggcgattggtgtcctggcaatttcttcggcaaagaagcgatcgctgggatggcagaactgctccagtgtgatgtgatcagccgtctccggcacgtagttggccttgcgcagtcgaaaaaggaactcgtggcgacggcgcagtgccgacaacggacagcgcagggcgagcggaaatgccactgaattattttgtggaaaatgtaaaagtgcgataaaattgcataaaatttagttttctaaagaaaaaataatccgaatttcgagatttaaaccgagacagaaaatgaaggcttcaaaatgactaattggctttagaaatcattcatgaatttcaatttgcgttaaatgattttgtcatttgattcccaaaaaaaaatttcgaattaacccaaccattttttttcattttatcttctgtccctcacttcatgcattttatttttgaattgctatttgtcaaggtttaaaaaaaaaataatcggaaagaaaacaaaaaaattggtaacacaaagtcttgccattttatagggacctctatacgaaaaacaaagtcagacaattggaccctagcccctgattttttgtatggcctctcaatacgaacactttctgattgagggttcgtccctctccattccatggataaatatttaaaaaaacatttcaaaaatgtgctcccaccaatctgttcgttggtgatgcgcatcacgtaggccaagtagttgtaggaggtcaacacgtggggcttctccgacagaaacacgcgcgggtctttgagcacaatttgttgcaggcactgctgggtgaagccgcacgtttggttcagcgccaaaatgagaccctggagaaagagcattcgaatggaaataaatttaggaattttttaagcattttggaccccccaaaattacgggtcaatgtcgaaacaacctgtaataattttggatttgtctggcagctaatgtaaaaatttcgcagggcattaaaaactcaaaaattccgttttgtcggtaggcccattcttcacttctgcagtgggcggaaggaaaggaaaaaaggcgtaaacagatgagatagctcggtttgttaaattcgtggtttcttttccaccattttttggactccgtaattggaaacatctccgtaattacgaatgacgggtttatgtaatgagaaattttgccacctggattgggccgacgccaaattggatcagccttggctctttgacaattgccaggcgcagttcgtcggcgcggagatggaactgacgctgcaaccagcccaatctggcaaaaaaaaagaaaaaaaattttaaattgtacgacaaaaattttgtttgaattagagaaacccggaaaacatttccacaataatataaaattaaaaaaatgcgtcggggttcgaacctgcacaaaacaagttaaaaggaacgatgcacaccacttaccacagaacaaaatttcataacgcgaacgggactcgaacccgtgtcaaagtatgggaaaaccaacaacattcaccacttgaccgacttttaaaaaatgttttcggaaactctaagggttcgaacccaaataaaacaggaattttttttgttttgtttttgtaatttaccgggcatcgatacgttcctgcgggatgttcaaccagtagcggtactccacgacaagtttggcaatctgttgccggctgaaccgatggaattggaggtaatcgagccgagcctgaaaaaacgaaatggaaaattaaaaaaaaaaataaatgaaaaatcgtaaacatttcccgcggaaaaaatgaaaaatgcctacaaaattcaataaaacacaccttcaagtcgtcaaatgactgcaggagaaagtacgggttcctggtcaggtacgggccgatgtccgcctcggggaccccgcaacgtttgaccagccaaaagattttcgctttgatgtccctttccgggtccaaccggagcagggcacggccaattttcggcgcttgacaaacctggcaaatttttatattttttaaataaaatttatcgtttatgggagagccataaacagaaataccattcatttaaaaaattctgagtttggcaccaaaagtgcggaatgaatgagccaaaatgtataatttcaagccaaaatgacaagaaaataggatcagcgatgggtggcgattaatgaagcatttaaacaaaacaaacaataaattttaaatttgttagaaacaaattgtcaattctttcccctttaaaagtttttcattttgt

SEQ ID NO: 7992 - DNA, 3076 bp, Heterodera glycines
tttcaaagaaactccggccccctccctccaatgggctctattttcctattataatctgaacgaaatttttgaaaaatgacgcattttatagaatataggtagcccaatttggctcaattttgcacccattttgtgcaacataaaacgttcgactcacttgagtgtgttggtggcaatgttgacgggtcgaaagggtgtggattttccctgaaaaaaaattaaagaaaaatgagtgaagcgaaggagcctgaaaacttagggaggattaattgccatgtaaattgaaaatttatggtaattgttccaaaaaatatatatatatatttttttttttgttcctaggggagggggtggaaattcacaggaatttgttttctaaatcactcgcctcgacggcggttggccaaggtcacttttgtccagctcgccctccgtgtacaaaattgggcggaatcggttgatcggtcgagaagccgtctcatcgccggtctccatctcggagatgtcgggctaaaaacagaaaaatcaaaaaaaaaaatttgttgtttgatcaaaaaataattttttagggagcggggggggggggggggattttcaaattcgcaccaattttcgttgcaaggaaaggctcggaaacggatgactcggttggttaaattgtttgtttttattggagattcaaatccaccaatttttcggtggtcgtagaattttaatatgacagggaatgaatgaacgaaaagaatgaccaagtggtctttttgtaggggagaagtccgggttcaagaccaccagcctgtaaagttttctttaaatatgaatccaaaaacaaaaaaattcaaaacttttgtcaaagtcagccaaattaaagattcttagtgtcacatacaatagcccttacaaattaaggttctttctctatgtaggcgcaaaattcaagaaaattttatcatgttttattggaagcaatttttcacaccttttcggtcttaaattgtttgaaacatgataaaaaaaatttgagatctccgaaatttatagggtttcacatgcccttgccatggctgactgacctcgttgagcgggtccgccaccatgtcaacgccgagcacatcaccctcctcgtccaacttgtccgcatgatgttcaagcagttcgtccagctgacgctcaaccatttcaaaatgggcccagtcctcccgggcagccaattggtcggccgattcgtcgtcagcgtgggccttcaaaatacagaatttagtcaaaaatttttaatttaatgcatttcttggattctaaaatttataccagtggcgccgaaaaaacgcgaaaaaaagtttaacgtatgtggttcagttggtaaaactcttgtcttgggatgggcctggccgggttcaaacccaccagcctttcaaatatattttttaatggatttgacttcagcctgtgccattctacttatttttggtgaacgacttggaaaggtcgacgattttttcagctttcaacatcccatgtgccaaaaagttcatttttgttgacccaacccagttcgacttgaacagattgtggtacggaaatgactgaccagccgtgccatccgccgattgttgcccatttgcaatttggcatttttcaacggttgttgttgtacttgttgagcctgtttttgttgctgttcgccttggtgttgtgcggttgattgttttttggctccaaccgttgcgaaagcggcggcggtggcacgaaataatggacaaaacaatgccgacgacgacgatggtgaaaatgagggacgacgacaacggagcaatagcaattggtggccaaatgcttggctcattttgataacaaatatatatattgtctgaaaattggatttaaatgggtcatttaatgaaaaagtgacgaaaaaattgtccaatttaatgagttgtgtttatctgcgggccaaacctgtgcggtttacaaaaatgcactaccattccatcggatttgaggtcaaatgttcacaaaactaaggttcgaattttctatcatccgccttcgaaaatgatggaaaaatgcggctttattaatccacaaaaattccgcttttgttcttcaaattagaatatgtaatataacctgctgacagcgctccacaacaaaaaaaaaggcaaaaatatatttgtaactgacaaaaatgatatcataaaatgaatcaaaccaaatttgtctaaaattttatgtatcaatagcttgaagaaattggtcaaacaaagaaaaacggcggataatggcgacgatttgagggtaaacggggcaaaggcgctctaattgttgtgaacacaacaaacgaaacaatcaaaaaatggaaaaaagcaacaaaaagtgatcgaaatcaatcagtgctgatcaagaaaattgcgctctctgatcgaccaatttgatcaaaatcaatcatttcagctgggccgtccaccgagcagcaactgttgctgttgtttcaactgtgccttctccacatcttgcaactccttgtccacaatgtacggcatcaccatgagcagcgcgctggtcgacaacacccaagcagcactgcgtgcaaaagagaactggcaaaaaaaaaaattctatcgaaaaagtcggttttttggatttattgaaatttgcgcggtccaaaaatttacagagtaaaaatttaaaaaaattttcaagagttgaaaaattctgttgttgtcatttttaaatgaatttttttttgtttagattgtaaaggctaacatagtagagaataaagctaggctaggctattgaatgttcccaagaataaattatggcatacattgaaataagcgtgaatctttgcagtcatggaaaatttgaaaatttcaaaaaaaaattattgggggatggaagcttcactcttttttcgcgaaatcggtaccctgaaattaaaaaaaccccaaaatccaaccgaattctgcgctaccacccatgtcaattgcacagtggtggacaacgcagagcgcaccggtgtcggaaacatttccttgagcccctcaaaacgttcgaacgcagtctcctcccaact

SEQ ID NO: 7993 - DNA, 3262 bp, Heterodera glycines
gaaaaaggacgacaacgccaacggggaaatgcgaacgaatgaatgtgaaatgggggggggaggaaaccttttatgggttaaatcgctctcgagaatcggtgaatgaatggctgatcaattttctcccgggctggagcaaaatgctgcggcgcattcttgacaattaaaattgaacggcggcgccgccggcggcatttccattttgaaatttaacagtgattgaaccaaccaattaatgcgtgttgattcctttttttcaagaaattgatcaattatcaagcggcaaatgatgtactcctcgaaattgtcgatatttgatttacttttaaaattaacagtaattgatcaatttattcttttaccaattcttctcagttgtgatcaaactatgaacaatttgcttcaaaaatagattttgaattttctattttaacaaaaatgtcgtttaatgattttaattaaatttaagtgtaaaaatttgaaattagaattacatcattgaaaaaaaaacaattaatattacgtgatcaactttcttttgttatatagcaaaattgaattcaattgaaaattgtgagcattaatcatttctttgcgtaatataattttttgtcaattaaattttctgcaaattgcatttacatcttttttggagtcattttttacgatttccactgatttttaattgctaatcattgtcattaacagattttgttgcaaaaataaataatttcaatcccaaaaactaactcaattttcaattatttattttatttaaaataaaattttcatttatttacaattaaatatttgcattccaagcaatttccgtttaatagaatgaaaaatggatttcccaacaactatttgtcatccatccttcctttttttctaaattattcattcatcagccatttttgttgttgacgttcacattgctgttaaattacaaaaaatttaattgaatttatttattcaaaaaataatttcattttgcttaatggcacactttaaaagcaatttttccttatttggtccttttttccaagacttgcccttaattttaggttttatgtgattgatttcatgagatttctttattttctgtttatgaattttatgattccctctaaatcattaagaatgacttttttgaataaaattatcaaattttggtcattaattgtttgaaaaaaaatattttagccgcttttaaaccgctttgttgaacgcaattaaattttagatgcattaaaatttgaaaaaaaagtaaagggaaagcaaataaattgccgaaaaatgcttcctttccaatatatttaattagaataattcaaatttgaatttgccagatcacagctttgatcaattccattctgcgtttttatatttccaatcacttttcaatcagcgaaagcacaccaaaaacggattaaacactggcattgatcacagtgttcaataacaggttaagcatgaaaattcaattttttcaatcaatttccaatttagcagtatccgatcacaacaacgaacggtgatcacaaattcagctggtcggttagagtgatcagaattcttacaaattagcaacataagagttctaaattttacaaactctttcagatcagtttcaccctgtgactcaaaagcgcgacttcttcatccctttgatcagtgcagttatgaacctaattaaatcctttcaataatttaaattccagttttttgatgtccaattgtggctctgatcaacaaattgatcaacaaaatcgtccattgcacgatcagccgcaaagatacattgacgaggacatcagcttgacagttgaccaaaaatttgagcaagaagcaaaaaagccactaattgaacaggtggggcacttattacaaaaattaataaaaaatttaaaaaatatgtcctggatatcttcttggataaaagggttattcttgaaaacatatccaaattatgaaaattttttacttgttcttattaactttaattcataaaataaacaaattgaattaatttattaatttaatataaacttgggattttgtttttaattttaaaaaagtttttttgacatttaaatctcaatttttataagaaagtccaaactaagaatttaagattgtgcgaatttttgataattctaagtattcagaatgttatcaaaactttaattttgctttccatgtctttaaatttactttaattttttttttatataattaccgcatttctttaatcctttttgtccaaattattttttttttaattttgtataagcaaatctttttcgcgcatctactgttcttttatccattcattttgcagggtcagacaaattcttactcattaaaatattccatttatataaatagaattttaattctattacataattgtcaatttgcgcgacttatttttgattttaatttgcgctttttttggcgttctgctgccatccgtccgtcgttgaaggtcgcgctgccggcgcgttctttgttctttttatgtccatctttcgtaccctcctttttacacaacaaaacattaaaattttgcttgatttgggttctctgttcagcagctccgctgctcgtcaaaaaaaaaaatatttaatttaatttaaaaatattttaaaatgggttaatttttaaattcgtactaaaattttaaatttgcgcaatcactccctaatttgtaagccttcagatatgctgaacttttcttctcttttttcaacgcaaacatttttcattatcatcctaccatattccattacagtatatatcgtaaatatccaaaaagtgaaaaaccaaaaattctcctgtttcctaaaaaagagaaaacattattttccatccctaatttttctcaatcctatcattccacttcttacccacatttccttttctgtggtcaccgtaaatcctattaaaagaattttttctacaaaaatgggtgaaacccattttttcacgcccggacctccccatttttttgtcatcccaattttcccaatcccataaaatgttttttttttctgtttttgtgttccttcttccaccaacatcatcagcagcagtgggcggagggatgagcgagcactgcttcttcttcttcctcttctgctgctcatcccatcacccaccacactttgtgcgcatttaaccgaacggacggacgttttttcgtcttcgtcgattgacgacgacggattttcacttgccccacagtgggggggggggg

SEQ ID NO: 7994 - DNA, 3752 bp, Heterodera glycines
  misc_feature (3584)..(3584): n is a, c, g, or t
  misc_feature (3596)..(3596): n is a, c, g, or t
  misc_feature (3604)..(3604): n is a, c, g, or t
  misc_feature (3621)..(3622): n is a, c, g, or t
  misc_feature (3626)..(3626): n is a, c, g, or t
  misc_feature (3637)..(3637): n is a, c, g, or t
  misc_feature (3675)..(3675): n is a, c, g, or t
  misc_feature (3684)..(3684): n is a, c, g, or t
  misc_feature (3686)..(3686): n is a, c, g, or t
  misc_feature (3689)..(3689): n is a, c, g, or t
gacgttttttcgtcttcgtcgattgtatgacgacggattttcactcggcccccgaggggggagagggcgggggggggggggggagctgagaaaaatttctactaattttatcctgctgtgggtcaggtcgatcgtcgtcgttttcgtcctccgtcgtccgaaaagtcactcatttgtcagccggcggttgatcttcgtcatcataatcattcattttgtcacttcttctccttctttttctgtgttgtgctacctaattttggtggatgcttctgcttaatctctctctctcttcttacttgggataaaatttaatacaatattttgtgctgtttaccattacaaatttttgggcgcaaaattcaaaatttgcaatttggaaaatactttaaaaatttgtttttactttttcatattttaatatttagcaaatgcttattaaaatagttttccctttgaatttgggtaataaaaattccaaaatttggcaaattctgcaaaatatttatgcgttccgtttttacccatgtatatttgggaaattcataaaaattttgagtttggcaaaaattggatttccatacaaaaccaatattctaggattttaatttaaagcagctaatttttggaaatttaaaaaactcttgattgaaatcttatgcaaaattcccaatcaaaaattgtttctcgcttttaaaagtaattttttcagatagttttttaaatttttgtagtcaatcagtttgacgaattggctcaattgatcaatgaaacaatacaataataattcataaagtaatcaaatggtcggttcattgaacaaccatttattttcaatttcttcattatcgatattactgatcgagaagccaaccgatcatttatttctctttctctctctcataagtatcaacacatattttgcatctccgatactccccgtctgaacattttttttaaaacagcaaaatctcgggcagataacaaaaacgattaaaaaatatctataataaaaaaaaatttaaaaattcaaaattcttgcgccgatcaaatctttaaagaaagaccattcacatattttttgtcgagccgagattttgtcttgtttcagatcgacacccctcctctaagcaagttataagcgactggaaaatggaaaactccatgaaattcaacggtccaagtaattaccatttccgacccattttagaaaaaccggtaattaatcggtagcggtaaatcaaaatcttaatttttttctcggcgtttactatcggcaccgagagcccaaatttccttagaatttgttatattttttatcaaaaatttaaaggctgttttcacaaaaaaattcacatagattaaaaatcctaaaattttgctgcagagttcgcgttacatcttatgtaaattatttttgtaagtgaaaatttcaaggcattctaaagacaaaaatattgttgtaaaaaccaacattttcttcaccttaaattatattattatatatcgtagaatatataattactgggtaattaatgttttaccgttaccgaaaaattgccgctcccgactccctcaaattacaattttgcttttgtgtatcaattcgttttatcattatcattagcactgactttaatcagtaattttcactcattttttgtaaacttccttatttagaaatatcttttttaaatattttttgtacataaaaatgaaaatgatgatgaggaaaaggaggatgaaggccccttcttgcctatttgtcatcgatagccattccttcacgtggcatcagcctccgctgctggcgaaggtacaaaaatctgtttattttctaaacaatttttacacaacaattctaactcacgtcgaattaaactaatttcacttttaaaaaaatagaagaacagtcttccaaagaaaaaaaaactaaaaattaaattttttaaatttttatattaaaatagagaaagctgagatctatcgaatggcactaagaatatttaaaaaatgcttttgaagaatgttaggaagcataaaatttatcaaagtttataaaaaggcaaacattttgtggcaatgtatttttttttaaagtcgtgtaactgtaataaagccaaaaaaccttgggatcattcaaaatagccctcagatttctcatttacctataaaatttcgaactttgttaccatataagcaatttctggtcataaattccgaaactcgaacacttataacctttaagagttcgacaaaattttgtttatgtatcaattttcacaaaaaaaagtctgaattttaaaattatttgtcctgaatttaaaaaaaaaaatttgcgaaccctgcagaagatgataacaaaattataagttaattagtgaagttttttcttaggctatttttcattttttaaataaatgtcaagcggtggtcagttctctggccaaggaaattcaaaggctcacgcttagctctacctactagctctatatgccggaacattttaagcccttatgaaaaaatctattaaaaatacctcttttcttctactgcttccacttcccccctcattaaaaatcatatccaattgcgcatcctcattattattaatattatcatcatcatcatctttatctccctccaaatccaccatcttttttcctcttccttgtcaccctctcctgctccgttttcatccttctttcgttagtcatcatccaaattttgggatgaattggattttggtaaaaggggggggggggggggggagcgcccggggggcaattgcgcccttttgaagaaatgacgcgaccgcccccgccctgtcggggtgggagacgcgtatgtacgggcacagcacacacaaaacgcattcaacaacaaatcatattgcgcagcggcagatgggggcgcggggatgtggcggcggcaaatttgagacgacacataacgccagaattatataacaaaaaaaataattggagacagtttgaatgttgtggtggggggatgaccactaaaagtagcgcagatgtcatctccaaacattttgacacagaaaatggcaccaaattttcaaaatgaaaatttttttagtccttcttttttgatcattatgggatttatgcggtaccaatgaatttaattggagaattttggcatccattttgaaaaaaataatgtgtatatattttgcatattttgtataggtatgttaatttggggattttcccaaaaattccaagaatgtcacctttacattaaaaaaaagaacttttcctgttggctaaaaaagtcggaaagttatttaaaaaaggcaaatcatttttggatttttatatttaaattttggattttaaaaatttaaaattaattaataagaaattttattctgtgtttgaagaatttaggtgtaggtgctttttggattaaaaaataaattaattatagttaaataattaatttttacattatgtatacgcattttgcatattttgaagacctctttcatcttcaattcattaggcaatatagaatttgccctagaaactcaataaaacttccaaattttgagtttaggngatgaaattttnaatttttnaaactttaatccttcgnnaatnttttttctttnaaaagaaattctcaaaaaattcaaaatactaaaagacntcaaaatantnacntacataatatcctacctagtgtagtaaaataaaacattttcggactaaaaatatgcttttcgt

SEQ ID NO: 7995 - DNA, 7198 bp, Heterodera glycines
  misc_feature (6301)..(6301): n is a, c, g, or t
  misc_feature (6369)..(6369): n is a, c, g, or t
acgtattataggaccaaagtattcaagacatacattcgtcctcttttagaatatgcgcccgaaatttggaatccgacatacaaaaaagatataaataaattggaaagatgccaaaaatattttacaaaaattgctttatttaaatgtaggcttccgtatataccttacgaacaaagacttgatttattcaaacttcaaactttagaagaaaggagaaaaacaattgatttagttcaggcattcaaaatcatcaatggtctcactcatcttaaaaaagacatattcccccaattttctggtcacatcccttacaatcttagacgtaaagttgtgttaaaaccacaatacagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctgaataataaaacctgcaatgaatgccgtgcgcaaaagtgccgaactgctcgtccgaatcacatcaaaagcaccgccgcatcgtgagtcaatctcggcacagaggcgcagaaagcccgtgccaggctcccacaattcaatggcttgcgccatggcctgaagccttgtagaaatttcattcccaattactttttcaacgcccacccatagcaaatcgttcaccgccactgtgaattgccgcttaacttcgttattagtctcaattccgaggccaattcgattcagcccatcggcgaatgtctgaaaagtgagtctttcgtgttttgtccatcttcgaatatcacttgaatgccgccttcccggactgatgcccccagggcatccattcggcacttcgcctccaacaaattttgccattgcgagcggacagtgtccatctctttgccggtcacacaatgggccaaataattgtggcgttggacggcgagaccgaaggccaaattggactccattttggcccaaagcttaaaaaatttatttattaaaatttaaattaaataattggcgaagagactgtccctcccgtcaaactaacttggtcccagtcctgctccaattcgtcgttaatttgttcattcgttcccaccacacattcgtcaagtgacagcaaaaactcttcgcgcatcatctacagaaagtaaaatcatttttactgattcttgtcaaatttttcaatgtttttctgtaaagacaccctttttatcttatggtacccgaataccgtaatttcccaaccttaaaatgcgtttcgttggcatcgtagaaaaagtgattggcgcccaattcctgcagaatttgacaaagtgaaggctcgtcgtccacattgtccatgatcagcgtgaaggaggtctgcaacaactcaaacattccaaattcagttttaaattggtttaattgcctgatacgcggcacaaaagtgtcggaacgcggcacttgccaacagttcgtccaacttttgtttggttgtgtcaaagcaacgcgcaaatggccacagggcgcgaaacggggcgtgccggtggagcagtcggagaaacatccgttgcagcacagtcaactgccagtgaatggatcaatgaatgattggacccgccaaccaatcaaatgccaattgccctttgatgccatgcttttcctcctcccccgcccctcccattcacctgcatgttctgcttgtgcagctgcatccaatgcgcccgtgccgcttgcatcggcacaaattgcgacaattcgtcgtcgacttccgtctgatcagcatctgactgaaccattaaccaaatcaaagacaaagtgttaatttgatcagtgccggaatggaattataaatgatttttatcactggtaaagattctttccttgccgtaaattaatcgcttttattttggcttttgaccacatgcctccgttccgccggtgtgccgtggcgtcgtgctgctgcgccgccgactaacagatgtcgcgccggacgatgcttcgatggcgccgataacggcgggagtcggaagcggtcggttgggccccgacgctggtaacgcgtcgtcctcctccgcttcgtacgcgcccatcggcggaagagtgacggaagagaaggacgagtcggtgaaggaacggagacgggcaaacgcaggcggtgcctgccgtaaaatgccaaaaaaatgaaaagaattctttttcttactttggcattccatcggtcgccactcgtctccgccgcccattggacgggcgaaatcgacgctgacggggtcgaattgttgtcaatcgaatgcgcggaggaggaactcccgacaatgttggcgttgcctatgtcccgatcgctgatcaacgcggtggacggcgtctcgcgacccgccgccgacgagcggggaaaaatttgctaaggagggaaaggagggcataaaattaataattttttcattgattttttccctttttgaataattttatttatttttatttgcaaagcaaatatcactttgcttataaatttctcacctctaactgatattgatggtacatttcctaattaattaattaattcatattaattgggcattttttgtccaagggaatgataaaaactctctcagacataaaatgctttcggtcaatgtgagaaaaaaattaattgcgccaaagagacggatttatttggcagtgccattcgcttctcatccgttccaaacacccggcacccaatggggtgggcggatgtccattagtggcggcgatgccgtaaattcgcgcaatggcaaaaagtaaaaaaaaaagagtgacacgggaaaacattttcaaaattaattaaaaacagaaacaaacgcaaaaacgaaagatgaaaaaattctttatataataaaaaattaattaataagcacataaataccaaaagacataaaaccgtaattacagtaaatacaaaaaaaaaagaaaaaggggcaattaaaaagaaacgaaatgacaaaagggaaagagggaaagggagaaaagaatgacccgtaattagaaggtgtctttgaatttgcggatttaagccaaaaaaaataataactaaattgtcggtgtcaccaattaacaaatttcatccctcggggcaaactctcggcgagcgaaaacggagatcagcagaagcgacttggacctgctgaaaagaaaataaaattaattaactaattattttgctaaacagctcctctctaaattagctgcagaatggggcttattgagtgggaaaaagtttattttttgtaagcattcttttagccggctctgcctttgttttattttaatcatttaaatcggtaatatctgaatgaatgcacttttgacccgtgcctgatcaaaaaccgatcagataaggctatttttgcgtgtcccacaacacctttctccaccttcgccagcaccggtggccgccgatgcatccgtctgctgctgctgccgttcggccggatttacttctcggactcgacttcgcttcctcggcttttccacgctaccgtatcccccagtctgtaccaccgtagcgtcggccctgttgctgtctaccgtatgctcatccgccgattgattgaccgatgacaccgatgttgaggaggaggaggaggaagaagaagcattgtctggaacaaacaccataaaatataagacccaaattgaaaatgatgattgaattgtcaaaaattaatttatttcaaaaaatactgtattttccactaaaactgtgggaaaacaaaaagaaaaacagaccaacgcccaccccattgcatgttatcactttatctttctgtatggtaatcaccatattttggggattcttttatactttcaccaattgtttctgtgccatggctacaatattggaaatgacaacctttctccattgatataattttaataaaaattaaatgtttaaaaatcatattcaaaataaaatttaaaaaaatatccatcatttctcggcatgctaattcattttaggagaaataatttaaaaataaataaatatatgtatttttttgttgcatagctgaaagccgcccctccattttaagcatttggttttttgtaaaaagaaaaaatcaattaaaattactcaaaaaatatatccaaatccgtcgcggtttcacgggggggggggggtcaaaatttggaacacggacccatcataaatttgctcatttgtcaaatgtccttgatcttcggaatggaaaaagggtcgaccgcgaagcgatgacccaaaaaacagaaaaagcaattagaacgctgaaaacggcgataattaagcgattataatgcgccaaatccctaaggctgtccccccggtgggtgcctatttaagcggaacgatttgtcagcaataatcagtttcaaaaggaagaaaaattcggatttaatcctttcgctctttcttttgtcaaatttaaatgatcagacttattttacctgctgtcgaaattacttttccaagatttgcttttaggattaaaaaaacacaaaatgaaccgtctgtctgtctgcaccctcctctgtctgctcattctctccgccaatgcacagtattactacaacagctattactatcccagctataattacggctatggtggctactattatcccaacaactacggttatggcagcaattacaatggctatgggaataattactatgggtacggtggctatggcaactactacggtaactacaacagaggctactccggctactcaggctatggtagagcgataaattaacgatttggatttaatttaatcacctattgggtgtttttatttttaataaagccaaaaagaatgggtctgtccacaatatttcccgttttacaggaagttccggtacttacatgcccggcatttattgctcccatgccaaagtgtgcggacggagatgagagaagaaaagcgggaaagagagaagccgaaagtgaagaagacaaataaaaataatcgatatttaattaaatatttgatatatatatatattttttaattaaattttgtcatttcatcacgattcattggttttaattgtaaatgaatttaaatatacgaaaaacagagaatttagctaaagaaaacttcagaaaaattaagaaaaaaaatgaaagaaaaataatgtgcaaataagaaaaataaattcaatcaaataaaagccaaagttaataattggctgataagataaaccagaacattttcgaagctcaggttcagactcaagcaaaaactcggatagagtatcaatcacactttgggtcggataaagccggatttcgggtaattaactctctttttccctggggtgcccttccctcgtgccgttcgcccacctaagcatgaccgcgtgttttgttcgctcccactgttgctgccgtcgctcgcccaccgcctctgctcgttttgttgtgctgcaagtgtttctggcactgccccgtgctctttctcagtgtgccgtgctctctgctgctcttttcgctgctctttcggcttttccctcgccgtgccgaccatttccatgtccaccattgggccgactttgttgctgcttttgttggcatccaataaaacattattctgcgcaaagtctcccaaagtgtgccgcctcaggcgatgctcattttcggcattttcttcttcgggatcgtccgaatcgcattggtggaccgggtcgccgacaccgtacgcaaacgatcggatgataatgggcagaaggaacagaccgtggaacagcccggtggccaccaccaacaccatcgttctgaacgatttgatcagattgtttttggatttctcattgataaaaaaataaaattttaaaagaggaattaacaaattcaatgttttttgtttttattttgtcagtctgattcaaaattctgatcaatagggtttggaatcatattataatcacaaaatattaaaagaaataatttaagaaaaatgccaaaatatttaagaaaacattgataaaagtaaaaatatttttgtaattttttattatgatcgatttttttatgtttatgaatgcgacaataaaacgaaatattttggctaaaaattattttttcttgcattctcatcaaaataaagatgcagaaaaaatatttaaatatataaaaattccaacccctaggactcaaactccacctgggcanacatgcgcacaacatgggacgggaccaaaagcatcacaatgatgccgagaaaggtggacactcccgcnctgaacgacgggccacccaattgcgcccagagaatcggaaatgcgctggtcagggtctcgacatctaagggagggcaatggcaattaggaggaaggcgattaattgttaattccgagagataagtgatgagcacctggaccggtacgtccgatagcccacgtgggtggcaaaatcgatgcaaagtccgatgctcatcagaatgttgaccaccgttgtcggatccaaatcggagccccatagggacaaatagccgcagacgccgatgtccatggacacctgacaaaatgatgatagtgagggagccaatgttagccgacagtaattagccaattttccacacactcactgaccagcataaaggacacccaaaagacgatggaagagtcggcgatgaacaaaacgcaaatgaaaatcatggcgagaatggcggtgcccagggaggacaactgagaaagacattagattcataaaaaataaaattaatctaatcgagagagaataaattaaataggcattcgattacttaaaaatccaccgaatttctaaaattaattttctaattccaaccgtcgtgtttttcaactcgagcatttggtcgctgaagaaattgttctcatcaaacacaagggcctcaagaatcgatgtaatttaagcaataaaagtgcccgatttggcacctgaaagtcggagtatcgagcggtgatattgcgccaaatgagcagcagcgaagtgcgcacattccaatccgggattttgaaggcggtggtgaagtaaaatttgtccaccaattccttgccctcctcaaaatggaacaattacaaatgatct

SEQ ID NO: 7996 - DNA, 2207 bp, Heterodera glycines
cgatttggttggagtgtcacgagaataactaaccaacgacattctcgaggggggggggggggacacaatgaatgaatggggaggaatgagtcatccatgtttaggcaatcaaaaaattttattttcattgttagcacccaccaaaatgcaacacacatacacataacatttgtatatgctacccttaccattgcaaaatccaaatattatttatggacataaatttttcaaagtcgaccaaattaaacattcttcgtgtcactctatagctcttaaacttttataatttaaattaggctcgaaagtttcggtttgtgctccctgtgaaaaaaaaaagcttttttctttcactaatggcatcatttgctctgaaaataattatcccttttttattgatttcatttatcaattggcgcataaaatgcaaacataattaaatgtacaagaaacacatgtgtattgatttgacttaatctgccgatttggtggggcatttgcaaagaattaaatttgtatgtgtgagatggaaatcaaaatcacaaattatttaatcacaaatttagatttttctaccaaaaatgccgtttttcttttaaagggtggcaattttaataatttgcctcaccttttttctgcggctttctttaaatcatatttttgactgtttattgaatgaaaccggtgttttaattggttttattacataattccaagtggttttctcattttattaattcgggtcaggcctaaatgctccattttgattaattaattaaccctctaaatgatccaattttagttgaggattaaataatctcaaaattccatcccatttttcataaacattttctaccataattaaattaattatttcactttttagtgccaatctcttaaatatttaaatacaccacattacacagcggcccaattttgggctccaagtacaattatgctggctttttcgtcttagtggtctgtgagttagtcaccaaaaggggggtcccaggttcaagtcctccctatgttgtgtgttaatttcaatttcttcttttaaagaagaaggcagaattattttttcattaataaaagttttcgtgtcaataaaaaatcatattcaaaaagagttggttacgtacaacatcgacaattttatgaaatttttttagcttataacttggtgaatactagagcaaataaaaccattttatgctcattttgaagggaaaattctagagaatattgttagttttatttgatttggccttaaattgcgcacttggctaaaaaagaattaaagtattgaaatgtttgccatgggaaaacattttttccatgtgggtaactttttttgaaattttgtatagacccatattttgtccccctctatcgaatcacagtttattttttagctgtctagtttttaactcgagatcggctcttctatttttacaagggaaaatcccaaaaaaattttaagttttgtaaagttttggcgttctgattactaaataaatagcatgcatacataacgggactgggtcgttttggcgccgacgaataagagccaacgtgagtctttagtataatatcttcctctctagatcggctgagcgaatgatctggagtgaattcggatgccctgcacgcactaaatgcacaccacaaaagccagttttgaactaaaagtaacaaattctattatttattgccagcttgaaattgtgtgtttttttagctttttattataaaaaaagttagataacttttggaaagtcaaatgcaacatattccattaaattcacaaaaaacttgctcatatttatcgaatagtcttttgataaactggtcctaaaatgcttgagtgatccaaaaattaattattgtgctgaattcgctaaaaataaattgttttcctgtattacattgtgtattaatgcctttttcagtcctcaatcatcttgccagcactttcgcacacatcagcaaagaacacgcagacaaacttcaaactttgcagaatgaatgcaaccgtttgaaggaagcgaacgaaaaacagaaggaggaaattggcgaactgcagaaacagctcgacgccattttccaaacagtgcttagccgcgcagttgatgaggaacaacgaggagggggagaaggaggatccgcctgaataattgtccatgtttggatttgttggattgttctgt

SEQ ID NO: 7997 - DNA, 2383 bp, Heterodera glycines
taacagttacataattaaataaacaaaataaaattgcaaacgatgtgttgtccgacataattataggcaggaaagcggggccagaggggggggtctgacctggaatttttttttcagacatgaatttaaatatgaaaaaacccaatggggattaggctctgacactgctgctcgactcgagaattctggggtttctcagtctcgagtccgaggaggacgctcggctctattgtagtttacagggccataaaaaaagaacgatcataaaattctgataattttaatgcaaccttaacttttataaaaaccatccaaattaaacattcttgattcatttgatagcctgaagagtcctctaatagcctgtaaaattccaaagaatttcgttcgttttcaaaaaagttgtgagcaggattattaacatttgttgggtaatacaatagatggtgggccccctttttgggaagttttttgttctaaaagtcgaaaaaacatctcggctttttaaaacaaaacaaaaaatctcttccaaaaagggggcctatttactatctatagtattactaatttttgtttttgttttgtcataatccatgcgctagtttttcagatgatgtttttccaattgtcatcctcagcaccaacatcatcttccgtcgatgggccacagcagttttttcaacatcaccaccaccaccaccaccaccaatttgtcccatcgatctcaccactgttcgacacctccggcaccggcatgttgggcacgttggcggcacccaccactgcctcaatcttcatgccgtccttgttcggcggctgcggcggggccgccgccggtgatggcaccatcaccgccgctggctcgctgatgcaaagtttgttgagcgcggcagtctgcagcggcgcattcccgttggtcggcacgactgttgcagcctcaccgctgactgctaccacctctcaacatcgaaaattgttcataggcgggctcagccatgagacgacggatgaacaggtgcaaaaacaaaatgaatgacggaaatgggctgagacagacggacaggtggttgggtgccattggcaccgcccgcaaaaacttacggggcgcgggtcccaggcgtttgttgtgtctctatgccaatgaatgtgccaatggcacacagtccatccatttcattaactattcggccaatcaaaatggattggtaaattgtatggttagggacccgtacttgaaaaaggagaggaatttgtagacctaaattttgtaaaaaaaataatttgttttttttactccatttcagttacgtgattactactccaaatggggcaaagtcattgactgcattgtgatcaggtagctgaaaaatgattggactggtctaatgagacacagctatcgaatatttcggatttttttaatttgttaaaaaaatgtgttgggtaccctttcgaaccggaaaactaactaaaaatctcaagggaacatttttgaaagtcacttcccaagattacttccagggaccctgtgacgaggcaatccagaggctttggctttgtaacatatgcaacaattggttagttttttaattgtattttgttgattttcaacgattttttggacacgaggcatggcacaatacaaaaacagaattttacttttcgaaagggcctaattgtaaaaaattttttcgttggttggtcgtcataaattccattgcttttccagagatggccgactccgcgatggcagaccgtccccacacaatagctggcaaggtttagatctgattttgatcagatcgaccgggaaataggatgggaaataaaaaattattttggtgcctctgcgaaggggggagggggtaaaaaaagatttgtttttttttgaaaatatatctctgttaaacccaccggtgggattaagtgcatgcgccaatttatataattttatgtatttttacatgagatgggtaattaaaaaccgaatataaatttataaaagacaccgaaccgagccccctccctatttgcaatttttttaatcccccatttttaggtggttgatccaaagcgtgcaattccgcgcgagcaaatgctgcaggcgaccagctgtccacccgcctttctcgacgttgagcccccctccgactgcaaattgtttctttcgggtactttttcaacaaaaaaaatttttttttttgaaaacattttcttattcaagagcaatttggagccaattctttcttttttatataacggataatattgaaattttgatgttcaaatgtttttcaaataccgtttgggtcatatggtttttttcattttatccactgtattgttttggggggggggggtcctttttgcccagtaattatga

SEQ ID NO: 7998 - DNA, 2776 bp, Heterodera glycines
tgtggacattcttcgacactatttgaaacgctttggcgagctggaacaggtggaaattgtcgggcacaccggccacgggttcatcgtgttcgagaagcgggcaagtgccgacaaatgcgtggcgcatggcaaacagcaaatgatcaacgggcgcaaggtcgacattgcgcgggtgagttgttcggaaggggttttggcgggggtcaccagggcaaaattcggacaaaaaaacggaaaatcggggagaggacggctggcgtacgactcacagggcgatatggtatcaggatttgtgtctgtctagggtaatggcacaaagccctggttaccattagagattgacattctgaagaaagcatgtatctggattcgatgttggacctggacctagatctcctggacaacaatccagttccaggaacaaacccagacctgggcgtccattctgttcttccctcccctccgacgggaagggggggggggattttttgctccttaaaacttgcgttgcttttttgcaaaaaaaaaattggccctcaatttttcatgccaagaaataaatccccctatttcagcagcagggtacagcagcacagcatcatcgtcatgtcaagccaaagtcaccaccattgaaatgttgaaccgccgtcttctccctcccccctccccaattcaatttaaatggttaaaactacatacatacatatatatacatataaataaaaataaaacattattattcttctaccatttgttgataaatgtttgttttttgcctcctcggttccatgttttgtcctcaaattgttttatttgtattttttttattgtgcacattactcgaaattgttatatgatgtgatcatggcggtattaaaataataagttcttcaaaaaattcattgttttccattttaataggccactttttttgtgaaaatgggttttcatctagagaactaaagcctgaattcttgagaaatttcattagagaatttgaaccggacctaatttgaggatactgatctggttcgattttcgtaatatataaggagtccgggaaaagtcaaggcattatccggtcctgttccgattctactaaaaccaagagaaaactcctattcctaaaataaacaaaaacaaaatggcgcatttttggcgtaatgttcaaatgaaaacctatcccttggctggtggcatattaatctttggactcctattttggaatactaaatatttttgtaatgtttagcttgattcactacccaaaatatatattttacaagaacttagcaaattctttctctcctactaaaagtatgcaacaagtgcacaccgaggacatttcagtcccatggggccaggcgccggacccgcttgaccaacagttcggcaagtggcgtctgtccgtgttccaggatgtgcaagagtcgtgggatgccagcaaactgtactttctgtacgacccggtggctgacgagtcgtgccaaacaacgtcagtcatccatcagccgctgtggcaaaatatattttggaaacagacaaaaagccgaatcggtgaaaaacggacataacgccgcattttcccatataacctctgacaaacaaaagtcggtattttgtccattttagtcgtgtcggggtgttttgtccgtttgatgctttatccatgcaccgtaaccattttttaaatttaattctttagtggcggcagaaaagcgatgacctgccttgccgtttttgacactaatcggaaatgctttgtcggtgaaatcccactccgagttcaaggtgaggagggtatttcaggaattttagacgacacaaacaaattgcggcaaacggaatttgaggcctcaaaatgggaaattgttatgacctttaaaatcgcgaaaattcggattccgagtgccgagagatttttaaaatgaatttggaaatctgcggaattccatttcatccacggaaatttcaaccaaaaaaaagacaaccgaacatttttgggtactttttcactttacgccacataaaatttttttttcgttattttttgtttttcttgtgttttcggagtcactgatcacgaatatgacattcatttcgaacaattacgaaacccggacccgaattcgaacaaaaagtcgaaaatcaaaattttcaaaattctcacttctgttctaaaaccgatgaaaacaagataaatttagtcgcagaccattaacgggtgtcattttagggatcagcatccctgaaaaccccctggagctttaattttaagccttaaagcaaaatcgacaaattattatttttttggctatttgatgcgcttgttttgaacattggacaatgtgtacctaaatgggaattgagcccaaaattagcgcacgacagggggaggaggaggaccatgtgaaggtgtgaatttgtttcggttttttgccattttccattctctcccccactctttttgtttcccataggttgcggtccgttgtcgtcccttaagccaacaggaacaccagcaaggacaccgggccattgtgcagacggatgagcacggaaaatgtgtcgctgtggcccacccggacaaccaaaatgttagaaaaaagtgcattttgtaagaaaaaattaaaaaaattccaaatctgacagcaaccccagaagtgctatttgttcgacgaactgttcggccccaacgcgactcaagcgaccgtttacaattcgttgtgccctgggagggtggaaaatgtgcttaggggttacaatggtatgttga

SEQ ID NO: 7999 - DNA, 2402 bp, Heterodera glycines
cgaaaatccacaaaattaggtattttttagtgaaaatctactaaaactagggtcaaaattatcaatttttcttcccccggcggcgcatatcggcactggacaatcagaaatataacacttgaacattttaagcgtattttgaataaattttgtaaataagaggctttttgacccaaaatgaggcttttttgcctgctaaactggggccctgcttttatagcccaaaatgttctctattatcctacaattcagaaacataagtcgcagatacataatttaaaacaaaaagtattagggcttccttttttatgtaagaaatatcgcgaaatatgtaaataaaatatgtattaaaaatactaaaatataggcaattatgaagaatgggggtcctatatttttcaaaaaaattttttaaaagttatctaaaacaactttttatgaggttttcgggagcgctgatcatgcatatgatatccatttcgacctattttgaaccccggacccgaactcgaacaaaagtcgaaaactaatttttcacaaaatccaactttattgtctaaaccgattcaaaatcagcacccccgaaaaccttaaccgatttttagggatacatttcaaaaaaaaatttttcacaagaaatttctacaaattctgaaaactatattaaaaaaactaaaaaatgtatgaaaattactaaatttgggttttttgaggcattcgaatttgtaaaaatatgtaaataaagtcaatacctttgttcccaaacacaaaaaagaagtgattttgctactaattaggttatggagaatcgaagaaaaaaatatggatttacataaaaaaaggaagctctagtaagtactaataatttgaacagccgtgagagaaggtgaaggagagataaggtcggggttcgggatttttcaatttttaccttatgcctaatagtcaaaattttttaaatattttttcggaaataatatttattaattccataataatatttgtattgtttttatatttttttatttcttttttatcagaaattttgtatagaattaatttttttttcttgaaattttaaaatttattacttttttgttttccaaaacatcttttttcacggcgctcttttctaaagacttttagggagaaagggtacggcgtccggcggtgccgataggcgccgctgggaaaaatttggtatatctgttaacagatttgtccaaaatatgctaaatttttgcgattttgagccaatttttttaattaggtttatgaatttttgggcacggtgatgacgataggcagcgccagacaaattttggaattaagctctattttctaagatttttccccaaaaaaattatgaatttcggtaaatttttgtttttcttcaatatgtattttgtcaaaatatgccaagattggtcgatttctatgagtatttaaaaaaacattttgtcagaaagaaaataattaaagaagaaaacgtcaaacggtatcgaactcacgacagaaagtaatgtcagtgtgatgcactaacctctacacaacattacaaatgcacaaaaatgagcaattttctttatttaataaaaatttggcaaaatggttaaaaaaaaattcaaatttcgtctaacttttttgcattttctcccacgaaaatgccattcttaggggtgtatatttaaccccgaccccgatcggggttaagggtcggggttcggggttgtcggggtatgaagcgtcggggtcggggttttccccgaaaatggccaaaaatgtcggggttcggggtcgggagcggggtcgggggcccaaccctaaattaaattataagtgcagagaaggaaactttgttaaaatttaacaaaatcaataaaaaaccggttaaatcgttgaaacctattgaattggttaacaaaaccaaaaccgagtgactgtttaaacgatgtcaaacctaaacctaaaaccataactaaatcgaaaccaaatatgtgagtttaccaaaacgatgactggaaaataacccgaaccgaaactgagttacataggtttaaaggaagtgaaccgaaaccgagtgactggtcccaaggaagcgaaacctgaaccgaaacccatcgagtgatttaactaattcgaaattgactagaatagacggaccgaaccgaaaccgaaaccaaaacggagtgacaactaaactaaaattgaatggctggtttatatgatccgaaacagagtgacattgtttagtaaaacaaaaccaaattactagtttttcaagcgaactgaaaacagagtaggtaaatgagtttgccaaactgaaaacaagtgactggtttaaatgatgctaaacctcaatcgaaatccattgaatgctataactaaatcgaaaccgaata

SEQ ID NO: 8000 - DNA, 3535 bp, Heterodera glycines
atctgaaacagagtgacatagatttactaaactgaaattgaagaatgttttaaactagcaaaaaccgggtaaagtgtttaccagactaaaatcgaatgactagtttaaactatgccaaacctaaaccagaacgaaattgtaaccgataaatgggtttaccacaccgagtgacttgaataaataaaccgaaacccgaaccgagtgacatacctaggtttacctgcagaccgaaagtgaatgactggaataaacgaaccgcaaaagtgttacaaaggttaactaaaccaaaacgaatgactggttttttataacaaaccgaaaccgagtaaatgggtttgccaaactgaaaccgagtgactggtttaaataatactaaacctcaaccgaaatccattgaatgctataactaaatcgaaaccgaataaataggtttaccaaacttaaactgaatgactggtttaaacaaacgaaacgaagtgatattctgtatgttaacgaagccgaaccgtcctattgaatagtaaccagtgtttgttttaaataggtcaaaaccgagtaaatggatttagcaaaccgaaagcaaagtgattatttatacacgaaatcaatagataaaattttcaacaattaataaattcttaaattaataatttagctatttttatttttagcttaagttcatcaacttagattttcccgatgctgacttttgtcatatatttatttaaaaagacaaaattggataatcggagatattcatggtcaaaaagtggtattatttaatgggatatttcattttaaatctgattaattttcggtcatcaactatcaatgcccatttggttggtccaacatttgtgacattgggaacagtaaaggcgagtcaattgctccaccgccacagcacactccgccaaggttcaaatccgaacgcttaaaattgaaagaatagttcgcattttgttttaagcatatttaaagttaggttgcttaatttttaaagattagttttagaagcattaatttatttgttaaaagatatttttaattttgttaatataattttttaaattttttatataaaaatatttttcatttttataattacaattaacgaattgatttataatatataataattagggctccaatttataggcactaaaaaccgctaaaataggtagtgtttaggctctaaaaagtctcaaatttaggtgtgtaaaatggaaatttattcaaatggtaaaaaaataagtcaaatcagtattgcgttgcattattttttttaaattcaaaaaattgtccaaaaaattttttaaagacgatttttgagaaaattttcattgcttaggcgatttattttcagaaatttttgaatctctgcttaggggtgtatttttaaattccaaaaaatcgattcttaggggtgtatttttttgtttttattgcatttttgttaacaaattttcggcaaaacgccaaaataggcaaaaataggctttttcaaaattttttaggctttttaggcgctaaaaataaaagcctagaaaataggcactaataactcgaaaagtagcttaacaacagcccaaaaaagcatgtttttcgtacgtttcaggccacggggagctcaggaaaaaatagccttttgcctaaaaattggagccctaataataatataactctattcaactgactttgcttcgaattgtgtgcccatcgaatgcgttgtgcaaaattcggccgttcgactggtcaccgatcagtgagccgtaaatgcccatttcgctcacaacatcctccaactcagccggctttgcttctcgcatcaaataattctttaaaataaaaataaactaataatgggtcgtttcataattatttttcaacctataaaaagtatgccaaattttaaaagtaaaaacaaattatttgtatttggtatcattcggtgcagaataccgaatttgaatcaaatgaagctaattttaactcaaatagttaaaatttaaaaaagttattgccaaagaaataataaaaccaaagattgacataatcaccgttttttaggatgcaaataattatgagataaactaataatagctttatttaacttaattttttttcttaaaattatttaacagattccgattttttaaaattattttcaatttaaaaatcacaaatttatatcttttgttcaccttgaccactaacggtttgattctctgttgaagaatgtatgctcctcggtcctctgtgctcatctgttgcagcatttcggccagctgatcgtcaaaaaagttgccaagtccggcctccatttgcgatttgagcacataattgccatgcgaacgaatagcatccttaaaatgaaaatttttttatttcaaaagatgaccaaatttttctcaaatttcgtatgctaatacagagaaaatctgggctatcaacgctaccaagaatgcaaatagattgcttttaagcattgtcatgccattttttgtcgaaaaaaggctgctaaaattgcggattttacgaaacgacccaacacgtaggtacggtacaaaaaaattaaattacgaaaattaaatgaagatttatttgtttttggcacatttcactacctcaatcacttctcgggtcgcctcgtcttcaacctcaaggccccacagtccggtgaatgtgctgcggatcagtgccacacgtttcggatcgttgggaaagaagcgttccaccatgccaggcttggccaacacctaaattatatttaaagatatatttaaacatttattaaatgatttgttaatttgacaattttaaattttttgtttgaatgggatgaaattagagtattttttgaaaaattaatttggctggacctgctgaattttcttggtgctgctcaggtggaagcgaatgtttggcgacaaaatggcatttgatcgctcgatcgttgtccgtgccgtccattcgtgctccgttgggtactcatgcggcacattgccatcagcaatgtgcaccaatgccacacgttttgtgccgtccaaatacaatgaaaagtcgccgctttcgtcaagcgaaattctaaaaataaataaagaaaatacttaaaaattatttaaaatattttaagtgtattaattcaaaaatatttttaattcaacatttttatgttgttttaaaaaatcatttaattggactggtaaattaattttgatgcaaactttacacttaatataaattttatattatcgtatttcctaaaatagatcctgagtctttattttgcaacccccctaaaattaataaaactggtcttcgaccttttcgatgcttcggtcagcgaaagcaccaacaccttcacaaaattgccttgttgtttgcctaacttttccacttcaaactgaatgaattgcagctgctcaaaatgcgtgatgttcggcgtgtccaaaaaaagaagcacagcttttgggtcaccgaacaatttcctttgaataaacaaacaattaacattttattgtttattaattga

SEQ ID NO: 8001 - DNA, 3080 bp, Heterodera glycines
tttcaaaagtgcatacagagcggttggcgccgagaagcggcgcccaagcgctcgtatttatttaacatgttttatcattataatacggtatcacatcgttgtcaaacattaaaaataaacaatttctctattgtatgcatttttcctataataatgcggttatatgacatttgcgcctatgcccacaaatcggtttcaattctaagctttgcaatcacaaatggcatacaatttgggtgcaccccacacgccgctagaaattttcaaaaagaaatttttttttttttagaaatttttcaaaaaacagtataaatttctgatcatttcaaaaattcacaaaaaaaagcatcgtgttaaatcgcattctttcagaactttactattaatgctgatttgtgattgggaaaactataagttttaaatcatttttgtgcataggtgcaaatgttggggcacgagtaataatgttcataaaaattgaataaaatattttccgttcgatcgcaaattaaaggaccaaaaaggaaagagacggaagacaaaaaagacaacaagcgaaaggagcatttgccaagaacaatggaattaattattgggacaaattgacattagtgaaaaagcagcagtctccccgtagtttaagaaagaatacatatggtattatgaagagggcccggcggatttttaggtgcagaaatcggaaattgaaccctaaaaagtgaaatgttgaaaacccacctaaaatgggtactaaaattgatgaactaaaattgatgaagaatgggaaaagcgttcaaaaaatagtcgtcaatttcggcaaaaatttcagtgtttttttttgttgagaaaatgggtgttaaagcgccgaaacaggcttcaagtatttccaaattgctctaatttaaaaaaatgggcgaagaatcgtatgaataatatacgtgcttttcttgtaaaatgctatcaccaataaatagttaaaacctaaaaatccgaggcctgcattaattatgaaaaaaggaagtgacccatcaacaaatgcacaaattttcattcccttcccccaacagccatagatggatgaacaaaaagtcatgaaatcaatcaaatgttgaacagttcgccttggcattccacacatcccgtgcagtgaatctgtgcttggttcgccgccatgcaagtggcttgtctgctgatcgcctaaattcaaagatggaaaatatgctcaccaaaccaatgcaaagacaaatataaaaaaaaatcaaaaactgtatctttcggcaagagcaccgaaaattacggtacaccccaaaacacagccgggaataaatgtaaaaaattttgaaacaaagtcagtaatttctccttaaatttgcttgtctgctgatcacctaaattcaaagatggaaaatgcaatcactgatcaccaaaaccaatgcaaagacgcgcaaattcaaagaatcaaaaactgatatctctcgccaagtgcaccaaaaataacggtgcattggtcaattaattcatataaaaatttaaaaaaattgaaaattgagtaatttttgtaatatttttttccggcagtaagtaaaactcactaatctttcttaaaaaattgaccctaagtcgcaaaatacctcgctccgttccaaaatgcgcattaagcgatcggccgacaattggtccatcggaggcggatggatttgttgtttttgttggtccgttggatttgcacaatccgagtgctcatcatttccctctgtgatggctgctgaattgcaaagtgttcagtttcgaataaaacgggtcaatgaaggcggaacaggacaaaactccgccgacgaaactctgtttaaaaattttttttaaaaaatttcaaaaaatattccagcgatttttcaaaattcattgaaaatgtattcaagaaaaaatttcctatgattacttcttgaaaatttccgttttgatatttttttccttggcggagtttttgggtgcatcgcaataaagggtcttacagcagttgtccacggacagttttgccgtcgctgttggcaatgttgccgcgttggcatcacttttttgcataatggccaacattgcgttgcgcaactcggtcaaaatggcctaaaaaatggtggcaaaaatgggagtcacaattaatttctcaaaaaatttgtttaacaatttccaatttgttcaagcagttcagaggaaatgctgtgaagaaaatgaaaccaagatataaaaatatttacctcaaaaaaaattagaaaatataaatttgcgaccccccctcgctgcggaccccctcccgccacctcttttacaccggcccccttctgtatgatcataaaattttgaaaaaagcgcataaaaattttatttttttgaattttcctattttttctaatttgcggaggggggactgctccaaaaacgtcaaaatttgcttttgaaaatttcacaaaattttgagacaaaccgtaagctgtgtgttctgctgctggagctgcagcagtgcggcatccttctcggcaatgcgctgctgaatttgggttcgctggaagcggtacaaagcgatgtattcgccgatgctttcattctcggactccaacgcggtcagccagtactccaaccgctcattggtgcgccggtacagcgcattttcacggcacagcgcttccatttgtgtggccaaattgttggtggtggtgccctccttcgcctcctccccctgttgctgatggccaagtgccgtcgtcctctcaatttgcgtcccattttcgccgttgtcgtatggctgttggcgttgttgttcaccaggtgggggaatggcatcagctaatggtgacgaggcgtccacggcgaaatggcgaactgttgatgcgtttgtttctgaacaaagagcatttattaagtgagaaaacaaaaaataaaaattagtaattgatatttggtgccgtagaaaaaaacgggaaatttgccaattttgagaccaagtttttgacaaaaaaaaaatttggtaaattggatccggtggtacggtaaggcgcgccgctgagacagaatttagacaactttag

SEQ ID NO: 8002 - DNA, 2525 bp, Heterodera glycines
gtccctgttttagaacagattttttttgcacaattcgatgatgatgatctccaactctgctcaccaattcgtcctcctcctcgttgttgttggcattcaataattgcttggttaggcgttcaaccgtggccattgcggtcgtccgttcgtcctccttggcggcgctctcgttgatcactgcaatcagtcggtcctgcaactccttcagttggctcttcagctcgacattctgcgcgactgcccgcgaaacggtggccttctcattttgcagttgcgcagcaagcagagaaacgtcctattgacgacattagtttaaaatataataggtattcaattaagaaatttttaatgattattttggtgcaccacaaaaaatggccggataaatagagccatggttttttggggtcccggcatttacatcctatgtccaaaatcggattcaaatgtgaattttttcaagctatgatagctctaattaatgattctttccaattttcagacaaatctctatcacttatttaatgctgtctatgcgatcagggattgaaaagactgattttgaacccaattttggacaaaggcgcaaatgtcgggacacgggctaaatgttgccgggaccaaaagacgctaatggaagacctaacgcactggaaaaaaggaattcattaaaatattcgcagaatttttatagaaaattcattttaagattaggcagcatgtgaattttgttgtttttttgcgaccaatttaagtctaggcgacattttacggcgatattttgtcatattccgcgaatatttaccaaatttacaatttcccgccccccccttacttcgtttattgttgattggatgttctgcaactgttcaagttgggcaattcgagactgagcttcggccaacgactgttgcagctggtcaagactgtgttcctgtgccagaaaaactttaagaaaacaaaaacactcagtttaaatgccgaactgctacaactacaatttatcattcagaattcgaggatttcaaccccgggcaaaaagcgtttaaaaattgtaaattccatttcaaaaaaaaaaacgaataaaaatttgaatcaccccttcccaaaatgtttggcccatattttgtcaaaaaattgccagaaattctcaccttttcttgcaccagctgttcactttcgcacaatttgctcgccaatttttcattttcccccgttaattcctttacgcttttcataagtccgttcatttcgctcaaatgctcagtttccggtagcaaattttgttgtccatccgcagaatttgtcaaattggcattttcatttctgttgttgttgttggacggtggcggtgaattgtcattcaaaagaagtttttgttgcaaaatgcgaaggcgttcctccaacacattgttgaacgactccaattgggcattctgtgccttcacactgtccaactaaatcactcgatttttaatataaatatttgaaattaataataaattgacctgacaaatatttttaaatttaagaataaatttgaatatttatttttggtgccctacgtttatttcctgtaaaatttacagcgatttttgtgaaatttttgaatacacttaataattataatgtatatttttgacaaaaaaaaacaaaaattcgttttgtttcaagaatttttttttaattttttcagatttcttgaaaaatttctatgtttgagaattaaaaaaaaaactttaggttgggaaacgagctgagcccatttatgttcacattttgtacctgttcgacaagtcttttcgcgttggcatttgccagtgaattttcaatttgttgctgttcctggaccaactgcagctgtttttgcaactcgagcaccttattcctgtgccatttcaaatcgtcatcacgcttttgttggatttcttaaaattttcaaatggaattcttgaaaagtttaaatgaaaattactggaattttttttgtgtcattatgccccccttaaaaaaaattatttaaaaaatgttgaaatgcttttagcgatttatttctaagattttttgaatattttttcggagtgtaacgatacgggggaactgatccgggtggggggacgagctgatcctccttggataagctgaaacccaatgaccaaaaagccaaaatccgattatttttttctatctggcggcaaccctggcacatgccttgttgattttgtgagctttcaccaccaccggaactctgttgatgggcaacattttgctggccaatggcatcggcacacttttcgaattccgttgtgttgttggccgtttgtctggtcaattgtttgatgtaaatgtctcgcattgtcagttcgcttcgttgctgttcaatggactgctccaactgcgccttcatcgcgtacagactttttattcgaccctaaaaaattaaaatggtataaataataaaaaatccaataaaatggaaacaaaggggaacaagatgatcgatggatgccaacgaacttgaaaaa

SEQ ID NO: 8003 - DNA, 1510 bp, Heterodera glycines
  misc_feature (26)..(26): n is a, c, g, or t
gaattttggaaaaaaaattcatacanttctggaaaatttctttaggaaaaagatttgacggacagaaagaaacactaaatttgtaactgaatgcaaaagcaaaaatcgagtatcccaaaaagtactgcattccaagggaaaatggttttgataattggtcatttttggaaaattttcctatttacggagaagggattgttggtaaaaatttcaccttgataagtcaatgggaagtaggcgaaatgacaaaaaaaattaaagaaatgtacaaaaaaaggaaacaatgagataatataatatactcaaggctatgtttttctctgccattgaaatgaatccctttaatgaatttgtactttcgtaaattgtgaacattttccgctttttgcctttgctcatccaacttattttaaattcttcctaattctatagaattttcagtgctttttctcattgttttgtctaaaaaggcattttgcaggcaaaagcgaatgcccgagcacttctctacttgaagtacaagcaaactccggacagtgtgaaccctttcccggattactgattgtgcgtgaggatggcatttggactgaccaatgccggacaatgaatgacttcgctaggaaattgtaatgtattgtaatgccgttatgtttcgatgtttatgtgctacggttaaaaataaacaaattcgtgttgttttcactccagttttgtcagtttggctaaattggcgacttttgcctggggacaaacgcccgtcgcagcttctgagcctggaccaatcgttcggcttcgcattggagtttgtgttcgattcggtagccgattttcatctgttccacgcaaaagtcgcccaaggcaatgagtgcgtctcgcaattcgacgcttttccctccgttttccattatcacttcgaccaatgcttggctgaacgactgaaagtagtgccattttagtccattgcttttctcccaattctctggccttccaataagcgcatttgtaagtgacgcccgtgtaactgacgtgccttccgcccaattgctgtcaattaacgggacatgctcaatcggtggttttgcttatgcctttttgcctggagatgtttgctgagagtggtggcatttgtcagatggcccatcaaatggacgagggtcggctcaaaagtctgaaaaacgaatggcaaattcgaaggaagaatgggcgatggaaatgccaattcgaacattggccaattccgtgaacaaagggtgcgttcggagttcaccagcggacaaatccctcagaaagaacaaagtcaaattgcgcgggtcgagttgaaagattcggagcaaaattcgaatctgccgatggatttatcgtcggattgtccgccgcttcaaatcccttcccaaagtgccaaccgcaatttcagtcccttcgttatccgtcgctttcagcgtcgctttccacgccctcctcaccaatccgatttgatgcgggttcaatccccgctgatgttaaacatcgg

SEQ ID NO: 8004 - DNA, 3674 bp, Heterodera glycines
acggcacaatttgtgccgaggaccgaattaatgtacgaattgctgctcgaactgctggagggcgagtgcattccgctgaacaaacaaaaaacagtgtgaagtgtcctccgtttcgctacctctgctccaaactttggctccgattgtgccttaaccatcgttgatcatttgtccgttttcgcctccctttgtctgtcttttgtccacctggtcatttggtgctgctgctgccgtgccaactttgtcgtgccgttcttcgcttttccctgtcctttttcttccgttcgttcttcgccgatgcttcccttcttctcctgctgctgttcaatgtgtgctgttctgttgactcttcgtggtgattttgacccgaatgattcgttccttttcatcgccaacattcgtttcggcatttcttgccccgctgagttggcgttgcccatttttgtgcttttcgctttgtctaatttgggaggggggcaatgccaaaggcaattggcacaactttttggattttcaaataaagaaaattgagagagaaaggggcaaagcattggcaaaagccatcgcatgactctctcccgcagaaggaaacttcggccgactttttgggccgtcgtttccttttcttctcaaaagcccattcattctcatcgcctcccctttttcacattgaccaatcccttgggattttccatcttcccattttttggaagcgaacattttaagggaaaagtgaatgcgtcactctctgcggcattgaatttttaaatttgagagattttgtggaggggggggggagggggatttagggtaatttgctaatttgaccaccctaataatataaagttttgtttgtcgtccaatttatttgtccttttatcttttccgctaattaattcagcccataatccttcggtctttccctttttaccgaaccgaaaaagtttcacatttttatttgttttaacgtttttgaatttattatttaattatcatgaaaatggaaaatttacacatgtgaaaatgagaatatttgaagacaaacagaaaaattaaggcagaaaatgggagcaaaaagaataaatgtacaaaagtgagggagggaaacggtagggggaggaggagtactgtaggaaggggaaaagaaggacccgttgattatggatgagatgggcgaaggggcggaatgggtgccggggaagtgatcagccgatcgatcgatcgattgatcagctaacaaataaaagaaaattcaaatttagcaaaataaaaacgaaacaaaattaaatgaaatgtttgcccggcaccacaaaaatgaactaacggatgacaataagaagagattcaacaaaagtcgatctcctcgtaaatggccgattccctcggcctttgtcggcccaattcattcgccgttgtccgcggcggtgcccttcgttctcccatcgctgacagtgccctttcttccaagtgccgtcgactttgtggtccgattctgaaggtcggctcgcacacataccgcgcgggttcggagttggcactttccgacgacgcgaagagagagcggtggtcgaaaacattctttggttgtgaaattgtcgaaatggaagagacggtgggggaagaagcggaaaaggcggcactgagggagaagagaaaggcgaacagaaagaacagcagcagggcgatgggcacggaaacggaggggaaagcggcggggggacgagaggacgaacagctgcaaaaggaagtgccattggctgcgatggctgtgcctttgtccgtttacttttgtccttttgacacttcctctgctcccatccttctcaagtcctccttcgttggcacttttcccgtttcgttttcatccattttttcctggcaattcgctccccaaaatcccttccgacaaacgcagtgaaatccgtccgccattttttggcaagagcctccgttttggcattgcgttgttcggcattcgtcgacctcttctttttccccacataaaatccctcgccatccgtgcggacaacgacagacgaagccgaaggaactgttcgggtcgacaaggcaagaagcacctgagggatttaagaattaaacattcgatgaacaaagacagaccattttggcacgaattgacgcgacaattctccaaaggttggtcacatatttggccagtccatccgttgggacagagacaaagaaacggaggaacttggcgatgacggaacgaaatgggagaggacgaaaagggggacgacgagggagggggggacgagtcggcacaggaacccccattttgacagggcaaatcggcacaaccggaactcacacggacctaaatgaaagaaaggaaaatggattagaattggaattgcctttgagaacctggcaaaatttgccgaaaaatccccggggacaatcgcaacgaaagccaaccaccgaattggacattaattgctgaacagtggaaagggaaggatcgtttcggataggggaggcgtgagatcaaaccggcacacaaaggcttccgtttcggcacggtctttccccacagccggtcagtctcttctcgcagttccgccccccaaacccaggcgggcattcgcaagtgtaagagccctccgggctgttaaggcaagtcgctccattttggcacggcgtgtggcgggcacagaactccaaatctggcaaattattgatggttgcgagggatctgatcaatcgatcggcttacctttctcacagaattggcctccctttccctcagggcacgcgcaacccccgggcaattgacagaagcccttacaacgaccatttgtgacacactgaagggacagagtcacccaatgataaccaatgccaaataccttctcacaatgggcaccgttgaaccccgggggacaaaggcaaaaaatgccatcggaggaacatttgccaccgttaagacagaaacagggagaagaagaggacgaagggacggaggaggacgagtcgacgcggggcactgatgggggacggatgagtgaggccgaatcggaaaacggactcactttggaaacggtcgcaattcggccctgcccatcctttggcacatcgcttccgtccgtcctccggcgcacattcaaaatggccgatgcgcctctcccattcgttcaattcgcaatgaaattcgcaattgggaccaaaaaaattggcacttaaatggagaattggagcaaatgaatcggaaatgggagaagggattcgcatttgagaccagcggggatttagggcattacagaaacggaccaaaattcagcgatcagcgaaatgccatttaaagaaaagtgccattggcaaatgccaaaaaatcactcatcagaggaccaacaccaacggattactcacccacagcccatccgatagcgaatgtccaacgagaagtttctgcttgagaagggttcgcatgcaccaaaaaattgccaagaaaaaaggccaatggaacgacggacattctcagaacagcggaaaagcactgaaaaaggcaatattaggcaaaagcgaataaagacaaaatgaggaagcatccctcaattcgttcccggcaatttaatttcgtcggattttacgcccaatcggtcgggccctccctttgttcgcctttttattgccccaattgggcctttctttat

SEQ ID NO: 8005 - DNA, 1051 bp, Heterodera glycines
aaagtgcggaagagacagaagagaaacgcagaggaaaagagagggggggaagccacccgaacagcagcaaagtgatgggataatcacttaattgggcataatcccatcgcataatccgccgcccctccgccgcttggagacaatcactcccttcccccccccaaacttttaccctctttgtcgccattttcctctgctgatgacatatttttgcgaagtcgtaaaactttgatgttaaatttaaaatgttgctaaaataaaaataaaataaaaacttttaaaataaattttcgaaaaaagaaagaaccttcgaaaaatgtgcgaattccaaagatagagctttttcttcggcggatgtgaagagaatttgcgcatggcccaattggcattcatttgacgaattgaatggacgagaagaaaggcaaaagtcgagttggatgggatcggagaggggggacgaggaggaaagggcgactcgaaagtgaagaagggcaaaagcatcgcctggggggacgagccaatggaggagcagtagcaggacgggaaggaggggcatggcaacaaagcactgatcaatcacggaaggggcagatcagttaaatggatgaccaatcgataaaacaggctgatcaattgatgaaagtgacccaatgataaaaagggaagagaatcaatcatagaatcatggataataatggcacatttaaacggttggcgagaaacatttgtctaacatttgcgaattggcgggtcatttggtcattcgttcggtggtcgcctcgcctaatgagcaaatagcaattgcacgggggcggtctttgagaatggttttggggttcacaagcaaatacaaagaaaggcgatcctttgcattgacgggacattttctaattgaattggcgggcatttaaattttggagaatttctctaaatttgcccttggcctcctgtaaacactcactcacttcgctaagtcagtcatttgaacatttaaaagggcgggggacaccgacccaaacaaaagacaaaaacggagggggaaaaggggggg

SEQ ID NO: 8006 - DNA, 1208 bp, Heterodera glycines
gcgactcgctgtgcttgcccactgcatttcaactagctggtaatttttatttgtccgacctaatccagaaaaaatcactatctctttttttggaatattttacgtgtcaaagggtgtgcattaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctgggaatttttatttctccggcctaatccagaaaaatcactatctct

SEQ ID NO: 8007 - DNA, 2650 bp, Heterodera glycines
  misc_feature (2492)..(2492): n is a, c, g, or t
  misc_feature (2609)..(2609): n is a, c, g, or t
  misc_feature (2628)..(2628): n is a, c, g, or t
aaaaataattgatttatttaaaattttatttaaaaataaatacaaaacatttacttaaaactttttcatattccggcgaattcccgtggaatttcatcatcaaaatgattgtattcaatacaatctaaaaatatattttatttaataaaaataaaatttatttctttataaaaaaagaagctttgagttgtcaaaaaaaattaaaattatataatataaaaaatgaatctcttctgcattctccaacccatcgatctcttctttttctacacatacttgtttttttcctccgtattattattccacatcgaaattttttttaattttaaacttttagttttttcttactgaccatggccatgataaaatattcaaatggtgttgacgtgacgagacgccaaattcggtacttcatcgaatttttgtcctccggcatgaacaacgaacggggacgggcattcaacgcgaaatcaatgcattgcttctgaatttttatacatcaattgttgaatatttattgcacataaatatgaaaaatatatacataaattttttcaaattagggtaaaatttctcaaatttcttcaaattcgttaaatttaggctaaaaatcttgaaaataagctaaatatggtatgaaaagccatattagaagaaaaaataaaaagtaaatcaaaaatttattaattataaaaaataataaataaaagatagaaaatgttgttccattttttgatatattttggcataaatttccaattaaaaaaaaaaaaaaattgtttttgaatttcggtctttataggtctctaaagaccttaactcctaaaaaaaacttaaggtaggggggaagcataacccggaagtgtcctaatttttgtacatatattgtaaaagaagaatttttggaaacaccaaaaattagggttataatatttttgaatttgctttgcctggtttttgtccaggtcaccctcggacagttcagcttcgccctgttcttggaaagtgatgatgatcaaggcgacaaaaatgttgacgaagaagaacgggaacacgatgaaaaacatcacataaaacagtgccacctccacacgataatacggcgatgggccttaaaaagagtgaaaatgggaatttgtgattggttgtcggttagtctgatcacttccatgattggctctgatcactccgttctctttctcgaagataattttcaagcttgtttacacatttttaattgcattttggtcaatttcgttttgtaattttttgagaaaaaagttttcttttgttatcgttaaaaacagatatcatgctctcataatcattgaccctgaaaacctctggaaacatgtttttcgggtcgtattaaaaagaaaaatttcgtcaaaaaacgaggttcgagataaacattgaaaaaccgaatttcctaaatttgtgtgttaaattattcaaaatattaaaattgaataaaaatgcctttataagcttaaattgataaaaaaaaatatcagaaatttcaaccatacggccatgattttcgcgtttcaatccaaaaaacaaattgggatggtgctgggtcgttacttaaaaaccatcattatgaaaaattttgtcgaaaaattatttataattttgctcgaaagcaaccaaatttttaattcttgatatcatttgatagcactaaatgttctctatcagtctgcaaaatttcaaaaaatttcgttaagtttcaaaaaagttatagctcggggaactcaaaaaacgtgattttcgaacatttttggccataactttttttaaacttaataaaattttttgaaattttacaggctcataaagaacatttagatctatcgaatgatagcaaggattaaaaatttggtctttttagagcaaagttataagcaaaaattttaattatgatggttttttaagtaacgcccattatgatggtttttaagtaatgacatagcaccattgggataataaaaacaatgagataacgaaaacttttcgggttaaaaatgttctttttaccattgtgataatggttcctgaattcaacagatacaggtcatttttcggcaacctgtatcccccacccctcgaaaaaatctttgaaaacattaatgaatcatttattgaatcccccaccttggtcctcatacgtagtgtccatcgaattctgccgaatgcctggccaacctgttgaattttaaatctacttttatccatcatacatagttaagtgttttacaatatttagttgggctgctctcgagattctcggcccctgttctctagtcgagaaatttatctgtgatgttattttgggtcttgatctctttcagcatcaattctaagatttcaattttctgtctcggtttccccaagttactggaaaataatttttgactctcgagcatcttaacgctccctaataattagtcaattaatttttacacataaaaattgcaattttccacgcncaccttcgcttgttgtgaccacaaacagtgtcagcatgggcgttgaattgtgttggtcgtagtataacggacgtaaacgccattctcgttgctcaacacgagggaaataactcttanaaataattaaagtaattanataattatttttgaaaatcaca

SEQ ID NO: 8008 - DNA, 1399 bp, Heterodera glycines
  misc_feature (141)..(141): n is a, c, g, or t
  misc_feature (185)..(185): n is a, c, g, or t
cttgaaacaaaaaatagacgaggagtatgttgaacacattcttaataataatgaatttaaaggattaatggctgtttttttaataacaataccttcaatgaattgaccacacagtcaaaaaccgcctaaaatggggaaatntaaaaattaaaaattaatttaaaaaattaaatttaaaattaatntaaaaattccccaggggctacttttagctttggaatacgtttgatggtcttcaacggtctcaacacgcgcaatactctcaacgatttgattgtactcaaatttttgccggttgccccggcggtgccgctaaaataattttaaaatttaattaaaaaaaaattgtatttaaaaaatttacgaaaatgcgaagccaacaagtgcacacgccaccacaacaccgtccaaaacattccaaaaatcacgacagtatgagcctcgatgcaaaatgacaccctgatcgatcagctaaagaacaaaaaaatatatacatttataaatatttgccggatttcctgaaaaaaaacaaataaaaatagcttttgtacttaattagaatttcagaaaataaaattaagttaattagctaaaatttttgttaccattgccaagattttttttaaaaaagtcacattttacattgaaaacccatcaaaggaagtcaaaaaaaataccaagtttttcagtttttaaaaaaaatttcgtgaaaatgatgcggtgggaaaattaaaaaatcacctctctccacctttttaatgtatttttcatccgatttttggcaaaatttcccgtccgcctactttttttaagtggaatatacatttgtacaatattcaaattggcaataaaatttaataaaattgttaaaaattatttcgtgccttcaacaacatttcacaggcgaaaacaccggtgaagcaatagtcgaagtattgcagaattttgttgcgcggattgtcgtcatcgacggggtcttcggcagctaacgaaatggaagaggcacagatcacagccatgacaacctttgaaaaaaaaatattttgatttttgtaatgattttattttaaattaaaatctaataaatattgtaaaaacaaaataattcaatttaggcggggttccaaaacaatattcaaatggatgatataaaaaacttttttctttttgacaaaactctggaaaattcacgcaattaaaaaaaaatctttgaggggatatcaaaaaggaaaatcgaaattttcatcaaaattttgcatatgttttaaaacactaccatttcaaaatatttggtggccaccacactgtgcacccaacacggaaattgggtttgcggtgccaaatgaacatggacgaatatggcacaatggggctttgggccaccaaatggactctcctc

SEQ ID NO: 8009 - DNA, 1906 bp, Heterodera glycines
acatgacgaaatatgcacaatggcttgggccaccaaatggactctcctcctcgtcacactcttcttctaatcagggacaaaaagaatatagaaatttgggtgcattattatgtccagctccagtatcagtttcctctccacattccccgaaaatctttttaattcgtcataaatttgaaaaaaaaaactataaaattaagatttttcgggaggaaacgatatgcgagggggggggagcggaaggcagagacgagctgctccttaacaatatttttttttgttgttgataaaattaccgtccaattccctggtaaattccccatccggaccagcctccaaatcatgttcatcataatcttaattattttaatttgaaaaaatcgatgagctcatcattcattatttattacccaatgtttccgactcgtcctcaaacattccattggctttttcgtctgcctataacaataggtaaaaatagaataacattaaaaagaatttctataaaattatcgccagccgaaccgtcgcaggacattttttgggccataacttttttctttttcaaccaaattaaacattcttggtattgttcaaaagcacttgataaattctattaatctgtaaaatatgaacatttttgtcatgtaaaaaaaaccagggcaaaaaattttagaaacagagaatttcttttttgagattttggcaaaggattttgacaggtctaataataaacatataagagcgattgcttaattcggtttaacaatgaaaaaagttttgggtcaaaaaaatcgtccggcgaattttttgggttcatcgaaatattcgacctcatctgcagcagttaactcttgcgcattggctaaattatccaccgcaatggccaagaacacgttgagcaaagtgtcttaacgttattatttttttttaaatatttttatattaatgcaaaaatttttaattatttgcaaaatgatcacatttcgattttcgaactgaacggattttggaaataattcgacatattaaattttctttacccaatattttggaccaaaattctcatgattaaccaatttttggttatataataatattaaaaataaaattaaaataagtttttacaattgccgaacagcacgagcacaataaagtacacacagtaaaccattccgccaccgtacacaccgccctgggattcgatggccaagtacatcacctcattccagtcttcaccggtcaaaatctacacaaaaattttgtaatgccaaaaaatccaggaggtccagggaaaagcctggatttcccggatttattatttcactggaccaagattttatttcaagctatcaaaatgcaaaattcggtagaaaatacccattctgacaaattttatttaagaattatgtaataattttaaaaatatttcacttggaatacggtaatcaaagcgattgggaaagtgtcaaaatgagtgtacggatgcatgttctggaaaaaaatattataaaaattattatattttatttaatatttttatttttttaaataaatattatgatattttatattagaaagattttataaatttaaaattcaaatattaaataatttatatattttttttacttgaaaattgaattttccaccaaacaattgcatgccgagcagtgcgaaaataacaatgaacaaaaacaacagaaacagcagtgaaatgatggaacgcattgaatgaagcagtgatcggaccaaatttcgcaaacttaaaaatgctcaaattaattaatttaattaaaaatatataaaaaataatttaaaaaatgtaattggggaaaggggaggcgacgggatggttaatttattttaccaaaattttaaaataaaatttaagcatataaaagca

SEQ ID NO: 8010 - DNA, 1394 bp, Heterodera glycines
gataattttaaattaattggacacgcctttctttggcaaattcaccagagagtacaccaagcaccaaattcagcataaaaaatgagccaagcacaatgagagggataaagtaagcccaattgtaagtgctgcccaatgagtcattcgtctgataatttaatgaaaaaaaaatattaaaattatatttaaaaaaatagatctcgaaagaatcacgcacataatacatgattgttgtccaaccctccatggtaatgcattggaacaccgtgatcatggcaaatgcaatgttgtcaaaggaagttatgccgtagtttggtccaatccattgggctaagcaaatggcacccggctaaacaaaagggaatttcttactaaagcccggaattttgaaaaagtcggattggaatcaagtcgggaaaggattattttgagatcgaaattcaggttttaaaaatttttagggcttcggaattccgcttttcgattttaaaatttttttttgagacgtcggaatttcattcctaacgccatcataccacgtcgcagttgtaggcaccagttgaagacgatttattcgagctaaaattttattaaattttaaatttgttataaaaaaaaaataataataaagcaccaagggaatggcttttcagagaaattcacaatttcgccgaaagaattgtagcaggcggcatgaaaaatgccagaataaaattccttaaaagtaaacataataaataaaaaaatattttttttcattttttaacaagttaaagaaataaagtagggacgagagactgtgggttttggtgagaacagcagataggcttgagtaagacgagggataggcttaaaaatgactgacgcactgaccaatccgatgatggcaaaaatgacaattgcaaacagaaccaacagcccaatttgaagcagtggtgccatcgcacacagaatggatttgagcacaacttgtagacctgagatttgaattttaatgaatatattttatttccaattaaaaccagggctggagacgtaactggattttaaataattagcgaaatacatatccttaattatgggattccaaaatgccctatttatgaattactaatccgtaaacatttattttttcatttatgtccaaatccaaaaaaaaaaacttgttagcatttgaaagttcttagacattagtcatcattttttgacgaaaaatagcaagcactgaaaattttaaaaataacattgggataatttttttacgaatttttggccaaaaaaaattcaaatccccccccccctctgaaaactttttttcctggctttgggccggcctgtcaaatctaaacaatttaattttctcaaataaaaaacgccactcggaatgccgctga

SEQ ID NO: 8011 - DNA, 1071 bp, Heterodera glycines
  misc_feature (1032)..(1032): n is a, c, g, or t
cccctttagatacgatttttcttgcaccaaagaacactacaatttctcattttatatagtaattaataattataataaatatatgtgaagcatgcttaattttaagtataaatataaacttattacctaatttgctttttgatggtattttgaaatgtacactacagatacaggtacacagatacattactttatcaacatgtaaaaatctttaaaaaacccaaattattaaacgattgataaacattatgccaatttatcaaaattcaatgaaatttaacagattatggcggttttcccaaatagcttcgaaaatcctcaaaatttcacaaaaagccacaaaaatcctcaaatcctcattccaataaaaaaatattcattgatctatcaataaaccacaaaatgaggataaatcctcatatctggcagctgattttatttcacttattgcactcaaaaaagttaaacaatgttctattgcttcaatgataatttatttaaatgctgactttatagatttaatttctttaatgtctactaatcacttttcaattgatctgaattggaaaacatttccagcatatccctgttgaataggattgcttatttgaattttataattacaaaacatattttgctacatgtgttttcttttttaaagataattttaataatttttagcgtttgacaatacgctttttaatctgtaattgcttgtctttggattggttattaaaaggtcagtatctaaggaacattttaaaaagttttttaatatttaaataattattttattattttctataatcctaactgttagaattattgagaaatttgtctttaaaaccgtacttttttatctataatgataatattttttcaaatttattcatctgaaagaatgggtttttatgattggaccaattataattattgattaattttttcttttattggttcaattattctattacttacgcgctatttttgctctcttcatttctatttattggtttattgtcagtaaagaanaagagtccacaaaagggaaaaatccgcttacattgagga

SEQ ID NO: 8012 - DNA, 3555 bp, Heterodera glycines
  misc_feature (11)..(11): n is a, c, g, or t
  misc_feature (36)..(36): n is a, c, g, or t
  misc_feature (41)..(41): n is a, c, g, or t
  misc_feature (57)..(58): n is a, c, g, or t
  misc_feature (117)..(117): n is a, c, g, or t
tttttccggtnctatttacagggaatgaaatagttntagtnttatttttaaatgatnntaatgagtttatttcaatgagctttttatcgagttggttccaaattttagttacccgcnccgcaaaaggtataaattttttgcctaatttatatttcgagttaagtctataaaagggaatgttaaagcgttcagaaggtttgaatatttcaaagggattaagatctgttcggccataaattattttatgagccatgaacagatcagacagctttcgcctgctttcaagtgttggtagttgaaggtattctaatctattttggtatggaatgggtggaaggctacatttaaaaagaactcttttggtgaaatatttttgacatttttcaatttttttaatattttttagaagagatggattccaaacctcaggagcatattccaataacggtctaacataagttttgtacaaaataatccaaatcctagaagattttgatttaataacccgaaataaagaacgcatacgtaaatatgcgttctttgttatttgtgtgacatgattggaaaattgcaatttattatcaatatttatgcctaaatccctaattgtatccgcaacatttattatatttccatcaattttatatatttctttggggtttttattccccaaatgaagtacaaaagtttttttaattgagattctgatttgccatttatttgcccattcggataaattatgcaatgctttatgcataatttctgtgtcagctctcgctttataacaaatatacaatttaacatcatcagcatataatttaattctcacttctgatggcaaagcatcaggaagatcgttaatatagatcaaaaataataaagggcccaggacagatccctgggggacgccagaaccaactttttactggaggataaatcatccccaattttaacacgaaaagtcctattactcaaaaagtcctttatccacatcaaaagtttgccccttataccaattttttccaatttgtatgaaagtaattcatggggcactgagtcaaatgctttttgaaagtcaatataaatacagtcaacattttttccatttataattgcctcataccaatcttccacaactgttatctggagatttctttacgtaaaaaaaagttattacaaaatttgttcattttttcaataaaatctgttaacaaatcagaagcaattttcaaaatttttcccggctgcgcctatcggcaccatcggaccgaccttgcctatgaaaatttttttggaaaaagcgcacagcaaaaaagtggtttaaatagcaataaaaacattcgacaaataataaagaatttgattttttaaagtataagcttttaacccggacccggttgttgcccaaatacgcggaccgtgcaatcatacaaaatacttgaatatttcaaattttgaatagttaatttaaattaaaatttataatttattatatctcataaaattcaattccctaaattcaatagaaatttttaatgcatttaatcttaaatttaaaaaaaatttatataacttatatttcatacataataattctctatttttcactgaaattaagtgacatcttaaactggtaataattaattttacttttatatatatatatatataatttgcaaaaagaatcttctattatttgtgttaaccatgaccgctaaccatgaccgctattattatatggcgtcgactacaaaatttgctattttgccattttgtatttgacttatcaataatattttcgactcaatggttgttttaaagtattagtaataaaatattcataaaatattatactaaaataatgtttattctttttcttacgagaataagaatctgcaatttaaaatttattttatccatttcgtgcaaatgtcttcttattgaaacaattttttttttactttaaatttcgccaattttcaaaattccctttatttgatttagcactaaaaatcggttgccgatgaaccatagctttttaaaaattcttaattaaagattttttgaaatcattttatagcattaagagtttatagacatgtctttttttggtcttgtaaattgcagagcccaaatatttttttgtgaaatagtctaattctgttgtcaaattcctttgcattaggcggaatgacatatttgaaccaagggatgtcagatgtgtcctgaacaagttgatgatacggcttcattcatcttatgcttttttatacatattttccattaagttagtatttgtaatttattggctttaatagaataaaaacattttaaaagatattaaggtttgttttccttcgagtgatattttaatatttcattattttatttatatttcatatatctcactattacatttatatttattagcttttatttttttttattcaagtgactcgccaagcagtgtattaatctcatgcccgatgcaagctttttttgatatttcaatttattaatttatttttcgtgcttacagtttctcttttaaataatgatttttttttaaatttatagctttaatttattccaatgtttaattttatattatcatattgattgctttaaagcagtaaaagaagtacgtaggcgtaattcgattttactagctagaataccgtaatatattctaagtattatgaatttaataaaaaatttcatcacatttgttatttatttattaaagaatatgcatacttcaatttaaactgaattgaaccgaaattgttacacataatggtttctataagggactactacctgcatattggtcatcatcataataaaaattttcaatcacaaaataattttatataaaaattgatttattaatgaaaattttcatgcagtacttttttatatttaattttctaaatttttgtttttttataatgaggttcgtatttacatcacattttattgttttcatgtttattttattttctaactcaatttcaatttttttaacttttagtctaatatttttatatctcgtttcattttactaaaaaaattaagcgtaataattttattatagttttttttaatattttttgatttaaagaatggaactggacttttttcaggaatcattattagctttttttacataaaatttaaatttcttataaaaatattcatattaagttcatatttttttataattaataaaaaaaataataattctttaatttgtttaaaaaatggtttaactttagttaaaaaatgccgaaataggtcaactgaaattcgttaagttattttttgatagcaaaatcgttgagattgagccgacatttgacaaagttacgacaaaaaacactttgtaccaaaacttttttccacctgtgtatattgatgaataaaataattaattaaaaaaaattgacaatgattttaaaatgagtattatactacattatattcaaataatacaataaatcttaaacgaattgttcttttaagaagttaataaaattgctttttacattgtat

SEQ ID NO: 8013 - DNA, 1914 bp, Heterodera glycines
  misc_feature (15)..(15): n is a, c, g, or t
  misc_feature (19)..(19): n is a, c, g, or t
  misc_feature (31)..(31): n is a, c, g, or t
  misc_feature (38)..(38): n is a, c, g, or t
ataattaatttaatntatntaattattattntaagttnttctcatagagataataaatggtgattacaaatggtttaaaaataagtgattatcatgtggtataaatcataaatttgaagcaaatagatctttttataacgtactattagtattatttattttacatcatcttgtatgcttcaattaatttgttgatttaattattgacatcatttaatacattatttatctgttattatatttataattaatttaaattgacaatttttcactattttcaaatttattaatttttttttttgcgattttacttcttcatcaattttttgttttaccaaatatcattaaactttttaagaatgttttttatttatttattgattgagaacaaaatccaattcaattctgtagatttaagtgttgataatttgtttttgtatgtatgatacatcattcaaactttgcgtaatcattttttaatgcacaaattcgaattgcaaatttttagttattctagaataaagtttttgtctattttagagattccgacatagttttatcgctattgctgtacttatttttcatttattccctttcagcctaatcttccatttccaataacatacaaattagccactttcaattccctcgcccttcttttcttgtctcgcaccaaaattttgagattgaacttatcgtcaagaagccttaaatattatttattttatcttttgttgttttttaaatcatcgacctttgtgttcgacatatttgagattgaagctatcttcattcaccattaaaccctatttataatttatttattttttgttgatttttaaaatatttcagcttttaaaaatttaaagagccgattacttttaaaactgatgaaagttttcatattttcgttttattaatagtgcttttttcggtatcttcttgctccaaactttcggttgttacggcatggcacatctcaatatatttcttttaatcaaaagatgtatattttttgcttgaaatatctttattttatttattttaaatcattttaatttatataaaatgccatatatttgtattatattcctttttatttgttatccattatattatattcctttttattttttataagtccacaagataaatgccattcacgaaaagcttaaaaattgccgtttataaacgaattgtgtttagtaaattaaaataattcgcatgaattctctattttgaaatgaataaagcttcttcatttttgaacccaatgaaacttatttaaaattatctattattatctattttaattcttgcaatttgtttaattatatgtttaagttcttttatcaattatttttatataacgatttaatttttttgctttaaaattattgaagaaacagcgttatataggtaatctttgtaagtgcttaataaaataattatatagatatatgaatcaaacatttaaaataccaaatgtggtaaatctgctccacgttgactcacacagagaaggcattgctcggagaaagttaatttacgaatttttgctgctcaaaataagttcgaaggttcaataaatactttgaatttttaaagggtaagaaatattattaaaaatttggattaaagaaatcttgatgattttaaaatatgaatttataattaacggacatttttaatgaaatatttaagggtaaaaataacaatttattttttaaagataatttatcatattgtttttttacttattcgctcgttctcttcagacatttgcaagaattattcacgtcctcaattatataatattttttaaatttttattcttaaagaatactgtattttattatcttttgagttcctaataattaattgctcatgatcgcttcatcaaatatgacatga

SEQ ID NO: 8014 - DNA, 5347 bp, Heterodera glycines
cttttcatctaccaaattcttcccttacaaataaatacacctttttaattaattaaatccaaaaccatttttcttaaactaaaaacaccttcttaaaatacacataaaacaattttatcccttactttaaaacttctatgacccatttcgatatgcatattttgtatatctgtatatattcacgtctttttgtgattattttatgatattggagctctttttaaaaaactaccattaaaactagcaccttaattatattggaccttttgactcataaggacagaaattttcataaatcaattagaaaaatatttggcattttaataataatataatcataaatctttataaaaattggaaattacgacaaaatataagatcaaaaagaaattttctattttttagttgttttcttagaatttataaatttttagcgttttccctttagataggcatatcttagctattttcgagagttgtagcttaaatttaaaggacttgaagaaattttgagaaattaacctcaatttggtaaaatttatgtgcgcatttcttcggttttatgagcacagaattaaaagccgtcaaatgagattatggggcgaattttaaggcaaaaattttaaggaatgtcagattaattcgagaaatccggatttaaatagcgcgggaaaggcaattcattctcaaaattttcaatctaatttcatattgaaatcattcaaaaactatgcaccttttgaggtaattaaacaaattatatatgaaataacagctcaaaaagcgaaaaacataattttggtaattattgagttttatttgacaaattcgattggctttttaatttcgagaattgtgaaaagttaaacaatgaatctccaaagagctaattgggatctgcccgggaaatattttaaaaaattattgacttgtcatttcttgcctttcactctgagatttccatgaggacaacaagcaaaagcatgtggcacaacacaactcaaaagaaggaacgacacaaagttgtggaagcagcagcagatgacaaatgaggagttcattaagaaaagtaatgggcaaatcagtgaaataatgaaattaaatgacataatttaatctcccatttataaaagaactaatttatcccataaatggacattttttgaattttgtttgcacaataaattaatgaaatttattaatggcgatttctgtttgttcaaagcaactcgcgtgatgccgaacagctgcaaataccaaaattttgaaccctttggaaaggaattagctgatttagaaatttaccgaaaaattggccatcatcatcagatcatcacacaccgaaattaactgattttaaatttgcaaatgaatttcacgttgactaattgcttataaaaagaaaattagtcactcagcaccgccagcttaaaaactcggtcggtagcggacacgaaagcttcggagatggcacaggcaattggcacgacaacgccaactatttttgtagtgttgaatgttcaactatttttgtaacggatactgatcatccaagttttcagcttcagcagatcatttggctgacttttgagttgtaatgcctgttttttttgcctatttcggctattttgttcttaatgccaattttggctttttttcaaaaatgcagtaaagacaaaaaagcaccgcatcccctcctcccccgagataaaaaaagtaaaaattcattttttatcttttcgaaaaatatgtatttattttatgcagaaacaatatataaattttaaaatgcgtgtaaaataaagtaaattaaatgtatatacaattaaaaacaaaagcaaaaattaattttgtaagttttctcttctctgttaaattaggcaatttgtgtagcgaacaaatccgaaacatttttgtactcaaagacaggtccgaaatccgcttcaatcacatcaccaagcgtattaacttgtacaaatggaagcaattcgttgtcaaaaacgaataaatttgaggtgtctaaaaatagtcttcatctgcttaatttcatgataaattaatatttctcactcaatttttgtccatttttggtgtaaatgatttccatcgatgttaaattggcgccgcatccgattgtgtcgccctctgcaaaggagggatatccgcccaagccagtggcactgtgtccgaaaatgaagccattgtttgaatatttgtaaaaggtgtcgtcggattttgtccaaattccaatcgaaatggtactgtaaatgcctaatgatatcaaattcaaatcagcatcggcttccaataccaaaggccgactttcagctttttaaatttgtccacaatttcttagattcctactctcctctctacatattagaaaggaattttttagaatgaaagtaaatttataaaaaattcaattttcctcggaattttaataaaattttcatttcctctggaacaaagcaaacactgaaaagccccaatccataggatgtggtcaacctcaaccagcctttgcatatctttaaaaatccaacatcaatacttacctgatgtttctgttattctttatgattttggtttcataatagacaatggccaaatttttatccttttttataattcaatttctgatcagattgtcggttttactcactttagttgtcctttaaagaatttattgttaagcaaacaaaaaatattaattaaatcccataaaattaaattcatttattcataatctaattgtaaaacatttttttaaatgggattttggacccccaaatttggcatttgaaagtcttccgttgcttctttttattgatggtttgccgatttctccttgattttggaggtcattattattattattatttttctgcccatttgcatatccgttttccatctattggctgagaacaaatgacctttacaagcaaataaatcgttcatttattcacattaaatgccggctcatcacagaagagcataactttttcaacttttcgatttcctgacgaattaattaacttttataaaaaaccgtcccataaaaaataattttatttgctatttaaatgctatttttattatatattcatttctatgaaatatattattaatttacttccatatcattttattaataatattcgaggcaggcgcagagtttgatccaacatttttttttggggggggggggaacagttttccaggcgcaacgaacctaaaccaaaaaaaaatttatcccgaagatggatgatccttccttttcttaaatattcttttgactttcatctcgaaaaacttctgaaaactccaggttaggtaggcttcgtgcttcttacgatttccactgattctggcgcttggcggcagcgaaaatcctaacaaataatcattaatttttaagatttgtgcaaatccaaaagcaaaagaaatgaatttttggcattttgcaattgttttgcttcatttatgtatgcaaatgttgtcagaacccactgctgaagtgcaggagaatggtatgttttttttgttcaatttttaattatatttttcagtgaaaaatattcgcgtcgaaattaatgatttacgcgagaacatttcacgacttttcaccaaatttgtaagtttttctaaaatatgccaaattagcagtcaaattacagacaaaaattgaattggaacagaaacaaattgaagaagcattgaatgaccaattattggttactcaagaacaaaaatcggcagttgtgagtcgccgacaaacttttaaataaaaacattttgatttaaaagtaatatttaattataaataaatgatgatgacatattgcgtatggcttattaagaaaccaaaaataaattttttagaacgaaacacgagaaacggagcaattgaagacattggaatttaaagttagatttgaagaaaatatttattattattattattattttttactttaagccgaaaaaccaatggagtgtcaacaaatctgatagcgaattgttcattttcaagcccaaacacttgaaagccattcatcgtggaaaagaaataggtaaaagaaattaattatttatttattttttattactatggcacataatataaaaatatactaatgctaataatgtaactttttcattgcttaggctaaaattgcacaaattctttgtataataaaactaaaaatagaagattctttgatactttaacattgagaaagttttttgaaaatttttgcataatttgttgccttttcaattaattaagtcattttgccttaaactttttttaaatttcattaaacactttttaacaaattcattccaccttttatgccttttgatttggcatttttaagcggcatattttaagggcggcgccgggaattaattgcggaatctgtgcttctcccatattttgaagttgtgtattatgagacgaaaattataagaaagcaactaaatattgaaggaagctcgtaagtaatcgaaggaatcaaataacaattttatttaattttaatcgttttaaaataaatttaaaattttaatgatttataaaaacttttaagatcgatcggaattggactttttggaaaaagcctttacatgtatggggacaatggcttcatttttgggcacaatgtgaatggcttctggggatatccctcgtttgaagagggcgacacaatcggatgtggggccaatttaacatcgatggaaatcatttacaccaaaaatgggcagaaattgagtgagtaaaaataaaataaacttagtgaaaaaattcagagaatatcgtgaaaaattggaaagaaaaatgatgactctattcatttcttaactttcacgtttacaagcaaataaaagtttaaaaaaatgaattttaaaactccactggggatagaaaatcttatctcaatggccataaaacttgaccaaaacactaattaatttataaacaaaattgtgcaaaataaagcattgtaaatcatttttatgaatttcgttttaaaagaaatcaagctatttaaaacacaattgtcacattaactcttatttatttgatttccaagtttaattttttgagttaatttaaaaaatagaaacacaccattacataataattattttttaggcattttttattcattaaatttatttattttttcatttttaagatccgcgaatttgattttaccggtctctattttaaactcataaaatatatttattacatgacttctacagtgttttaaatcagagactaagtggcgctgcaagatttttaattttcttttttttatttaaacagtattgtttt

SEQ ID NO: 8015 - DNA, 1082 bp, Heterodera glycines
taaatcagagactaagtggcgctgcaagatttttaaatcctcttttttttattctacacagtatcgtttttttgtttgattgctcatttttgtagatacttcaaatttgttcgtacctgactctgatctgctccctgttgtcttcctgtatctcgcaggagacataatcgaggcgaactttggcacgagatttgcttataatttcaacgccagcgaatcttttcttgatgattgatattcggcaattaaaattaattatttccatgtgggcggggggggggggcgtaaaatggctgcatttagtccaatgtttttttaatcgcggtaaattcggccacggttttagtcttaacgtttttaaaagttagaatttcttaaatcgtaccctgaggctggaaacagcttgttaaaatgcacataaaacaattttgtgccttggtttgaaacttctatgacccatttcgatatgcatattttgtatatctgtatatattcacgtctttttgtgattatttttatgatattggagctctttttaaaaaacgaccattaaaactagcaccttaattatattggaccttttgactcataaggacagaaattttcataaatcaattagaaaaatatttggcattttaataataatataattataaatctttataaaaattggcaattacgacaaaatataagatcaaaaagaaattttctatttttagttgttttcttagaatttataaatttttagcgttttccctttagataggcatatcttagctattttcgagagttgtagcttaaatttaaaggacttgaagaaattttgagaaattaacctcaatttggtaaaatttatgtgcgcatttcttcggttttatgagcacagaattaaaagccgtcaaatgagattatggggcgaattttaaggcaaaaattttaaggaatgtcagattaattcgagaaatccggatttaaatagcgcgggaaaggcaattcattctcaagattttcaatctaatttcatattgaaatcattcaaaataaagcaccttttgaggtaattaaacaaattatatatgaaa

SEQ ID NO: 8016 - DNA, 7098 bp, Heterodera glycines
  misc_feature (4588)..(4588): n is a, c, g, or t
ataaagttacatatttagatatttttattataatgcaaaaaattggcaagatattctttctctacttcaaaatcatttttggaataatgttcataattaagctatttagtcagtcgagattgaaatggctaatacttttatttcaatcattgcccgattccatcacaatgcagaagcgattgaaatagtagaagatctcgtatttgatgtaaatgcatatagaaagtctaaatgtagtatgtggaacgaatttacaagcactctcttttactttgttattgttagtgaaattcacataggttagcacgctggggccaacatcattaaagatcaatctctgttacaccatcagcaataagcatgtgtatttaatgccagaataaattttgcatggcgataagatggattttatgataattacttcttaccaaattttatgcagccagttcaatattctttttattcaagaaagcatccacatctataccataagactgaatgtgccaagggttttttaatacggttcactcgaagagaacttttcatatggatctaacacatacgcaatcaaaatcatatctgaattggcataggtggttggggagaggggggggggagaattgaggattgatcagaacgatcccgaacgaaccaaccaaaacgaactacgcttggtttgatcagagcaattccagacttatcgggaaactgaaattgatcatgttgatcacaaacggaccaacttaaacggactacgattaggttgaaaaatgagggtcattaatcactgcttcatcgctcaataatggggctgatcagatcaatcccaatcgatgagttccaactttttttgtgtgttttcttcagctgctgtaaatgtgcaaatgcttctttcagtgttctgtatgctgatcagccgacgactttcgatgttgacttgcccatgatttgctcctatttgacctattggtggcaacatggcctcgagggcccttcgcgctcactcgtcctaattacccaagtgaccgccgagcacattaaccgtttgttctgctccttgctgaccatgatgaaggaccacgtgggccgtgaaaatgccccgtggctgtgccgtgcccatttctcagccgtgccgctgattcaatacgtaacttgcgacccggtcagggaacaaatgctgccggtggcggaacacttacgccaaatggccgagaaggcatttgccgacgaggagcgcatgagaacgcatccggacgaggcggacgacgcaacagttgcggaggtgggtgccatgccaatgaggcgacacacgccgaaagtttaaaagggcggcaaaaaaggagctaaaatggggacaaaagcatcaaaaggggtaaaagaaagaacttttcttaaggacaatgcgcgactcgtccgcgacgtttacgcgttctttccaattttgatgaaattcaccgatttgcaccgcgccaaatggttgaaaatgccctcttgggagagtgacggcatttacgagaatgtggcggtgattttccgcatttggtcgcttagccagcacttcaagcgggaggagttgaattacatggctcagtttgaggacggagagggcactttgagcgcaatgggcgcggaaatgaaaacgggcaaagcggcaattgcggagcggaaaaagcgccgcagggagggacaggtcggaaagatgggcgagtggggagagaggacggggcaattggcaatgtgcagggggcacgggagggaggagacgagacggcggagtgaaaattcgggaattttggagggtcgaatggtccatagtcaaggaagaagtcgggaatggggaagcaccccaggaagaggaagaagtcgggaatggagaagggaggagagagtcgggaatggggaaggggacacgaagaagttgatcaataacctatcccaaatgaacccatctctctctgctgatcacaggtccgacgtgataaacacgcgaatagcattgtgatcgcctgtctgaagcggcttttgcctgtgggactaaacgttttcgggggccgagagttggacattgtccagcaaagcaaagagcgctttttggccaaagagaatgaggaaaaagtgtgcaaattcatccgatcgcggctcaccgtccccgtggtaattaattcatccgctaaacactaaacacccaatcaaaatgactgattaatcttttcggttttcaattagcgcaccgatccgacggataaaaacgcgtggcaattgagtctctaccggaagatcggtaaatcgcaaatgcgaggcaaagaggagatgagtcaggaagcggtggtggacaaaatcgccaacatggccaaagtggtggccattttgcacacggtgagagggcaaaataaaataaaaaagggtgtggggagaagggagggacggacaattggccaatggcacgcgacaattggtcaatcggcggggtttgctttgcttccatttgtggccactttctccgtcgtccgactttttctcttcgttgtttttcccatttgttgctgtgctattttcactcacttttttctcttcccttttcatttaggctttctttatcttttggcattttccaaaaattttttccattttttggcaaagtaattaaattcaaaatttgcctgagggcatttccgctctctgccctccctttgccttgcaattttctgtgtctgtctgtgtttgtctaacactctgtcctttcatttcccttcagaccgaacacccccaggcatataaaccgtctgagtggaaaaagatggtcagcagccaacggaagcgagcagtagtcgcgtgtttccggatgatccccgtgtacagtatccccaggtacgcactgctaatacagtacactcggcacgccatttccgcactaaccaaacacagcacatgcacagtttgaactttgtttctgccgtgtgcttattgacagtaattaacgttatgccaagggaaggatacggtattacagtaggaatagtttttttcgaaaagcgatcgatcggcggtcattccaccgaatgtctgtctttgagcactaatcggccctctcccaaaggtaacaagccgactggagaaggaagaccgatggaagaaagtactaacactgcagcgaaagcgcatggccatttcactgatcaccgcgagtcatttgtacaggctggaaaagtatgtgaggagcacagagtgctgatctgatccgatcatttggtgctgtgcttttccgatttgctgttcaaaatcaacaaaaaacgcaaaaggcttcccatttaaggcatcgtggcatcaactattttttgcccgtgttcagtcaacattggctgaacgatgaagacattgacgaggatcggcttgtctccgacatttgcgtaaatttatttttgagaagcaaaatttggactctcactaaagaacgatgccattggagacgctgttgtggagcaacaaaattcaactcaaattgtccgcgtggtggaggacgaaagtggggggctgaagatcgaagaagggccaaacgcagggcaccaggaaaagtacaattagcaagcacataatgatgatgatcataatgaggatgagcagggtgtcataatggggtagtaaaatgggacaaacccattccatcgaactgtgcgaagagtgaaagggtatgtgtctgtatgggcaaagaaaagccctgttttcagggactaataaaaaaacgctttctaccgaaaataggctgaaaggaattgcttctcagcgtttgttctctcctcaaggccctaaaacccaaacaaaaatactgatcattttattaccattggtctatgattactgtgatctgaccatttctgattgacctttgcctttgacagaattgtgccggacgcacttcgccagctgatcctttgcttccaaagggcggccaccagcgaagagagtggccaatcgaacagcacgacggaggacaagtggggcagggcaaaggccaaaaggggtacaaaagccgctgatcggacagattgttcattcgctacgcggacgtaatgtgccgatcagtgcacattgggcaggacggagacgaaggcggcgcaatggacgacgaaaatgaggtggaccaagcggagaaggaggaaatggcacagacactgcgggcggaacagggcgtattggcaaaccgaggagcagcgataatgtgagaggacaaacggaattttgggaagaggggggggggggtaattagtgggagaaaaaaacagaggaaccgttgcagggtgttgatgtatttgagtgcggcaagcggagagccgaccgaaatggtggcacaaacacttcagctgggcatccatctgctgaacggaggcaacaaaaccattcagaaggtccttgccattcattttggctttttcttccgctgattttcacttttccttttcttagtcaatgctcaattatttgcaactgaaaaaggacgtgcgcttcttcacctccctctccggactgatgaacaaatgcagcgtgctcaacttagaaatgttcgagcgacagatcaaagcggaagggttgngaatgggcgcggcattggcagcggggtaattagcctaatgaatgattaatgaacgaaccttggaaagtgccgagcctttgccaactccgtttttagggagcatcagaatctgaacgacgcgccgttcacctgctcactgttccgctttatgcaattgacttgcgaaggacacaatttggactttcaaaattatttggtcattaaagcaaaatgccattgtcgaaatgccattttagcgtacccaacctggccacaccaccagcgtcaatttgatcaattcaacggtcgattatttgcttcgtttgcaggaatctgtgatggacttttactggcattattcctccaaggaagtgagtggtaaatggcgggaaaaaggcatgagaattgatcgctggaagattttgtgtgattgatcagttagtatgagagattgatcagtaaagaacactggtcaggaaggacttatacaatcaaaaattaattttgtgcaacaactgattaatcagtaaaggcattccattgaataataagttgagttatgtgagactgatcaatgacgaatgattaaaagagactttctcacttggcatttgtcagatgatcgatgagaacggcaaagaatactttctgcgtgccatccaagtgtgcagccaagtgttcaacactttgaccgaaagcatccaggcatttatttgttttttgatttgtttatttcatcactttccctgaagggcccctgcgtcggcaaccaaatgactttggccaattcccgcctttgggatgccatcaacggctttttctttctgtttgctcacatgatggagaagctgtacaagaacagcacgcagttggaactgctcagagagtttctgaaccttcagaaggacatggtggtgctgatgctttcaatgttggaaggtgaccaatggcaccgatgattaagccataatcttggcaaatgttaaggcaatgtgctaaacggaccgatcggaaagcaaatggtggacgcattggtggagagtcagcagtgcgtggagatgatcctcaagttttcggatatgttcctcaaactgaaggtccatccgccgaatgggccactactttcggcacatttaacgtttttggcattcctttgaaggatttgaccacttcgcaagcattccaagactttgacaccaatcgcgacggatggatttcgccgaaggaattccaacgggcgatggaagcgcagaaaatgtactcggtggaggagatcacctacctgatgatgtgcacggacgtgaacaatgacggcaaaatcgactacatggagttcacggaacgatttcacaacccagcgagagacatcggtaggggagggaatggccagggaataggccaacgcggcacttaaaaagggccaatttggcattccattgtcttccagggtttaacttagccgttctgctgaccaacctcaaggagcacatcaccaacgacccccggctcgaaaagatcgtcgagaaggctggctcactgttggactattttgacccctttttgggccgaattgaaataatggggtgagcgatggcgaaaggaataataactctctcggcaaactccgaccaatgaagttttgggacggagttggccggactgagtggggggggggggattcactgctctgatcaatcgcactcattgtcagatcctcgaaaaaggtggagaagatttacttcgagatccaagagagttggttggaacagtggggcaagcagcaaatccgcgactcgaagaacgcttttctgttcaatgtgctgcaggacgacggtggcgaccagggcaagctggaggcgttcatcaatttttgtgaagacacaatttttgaggtattgcaaaatatgctttctgctggcataagcaatgcgataaataatcattggcattttatgccatttttcaaatgccaaatgttcgtcaatcattggcattttatgatgttattccatttcgatcgtccattttgaccatttgtccacctttgcgctttcctctggcagatgcaacacgcggctgagatcagttcgggcgattcgaccagcgagtcgaaagtcgagcgtgcgatgcgccaaagggactatttcctgcagcaaacgtacgccggcgagcaaatctccaaaacgcttcgggcggggtacaaatgcgggatggacgcggcggcggcactgcgcccggaaaacatacaaaaggaactgaaaagggcggcaaagaaattcagcaggtaaagcaaaattggaagcgcaattaattacccataattaattgggtgtgaaaaacaaagcattgaaagtcgacgaatgttttgcctttcgttgggtccgtcccgcgccattccgttaatccgcgtccattcccgcttctcagcatgagttgggctgagctgttcaccgcgttggcattgctttgcttccgcgccggtcgtgccttcttcttcttccacctgtttttgctttcgaccgcttttcgtt

SEQ ID NO: 8017 - DNA, 6352 bp, Heterodera glycines
  misc_feature (91)..(91): n is a, c, g, or t
  misc_feature (94)..(94): n is a, c, g, or t
gaaaagttactcccgatcgaagtaaagctgatgtgttccatctcaggggtctcctggataagaaacacccgaggtttggctggttttcgcncanagtttccaggcgaattattgtatagacaataaattccccagggattgcagcctatgatttcatagactgtcttggacttttcctgagcataccaacgataaaaaaaggcatgcactgccgcttaagaggcatttattgccccaaaaggctgtgctgtccaggcaaaatgaattgcctggaaaattgttggcatcttttagctcaggaatggaagtattgtggcgaacttcgctaccatactttccttcacaggagcccatcttagggcaccttttaccggccaatacattaattgcgtatgaacgttgccaggctttagtgaagctttggcattccaaagctaaagccttaagcacaacgtttattgagccaaggataacaccttcatctgttttcagaagaagtgtgtttgtttggccaactggcagcaacgtcagcattgctgagttttcgacaatgcatctcatgcttgtcgcatttttaatgcatttttccgatttggccatgactgctatggtctctgctccagtcaaatcctggagagagttagccataaggacaacaaacgccattgttctgtaaacacggcgtgatgtccaattttgagaagctgttgcccttggcctcctctctttcggaagccgatttgggccagctaagtaaattattggcctgataaattgaattatcagccaaatgaccatataaaatcctgaaaacaggacttttaatatggaaaaggccataaagctaatgcttatgagtgataagcaaagtccccctgctaacattgatgaaatcaatgggtaacaggttggattcgctaactgttcaatgcaaaaatagcattcgatgagttcgcactcatcaactgctggacataacatgtcctttttgaacatgtgtttcgaatccatccaaaaatgaccttcacattggaagtcatttaggaggatttcctttggtagctcgtaagtgagctgctttacattctcatgaatgtaacagttctctgcacagcagagctcaactttattgatttcttttggaatctttgctttaacgcctttgttaaagcaaagaagtttgcattcattgcagtgattggttggataagcatttgtttctgttccccccttaacgggaagagggaacaaacatgctaaaattacagtaaacgccattatttgcaaaatatggcgcgctgtacaaaattgagggattgcccctctttgccttccttcttgaaagcaaggcgtgctctgatcctcaaaacaaagtaatgatactttgagttggatcattagccaagcaatggttttacgcccaatagaaagggcttttaaaattgagagaaccatcaggcttatgctgatgtaaaaacaaagcgtcaatgctatgattgattgctctgttcgattaggaagagtttcttcccatttattgtccattcgattaatacgaatggaaaaaactgaatggctcacaacgccattcttttttatgcaacagccacagattttcttatctgtgggagttactttcggtgtcttctgctcaccgaaatgagagtcagattggtatgaaatctgactcggttgatcgaaaagaactgacttttcgatcattttttggtggtcgtgctttggcatgaccatggcacgacaaaaaaatgaatgtgatttatttgtcacatttttcaacccactggttgagctgcagtcgaaagcaatactttcagacggtttatcctctactctagaggatacgcctgagtaaagggttttagaacgaggaaactctcctctttgtttggaggactgtttcttctgaacagtccttccttcccttatctgttgcggagtgctcccaattggagcatctccatgataacagatcatatagtggtgctttccaccacacttcaagcatctctttggagattggcattgttgtgccttatgatctttcataaggcaattaaaacattttcgctgttttgcgagccgccttctgcgtgctcctggtgtggaatattggggacatcgacttggaggatgtcccatagcacaacaaagggaacaagtttgtcttgtccctgtccctatttttctttgagaaaattggggacttgtcaatgtcagaaatgatctgtttacttggggagacatcatccccacagaatcatttctgttgtcgggtctctcgtgaccctggataaactgattgggaggggactctgtccccatcccatggaaattattcctctgcacttgcggaggaatattccattgtttttctcctccataacacaccataaagtggtgtctttcaccacattgactgcacctgcggggtgaggtgcagttcagagaattatgccccataatgaggcaattaatacacctgtcttggtccgcgaggcgcttccttcgagcccccggagtggtgtatttcgtgcaccgactcggtgcatgcccctttgcttcacaaagggagcataagcgatttgaccccctatctgaaataggggtttgagatttgttaatggccgagaaggaacgattcggttgaggagacatcctcctcaccggttcgtttcgttccattggcctccactgccattcttgccggaacggctgggagaaacggaacggtgttcctctcccttggttagctcttcccccatttgaatgtgggggaaaattccggggtttttcctcacctcgaaaaacctgagtacatctctgtacttcttctttcacttcaacgattgaagtgatagctcttcggagctctgtgcaattaaaggcacctcctgccctcatttccttctccaccacttgggtgagaaggtgataaggcagtttggacttaatagtggaggccatgaacttattttgttcattttctccatagtccaacaactgatggcaaatccgttcaatggactctgagaattgtctcagagactgaacggattctgctggtttgggaaggtggagtaactccgcttggagggactccaccatcgttttttcatccccaaaccgctttttcagaatttcaactacccttggataattttcatctgacggtgggtataagtcaattgctctcctagcaactgacttctctgggaggcatcccagcaaataaatgtgcttcttgaagtcttcaatttgaagactttcaacggaagtctcaaatagcttccaaaacaaaggccattctcggggttcccccgagaatttgggcaatgttatcggcggaagcgtcacatcatgacgctgatgcacaagttgtggctgctgcacaacttgtgctggttggtttggctggggaattgcatcccccagctctgagaggcctaaagccccttcaatagtgtcgacaagccctcgggcttggtcaacccaatgcatgaaagccttcccttcaggcttaaagtctctgtaattttgctcttcatcttgaagagcttgtcccttcactctcagaaaaatggcttcccattttccattgtatttctccaaaagagaaattgttttgcagagattttgtctctccgcgattagatctgcacggacactttggtccgccagctctttgcccaagttttcttgggctgtctcaatgtacatcttgagacgcaccaccattggtgcaatggagatgcgcaagagctcactcattgctcttacgcttaatgaaaacacaataaacccctttgggttgtgtgtttgatccaagcgctcaggccgcgctttggattggtttggttggagggtaggcttacgactggaagtcgacccctacggggctccaattttgtgggcaaaaggccacaaaaatttgcacttcccggcagaaggggaagcagactctcacggcagaaggggggagtcttttaagcaaagcgaatttctgtccaaaagacagaaattcactgaatgtccaaagggacaaattaaaggaggaaattcctctcctttactgaagggacaatttgaaaggaggaaaatgtttctcctttccttttgtaagccttttctttgacccaacgggggtcaacggcttaatggtctgtatgaaagggctcctgagcgtcccttttacagatagagaaaagactaagactctttcttaatctttattcaattcaattgcacaattacaatttaatgcaaatgcttggacagaaaactgtcacgactgacttaatcaaaaagtgatcagagtgaagaaaatggagaatgggccgggcttttataccctcacaatcgatgggggcggggccaggcacgtgaagaaatgtgcacaagcaaagggaaaaaattccctcaaaaatgatgactcatagcgaaaatatggagaaaagaaaagatgagtcataattaaaggagcgagcgaagggagaaaattgatcgacgaaaaggatcaaaaataaaagaaatttcaaagaaatttgtgtcgctttggcgacatactccgggcctcaaggatggcgacatctgttgccgtctctttgccaaaattcttttcatcatcggtttggaagtcgacgagccaccctcggaggacgattctccagtcgtccatctggtaactggtggtcacgtagaggagggtgaggttcctccaaaactgctggcgctctccaagcaactccgattctggttcggatgttgaccagttcgatcggataaatgtcgacaagcatcccttgctcgcgagggctaaaccctacatattcttgtatgcacggttttactgggtctacttgaagacccaaccgtacaaaatgatcgaaaagtgttatgcccggagagatgaagagaccctccggaccataacaggtgaatccatcaaaatggatctcggcaattctgccaaaatgttcgccaagtagcgtggctccttcgcgaagttctccgcgaaggcgggcttcgacagcacggcgctcccgtgctgtttcataccaatgcggtccataagaccgctcaatccatgagctcaatgactcaatttggcgaggaataggaggttcctgccagcgaggaactctctcctcctcttcaaatcgtggatcgccaagtccgtaaaggcgatcattgaagacctcggcattttcgggtatgaccacccggcgagccgagaaataaggcccttctcgtatgggaataggcattccgtggaaggatgatttgaaagtggtggttgggtggcaaatccgccacccttttataccaccattcaatggaagagatgaatcattcccctgaacgaggggtgactcacaaaattttttgactgccgagaggataggacgtgattcaacaccacatccgaaggatcctcccccggccaagtacagtattgccaatactgtaggcacattactgtacccctttctcgttatagaccaggaaataaatttccaaagtctatagaaaggagaaagtttaatgaaaattgttaggcaaacaatgcctacacaaataatcattatgaagatgagtgatgattggaggccaatcaaagaccaaagggtcgccttccaatcaaaattccagttaggccaactggattgactgtttatcactctttcggagtgatttggattgtagttttctatttgttcgggcgggacataatgtaatgtcccgctgagaacaaaagaagtgtttccagccaaacattttgtttggcattttgtgtcaattctggctttgtcaaaagccaagattgtttggtaaatggatgcattggaatcacattttgttgaaaaatgtgtaccatcatcgcatttaatttcggcaagagaattgccaaaattagtcgagcacacataacggaattgtgctcccgttgaacatctgtaacagccagatatgttcaacggcaaaatggtgcaaaggctttggtgaagttccaaagccatttgaagaccttcgatttgaaggtttaattggacaggactgaatcctgtcaaggcaattacttttctcccagtatttctgagttggtaatttttgatgtttaatggaagtctcctctctggactttccattaacttttcaaggttatgtgaacggcaattgcagttcactaaacctgatgaatggtcaggtatgcaatcagtgcatgcctgaactccaagactgcaattgaaatcaattgcttcttgccgatttttacagttgaagtcaattgtaaagggctctcgggtcagagccatattgctcccgtcaaaaa

SEQ ID NO: 8018 - DNA, 3316 bp, Heterodera glycines
cccaccataagggttgtcatagagtggagaaatgtccaaatttaccatatagaaaattaatcctgttacttttttgtgttaaacgctatttgtacctcttctaatcactgttgtacctcttctgatcactgttgtacctcttctgatcactgttgtacctcttctaatccctgtaaggccaacaaaaattgaaaaacgggcgcgaagcgcccgtatgagttcaacaaatttaaaaaacgggcgcgaagcgcccgtcgtgagcctcgatgtggactaaaaacccataataattttttaaaaattcaaaaaaaaatcaccaaccaattcgatcaatttgaatcgcttcacagtctaggtagcgaagctcccaaagcgcgaagcgctttttcccagctaaatagccgacggttcacgcacccgctagttttgtcttaaatgcgattactgtaaaattgggttgtgaggttttcggcggaaaattttgttttatttcctgtaattttttttttggcaagaagaatttaattttttgaattttttcaatatataatactttaaaacctgacaaattttgtgcaaaaaaaaagcaatagcgaatgatacgaactaagactttccaattttttcttcttcggagaaattaatgacgattttttgtcgaaaaaataccccaaaaaattgcggtggataaaatgaaaaatttctgtttttttcctgcaaaacaattcaaatttttttttttaaattcttgattttgtatcatcatttgatagaaattttttttaaaaaagtaaaaaaatggatgaaatatgcatttaaaatttttttattatggatttttagagagaaaaacatgtaaaacttatccaaaaaacttaattttggtcatttaaatgattattggaaaatttttaaacgcaaaattttttacaaaaaacaaaaaattaaattttgacatcaatttttgaaaaaattttcaattcttagggtttatattctgaaaaattttcgggtcttttcttagagtttcattttcccgatttcttacatttttaatggaatttttcggaaaaaaatgccaaaacaaggcatgaaaattcaaaaatgccaaaaaagtcggtctctagtcattaaatgtgtccctctctgatcagggaaacggttcgtgatcaattgtgtggagaggggcgattcggaaaatgagcacaccgacttcttgaacctttgcaccacatgctgggcaagttttggcttattttttggcaaatcttaaaattaaataatattaaatctcaaatattttcatgtaaaaaaaatcagccttacctttgattcaggaatgtttttttttgattttccgagtctcggtaaattctcgagttgtacctggccaattaattatggatttattatcgagaattattggtcccgagtgtgtgtgtgtataggagcctagtctattcagagaattccgaactcaaattttaaattctcatttcaaaaaaagaaaatgatcataataaatcttcatatatccgaacactggtcttagttctcgagtttattctcgaaactcggcaccgattcttgacaattcattcattcattcatcatcattcatttcttgaaaaatgttgttaaacttaataaattttttgaagacatggcgacaactgcccgaggattactttcctcgactgatcaatgaattggttggtttttaaaaatttaattggcatcaaaaaaggtcatcaatttgccaacaaagccttttctctttataaaggtgtgccaggagaacgacttctgtttatccggtcagtttaacatcatccattcgtagaagatttgatcagaacgattgatcactttctgatcagtgacgtcacagagaataattactgaaaaaattaagagttctaatctcaatttttaaattattcttaattttgaaaagaaaaaattccagctttgaccgtttttttggtcaatttgtctgactgatcaatgagtaacaaacagactgatcaacgacccaatttaccagagacgttgccatacttttttatacaccgattcaattttagactccgtcaaaaaagtagtaattaattttattatttgattttttatgccaaaaaagtaacaagtggacggttttcagaaaatttttcgaagctttttgccaatcaaaatcgtgctaaaattttttctttctcaatcaatcaatatgcaaaatttaaagaaaatcagtaagaaattttgtttagaaatagcacgtcaaaatgagggggttgtttctctcacaatctccacggaaaaccgacaaaatcggcaaagtcttaaaattttccaccatcttcatataatttttaattattttttttaaatttttgcgattccaatcagtcgtgatcaagcatccattttccacttctttcgatcaatgttccaaatatataatccaatttttcaaggatggggcgtctgtaatcagcggtaccgtaattttgatgtgttgcaacgagtgactgtgaacgggcaggacgagtggaggccaaccacaatttccgcggctagctgctgcgattgcaaggcaatttttttattttttaaaatgccattgttggcgcggaatgccaaaactgcaacacttttgtttaccgattttttttttgtataaaataataaattccttatttgttttaggttaaagccggcagtcaagcgcacagtttggtcagtttaaaatggagaaattggcgggtcaaatccataaaaaaaatacaaaaacgaagtacactggtgatgctcaagcatctcgatctcggtcaatgtttacccgtgatgagaaaaaaagtcggaagtactcgagaagggaaactgccgcaaattttttcgatcgggacgggattcaggacgagaaaaagctcgagattcggaagagaaatggcgccgaaaatttttgagtatccaattcgggatttgggattgggagcagcttattcccctctccccacgtgtcgtttcgcccccggcggatatcgtattgttcccgcctacctcctccgaaattttttttttttactttcttagaggtttttttctgggaaaatttttttcagaaaaacatgtcttttttaatttttggaccttgggggtggtaacattgtacttattgagatttgggtgacactctggtctcaacttgggacttgagcctccaaaaaatatcagtttcatgcatcaaaattttttttgaaagactcgttctcgaaagtcgagaaattttcgaaactctccccatgttttatgc

SEQ ID NO: 8019 - DNA, 4346 bp, Heterodera glycines
cccccccccttttaggttgttggaggaaagagctaaaaaacgcgccggaaaattgcgccccatctgctctgatggtccagccaattgtgctgaattctagtcattcaaatccctttaatttttcacttttttctttaatttttttttatatttaaatggcgtttgtttcccaccaatgccaatttcaaatttcaccaccaccacaccaaccaattcatattattattatttgtctgtctgtctctcatgttatgcttttcctctctctctacccattaatcggactgatcagttgatttattttgatgattcataatcattttcctttttatcataatggggtttataaaatgtatgcaacaacaaaaaatgcaaaaaacagaaaaaaacaaaaaatgttggccaatctgaaatgaataatttgaacgagaaaatcaaacaaagcattggcattctgccgaaaaacaaatattgagttgcgactcggatggtaatggttagggcttctttttaggcacgaaaaatcgcgaaataggcaccccaaaaggcataaaaaattcgcaaaataggcattaaataggcacaaaaatagtaaaataaaattttttattaacgctttttaggtagtaaaacacataaaaatttaaatttttcaattgtaaatgtaaatattttaaagattttttttcgaataaagacattttaagaaaaaatattaaattttgaagatcaatttttggaaaaaatttcaattttattgcatttttgttaatgattttttcaaaatcctgaaaataggcacattaaacacaaaaacccccgaaataggcaaaaaaaaaacatttaaaaaagtcatcgttgattccccaaaccaagcggaaaaccgttttttgtgcttttctgagcgcatcaagtgcgcataaatttttggcagttgcctaaaaaacgaagccccatagttattatttgtccggactaataactcgaaaagtaatttaacaacaaccaaaataatcacatgtttttcgtgcattttcaggccatagggatctcagaaaaataggtaaaaactaaaaaatggagccctaattataatgcattttacaaaaagctgtatataaataaataataaaaagtcaattaataaataaatgtgaaaggacaaaacggacgcaataaattggaggaaacaaaacgagaaggaggggagggggtaattgatgaacagaaattcaatttggcaaaggcggaggacgactaaaagggagggatttaggagggagtgccacagaaggaaatggggggggggggagagtgaccggtgctgagtcattataaaaaactaccaaaaaggcgttattaaaaattggatgttcggcacagatccgaccaatttcagtccgaaacaggcactcacgcgaagacgtaccccacgcgaaaatggccacacgaaaacggcatggccagcactcgccctgcttctgtaatgccaggataccgcagggaaattttgaaaatttaggggtgtctgtaatcagcggtaccgtaattttgacgtgttgcaacgagtgactgtgaacgggcaggacgagtggagtccaacaacaatttccacggcgtactgctgcgattgcaaagcaatttcttttttgttttttgaactgccgttttcggcacggaatgccaaaggctcagaacatcgtgcgcctgtgaaccaaaaattgaagattttgggaacatcccagctgaacggcaaacgctgagagtgtggcccaaacactcaagtgcttgagaacgataatgaaacaatgggatattatggtattgaagataaccatcattatcctgtcaagaacatttgagaatttttattaggtatttaggtttcattgaattattttatttttttaagtgtccaaaaactattaataataaataagatatttatgttattctaatgaaattaaatttattgaagatcactcttaaattcaatttaaattacaataatatttgaatgcgccaacaaataagggtgttggataatccgactgatgataggaatcaacatttttaaataataacattattatttagatattaaatgagtaagagatttggataattctactgaaggtgccatcagaaagtgaatgtgtttttattgcgtcattttttaatataaaataataaatggaccttaaataaatagggaaattttctctctttatccaatatatccattaatcgcccggtctccaattatcgctccagtctccatttatcccccaggggattaaattgaattttattttttgaaagaattatttatttttgaattttaataaaaaataattaattctaaaatgaaactcgtttaaatgtttaataaatagggctataaattatatgcactatccctaaaaatatgccccaaaaccctgaaaaatgcataaatatgcacaaaaatatgccttaaaaaatgaaaaaaatgttttaaacctcaaaaaatgccaaattgtgtaaaaaaaaaatacagaattgactttaaaaacatcaagagaataggttaaggagtcgaataaaaaattttgatttcaaaatttgtatatgcaatttagaaagcatacgtgcttattatgtgcttctttttgaaaataaaaaattcaaaagagctgtgtttgtttttgagccgcttttctaattaaatagatatttttcaaaagttggaaaataattttttatgcaaataaaagcaacaaaaaagatagttgaaagaattgtgtggctttggggagggggtaaaatttgtacaattgaaaagaaagataggtagccaaaagtggaaagattttctgtttggttatagcaaatgatcaaaagcaacgggaaatggataggttggttcatttgagatgctcggttctcgaaataagaaatttctcggaattcttggtttaggaggggtctgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcattttatattatatttattaaataaacttctttcttatttgggaattattttcccccttattccaccccgccctctctccctcgcgccttcccatttttgcccccatctcgccgtccgagccaacaagtggtgccgctaacaaacaaagatgtcttcagctcgatgccggatggctttggggcccgcgctgttccgacttcggcaacatgtcactacggccgaaaatttgctggacgagcccatgatcaatgccgagacgaccgaaaaccttgaacaggaacgggggcacatcacccgtatcctgtcaaggatggaggtcgagctggacgcgtggggtgccatcatgaacggactgcaaggccctgcgagagaggcggaggaagcgtttttcactgcctttattcgagatgaccggcacttgacggagtggttggaagatgcgcgagaaatgctggctcacatagcagcagaactcgcagatgagcccaaccagccaatcgcggcgggaggacagcaaccagctgttgctgtgaatccacccgtgccagccgtgccattcgtcaacaatgccgcatttctcggcggtgccaatgttcaacagccagctgctgttgccaaccatgccaatcagccaccattggtgccaattaatgcccaaatcgtgccaaacttgccggctgttgctgcgcctgcgcctttagccactgctcggctgccgcagctcagtcttcctgttttttcgggcgaaccaatggaatggcccgcgttttggcagagtttcgagagtgccgtcgaccgtgccgcccttgagcccgtcgacaagctcaactatctccacggttgcttacgcggaaaggctgctcgtgccgtaaccgcctaccgtggaggggacaattatgcccatgccgttgccgcactcaggcgactcttcggagatccacggaaaattgccgaagcacttcagtccgaactgatcaatctccggcctgtggacgatagcgttggatcactgcaacacttactcgagactttggagcgtgtgtgccgccaactttgaacataggcatgccggatgacagcccattcatgtaccaaatca

SEQ ID NO: 8020 - DNA, 3112 bp, Heterodera glycines
attttacttacggctttgcacccttttttgagcaaaaaaaaaaattttttgaaaaaacaaatctgaattaaaaaacaattaaaattttactgccgtgtttgtttgagcccactcagttgcatttctaattcagcttcagcttccgcgagctgctgcttcttgtctgccaacatttttttgctttcgcttttatcaaggcggcgatgaccaccgtcgtggtaactttgttgttggacatttcttggtgagtccatatcaaagttgggttcatcattttccaccttttcctcaacatcatcactatcttcatcatccaatccatttcctcccatacaattaggactttttgttgacccattacggcgcacaaccgcttcatagtgctgcctttgttgtcgccgcttttcctctgcttctttcacagaattagagcgcagaaatttgtatgactcatccaaaataggtaagccatgtacattttcggcaacatcaaagggaccgcttgatgtgccagcaacaggggacgatgacaaatcaacattttttacttctgctggtggtgaactcttacgccgatgcggcaacggtggacgtaaacgatgcgatgctgagaatgatgatgatgatgacaatgatgatgaggatgaatgtgatggtggtggtggtccgtatgaaaattctcctcgccgagataaatttcgttttaataaattgatcggatcaccatcgtcatctttatgccgacgcgatcgccttgtgcgactattttgtttgtgcagcttttttgtcttgttaacgtcaactttgagttcggcaatatttcctggaaaaaaataaattacaaagatcggaataatgaagaaaacgaaaaactatgccaagtattaggaggatgattttttaaattttttaacaagatatttttctaaattttcaaaaattctcaaaatatgtaaaaaattaaaatatttaacgaaaaattgttaaattttggattttttgaggtatttaataaaaattgcttaaaaaatcctcaaaaattgcaaaatatgtaagaaaaattgtgaaagagtccgaattatgtataaaatatgtacatatgtaacagggatgacacggaattccgatttccgacattttttgggtcggaattccgatttccgaaaaaattttggtcgtcggaattccgacttccgatttctgaaatttttgatgaaaagtcggaaattttcggaaattttttttttaattttttcaaaaattagaagtaatttttctacaatttctgttaataaattgaactgaaattttcaatttttttcccggcggcgcctttcggcaccgccgcgccttaaaaatccttaattttcttgaaaaattgctcaaacgctaaatttgatcattttttgacaaagtctcttaacaaatcgtattaaaaaattacaaaatttttcccggcggcgcctatcggcactgccggacgccctgccctcccccccatattccccaaaattctttggaaaaacgcgccacaaaaaaacaatgtaaaatgacatgaaaagatttttatgaaaaccagaatacttttttcaagcgaatataccaaatacatttttgaaatcaccttttactttttaagaattaaaaattagcctattatttagaaaatttttattatattttgtgttttttgaaaattttccgatttccgacgttttttggggttggaattctgattttcgaaaatttttagggcctcggaatgccatccctgatatgtaacgtgctggatcgtttcgtaaaaactgccaacatgggcgttttgtaaaactgccaaattcacagaatttttgagaaaattcagtcataacttttcttaaataaaacctaaaaataatcttactatcttacgatagctcttggcttgctctataagcatgaaaaatttcagaatatttcattaagtttccagaaagttatgaccaaacatattcaaaaaatagacataactttctgaaaaatattaataataaaatatttacaaaaaaaaattaaagaaaaataataattttttttttgtttacgaattttcaaaggtctttaaaccctatttttcgccaatacgattgggataccacccaatgcagccggagggtaatttttgatataattaaattacataaaaattcattcacttatagactttcccagttgctccgatgttgtttcatccgagaacattttgtgctggaacgccttaatcaactccgagcccttgacacaatccatggcctttttccgctcctccctgctccgcgcgttcaacatttcccatttgttctcttccgtttccgcttccatctttgcctggtggcttttcgtatctctacaacaaaaaaacggacaattaaacaacctgaggcagagacggtcccatggattttggcatagatggggcagggacggtctcatggagttcggcatggatggggaaggaatggtcccatggatttcggcacaaagcctttaatttttaatgattttactaaaaagaattcaaaaaacaaataatttctcccctaaaaataaagcgagtgaaggattcggaaatgaaatttttgcgggacgtaattaattacgcgagactcattcatataaaatcgcaaaaatttgctggattaagaactttttagtccagcaaaatttaaaaaattatggccttaggggcttgtggatctcgaaaatctgactaaaaattgtgaccttaaggacttcgggatctcaaaaaatctgaccaaaaaaatggccttaagggcttgggtctcgcatatgaaaaattgtggccttcggcatcatgcaaaatcccgcacataatccattcccgcaccggactatagttggcacaatttgtgccaaaatgttttctcgctgaccgtttgtgattgcgaaattcgttcactatttctttgataaaattttttcttggctttttgtccaactctttccaatcatctttgtcttcatcaaattttgaatgcattttagggtcgaattcgaaagttaacccatggaaagcctaaaaatgagaattatttcatttaagaacattaat

SEQ ID NO: 8021 - DNA, 3054 bp, Heterodera glycines
  misc_feature (44)..(44): n is a, c, g, or t
tcatgcattctgttctttactgaaaagtatttgagtgaataaanaattaatgtaatttttttttcaaaatgacaatttataaaatctgaatttaaattttgaaaaaatctctcgaacaaataattttttagactttttggaatggattccgagttgttgttcccgaattttggggtcgtaagccgggtttcgcttcatccaggatatcccagaaattatgacaatttttttgtgccgaaaaacattttggcgaattttgccagcccagggtcggtcgcggagttgggtccgataattagcaataaaatttggccataaacccttgggccaaacatgaccaccaccagcccagcaggcactcagcaagcagtttacattgttcaagggtgtgcacacgtagttgcggatctcctccccctccatttgtttggccaccgcggcccagttgcggaattggacttcaaatgccgtcttgctgcaaaggtcgcgcgccaaacgatcaaaaaccgcgtccacaagcagcacatggatgatcaggtggatgcgctcgtgattgtccgaatttgttagcccatgttcgtataatttgtgccctgaaatgaaataatgaccgatcaaagagcgtggagacggaattttaaaatgaattaaggaatgggcgccgccggctaatggaacaaattaaatttttttttaaatgccaaaaaagaaaggctgaaattaatggccgtaatattggtagaagaattctaaaatgagtaactataatagaggaccctaattaaaaaaggtaaaaaatgggcaaaaaaaaaaatctaaatcagtgaaaacccctaaaaattttttcacattttgttgttttttttagaattttctatgaactaaaaaatagaacaatatttgagcagaattttaactgcagccataagcttcaaacaaagttaaaaagcctttgtcatgaaatttttggtgttacaaattctcccctccccacaaaaatgtattaaactattagtagtattccaattggtattcattttcattgcacacagtaatattctattaacatacagtagtatggtgtaattcgctgtgttccgtatccaaaaaatgtatttatatatgtgttccttcattttacatacagtaacactacactcattcatatacagtaatatgctgtctgtaactcactgtgttccggcgggtccggatttttgtactgttttgccacccaaatgctcatttggttacggtcccattcgtacagtttcttcttctcccaatcgtacaacaatttgcccactataccatttttgcgctctacggcattgaaaatgtgattgccaaatgaaaactcagcgcccttttcggtcttatcgaaaatgtcacttaatttgggattaatttcttccattgaaaattttttttttaaatgggttttggattaatttatttcaattaagcagtaataggcatatgaattcaaaattgatcggaaatctataataatttttgattaaaatatttttttaatttcaaaaacgccaaaaacagcaaactgttgagaaataaaataattaatataatataattaattatccatccaaaacaaataaaatttctcgttttagcttatagaaaagaattatagttagtaaagtttgtttatttgggtcaaatttaattaaaaaattcaaaattaaaaaaatattataattagggctaatatttttaggctctaaaaagccaaaatagctaggctttaggctctaaaaaacccccgtttagctaaaaatgaataactcgaaaagtagcttaacaacccacaaaaaaaaacttgtttttcgtggcgctttaggctatttaacactggaaaaaataagctaaaacctaaaaatattggcactaattatgcataattatgacagctcaaaaaattttaaaaagaaaataattaggttttttaaaaaattaaatttatgtgttttttcttatttttaaattcttacgttttaattttgcgttttattttcttaaattctttcttttttcgttcccattcaatctttgcctttttgttgtcgttgcatccatcatcataatgatattggtggtaggctttatcatatttttctttcgcctctttctgctcattctttttttttgaaatttggcaattattttaattaattacaaactaatttttctttaataaaatattaatttattggccttttttaaagcaaatcacaattgaatttggatgatttgttgttaatctttttcaaatttcaaattttaattttttcttttaattctaataattataatgttcttaagtaaaattctttaactttttttttttgtacatatatcaaatgtaatgaaattttttgaaaaattttaatgttttctttcatggcgtgttttttccactttttttgtgccgactattttggctttttaaaacacaatctatttttcaaatttattatctgcaaatcgcgtagcttacaaaaaataaatttgcgactctgaaaacttgaaaatttatgaacttgaaatattggggagggggtaaactttaaaacgaatttgcaattttaattttttattaaaagttaatttttcttgattttgttaatttcacatttaattaattattttactttaaacaaagtgagtgtttgctgtttgtaaatggccagcttcagtacctccttcagtttttttactgtttctggcttttcggtgctgagtatttcaagtgcaagactgacttgctgctgcgttatcttcaatttacacaaatttttaaaaatagaaattttttttataaaattaaatttttcattggcataaataagttacgcttttttgtacatttaaaatatcaacaaaaattctgtaaaaactgctcttaagctaccgtagtttctctaattatcccccatgggggattatttttaatctcctcagaaagggggtgggggataattggagaatgggggattaatggagattgggggataattagagaaaatacggtat

SEQ ID NO: 8022 - DNA, 1532 bp, Heterodera glycines
  misc_feature (65)..(65): n is a, c, g, or t
gcagtgcccagggtaaaacaaaaacgaatttgatggttctgcccacttctttgggcggccaattnaaataataatctctatgaattatttctcccttttggggctcggcaatctttgcactttgattgtcaatcgcggcactctgcgccgaggctcttttcttgtctcgggtttttgttggtgtcgtgtgcggacgatgaacgacgaatttggcacttcggtggacagtgccggcccgagcatgccggtccaaatttcaggtgcgaaaacccgaaaaacaaaaggaaaatcaaaaatgggagggaattatggcattttttgattgtttttctcaacattcttaaggttggcgtgaccttttgccaccgccgggcgaattggcgttggaagtgcaaacgcagcaaatggcggagagagtggtggccattcgaacggataaaaaaaatgagacggaatcactgagggctatggtgggaattgtgggggagggcaaatgggaaaggaaaaagcatggggacggggggggggaccccgggttctgcaaaaactgcaacgttcggccatttctcagaatgtttccaaaattggatggaaaaaggggatgagagtgcatttggccaacaacaaaataatcgaattaataagtgtttaggaggcagtcgaagggaaacgctcggagctcagacaacgctatgagacagcgcgcaaagagaaaattgccaaaggccaattggaattatccgtgtaagaggagggggcgggggatgatggtcctcaaaatagggaaagtgtgggcataaagcgagggttggaactgcttggttcagttcataccaaatcaacgacgaactgaggaaggaccaaaagacacgggcgaagccgccgcgactttcactcattctcaaatgcgacgttgagggcacccttcaggtgcatacggagggaacgagacaatttaaatgccatagtatgatggttattaattttgaaacttcaaccacaagaggggtaaagccccccccccccccaaattcactgggaaaagcattcgcacgaatccgaaagagtcgggtatccactaacagagagatgcgttcttttcttttgaggcaatccaaacagtgctcgactcgtacagtgccaatgaccaagtgcagttggacatcgtttccacgggggttgggccgttgaatgaatctgaattggagttggccgctgaaacgaaggcgcatattttctgcttcaacaacaacgcatctcaacgactgtcaatgatggccaaagacttgaaagttccgctccaccaattcaacgtcatctacagtttggtcgcccatctaaaggtggtccataatatattttcaaaaattatcatttgttttaatttttcggggaggggggaagagtcggaacaggacaaaacacagcctagtcgagacataacacagccgggaataaatttttaaaaaatttcaagcttagaaattttttcccggctgtgttatgtctcggctgtgttttggggtgtaccg

SEQ ID NO: 8023 - DNA, 1385 bp, Heterodera glycines
ggtcagtaaggggtgacagtaggaggacaaaaacatctcggtacaatgaagacgaccatgtggaagtgtttgaggatgtgcggccgatgcaagagctcaattggactccgcccggcttctgatcggccgtcgcctttcgctctttcgttttttatcgtattttaaatttgaataaattcaacacaaacattaatacaaaaaaattgtaatttacgttttcattctttgtgtcccttcgtttcgttccttttccctctttctttgtgtacttttttgtacggattgaagaggggcgaaattggggtgggaagctgtggcggagcggcaggcgacagataccgcaagggaagtgcgccgggagcgaatggcgtggggggcggtgacgccgcgagcgcgttaacaacgtcgacggaagttgaaaacaatgctggggacggaaggaagggcgataaatggggcaaatggcacggatgagacggcggtgggacggggggacatggcgggggaagggcggacggcactaaattaaacggaaagcggtgagtgaaagtagcggaattacggagcggaagggccggcacgggcgacggcgccaacggttcgatgggcaatggctcagggggcactgcctgaggggaaacgagaaaaagttcctgcagcagtggccgaagctgcgacggcaatgatctcagagggaattcggcaagcgctgccggggctaagcatttagaaaatgggacggggaatttcacttttggtcattttacccggcggcggtacgggcgacgaaattggaagaggcgccggaagggcgagtggtgggggaggggcactgaacatgccgggttggaagtacggcaacgacggcggaggaggggccaatggcaccgccggcggtagcacagccgtttcaaaagcttgagccaagtcaaacacctcaacggaaaattattgctgacttaaacaagcaaattcgctaacaattggccgtgccggaggcaaatttggaggtggaagcgccgattggaaaactgaaatttgtggatagcgggtaaaaatgcaattttttgccacctgctggcggctgtgccgcaacttcagctggaattgctggcggcactattgccaccgccggaggctcaatgtcaaccgcagggggcggagactaaaagggtaaaaaagggaatgaaacaacggaattgctgaaccaatggagtagccgctgagggcaaaagagtacgacacggggtgaaagtgcaaaaaatggcgggaattggcaccaaattatggggggacagtggcggaggaggcggaggaaggacggtaagttcagcgaacagcggcggaagaagcagcgaaatggcaaacggaaaaagagagcgcct

SEQ ID NO: 8024 - DNA, 4264 bp, Heterodera glycines
tagggaaaaagaaacgccgtgagaaattacattggcaattccatggccatttctgtgcccgacgatgaaaaggtcgttgaacggagctaagaagaacagtgaagatgggaattagcaacgtgaagcaacgcttagtgaacgtcttgcgaacgacggaaaggcttaaatacgcccgaggggacgaacgtgcgctttgtctctgctgccattgtggcaaatcccagcaaaaacgagttggggtggcagtgacgagacggagaagaagacggacaacgccaccggacggagacaatggccgaaggatgggattaaatgacggactggcggacattgtgcggacggggcattgtcttatggtcggattttggggaaaccgatcccttcgctggagaaagcgttgccccctccccccccccccccgcttcagctgatcattccacgtttccgtgcactttattatcacattagccgagtctctctcattgccagcggaagaaacaaatttttgctgacattttgaacaaatttcaaactcaaattaatattattctcagaaaaagcaatttcatttagtcattaacctaatgaatggaatttaatttaattatgaagtcatttagttaccctccttttattcaatggctttttgcgcattttcaatttcaaagtgttgacaatgactccgactcaaagttcatgtcagcaattggcaatttgtcagaaaaacactttgacgtcacttagagcaaaaaggcgacaactaatggacggggaaagcggcggaaggcgtaggggagggaaaactaaggggaaagaaacttggcaaagggggaagcggacgtggcacacaaaaaaagggggaggatggcaccgtggtgagctatttgacctcattcaattttaattgtgattgattgagcgatgaaaaagggacgagcgattgaaatgttaaatttgacggtggcaccgtggacaatcttttgccaatttgatggaaggaagtccttttcaaaatatttggaatttcaaataaccattttctctccactttttgctctttgggacattccgctataaatgtgccgttcttacaaatggcggcgcggcaccgcgcaacgatccaaccccactccccccccccttaagcttcatcgaaaagcggatggatgtctttgacggcttaatccccctccccacccgtcagtttccacgctaacccatgtcagccttaagctgtgcccaatgttttcgttccattgaccgatcgctggattcatttatattattattatttacattgccccaccatttaccaaaaagagaagaatggcataactctgtaaatcgttatttaatcccaatcgaacatttgtcatttttggcatttgggccaattaattataaaagggttggttgaacaattagacaattcaaaggaacaaataactcccatcagcccttcccccccccctttgtcccatttctgtcagcgacagaaggtacggtggacgaattcgattctgtgctcggacaaaggctttaaggtgttcaaatctttcgttcgtctttagtgtcggatttggcacaattaaagtctttccccaagcataattttaaaaataagccattagtcagtcagtgatcagttccgagttaaaccaaaactaaagggctaacaatttagtaggtttcacctccccccccctccttttcaatgaaaatctcattatgacaacttttccggtggttgtctctgctcataacatccgttaacatatttagtaagggacaattgggcacagaaaaaatacattagacaggaaaaaagtgtcaaaaatgttctctttattttcaaatttgattaaaacaccaaagatacattttctatgttacaggaaatggggtgaaaagggaggagaaattccgagggcaaaaggtgacatgaaaatgtggcgaaagatggtcggcgattacttttttgggatttttgtgcttttgaacggataaaacaatgaatggactttaaggcataaatcgctcggcttccaaagacaacaaaacaaataacaacaaccaccaccatcagcggagaatatttatgttgtgatcggaaacaggggagaaaaaacaaatgaggaaatacgccgaattggatgaattctcagagactgaaacagacgagcaaatttggatggcgatgacgagaaatgagtgaacgggcggagaatgaatgggtcggaacggtccgatggaaaaatgcaattggtaaaacaccggcgaattccgaaccattcaaagggcaaaggctccacccgcacgaaaaagacaaaaaatgtgagagttgtcacaatccaaaaagggggaggcgagggcaaacatcggctgctgtgctgcgtcaatctctgcaagaggaggaggaacccgcggaggcgtaactgccccttccgttcaacgacgtgtcgaagccaaccccgtcgacccgtgcccgcatgttcgggtccaaccgattgaagtacggatggcgcagcgcctcgctcaaagttatgcgggacgccggctcgtattcaagcatactccggattaaggagaacaattgctgatgctcttcactggttgaaatcatatatctctggaggagggaaagggtcaattaacggcggaaggcacggacaaaataatctcacggaaagcggtttgcagtggtcccgaacgtattggccggctgttgtgtggtcgtgccagtcgaggcggccatggaaaaaatactttgttctaaaacaatggcaattttatggcatttaatcagacgatggcactcaaaaaacattaacaaataagtccagctctcaaaactgacttgcttttccgccccattctgtaagggatgccatccaaaatgcgctgcatcatcgccaaatgctcgcggttgtcgtgcgtttggaacaacgtcatcccggagtacaattcgaacattatgcagccgattgaccaaacatcgcacggttgagcccagccaagttctgaaatgtaaaaaatgcatgatgggaattaaaaactgttgacatgcgaaattctgacctaaaatcacttcgggcgcccggtagtgccgcgtggagacaatggtcgaatgatgctcgtggtcgaaggtggcggagccaaggtcgatcagccgaacagaggcgtccttaaatgcccattttccaattttaatttgttttccaaatccattcgaccttaataacccgaaattgctttttccgcttggcttcctccccgccgttgaccacgtcagactcactgttgacgaacaaaatgttttcgggcttcaggtccgtgtgagtcaatttgttgtcgtggagaaatttgactgcgtggatcagctaaaaagagaaagggaccaaatttatgataaaaatgaaaattggaaactaataaattattttattccattggccgacaaccattaccaccgtcattacctgataagcgatataccgcgcctggtccattgggtaaggctggtaattgttcaatttctttaaaggggtaaaaaaaatagcaagaaaaaaggacaaacggaattttttttttgtcggttaaagggaataaaaggcgcaccataaagtcgaagacactcagtccgagcagttcgaacaccaaacacatgtgtccactgaaagcggtgctttgttttctgtgcttttccccaaacccaaaacccactgatagtcgaaactgtccaacaattggatgaccaaattgcgtccgtccgggtccttgtccttcaacttcctcagaacgttaatttccagtcgagcggcctctctgtatttggacacgtttttgatgattttcagcgcccgttgcggcccctttgggttgtttaagtctttcacttggacgactttgccgaaggttccctcgccgagagtcttcacgatttcaactgaaaatggcaattgtttttaaattttgtaacgaaaaatttccaatcttaataaattttgtgagaaaacggacgggaaaaacaaatacgaccacctatagtcttacatttgttgtcaattctgtccccatttgagtagatcaaatgtccatctttgtcgtcctgaatcggcagccgatgtgctggcgatgcgcttacaaccacaccgcattcgccctgaatttccgagtggtggtgctggttgtgtgtgcgatggtgacgtgcgcctccattagcatagaactgaaaattgaaaaaaacaataacatttaatggcga

SEQ ID NO: 8025 - DNA, 2414 bp, Heterodera glycines
tgcattcattaaattataggacctaatggctaaacaaataaacttgacactctctttcatttatataaaatatttttcttattttaaatttaaattctgaattataattaattacatatttaaaatttataaatactatttttcatgaatatgattttgaaaaaatttatcaattttttttccttataatttcacagacctctggtcaactcaatagactctgagcaagcgtctataattgtatgtatttgtattcgtcgccataaaaccctaaaaaaaataaagtgtttttttggatttttattatgaccaataatcttaacaattgccctggctttgaaattccattaaataaaattcgctagattttttttttgttttttttcaaattgaaaaatctttaaaaaaataataaatgacgtgccaacgggtggaagccggtgtgcaaatgggaacgaccactttcgttggccaacagcaccaaccgacggtccaatgccatgtcaatgcccaggaagccattgccagcaaaagcgacacggttttctgggttaaaaatatggaaaattgagggggaagggcaccaaaatgccattttcatcgcttgttttgcacaatgccaacctcgccaatatgtgccgtcctcggcttgtccatttaccaacggatgggaaatgcctttcctaaaattttttggggaaattaaaaaataaaaccaaacctaaaaaattggttgaaaattttagttaggcctctatttttcaaccccctcggaggggtaggggttttggaaaaatttaacccattttttagaccaaaaatgcgaattaaaaaaatttgagtttttgttcgaattcgggtccaatgtagggagttggtcgaaacggacgccagattcgtgatcagcgaccacaaagcccttggaaacaaattttatgatttttgaaaacaaaattttttgtttttcaaaaaagatgggttaccatcggcagtattatccatccatatcaacgacgtcatttacaaaacaaaaaaatccagcggtttttttaaacgaaaaaatctaggggattttttttcgaaatttcaaaaaaaaatggaaaatccgcgggggactgagacgggacctgatcatatggtcggccacacagtgctcaatggccggttgtttgttgctgtaaatgttggggcctggccatccaaacagaaatgtgtagaggagcagcaccgaaatgacacagccgacaagtgccaaccgtcgggaactctgccgaggcctaaaaaatttttggaaaattcggcaaaattttggcattctttacgaatttttggggcaaaatgcttacattttttgtacactcatatgtagaaacaaaattcttttgaacaaatgctacaatatttgttccaattcaatttgtgtgtataaaatttgaaaaaaaaaattctacaataaaacgtggccgaataaaaatgccaattttatgttcaaaatctaacaaaatgtgccgagataggtccagaattaagctgagccgacgcaacaaccatcgcttggccgtcatccaagtaaacatgaaattgttggacagtttacaattgttgtacaaaattcaatttactgtaattgttgtttgacgccgaaaaattttatttttaaaaaatcgggaaaaatttcacgaaaaatttagtgtcaaaaatataagaatttctgatgaagcggaaatttcatagaaaatttacttgggtttcttaaaaattgaaccttacaaaaacgaaaattaaaaaccatgaaatttaaaaatgaaacattatgccagaatgaacaaatttaaaaaaaaaaattaaaattatttcgtaagaaaaatctgctgattcacaagtctagccttaaaaaacaggaggaactgtaagattttccatttcaattagcatttagctaatttattcccatcttcatgctaatttgaacacggatttacaccaaattctgtcctgaaatccgttgaaaaactttgttttccccaatttaaaataaaaaacacttaaaaactttagctcaaatttcttagagaagagtgcgttctcttaatttttcaacaaaatttatgtgctccgacaacaacgaattgctgaaggacccttccgccgcccacaaattgacgcttttgttggccaaccgccaccgttgtcataaaagcagaaaaactttggccgattttttacgaaaaaaatttcattttcataaccgtcgtgtgaaaaactgtgccaccaatttgacgacgacgacaaaattttttaccgatattagaaagggttgttacacgaaaagcattgaaagaggaggaggaataagctaacaaaagtcgaggacaaagtgccgaaagtcgagacaaacgaacaaaaaaaagtga

SEQ ID NO: 8026 - DNA, 2205 bp, Heterodera glycines
aaattccaaactttctcgggctgaatgatccaaaaatgggactgtacatccggaaaaatggagtattttaatccaattagtcagtccgtcattaatttttcatgcattcgtaaattttaaaaaatctaacaaattccaatttttccgttacaggtggtggtggcggttcggtgtgtggccgtgaacggttggagttgctcagcgaaatggacgagttggaaagtgtgcactcgtcgatgaccggcggcggagcggacattggcggctgcggtgattccggtgccattttcatcaatataattgcatatttcacacctaattagttaattaattaattttgatcgaggctttttttaaatacccaaaactttcagatggcgaaaacattgagttcgccatgatcgattcgtttgctgaccaagtggagaatgcgcaggacaaacggtttttgttattgcaaaaaaaaaaaaatccctttatttaaccgtttttcattcaatgatcagagggctcaattttcgtcatcacttactatttaagatccggaatttccacaaaaaaaacggaccaaaatgtttcggaaactactttatacaaaatcattgttcctgtcccgggttctatagaccgcaaattacaattttacggacccaatttgcgagaataggattcaaattttgcccgaaattcggtaaattcttggaacattgaccgatccatttttttaaatttgtttttcacaaattcagaattgccacacggacaaaggcgttggacaaccttttgttggtgctgcacaaacattggattccggacagtgtgtaagtttttttttgatgatgaaaactccgccaaaatttgcagaaaattcgaaaaaaaaaaattttttttttcagtgacaaatggcgttgtgccattgcggaaattgtggagaaaaatttgaaacggacgtcggaggagacgattcgcgcctgttcattggccgcactgatcagtgtccaattgggtgtgtgttgtgccttttttttacacaaaaatgccaatagccaacccaagaaataatttgggtacatccaaaaacgtggcaaaaaaaaaaatttaaaatttaattattttttttgaaagcctaaatataatttaaaaaaatttttttgtgtctttttcttaatgtaatttttttcgaattaggccaggcataactaaaaaacttgcaaatttaaaacaaattgtggcgagattatgtcccagagacgttacggcgtcgacactttgtcactgttccctaaaatttaaaattttactctaaaattctacaaactttaaatttttcgtcaaaatttttatcttattgttcgtgcctgatcctacatctttttcttggccacaggtgttgatcttgagaacgagctgtgtgccattgtggaggcgatgtgccaaatgtgcgcggatggaaccgccgccgaagcggtgcgtgccgcgtgtgcccaagccgttggcatttgcgtctatttgagcattgaggtgggtggatgcacgaggattttcaaatttaaaatcattccttccccctgaaaaattaacaaaattttaaatttttttgcgatttatttttaaaaaaatcaaactaggtatcatataagtataaaattcttaattgaaattttctaaaaagatagatttcttttctttttttgcgctggaatttttcacacgaattcgaaaaataaaattttttttttttaaatttctcaacgacagagtcgtggccaccgtttcgctgcgttgcaaacgctcaaaaatgtttggcttggcatgcgaccgaccggcaccgacggcacttcgctgttctcatccgcaattgcctcatgggcactgctgttggaaagagtgagtcatcgtccaaattaacgaattaaaaattatggaaaatccgtaattaccggtggtaaaatttcaaaaaaaaattggtaaaaatccaatttatttttgcttaaacattcctcgctacaaattgcaattacaaaatctaattaattaattgctataattactagggttggtcgggaccgggaccaaaacacggacaactgagtatggaagttcccggtttttcaacccgaaaagtgccggtcccggttttgcccaaaattcccggtcccgacctactctattaatactatgcccttaattatgccactaattaat

SEQ ID NO: 8027 - DNA, 1091 bp, Heterodera glycines
  misc_feature (115)..(115): n is a, c, g, or t
  misc_feature (1030)..(1030): n is a, c, g, or t
tatttatgtataccattggacagaattgagtcgctttgtatttgtcaattttttattttagcgatttggttgacgaaaaaaaacgaaaaattttatcgggcctcaaaaaactaanattatagattttttttttatgccgtatcaatcaatcacttgcagaaaccatgccgaactcgtcgacgtgttggccgacttggcgctcgactcgtccaagcagcgcgccaagcgggacaagaaactgcaacgaatgacattccgtcagctgaacgacgtgctgttgaccaactccaacgccacctcctcctccacggccgccaccgtacggttcaacaaacagcgcgaggcgctggcactggacggatgccatgccaaactgttgtacgacgcgttgtgccaactgttacgggtcggtggagtggcggggcatgggaatttgcgcatgaattccggggcgcatgaaaattttttcatgaaacgactccttggcttgttgttcgcccccctcgaaaaattaattttgtaaaatttaacaaaaaaaaaaaaatcgttttggggcaaaatgcgcgtgttgtgtgtcaacacgaatttttctagcgattttttcaaattttctgatgaattacaactatttggtaagttttttctaaaaaaaaattccaaaattaccgaaattttaggttttcttaaaattttcctattaatttttaaattttaaaacttggcacacaacttgcttcccaattgtgtggaacattcatttttctgttgtttttttgtacagagtgacctgaaccggcacttaaccaccaacgaggtggtgcgcgaactgttcgacttgggccccgtgctgaatgaggaggaacaggcacaaaagatgtccaaggcgcagaagttggagcgggtcagtcagcttattacaatatgtagcattaattgatcagcgaacaccttactgatcggcaatttgatcaattgaatatctaatcagagttcgaattcgaacaaaaagatgatttttatttttttcaanaaatattcatttttctctgataaaaaactttgaattcttttaaaaacaatttattttggtg

SEQ ID NO: 8028 - DNA, 1511 bp, Heterodera glycines
aaaattttgatgaaatattcggcaacgaatggaacaaaaatgaacgacaagataaaatgataaaatttgaacaaaatgaccaaaacgagcaaaatgaaaacacatcaggagttgatcaaatgggtgaagaaatgggaaatggtccaaatgatcaacaaaaaagagaaactgtcaaaaaatttgatgcaattaaagaaaaattaaaagaaaaaggaaaatttgaatggaaaaaccaaagcaaaactgagagaaaaattgcgaaattattaggcacaaaccgaaattcaatacaaaaatggaaaaatgaattaaatttaaagaaaaacaacaaaaagaaaaaacaattttatgagcagaaaaagcgcaaattcattgaacaatttggtgaatttaaagaattatatgcccaagggaaacagaaagaatttgtgaaggaattgggcatttctaaagacacatttcgaaagtggaaaaaagaattggcaccaaaatatcataaaagtaaaaataagagatttttaaaaattttattattttatttttgtttaagcacaacataacaatgttgacaaattgaaaaagatgaagcaatattacgaaattaaagaatcaaatcctcaaattagtgaccgaaaaattacagagaaattgggaattacatgtcggactttgttaacgtggaaaaagaaatttgcctcattttcgaccatttgattttgcgggtgataatcggctcaaattttttttaaaaacaaaaaaaaaaattttaatgcgttaatgaacaaccctaaagcattttttgatacaataaatatggtatttccttgttttgtgacccgcctttcttcaaaattatttaacttcttatggtttgttcgaatttcagtacaaaaaattgaaataaatgaaaaaatcaagggctcataaactcataaataccaaaaatttatacatttttattcgatcgcttttttcaattcatgcatcgtcgaacagtgttctcgaacatgaaattggttctattctcgagcaattatgagcagtgaatcacgtagaaccccaaaattagtccattgtcaagtgacggtgtccaatttatttctataaattttaatccgtatagagaggtggaaaaatggccgaaatatgaatgcaatatggcaaaatattataaaaaaaacgggaccaaccaaaatcccaaggaaaaagaaatcacatggaatttgaagcaattaaagaaaaattgaggaaaaattggataaatcgccatgaaaaaataaatataaattaattactagggatgcgattttatgcacaaaaaatcgtgaaataggcacctaaaaagacagaaaaaaaaatcgcaaaataggcattaaataggaacaaaaaccctctaatatgcacaaaaataggcaaacaaaattttttattaacgctttttaggcagcgaagcacgtaaaaagttaatttaaaaaaatttaattttgctaacagttcaatcattttaaagt

SEQ ID NO: 8029 - DNA, 4218 bp, Heterodera glycines
accgtattttctctaattatatgcccgggtatattatttttcaaccccctcagaaagggggagataattggagacgggtagattaatggagacgggcatataattagagaaaatacggtaatcaaataatccatccaatttttggtcccacaaattcattcattcatcctttgctcattgtcattacgggagtcggggtcgttttggcgcccacgttttggcgccagggtcgttttggcgccgacgttttggcgcccacgttttggcgccaaaatgtggagaaagggcgaaattgtatatttttttgttttttcttggagtggggcaaagtctataaaaggagcaccttcctagtagatttagtatttttttcttttcattcttcaaataacgcatttttgttttttcttgtataggaaatgataaatcgtcaaattgatacaaaaaggcagaagcctaaaattacctatgaaggccagctttacaccttcgataaatcaagtgcggacggaacgagaaaattttggagatgcgaatacaagaactagagtagagcgggaccgggaattttgggcaaaaccgggaccgggacttgccgggacctgagaagccgggaccgggacctcgatttttcttcgggaccgtgaaccgggaccaaccgagaaatttaaaaaattcaaattttaatttatttcaagaaaaataatacaaaattaatttttttttaatttaataaaatccaaaagttaaagctaaattaaattaaagaaaattttcaaatcaaaatttcttcaattatttcaagcaattaatcatttgggctaaatggtcgaatattatttgaaatttaaatttacttatcacaccactttttccggcgcgctttttccagaaaacttttggggaaaaaggtggtccggcggtgccgttaggcgccgccgggggaaattttgaaaatttgagtgagatttgttaacagattttcaacaaaaatggcttcttttttgggattattaggctcaatttgtacggattttcatttaaaaaataataaaatatatatatcaattaaaatatatgaggaatgatattttcttgattggaaaaccaatgagtatacagaaaaaaatcagatattttattacatatttaagggtgctgagtagagaccggaaatttcaaatttgcggatcccgctgcgtgattggtgttgtgtcttttgcttgaccacaacacttagaaagaataatctttaataaataaaataagtccacaaatagataaataaaatagaacaataaattgatgacagaaaataaatgcgaaatgaatgagagatggcaaaatgacatggactgaccaagaataactgtgtgttcggctatttatgaggatgaacacaggtaagagacacatgaatagtgtgagggagagacatgacaaagcgagagtgtaatggtagagaaatagagaaatgactgaaagggaaatgagcgaaggcaattattgattgactacccaacatctccccttttaagatcagaccccgatagacataatcatatctggcttttgaggcatccgggttcaaaatcttcggtgcctttctttcgcgtgttgatcgtctcagtgttggtggcgattgtgctctctccagtggttcgtttagttcgtccgcaaatcgtacacgacgtggcgatctgggttgaacttcttccggttgatcgtttggcggttgttgctgtgggtgttcgtcgggcaactgttcatggtgttctttgtatgggatgggataaatttttctcatttgattggaataccgtgtgactacggcattcaacttcggagcctgaactttccaaactacaccattgcctgactcgatcatgcccttcaaccaagtttttgtgccatgttggtagttgatgaactgcacttggtcaccaatgccgaactttcgttcatgtgtgccgtggtgctgattgaattgtttgatcatccgctgcttgtacttgtcgttgcctttttcctgcttgtcaacttggggtttaacaagggaaagaattgtccgaaccggacgacccaaaaacaattcagcgggcgttcgcccgttcaaacttgcgttcggcgtgcttcggtaggccaaaagcgaattttgcacccaatttacgtcgtctcgggcgcacttcttcatttggcgcttcaatgtgtcgacgaatcgttcggcacgtccgttgctctgcggatggaatggcggtgaaaatgtctgtttgatgcaatggtttctgcaaaattgggaaatttcatttgatttgaatggcggaccgttgtccgtgacgatttccttaggaaaaccataccgcgagaacaaccaaacaaacttttcgatgagcatgctggcggtcgtcgtggtcattttgatcacctctggccatttgctgtaggagtcaaccacaacaaggtatttgtttccgtcagcacaaggaccagcgaaatccatgtgcagtctttcgtagacttcggttgatgatggccaaggatgaagcagtacttttgatggcgctttggctgctgaacgacattcctcacagtttattacccacctttcaatgtccatgtctatttttggccaatagacaaattgtttcgccaggctcttcattctgaccatgccgggatgggtgaaatgaagtgccttcaaaatgcgaaaacggagtgcggatgggattatgacgcgatcgcccatgagcaggcagccgttgacttcactgattcgcagtcggtgcgtataaaatgctgccatggtcgattcgtttgctgtttttggccatccattcctgcaatgttcaatgacctttttcatttcttcgtcacgtttaatgtgttctgcgatttcgtcggccgtgactggcagttgatcaattgttgtttggaacatgtagtcgactgctgcggcacaaaactcaatgttatcgtcctcggaattgtccaaattttgtgccatctgtgcagaagcaataactttgtcctcctcttgaagtgtgtcgcgatgctgtttgatcagtcgcgagaggacatcggcctggccaaaatttttcgtcgagatgtaccttatgctgaaatcataatttgacagaattaatgcccagcgttggagcctagacgctgtgtaaatggggatcccgtttttggacccaaaaatgctgattaacggcttatggtccgttaaaaggctaaattttcgcccatacaacatgcgatgaaacttctgtacggcgaagatgatggacagcgcctccttctcaatttgggagtagttgcgctcggctggcgtcaatgatcgggacgcatgttcgacgactttttcgctgccatcggcgaatgtgtgactgatcgtagcgcctagtcctttgttgctggcgtccgctgcgacgacgattggcttggccgggtcgtaactcgtgagcagcaaatctgaagtgatgattttctttgccccttcaaatgcctgctgttgatccggtccccagcgccattgaacatccttcttaagcagttcgtccagcggtgcacggatctcgcgcatttggctgacaaaacgggaataataattaattgcgccgagaaaagagcgtaatgtttgctcatccgttggtgctggcatctcgttgatcatccgcgatcggtcggggtctggtcgaatgccttccgctgagatgatgtgacccaggaacttcagttcggtgcagagaaatttacacttctcgaatttgactcgcaatccccattcctgcaaacgactgaaaaatttgtaaagggtttgctgatgctgatccatggagtttgttgccacgatgaagtcgtccaggtagacgaaaactccatgaatgcctgtgactaactcgtccattaatttctgaataatggacggggcagatttgaccccaaatggcaacctctgattaatttttggtcaaaacatttaaaaaagcgaaagatttcaattttcgttttttttatctgggatataatattatatttaaatttaattgtaggagagaatgtcatcgaagtatgaaatgcccgtgaaataattattcttttagaatgaaaatattaaaaattgtctacaaatacatatgtctctgtctaataatttccccaatataaattcatatttatttcacggggaaatgttagttttttcgtaaattgatt

SEQ ID NO: 8030 - DNA, 5711 bp, Heterodera glycines
  misc_feature (11)..(11): n is a, c, g, or t
caaaatgcacncgctaaaataaaaaattcacaatagaactcgatcctcctctatccaatggtatatcgtttataggcattttccgactgacagctcggaatgttcccttgtaagccgtttcggtttcgggatttggggcgacttatccacaaaacaactgattcgaactgtaaaagggagggctgaaaactgtgcaaagtgtgggcgaactgagcactgtcagcgtcaccggaagattgtcattggcagacgtacagccgagtcggaagatgcaaatcggcgcgcttaaccttccggattttagcggtgttcagacgcccagtgacttgggtattttactttcaataaccctttgcatttgctttttatcaattcccactttggagagagcaatttggacgagactttgtcaattggcaccacaaactctgctgaacattttctcatcgacggactactaaatgttggcgaggacgaaatggtggccggcgaagaggtggtggaagcggaggaggcggtggaaagtgtgcaggacattgcgatgctgcggaggaggggcaggacgttggcccgtcaagtgaatgtgctcgacattctcgtggaagacctgaacatttgcgcttctgttgtagacgttcgctcttccgtcttgggattcgcttcggagtgcgccatcggcttcttttttccttctcataattccctttttagtctctatttcggtgaaagactgggcgtaaaatgtggcgaagtgtacgacgaaaggggcgccacttttgagccgaaacagcccatgctgcagttgaacagaagcgacggaccaacgggagaatgcgaatcgaagtcggacgaggaaaggctcagactagagatacgatcagagccgaaacaaaccgcgataaaagtgcagtttgggatggaataactgaacacagcaatccatgggatggtaatgatgaaaagttacagttaaatgtgcatggcgtggacatttgcgtcagtgacgaggtggtctcccaactggcgccgttcattgaaaaccccgcagaaaatgcacaccctccagcacttgagctgtccgtacagaagtgccggattgaaattaaagtaaatatttgtggggtttaagaagttatattaaaataaaaaaacttggacaacaggacccgaagaagaaattcccaattcggattggatttgatgaactcaaattcgaagacggaccagtaagcagcaaacaaacaagtgcttcctagtgattgaacctggcatatccgcgttttgttcctccatctcggggatttatttggccttttgattcttttttattgtggatgatcgaatgttgaacgcttttgctgaccatttgtttgaaactagttcctgtctttctctccacagttcattagaaatgcgttcgttgtttgttatttacgggatcgtttttctttcttttttctaacatatcgtgctcaatttaagtctctgttgatgtcatattgtactgtgttacaacaccaatgaaaaatgatcaatgaaatattttcggtaacgaaaaaaaacttatttttataattttagaatctatttgtttccttaattttattaaattcatattatttatttcaataaaacacgtgttaattccgttcgtctgttaacattcttctcgtgactttctcttcagtctgtgtttgcctttctccgccttcgaattggcttagaaacgaattcctttgctgtgcgattgtcttcgaaattctctctcaaaatttaattcgttttattttcttcctgcgtttcgctttaccttcgtaattcatcacaaatttcccgcaaagttcgctcagtctgtgaagctccgcgagatgtattcgcagcacaattgccgcgtcgaatatcacttcgtccaccatttcgctcttttgggtttccccggggctttcatcagctttttcacctttttctccaacggttcgacgcctccagcaagcgaacgatcatctcgaacgggggttcaacggcactcgttaaccattcgttggcatttgcctcgctcgacatcgcccgtactcgaaaaggccgggctcttcccaaaattcggggctaagtgcccgctcggcatttgaggaacaaaagcttaattaagcgtaaggaaaaagtgtattatggccacatgtcaatgggctgagaaaggatggacggcacaccttaacaatggcgaagtgtggatgtcctctgatcatttcgatgatttggtcgaatgtctttgacacatcaaatggttgtgaaaatgccataaaatacaaattatgggaagaaatgggcaaagcaaagaaacgcgaaattagacgatcaaaagcacctcaaaacgcttcaactgataaggaaaatggggggggggaatgaaaggaaaggaaaaatgagacggacggacggacctttggggtgtcaaaaaagggggggggggggaaataaaccataaataatgcgattgttcgtctgagcttcattagttaataatttaaatgcgataactacaatatgtatgtatgtacagtttgttagccaaacgcagcaaaaataatccaccaaatcacctaaaaaggcaaacggcactatgaacagcatttttctccttctgaaaggccttttccctttaaaatggcatttccccgtctttttcaatcttacaatttattacacctttcctctcttcctccctcttccgctcattttctaatctcaacaaaatctctccccttcccttctcccgcctttttcatcaaatgccgccaacccaaagaattaattaattggttttatacacaaaagataatttattaatagaaatcctttcatctcacaatataattaagcgctgatcagctattttttgtctttctgctcaaaccgatcggctgaataaatattttgcgaatttttcctccgcttggcttttttcccaagccttccttttgaagaagcgaatggccgcgcgttttcgcctgccgcagctaaggcctaaagggaaaaggcttaaaagtgaagggttaggaagagtcgaacatgagggaggctgacagcagcagcagcaacacttacagcagcagggacaaacgcagggcaactgaacggagggggggggggcggagatggacagcaggaagaagcgggagaataattattgctcgaaatcctcaattcttgaatttttgtgaaattcgagcctcccccataacagagtgatcggtggtcaagttaattttatgacggagataataaccgatgaattaaatattggtgtgcccacctttatgcaaattggcccctgaaattgtaaaaataatttaattgtttttctgataccatttacaatttttactcactttgtgacaacaacagcacgtgcaacagcagggacagcagcagcacttgctaattggggcaaatacaactcatattttcgactttttgttttattttttgattttaggttcgaactcgtgtcttacgaaaatggcttaattacggccctaagatatcgaaaactctttcataaaaattggcggaggggggggggggggggaatttgctcaaatggtttcccacgcacttgcagcaacaacagcagcccgcttcgaccattcccttctccccaattttgtcaaaaagcatcagaaggaggagaggggaaaatatcgctgaacagagaaagaaacgagccatttttggagaaattaattgggaaagcaaaatgcgaatttagggacaaatgaacgaaattcagtggaaggacggactaataagtgacgatgatcagaggggaggaggggaagtgatcggaggggcccatcgaaagggggggggggacaatgcgattggatggacaacgaacgactcggacaattcactcgccgccgaccgacagattctcccccctccccccgaattgccaatcactccaattaatggccaacaacgacagaagaaatgacaacacaaaaatttattaaacaatgttttgtccacgggaatcacccacatttccgagcagtacgtcatcagcagacaaaaaaaacaattaatcataattaataaaattgcatggagccaagacaggaattcgagattaggtcccgaattttgagtctagctgggtcaatcagcaagaaattgcgaacatgaaaacatgtaataaaacatcattttcaaaaacgttttgcaaacagaaggggacttctcccattttacttttttcgttcattcccaatcagaaaaaatgacatttttggcttttctttttcaaatttttattcaaatttgaaatttttcttggaacttctaatcaggctcgattttactacaaaaatatacatttgtactaactatattatcatatatgcacagaataatatttttatttttgccttcgtttaaaatcccttggcctgtatttccattaacaaataaacgcgcaaattttcgtcctcaacgttttgatttaatgcatctccgaccattttcttctgctgtttttccactccgtcgtgcaaaggcaaactctgaaaaagtgaaaaaggaggaaattgagagaaaacgaaagtaaagaacaaaggggggaaggagcaccttcacataatccatcacttcgtcagcaaattgaatccaaacgccttaattatccaattaattacaaaggtgaaagtgatcggtttcagatcagaaacataacaaaaagagcatttcatgaagagaaaacccaacaaattcaaagtgtttttggtatgtttctgcgcaaagctaaaaaaaatcgtacagtttgaacagcccgaaccacagcaaaggtcacgagacggaggagtgggaaattgctttatctgaatgaacaataagtgtctatacgcttaaagcaaaggtttgaattcgaaaatgccctgcagcagagacagtggggaaaaccaacggatgaaacgaacactttttttgttgcttttcggcccttttttctcaagtgcaatttttaagtgccatgtttggacgatttttagaacaaaaataatttttaacatgctttttcaaaaaaatttgggatacattggtggtatccggtggttctgatagggccgcagaggaaatatttgggatttttaattaattttgctaacaatacataagtaaatgtggtacgaagtacgtgtcaaaaagaatcatattttttaatttttttttatgaaattatttattagcatgctttaaggattacattatttttcaacaatttctaacccgaacacgaaaaaacatttctaagaataaaatcagtttttttaagaatttttgtcaaaagattggcaatgagaccactgattttttgaagttcgaattgggttttttgtgtttggaattgttgaaaaccatgtcagtccctgtcagcatgcttttgcctccgtttaacccgtgccgacgtcgtctccgttgccgccccgccgccgtcggtgaggccaattcctttgactgattcgggcgcagcgattggctgtccgatgggcccaatcactgacgacttttgaacattcgttgcacaatcacttgctgaaaagagagccccaaaaggcgtaactttgggcaatggtgcagttttgtggtttctgcgtaaataaattaaaaatgtaagaagcattttttctaggataaaaaaatgcgctgat

SEQ ID NO: 8031 - DNA, 1111 bp, Heterodera glycines
aaaagaaaagtcaatttaaggcagacacatatcgcaattagaaccggctcttcaagtcttatgcgcagaattctcgctagaataaactccaaaggacgtccattaacctgaatgtgtaattgagaactcagcatgggagaatgtataaatgtagaaaagctgtaacaaattcttgactcgtttctcactagtcaacaaacagtcaataaattagtctttactaccccacaaaataattcacatctaactgaagacgcccacaaaatacggatcaatggcaactcgtaccaaaaaaacagcctaagagcttcaaactaaaacatacaatctctacatcaacaaaaaatctaaatcattgccctttttcccgataataaaattactcgttgggacgacggtgtgcatttgggaggagagggaaaggcgacaatgattgtctgaaagccttttgaacagaattcgaaaggacggattggagaagaagcattgccaaacccagcgcatttctcacatctgcggattgacaagcaaaatttaaaaaaagaaaaaactaaactcattttcaataggcatttaaaacctcaaatttaggggtataaaatgacaaaatttattcaaaaacacggcgagtcaattttgggctccaagtacaactaagttggttttttcgtcttagtggtctgtgagttagtcaaaaaatggggggtcacaggtagagaccggaaatttcaaatttgcggatcccgctgcgggactggaactcaaaattttttgcgggacgggatcccgcgggattaatcccgcaaatcccgcatttaaaatttgcgggatcccgtgcggaattgcgggattttggaaaattcgaaaaaatttcaattaaattcaaaaaatttccaaaaatcaaaaaatgctgaaaaataaatttttaggggctgacgggatgcattaaaaggggctgatgggtcgactaagatttttcgattggatccgacggtaaaaagttgatcggaaatcaaattattaacggttcataaatttgactatttttttcttttcaaaaccacttttttacggtgcaatttttcaaaaaactaggaacaggggtccggcg

SEQ ID NO: 8032 - DNA, 1057 bp, Heterodera glycines
cttctgcttaattttaatctttcaaatatgtattagttttctactctgaagaatactttcttaaaaaaattaatttttaaaaatttataaattggttttagcaaacgatgatatttagtgttcgtctggagcagaaagtgcataatttattcttttttcccatatttttcggattcattttaaatttttgtttcattttatcgtttccattaggctcttgcttttaaatttttcaaatgtttcaccattttattttttatttcttcaactattattaattataaaattgttaaaagacttgctgcttggttaaatttttaacggtatttttctctgattattattaatatgtcaatacaattatgaattaaaactttatattattttaattattgcaatttaaacctaatatattatacttaaatatttctttcctaagtttatattaatgtcatattatatcataataaaatttaataaataaacctaaattttgttaaattacaattaaaattttactatattaataatttatacaaaattttgttgaatacgatattattaatatactttgtatagatcacttttaatcaatgttattttttaaatttttgaaatttgttcaaaaaatttaagtatttttaaaatttttttaaaccatttttcaaaaaactttttttttaattttcttatataaaaattaattaaaatcccgatgcatacaaaatttggaactttgcgaagggattccagtaatgcaaacccggtgatttttttgcgtttcaatcgctttttctcggcgcgctctttctaataaacttttggggaacaaggtggagagaaggctggcggtgccgataggcggcgccgggaaaattttgaaaatttgagtgcaacttgctaaaaattttgtctaaaaatgacctattttgttatttagaatcattttctaaagaaaattaaaggttttggtcggatacgactgggaaaaaattggaatttaattgaattttttttgagaaattatcaattttccataaatctcttgcttttttat

SEQ ID NO: 8033 - DNA, 5692 bp, Heterodera glycines
  misc_feature (83)..(83): n is a, c, g, or t
  misc_feature (5059)..(5059): n is a, c, g, or t
caaattgcagcggtcgcgaatcgcggatcgaggaaaaaaatgtcgcgaatcgcggatcacgcatcgcaatcgcggtcgcgtcncagcgctggtgcgcaattgcagcccattctctgccaaactccgcaggaggaaacaccgaaaatcaatggaattgcttcgcttggggacgccaccccaaaaaacgaagccaaaaaatattcttttctaaaaaaatactctcacaacgaaaaaatgtagatttaacacactgttttcgcgacggtctacacctgactgcttaacggttccccctgaactgctaggcccagctgactaaattcggcaccaatccctcagacgcctagttttttaagggtaattttaatagagttttcgcattgtcatatctttatgaacaatagtttatgcctttttaattttcttctttatttgaatacatttttttaattttgaacgattgttttttaaattttagcattttgcttttttgtcctttttattatttacaagtcttttgttaatatattacttaaactaatgcatttttataatcttctcaatttcgtttctttttatgttctacaacctttaacttttccatttattcatgtaaatggagtaaaacttgttgatatttattagaattcgccttgttcgattttttgcctttaatttttattatgcgtttttttctttcgatgttttatctccgtcatttcattgtatcacattttcacggtctttgtgttttttttttcaagttcctctcactccgtttttcggagaatcctctacagataccacataatcctctagattttttttgattatctttttcatcattttgttaatttttgatcattattctccaatataggtggtgctttatgataaaatgaggtagtctattatttttacagatacactatcacaaaatttttcataatctttattgtgttggattatgttttatgtatatcattgcatttttcattattttatttttattagggtgggaaataagtcctgtcatagcattttattttgttttataattttttatgatttttatcagcttcccaaaatgcaattttttcgtagttttttgaatgaatcttaattccgagacctagcaataggaaaaaacaattatgaataccgtacctattgaattagtaccaccgggggttctatttttcaacccccctcgaaaggggggttatattacagagggaggttctaattcagaggggggttttttcaacgctcatttttcaaaaacccaccaaaaaatggctacttattttgtaaacatttcgccaaaaaattgattttttttgtaatttcatttgttttattcattctccatatttttcatcttttacgaatgacggacgagagaaacccttctgcatcgttaaaaaaggtagttcaaaattataggttttaggtacctacctgttcataacttgttcattatacaattaatttcaatttaggtgtgctgttactgcaataacatctgttctggagcgcaccagtgccgcaaatgctcaaagccgtgccatgcaattgctccgtgctctttttgcggccgaggactacgagggattcagcgcaaaagtcacctgctgcaactgttggctcaacgatgatgacgatgatgttgtgatggacaaaaaagcgaacttcgccggtataaatgaagcgacaaacaatgaccaagacgacgacgcattcgaacaatttgccaacagccaaatcatcggagaggacaatgacaagattgatgcgtcggcttcatcatcaactcacaaacgtcgcggatacataatcgaagagaaaatccgcattttggactgcgccaagatgtcgtccattcacgtcgccagcagacgcttcagcatggaccgaaacacaatttgaggctcgaagaagcaggaggcggcactgaggaaaatgtaaatttaagtgttgtgtttttcaataaatcaaaaatccatataaatttcaaaattgacattttaaaggccccggatgtttgttggaacattgttattttttgttattacttaccaaatacattttatttaaaatatcttttttgtacgatttcttggccgtataaaaatttgatttttttgaaaaaatttttttggggggggggggttataattcagagggggttctaattctgaggggggttctatttttcaaccaccctcgaaaggggggttgtaatacagaggggggttctaattcagagggggttatatttcaataaatacgtaaatacggtatattgtaaaggctatttgttatctcatggcacattcagatttgtttatattgattcagcatggtccaaaaagtgttcgggtggcataactttctgaatagaagagcaattcccaaaaaataatgtgattattttatacatatttaagtcctacagataccgactttttgaagtttttcgagttcttaggtaaggaaatgaaaaagccccttttgtcatttcaaaaacattagaattttttataaaatttctttccgctctaaattattgctctgtctttgcttattcagaaaatatttgatcggactattaaaaaattaggggctgagtatgcctcctgaaatgtgagtggtttttccaagatcttggccaattcacggggccataactttgttaagtcaaagagaatgaatgcactaatcaattagtcaaaacttgggactaatgagaataatctggcaaagtttcattaaaattgcattataatttcaaaatctcatcttaaaagttaaacagtaactttgaccaatgatttattttaattgaatatcaattattattttcggtgaaattttcttaatattcttcctcgataattattttttatacatttaatttttctcggtcaaaatttcttatattgctttagttatttcccaaataggtcgttagagaatttattataattgtttcttaaaataatttttttttaaattatttaatgttctagttaaaatgacaatcattataatcaattaggattaatttttattgttaaatgttcaaacattttaataaaagaaaaatttacagaattttataatataaaaatggcattcaacaaagatttttatttcgttttatcatgattccgcgttctcttctcttgatctgcaacgttttctcattttacttttttagtcacatgtaatttttcattttaaatatgaaattttttctatgaaaataacttaataaatattgattgatagtttaatattcttaaataataatcaatttttgtcttcatttattatgcttctggtgtaaaccattgttgccgtttatgagaattcgccttttttgatattttaactttataattttattctttagaattattttcttatatcgattatgtcatttgtcgcattttcactaattttgatgctcaaatgcatcccactcgttttttagactaacaagaaatatttccaatgtgagtgttcaattgttaatttaaacaaaattataaaaatgcaaaaacattttttctattttaaacatttattttccgccttatgtttattatataaatttaggattaaattataataatttttttatataaaaaatattcttaattattttatatttatttttccatgtttaatttctttgtaattcagttttagtttcaatgttcttgtgtttttaaagttttgccaatttttaaaaaactagctgatttttttcttgcgcatatcgtgtgacaacattcatgcaagttgctcggtgcagataaattggttctaaaattatttgaaaataattctatttcatattttgcggcacaatactctaaatatgctttgtagaaattttttttgatattgttgatgaagtggaatatttcgaattaatccaattttatgaaaatttaatagcattttattcgaggaaaatttttttgcgtccagaatttacggacagaactcgtctgtacggtctctttcggctaaaaagtactaaataagtgtgtttcggcccaactgtagaaactcctaacttaaaaggcgcataacaacacaaacaaacaaaaaatgtaaaacaaatatatttattttcttggctaaattaataatataaatttattaatggcttgccgaaggcccaactggcaatttaaacataatcaaagacactcaagcaggttaagtttttttatcattctgaatggcatatagaaacaatgtagtcagtccatgcttgtcggacttagctcttttgatttgtccatcgggcccttaatacctatttttatatctatatgtcccatacaattattaccgaaaaacatatttccttaagtgactcacggtccatatacgaagcaatttttgaaataaaatttgaacccgaaattcgtattggcttacaaaaaactgtatccgttacagagaatttgagtggggaaaaagtggcagttagagatgttcttaagataagatgtatctatctattttaataaaaatacaaaaccttcgcttaaaacgtcaaataattcatccactattaagccgactaatgccccagctccgccaattaagagctcagatttttttaatagccgaacttcacggaagttttcccaaatttaaatttggccgcggaatattttttacctatttatgtacatattttgaccaatgttagaggtggcttattatatatttttacctagtcacacaaaattttcaaggtacttagaacccgtcttcgcactaatccaaagtctgttcttattgatttcgagctcggttttttatttttgaacttttgaatttattaaaataattaggagcgagaagcgcatttaaacatatttggcctcaaattcaaattagaatgtgcttatttcatttgtctcaatcggtattacgttatgtacaggtaaaaatacctttgttgcccctattattttacttcagagacatggtcttatccgtgaatatgaagctaatgaaaacttagaanaatatatacgctcattagctgcactcgcttttcttcaacctaatttggttgagggttctctagacatattgtatgcacgggctccaatggtagctcgtcctgtttttgaatattttagaaagtaatgttgcaaattattcgtctttaattagatgttttagaacctatataatcagggataatggtgaacagccattatttccggttgatagttggaatcatcaccaggcggttattgatgatttatgtagaacaaacaatgctcaggtatcaaacttgaggggtcaaaccgatttgttattaaaaataatttaggaagcatttcatcttcgctgcccgtcaaaatcccgacgcgtcataatcccgatgcgtcataatcccgatgcgtcaaaatcccgacgcgtcgaaatctcgactaagctaaaaagagtcataatcccgataaatttaaaaaataaataaataacattatttccggtgaattaaatcgagaaaggatataattttctaatttccaatatttagcaagcttaatgaaccgaaaaaataggtataagcaactgcagccgtgacggactcacggcgatcacttgcgactcgccgtcattttccgctgacagtcgccgcctttgt

SEQ ID NO: 8034 - DNA, 1636 bp, Heterodera glycines
tagctgtttttatatttatatttcatgaaaattttatcgaaaaaatattgtatttttcatatttaatttaacagggatctattaaattaattttatttatttaaatatcttaatttagtattttttgcaggacatattccatattattatgataaatatttattattaaaattttattgtctttttctgagtctaagctattcgcaaaaactcagaatccttaaattaaatatgtaaaaattaaagtgttttttatttgtaattttttttcacatacatttgccggttctgagtcactttgatttaaaacaataatctaaattattttgtaaaatttttggaaataatgttataaattcaaatcatatcaatgatgtgttgccatttttcaggtaaaagatcaatcccaatggaaacgtatttaagaagttagagctaattaagtaaaaatggtcattttcgaggtaggtatttttggtggctgattttgagaaaacgaagagaggatacagaagctgagaaatagtgattaaatagagcaaagttagtactataagaatactaaaatataaagttttatttcataaaaattgaattattgggggggggccgagtctgaaagtggtttccagaaacggcatttttcaaaaccatcaaataacaaaattctttaataggggtcttggaaattccgaatttaattgaactagttaaaccgaccacgctgagttcgaacatagccttagatttgatctctgaattctcactgaacctgtacagctccaacttcatgcatggaattgaagcagtacaagctcaagtagcaaagataggtcagatttaagaccatattcggattctgctggtctaatttacagaaaaagtttgtctttgttgtatcagctttcattttcgaccataaaaaatccgagaaaaattagtaagccaatttccaattttggcatggtttggaaaaaaggcagaaaaaatcgatcaagcaaataaaaagtgaaacgttggtatgaaatgaaagaggacagtttgacgaacaaattaaaaggaatcattaaaataggtgcagaaattacggagttatgaatttttgaagtcggcagaaaaaatgtgtgcggaaacttatgttacaccctaagtaattaaatttactttttaattgacaaataaatattcacttgactttaagattttccttttactatattttatatttctgagatattaacgatcatataatattatttggttgtaattacaacattcttagctatttagtattaaaaaaaaataatttgtcgttttttctcagtactagcaaatataaattatttttggcaatatttttaaacaaaatataacaaaaatattttttttattaatgtcatgtttattttgtctaagccatcctaataattttaatccttctgaatgggtattctgtagattatatgtaaaaattttctttatctatttatgcatgttttatttaaatgccaataataaaaaacagatcatttaaataggaaatgaattggcgaatatatcaaaatttgaaatataaaattttgaacaggtttcttttaggcgctacttacattttaaaaaattcctttttttcatc

SEQ ID NO: 8035 - DNA, 2178 bp, Heterodera glycines
aacagtgtgtgcagctgataaacaccggcacaaatctaaattaaaaagaaaccgaaaattagcatactaaaatttcgttttatgaggaaaattttaatatttttaataaaaaatttaaaaaattctaacccaacccatacttgaatggcaattctcaacaaatctttgctgtccaactgctttacactgtttgccgaattcgttttttgttcactgagaaatgcccaaacactgcccaaattcatccattccaacacaatgccaaactgggccggcctcagttggcaaatgccgttgaaattgctaatgtgcaatggcattgtcttgaacaggtgggcggacaaccgaatgtgccacaaaattgccgcttcattgaggaaaatatcgaaattgtcattttggcatttcatcgattttaggcacactgatgagtcatgcagttttgacttatgcaagacgaggaatttgccctaggcagtggttgattaattatgctttatttaaaagaatttaaatttgaataaaaaagaatattaattaatttaaatatgttaaattaattacaattacaatcattaatttaaaaatgccaaaatatttaccaaactaaagaaaagtttttacaatttattttttaaacattaaatttagtaatttttaccgaagaaattttcggtccaattttcaattccttcttggaaatggttggaagctataaggaaaatattaatttaaaaataaaatttaataaaattacgaatttattttaccaatttaatcaaggttttcacagcccatgtttcagttgccaaagttgttgcaaatttattatcatctgcagcagatgttgtcgcaaagcttgcttttttcttttgatttgctttataaaatggatttaaaattgcttttttaattttaaaaataaaattagcagttaatatcttttcaaataaaattttaaaaacattctcaccaacaaagcgtttggccatttttgcaattaaaataccagttgataacaataagaaaaacgaaatataaaaataaacaatgattttaaaggaaggaataaatgagagaaaatatttccatttggatgcttttggtacacaacaccttaattaattaaattagctaattaatataattaatttatttgttgatgaaaaaatttcaaattaattaggcaaattaattttacattgatggcattgggcaaagttcttcaaacaaatccatctccttccattcacaataccatgtctaaaaataagaaattattatttcctcaaataattgtattgtagtacaaaatttttgcctgaaaatctgtaaaattgcaatatccaccgatgtctttacagtccataatgtcaaataaatatactgtagattccatgaatatttcggatttgtttaactttaacaaaaaaataacaataatttttttaatatttatttgggttcaacagataaatattcttgaaaggtccttatcaataaaagaattcacatcacataaaaggaataattacttgataagaaatactgacacttgttgacaaatgattatgttaaattttaaaattattttgtattaaaattgaatttatttaaaaatatgttttattataataagaaaatatttcaatgatttcttcaggattagtgccgatcgtgctcagaaggtttatcggcgacttcttccaataaaccacaaaaaattctttctttttatcaccaatatttttaaaattttgattttaaaaatttctacctaattttttgaatttttttttctcactcaattttttacgggaacattcatttttagaataatttttactgcaattacaaattgttcatttatttaatgtctttgctaattaatttttatttattttttactaattaacgactaattattttattgctgtttctctcgttttatcccattagtttttggttggccattgattgattgatggttgagtttgcttaatctcatcacctcctcacgctacaaaacaccttctttcggcgcttttacttttgttcacttctccattcgatcgatgttttcaatatagttaaatatttttcaaatttaactaagttgacttgccagaaaaataattttttaaattgaaatatataattttatcgagcacatatttc

SEQ ID NO: 8036 - DNA, 3766 bp, Heterodera glycines
  misc_feature (55)..(56): n is a, c, g, or t
tcatgacaatttgtgagccaaaaatagtcagaaatgcaatttacagagaaaccannccaataatttatgagaattttttttaaactaatattggaaatttttatcaaaaatttccaatttctctccttcggccccatcgcattaaaaatagatttaaatgatttttttaaatagataagtcactaaaattgccggccctaattattaagctcaatgaatttatgtaaataacattttttgtgacagtagtccaatattaaccaattaattccttgagaacaagaaattcatgataacaattatcaaataattagaatttataatcttttccttttttaatttagaaaatgcataattatcatttaatctttttgcttgtcgcactaataggaggtattaactccttaattgacaataataaaaaaaagtaaatatattttatttaatcaaaggttttggtctgatagcaccaatgaaatttgaagaactgaatggcctggacgccgaaaattttgtgtcaaagttgggcaaaatttttgaaaaatcagcttgggtagtccaagaagcgtacggagaaaagccatttgaaagcgttgaccaattattcaatgcaatggaacggggtaaaaatttttaaaattaaaaaagtatatatttaaatattttttaacagttttaatgaatgctggacgagaaaaacaactgaaattgatccaagctcatcctgatttggcggggaatgaaatgtttagtggcaatctaactcagcattctacgagcgagcaggttggtatcagagatgctcagaacgtcccgaaatgctcgatcccgagatcttttgctttatgaataccggcccgaaaatttttgaccgttgccacccaacccaaattttttttctcatctggaaacattcctggttggatttgcaggcatgttgagggtcggggaaaagcccaaaaaaagacaggggattcggcgagtgtcgaaggaagtttttagaaaattaaaattaatttaaaaaatcaatcctaataggctaatgctgggcttagcgcattaacggctcagcaattggctgagtttaattcgctgaactccgcttacaagtctcgcttcaattttccgtttattattgcgcttcgagaccaaaaagaaggtagtaatataatttcatatgtatcatattttaatttatttatttaataaatttttaaattttttggcattgatggcattttggcggcatttcgtcgacgacttaacaactcggaagaacaagaaatcaatgaggcactctcacaaattggacgaattgctcgccatcgattggacacattgatgatggagtcgaaatgagaattttatcgaaatgagaatttaaatgttaaaaaatgcttttataaaattttaatgctttattgtataataataaattatcggcttcaacattttaatataaaaataaattcattttttaaatttgttaagaaaaatgcaatgaaacagaaaatttatctgcgacggactaaccccaaaattacataaatttcaaaaattctaaccaaaattgaaaaaaatagtaattttaaaaagactgattaaaatattggcacaagacggatcagagagataatctctggactgaaatagtttcaaaacacgaagaaatcaagacaaaaatagaattaatattttcattataaattgaaaattaaataaaaaatttaatagatttaaaaaatttcttccatttacctttgctttttcgttaaaaatttacatatttaaaataatcacttaaatatttcatcaaaaaagctcattagtgacccaattcaaagctttaaccaactaaaataggcaaaaaatatatattacaacgttgagacagacaaaaacatatgtttttatactttacaaacaacaattggatttaaattggacaacggaaatcctgtgtattactcagaacaaaaagaatgaattaaaaacggaaatgtgcctgccctttggcagtcacagttactaattgctgcagttgtctgagaattgaaaaatgaaaaataaagccacgggggctctattttgggaaacacagtatgttatttaatttagaattttgtgccaataatcattttttattttctgaatttaaatatatattttttctgtcttggaattctaaaaaatgtgtagtaattcaggtttttgccaataaattagtatgagtatttttgggcttgaaattggcgtggagccggtcggcctactgatgggcgtgttcgagccgcaaaagtacacccaaatgtacaattgcaatatgtacaatgttgaagacattccattggcggatcgtcaatccatcccacttggcctgatgttcctcacgttgggattgatttgtgaggtaaaaaatacttagcgaaaaattgagactgcgaaattgttgaaaaaccccggattaagatcgaaatttgggattgaacgaagacagaaaaatccatttatcccctgaactttgactgggtacctttttacattatctgatgatacaagtcctatgttaaatttgaggtcggatatacagcaacaataattataatgtttttattcagctcgaggtcattatatgaagaatatttaaagctctgacagggccggaccctgccaggatttttccgggctcctgatcctgatcgggtatattttgaaaaattgggagccctgaaaaacagggttttgaatgcggaatcccggtccgggtcggtcaaattatttaatcctgattccgaatttttcaaagttacgagctcgaaaacacacatacatacaatgtacaaaaaaaattattatatatatatatattttttatatatataatagatatatattacatggttataggttctctacctcccgtgtatgcttgcgattcgcaaacatatggacagcacatgctttaaagtatgtacaaattatttattataatttaatttttgtaaattaattatttataaaaatggtaataaaatttccatatttttttccaagttcatgttttacattgctgtggctgacatgcttgcgctgtttatcagcggtgtactcactggatatttggcattggttggtgctgtctattgctcctacccaaaactcatttacaccatgggcgcatgggcaatttgtatgttaatttttttgttgctcccgtgtaattagggtaattaattgggttaataattgatttaatttttattctcataacaataactgtttgattgcttttaaagcattaaattttggagtttgatatgtgagggatcttttccggattagaactttgcatggtataaaattcgataaacaattaaattaattttcgactttggtgccgacttaacaaaacatgaatttattaaaaaaggtctctggggaaccgagtccactgccgagatggtgctggcgttcaaccgttgtgtggagttgtcatcatcctattgggccgatgtgctgtttcatggaaagcgtacttatctgtggatgatgatcccaactctttatgggtgaaccattttttgtaccgttagatttggggctatttagagaccgaatttttggacacacacgaatagagttaaggggtcaatggaaactcgtacaaaaggcatttttttaccaagattttgtagccaaatataaaaacccttcaaattttgtatagaaaatttttttttgtaaattatactaaaaaaaatttaca

SEQ ID NO: 8037 - DNA, 4165 bp, Heterodera glycines
tttttaacaattgattatttttcgtaataaaatgattgcatacatatccggacttgaacaattattaagtaaagtgagaaattgtgtaaatgagtccccttgggacatgtggtaaatgaaaacaatacaatgggcagcacaagttgataataaaggggattgatattggtaagcgttcttctttactccctccggaaatttgcacaaaaatgatgacgtaatgggtactggaatgggcagggcaaggctgtcaaaatacaccaccggcgcatccattcccttcgcataaatcgcgcaccaatgagagccttgcttgtggtgggggtccctattcacaacgagcgctgccgggtactgtagtgtagagggaggaggcaatttatcactggcgaagcagccctgaaacactcgcccggtccgacggttttcgctcaaaagttttgttatttgcatgctgtccattctttaaccaaaaaattgaacagagttgatgaagtaccaggctgatgatgaacattaaatagagagcaaagagggcccagcaaacagcttgatgaaaaaagctgctttcctctggtctgtccttgcacatttgaataagcggtgggagaacagccgagacatgctcatcaattaacttgtcgctttttggagggactttaggtgttgtagtaaacggaatgtttgtagtacgtttcgataaagacaatcttctcaaatattcagtgtaggaatattcaggctcgtattgttgtcgagtgaaagtcagattttttagataagcagagtaggtattttccggttgtctttgttgttgttgttgttgttgttctcgcagtgttgatgaaacgaggggaagagaaattcggagaaagaacaaaataagacccaattttcttgaaaacatcttttatttttatgaaaaatgaaatgacaaacggtttaaatagtggtgtcactgctaatcgatcgatttttgtctaacatcaccaaagagtcacattctcccatcaccaccagcattattcctccgacaggtactggttgattgaatttgatactcaccgctgtggtcccattctttatcaggtcaaacagtgccgcttggtcatccccgctgtttgtcagattgaacacgtaaatgcaatgcgttttaccgtattgggcaaaagttatcccattgctctccgatgaattggcgaagcccaccgcttcgttcatgtcattgaagggccgaacatattttccgtttgggtaaaccaaatcatagggtgcttgcggatacgatcgtccatttgcaagaatggaaatttcgcgcacattaaatggttgaaaattgaatggactgcgcaaaattgtcccaacatagtcagtattagccaccagacccattgtcacacgacgaggaatttgggccatgaacatattggcagtaaactcatatcggccctgactgatgaacatcgatttcatcattgtcttccgcacagcataacggacaggtttcacctccagctttcgcgcaatgtctagcgccaacccatccatcagggacacttttttcacatacattttcagtcccacaacctcgaaacggtaccgacccccggtcggcgcaattaacacaaagtcattgtcgttgggtagaatttcaatgtccaattcacagaaattgatcaggtatagcggttggttgaataggtcggtgtcaattttggcgatgaattgagctacgttactacccgcaaacaaatcacgtcgcgctgtgcatccgcctcccatctccaaagtatcgcccgtgtccctataatacccagcagcattcaaatgagagtcttttgctgtcgttgaataagagagttcatgtgagaaatatgatttgtaggccattagggcattggcattaaaaattttgcgcccattgatactcatttttatgttacggatgaaggtttgtccgatcatttgaattggtgcaatatttatgtcatcaatgtctaggttaatgagttgaccattagcgttttccttacggattcgaaactcggtgagcaaataacatttggacagatcaatataattttggctggaatgaagtttgaaatggtaaggtgtgtctgtaagcggattgctgggcagaagctcgaatacctttgaagatgaaacgctcacatttgtagggggtatacggaaaaagtccaatgcattggtgattgagttcacggagtcgttgtcgattttatggaaagccatttatttaattaataaagtccaaaagcgtccgatcgaatacgcttttttgcctgttttacaataggtcgtccaattagtgtttgatgaccatgcacatatgttctctttctttttatactccgttttccgcttccaaactgttttggtagtcctcctttgtcgagaacggtatcaattcctcgctttccctcactgacaagcgcctctttaaatggcaccccctcattcccgactcgctccagcacgcgttgcccagtgctcagcgcctccgaccctaccgtggtgccaacgcggcgaagaatgggtaggaaaaaacgccacagtccacgaaacacatctccaacgcccgcccctcgttgaataccgtaccccctctgaaaggggcttgaccccctgaagtagtcaaaatcgtccttttctaatccgctaccgtactgcacatactcgtcgtactgcgcaatgcttgggtcaaacacaatatgaaccatttttattaacgtatgacaaataaaacacaaaatgaatgaaatcaaaaatttatcactttcttaaatatcaacacggccatcgttgtcccataggcgaatggcacgagacgacctttgtccattgtgcgcagttcaatctcaatctcgttgatctcacgtggcaacactcgcgcaaatattggcgagtcgtaaatcttctcattatactccccggggattgcaccgctgatagacacaacccggagcaaggagctcaatgaattgccaattatcatattttcagttagtccttttgagtagactgcaaaacttgagatgccacctcgtagatcaaacccgtatttggcaacttcatttgacaccacacgctgagggttttcaaagccaagcacatacccgagctgtggtgagaaggacaaatggctgatgatctcctcattgaacaccaccttgaatcgttccatattggtttcatacagaataaacactgaattgggcacatatgtcagagggttttgattagctggaggagttctaaaaaatatttttggtgggtcgagcgtgtgaatcaaacgcgatgggtctatttgagctgctgatgttggtggtggtggtggtggtggtggctgttgatgttctgtttcttcaaaacggggtggagagcctgacggcggagcttgaggcttagaaggctgttgaggtttgagttgagatgctgtcggacttattagttgcgctggaggcgccgtaattatcggtttggcagaaggttttacaggcgttgctgtctttacagttaatttgtccttatcttcttcttcatcataatgtggtggagattccgccttaggagacggcggcgtttgaggcctagtgcccactttagcggaaaccgacgctggaagtggcggcttaacagtagaaattggggtttttgattttggagacagtgccgagctttttagttgcgccggcggtaccggaatcgtcggcttcacagatgggctaggaactgcacttattactggcgtacttgttgttgttgtcattggcggtgcagactcagaaattaaagcatcttttgtaaatggacgatcgtcagctggaaatgcaaatcatcgaggtccaatgagcatttcaatggcttcggcactttgtccggagcggggagtgaagccattttgtctccgcttgtccatccgatgccaaaaaatgataaaaatattctttaatgagtgttactggccaattgttgagaatggcgttattggcgctagtctctttgacttttgtcttcttctttcacctggttcaatccctctacagaaattaaaatatttagagggttctttttgtatattcattggtttcctatcgccttagaaggattcctcatcttttttatttatctatacatattttat

SEQ ID NO: 8038 - DNA, 2040 bp, Heterodera glycines
cttggaaagcgcatcctgcgagggcgcatcagagtgtagctgcggtgaccatccatataatgctgtacgtcctttttctgtaaatgtttaatcgtctttcgcgcctctttccacagcgctgtaacacctgcgaatgccgctggggatgatggatcattgtacattttgtcaagagtggtgttgatcagctccattttttgggcgaaattccttcttgattgtccgttccgttcgggtggttttgctctgtgatggtctctttggtggggccgtccatgaatacaaaattgggtccttcctaagccgctcttccaataggttcgctcctggtggtttaatggtggggcggcccgctctccggtctattatatacttgatggccattcgcaaattgctatgcgccaacggtttgccgtttgcggtattaattgtatttccccgaacgcccatacgatctgcataatggttgcatttgatgtatagccgttcaatccgctgagtcatggtcagctgatttgactgaatagcaaacagttcacgttgttgttgttgttgttgttgttcataagcttgtgcagatgttgaagggcctggctctggcgaatactgtacccttacccttctcggttgcctcacccgttttcttatgtgcacctcaccattctcatcatttacggggtgggggcgtttggtccccctcctaggcggaggaacatagggcatttcttcgacgacagcagtaggaggaggaggttgttgttgctgtaatggtttttctctgatttttggctctctttccgggatacggtatggtacgggcctctttgttggtgcatgttttggttctattttggttgtcgggggagggaagtacccggcttgcctagacgtggatggccgcgggtccagcttaagttctggctctcttttcgcccgaggcgctggagtagggtgttggtttttcttccaatccagctttgcctgttgtttttctctcttggcggtaggacgcggtggaggtggtcttggttcaatttttgttttcaaacgaggcggggatgtgagccgtggaggtgaacggtgataaaccaaaaatcttggccaaatgcgggaaaaagggtttgtcttcgacgtccaatccgtaggatggtattctgcaaattttttccgcatttccctgcttctgtccaacattcgttgaatctcgcactcccagaagacatcaactcgtgtcacttgagtcctcaagaactgtaaccgcttggcatcgcgctccctttgttctccagcagttttcccgttgggcaacatcatgttgtcagaaggaaagcattttctacagccgtgccaaacacaacctgcaaacaacttttttttaaattgcttaaaaatatagaaaaattaccattcacttcaattacacacccttctgcctcaatccaaccgtccacagtgtagtttgcaatctttttttctccatcaggtgagtaggctgtctgcacttgtacgttgttttcctcagcataccagaaaagaaagcggagagccagcttgctctggttctgggtgttgtcatagcccttttcagggacaatggcaaggtgctccgccggcagatggttcaacctgaagtgcttcatgcacgcaccggcaacagtcatgcattcccgtagaacatcaatcccatcgtggttttcccggtcgtcgattccgtcgacatattcgttccgcttcgacacatcaaaaaactcgcggcggaatgcgacgagagctgccattagaatttcaacgtcattcgtacaataactgaaaaagtccaaaataaatattttaatttaaaaatgttttacctcgctagtgcttcatcgagttgaaaaggctcttcgcgatgctgctcgtaccaatgatcgaattgtcgtcgcttctctggcatcattccgttggccaaatagtcgtcaggggttgggtagatgtgttgaccgtagttctccggacgcttagaaagatgcgggaaaaagggtttgtcttcgacgtccaatc

SEQ ID NO: 8039 - DNA, 4475 bp, Heterodera glycines
tgcgatgccaaaaaagatggcgaaataaatctgcgcgagttcaaatgctttgttaaatcactgctcgcctcatatttggtggacgaggaccggaacaaatgcatcacggaggaggagctggagagtttttacaaagaatgtggattaaaagaaatggaagaggaaatgatgggagacggatcagtgcgaaaagagtgatcggggagaggacattgggaaaagagcgatcaattgataatgtgatcaatcgataatgcctagcaataatatggaatttatcggtataagatatatgattagaatggtcacgtagaaataaataaacgacggtgattagtagtaagtgatccgaatgagtggaagaatgtaccaataaaatggaaaaacatgtaaataaatgatttagacgattaaatttctatatgccaagctatttacatgatgaaaaacaataattatttttgttaattaatttttcatatattttttattttatttatcgctactggccaaaacagccgtctcttccgatgaaaaatataacaacagctgctcattttttggccatttgtgctcaaatgctgcaaaagtgaagacagcataaacaggaaaaaataacaactgccattatttggcaaaaagtggaaataaaatgatgaccctcaaatgtttttaggaccaaattttgaaaaaagagagcaaagccatgcccaaccaaatgaatgggaataattatgttttttccttaaatattaaggaaatattttttttgtgaataaagaattgaatggcaaaattcgttgttttcatttttacgttggcattttttgcgagcgcaacaaatggccaagttgtgacgggacaatccgaccgaacgcagcaaggcactttagcatttgaagccatttatcggaaataaaaaataaataaaattaaaataatttaataagagatttatttttcttccaaattatatatattaaaagttaatttgtgcagaacttgcgctgtttggctggacagttgggctaagaacggcctattgccagcaggtgccagcccaagaattagtcgatccgttcaaagatgcagttgtacggatgctgaacagacattgccgaaatgcgtcggcatgccggctgaagaaaaggtcggcggatgtttaaaagggataattaatatgtgtttttgtggtttcaaatactggacaatgaatgagtttttaaaaagatatttatagtagaaacaaatttgcgtaattttacggatttatgtaaaaaaaaatttattcccctacaaatgaaaaacctaatccaaaaaattaaaattttatttaaacaattttatctcctttttctgctgcagtgtctccttctccaagcatcaaattgtccttttggatggatatcctcgtcgtgagcatcgcatcctccacttccgtttctttgtcgttttgccacatgatgctgtgagtttttgatttcattttaattgaattatcaattaaaatctgtttcctaattaagatttcaatggacaaaaaacccgacaaacctttactttccaaccaaattttatcgggtgaaaaatattttattttgagtttaattttattaatgtattgtagaaatgctcgactcacaaatcggagagcttagccatgggcttgggtggcaagtgcttggccatgacaaatacccgcgctttgacccggccaccacggtacagtatgacaaccgtacgccccatttgatcactttcccaaatggtggcatttgcttccgattttagtttttcaaccgcactttgatcccaatcgctgtgctcgcagggctctgtatgttctttttggcttattggaccactgctttcacttcgggctcgtccttttatgccggcggatggcttgtccggggctcaagtggcggcaaaaacgcggcattgaggcacgcatttttattatatttatttaaatattttttcaattcaaaataaaggtttgcttaaatcttttacattaaattaatgctattttgacttttttttttgttttcttttaaaacttttgttcgccataagaagtttggtggttttgattggaatttcaaggagcaattaattatttgtaaaaaaaattgattaaattttctggaaaattcgtgaaaaatatatgaatctcagaacttactcatccttaaaatcctacaaagctgaaaattcggaaatttttgattgtttacgattggctatttccaataaaactcagattattgtggtaaaaatggcatattgcctattccaaaagcttatctctcacctttagaagaacaatggaaatcattgaagaacaaaagtaccgttttgccctctatgacgcgcagagaggtaggccatcaaaagcaattttaaaaactaattaattaatattattattgggagaaacgatttatataccgtatgatcaccgtgcccgttaaccgttaaaggagtgcctccccattcgggccttttaccgcccaccaaggcggtggtggtgtacaaaagcaatgagcgagtgaggggcgttcagggtccgccaaaaagtgtggctacttcctactgcagtccgcaggtgaaaaattgttgcaattggacaatcatttttagactttttcattttttcgaactccaatggacccgaaagtacgaaaaagttgttcttagcattaattttacaattctagtgcatatttaggcttttttttctataaaatgttctttcactgccaaggcggtggaagcgaatcgcgcgatgccaatcattgcgccgaatgtcgaagaaaaagccgcagtcgaccaacaacaacagcaaaaagttgccaaaaaaggtgccacaaacattcagccacaacaacacgaagcgttgcccaccagcggcgccaaagggcctcaggcggcacaaaatggtcggcaaatttccatttcacaattagagtgatgtccgaacaaagtccaccatttaaattaatttttaacatgtaaaacgtaattaacatgctccctttgactaattaatgcacacaaataaaatcctttttttattgaatataaaaaagtataaacaattattttaaataaattaataatacgacaatataaatttaattaatttttttagggatccaacaaaaatatttgggcccggcaaagggttcgctttcttcagtgtccggctcgagcagcacaaaacgccgagagatggaagagatggatgacatggtgcccgaaattgtggtgatgcacgcgcacacctcgtcccaggaaagcagagaaacggcggccagcggaggccgacgcgtgtcgaccgccgcggaaaaagggtatcgagaatctcgacaaaaaagttatgtgtttttcaaaaattacccaggataaagacgaatgctctgggaaagtctgacagagtccggccctgttccgggctctagtccaaattctggaaaaccggaaattcgggagggagagcaattgcgagaccaaaactagccagaaaagaagtagtgaacttaggggaaaaggttcacaccggtccagtcaaattgctaatttccccccttccttaagccatcgtcgacagtcgcgtcgtgtcagcaccaccggcggggacgagtttaagcgcaaaaaatcttctgtttttggcggcaccgctttcaaaggatcggccgcgacacaacccgaaagacagaagcggtggaaggcgagttcgctggtgttgtccaagttcagcagcgccgggatgggaagccgtaaataatggacaaacagagaacattcggcgggagaaggaagcaaaaggacagcaaaaatggaagaatgaatgtcggaatggatatgttttctcgattttcaaaagaaaatttggtacggcacaccgactcaataccgtaatcaaacgctactataaaagagagggttttcttcccgggaccaatcacaattacgaacgataaactacaaaagacatacgccaaatctgtcgtaaaataagtcgtttgtcgttttccccaaacacaaaaagttttgtcgttcgtaattgttattggcccccgctgttttcaatttgttcagtttctctcttctccgttcaatcgctgctcttcgctttagccatatctcggaaaccaataatcccatctcgatgggtcttcaccaaagtgaagcgttggcgcagtgtttcccgtccctccggcactcgcccgtgacgaactgctcccactgctggcacccgtcctggcacttgtgtttgaacttctgatggagcttgtaattgacgagatgctgctgctgctgctgccgccactcgttctggcacttccccgtgccatgctgctgctgttgctactggcaccagtcgatgccgaacttgccgggctgtcttggcaagctcggagcaccattggtcgcaccacaaaataggagagaagagctaaaatgat

SEQ ID NO: 8040 - DNA, 2377 bp, Heterodera glycines
  misc_feature (109)..(109): n is a, c, g, or t
gtcgccaatcgctgccaaaatcgttttcagagtttcgcgctgattttggtatgaattttcagagtttttgctgttttccttttcatttttttcatttccgtttctttcncaattattttggttccaatttttcgccaatttttttaaaatttcaattttatttttattttcatttttgtttgctttgtcttcaattttctcccgttggattttcatacgtttggctaacagaaacactgcttcgaccgcattttttcttagtctctcaactgctgctacatcacacacagattctaatactttaattatcagggattctttttttatgtaagaaaaatcgcgaaatatgtaaataaaatatgtataaaaaatgctaaaatatgtatgaaatatgtacaaaaactcccaaatatgtacgaaaatatgtataaaaatttttttaacggttattttttttggaaaaattcttcgtaaagggtgaaataggaatgcaataaaaatgacccaaataggcctagaatcactttttagtactttaaaaattaatttttggtatctgtttttgaaaaaaaattgattttttagaagtatatttctcaaaaaaaaatctaaatttcacaagaaatttatataaattctcaaaatatgaaaaaaaatgtaaataaaagtcccgatttttgttcgcaaacacaaaaaagaaagtgtttttcctactaattaggctatggagaatccaggaaaaaaaatgtatttacataaaaaaagaatccctgttaattataattaaatttttaaataattacccaattaccattcttctcattaattacttatttacctcgctaattaatttaattgcccatttaaatcatccttaattaatttaattacccaattaccttctcctccttttatttctccgagttttgtttttaaactgaagtaaattttggccaatttcgcgtcttcccgttcttcgattgcttcacatttttctatcactttggccatcgtttcgttttggtcctccaatttttggataaactcgcgcaattccccagtgccatcattttctgccaatttttgctcataaatttggcggtcgatcaataccaaatttttgggctttgattttatcacggaaaaaattggttggggaaaagcaatggaacacacaaaaaagacaattgccagcaacattttaagcaactaaaagaatgtgtttttaggctataatttcggtggtggcgatgggatttgctgggcaaaaaatttggaattttgattaaattatatttgaccaaatcgatgtattaaacgattggaaaagtatatcaaataaaacttattctttttgaaagaaaattatggtgacattaaaacaaatgcattaataggtttaaaaaccgaattaaagccttaattagagaattaataaaatttttgagcagttgaaaacaaatgataaattgtgaataaaaattaattgaaacttttttaaatatgcaaagatttacgcaaaaaaaagaaacagagatgacgaactatgacaaattttaatgtcataaaaacaggatatccggctaaattattatcctaacattatttattttatatacctatatattttttgttatttgcattattaattagtgggctatttctccagcaccgccggacgcaattaagtgctttttaaaaacagactctattcaatgttcgattttttttcgatgtcggaattgcttggaggcaataaaaaatgcctctaaacatctgatttgttgaaaaaaatgaaattttagcttttcccaactacaaatttcctttcgaaaaatttcagaccggagctctatatgtttcataaacgtaccaatttcacatttaatgaattaatttttataaaataattcataaatcacttttctctacgattttggaaattatccaaaaatgaaattctcgggggaataattgtcaattaattctccccatgggtcggtcggtggtgtttccttttcgccatttaatttttccctccccaatctgaacggaataagcgattaaaaaatcacgggactaacttaaagattttggagtgcggacgattgaattgtgattttgtggcttggggaccaattttttttttaatattaatcaatgattaataatcatagacggaaaagggttggaaacaataaaagtttatttttaaataaaaattgtaatttttatttatttttttatattattttaaaatgtgatttttatttgttaagtaccaattttttgaaatattttgaaataacaaaatttagctgacttttataaaacataaaaaaatgcttccccctgtgccggagagtgagaagagaga

SEQ ID NO: 8041 - DNA, 1033 bp, Heterodera glycines
tttattaattaggtgtcggtattgtcaaaaactgctttttaaaaggtttttaccactcttcttttttctaaataattaaaatgaaattcttcgaattttcatcgcgaatacggcaattttcctttcatttttcatccattatcgcatcaacaccttttgatgatgcctttttcactcttttttgtccaaaccgccgaagaaaatcgcccgcgggcaaattcccactttttgttttttgtcaacagtttttgccgctgacaaaagcatttcccccccccccccccctcctaatgcatcaccattaagttggcaaaattgctgagtgctatcactttcggcaatgtttctgaagagatgtgagcatttttattttttatttttgctttttctttttattttcgccattttttgaaaatattataaattaaaattcctcattttctccttttcacatataaaaattttactcatacaaattgcctaacaattaagcattttctcggctcgggcgagactgatttgtctcgcatatcgctccacaaaatctcccaccccccaaaagtttgtttacccaacaaccatcaaaacatgggacgtcacccccatataagtcataaaaaagcattaaaagattttatctcggacatatatatgtttcttgctcaaatcaacaaaaggcattgggggtcatcatcatcatcataatgatcataatcagagaatggatgggtcaaataaagttacgcctttttggcactcgctcttgctacgatcactcatacttcagcccactcttcttattattattggctcgttcaacccccccccccccttctcatgatgatcgtcgtcgtcttctgccccttttatctaatcccctccctcacccccccaccaattctcgactctcgacccacatccgattattatttttgcgcggcattggcggccggcgtttcggtgccaatcttctcgacttacgccttcttcgtcccccctccggggattacccagcggcttatccgccaccctc

SEQ ID NO: 8042 - DNA, 3754 bp, Heterodera glycines
  misc_feature (630)..(630): n is a, c, g, or t
  misc_feature (642)..(642): n is a, c, g, or t
aaatcactattttggcgttttgtcactattttttcactattttgacatttttgggcaaaattccttaacagaaatgcaataaaaccaaaaaatacacccctaagaatcgacctaaaaaattttcaaaaaaatacacccctaagaatcgagcaaaaatttttcaaaatatactcctatgaaatgaaaaaaaattttctcaaaaatttactttcttggcaaaaatttttaatttaaaaaaattttttatgtaactattttgggtttttttggtcttaaaaataccagtccaactcatttgcaactgcaaatagtgaataaaaattagttttgctcaatttttggctgaaaattatgtcactattcgtcactatttcggactttttatcactatttcttcactatttcggcatttttactcactattttagttaactattttgggatttttcgtcactaaaattcacagccctaataattagttagtcaaaaagacattaatttggatgacatttatttgaatttctccaattacatttaccattaaattctaacacttaaaaaatgcccaatttgataaataaagcgtcccaaatttattataacgattgatgctaattttttattttttanataaatttctanatttacaaattcatttgccgtttaaatgatgtaggtgattcatcacatccccttctccgttttacaccccgttttttgatcctttctcatccaccaaagtcccaagtccagcagtagtcattcgctttcacagttcatcacgagtgttgttgttttgtggccaattcaaaggccatcatttttcgttgtcctgtgactgaatcgaaaacagcagaagttcgtttttatccgccgtccatatatttattattgaccattcatttaacaaaataaatggtggggaagcatcttttttccggtgtaatttgctttaagtcaatcccctcggggttggcgctttcgaaacccaatccaaccgccgctgacaaattgaaacattctttctgtttcattttttaaaaattacagattaaacaaattattttaaatccattaaccccccccccccctccgtattttctgctgggtgtttttaatggaagcccacaatgaagacatcgactttcaaatccctttttgttaagcgcctctccgccccctccacctccctttcaatccaattcaatgatcctttggcatttttttcatttattttgcttaaatgttgtctcccaaccttttcgtttctcattgaaagtctttgccgccatttcaacaacaacaaactccttcccttttttctgcacaattaccgttactctctctccgatcaacaatatgccatatcaattgggcaaaaaaaaacggggggattttccatcaccacctccgccatcacattgtcaagcagcacattggtggtggtgaataatgaatgattgctgtgctgcctggcgatgaatgaacaaaactgactaattcagccaagtgttagcggcgaatgcattcattacacaataaaaaagtgaagtcggcggacggggcgatagccccccggggccatcccaacgcatcggtcggcggacggtggtgatttgctctgcttttgctttttcgccaccgtttggttggctccgcgtcgtaaaagaaagtgattcgttttttgtccataagcggcggttgttccccccccccccccaaaaaaaagtgctgctgctgaagctttcttatttctttctctatcattcatcacattttccgggatggaccaatgatgctcggctcgctccgccccaggcgttttttcttccgtgttttttcaacggcaacatttttttgttgttgattaaaataaaattttttgatagacattttttgatttttcatttttgaaaaaatattttttgactttttaattttttgcttaggcgacttatgtacaacatttgtatggtttgtgatttcaaaaaaaaaaaacaaaatgatattgttttgggtaattttcattaatttgaacacaattttaaacatagattccctcttcaacccatcctccgccctccgaaaactaatttttattattttttaaattcattaaattagttaatccattatttattaattcattagtatgattgaatgtttgaaaattgtttctttgtttctgctgtactttgcctgctccgtcgttcattatttaagccccccgaaaattcaaatgaccaaaaattttggatcatttccattcattcattccaacagatggaggacctaaattgacaacaaatcacccattaatcctcgacttttttttcctcttaaactttgggatgtcaacccccgaaattttttttgtgttcgtttgagggtcatcaaattttgccgatggcaaatttttttggtgccaaaatttttgattatttgtcattcatctgtattagttttatttggaacgttcatctatgttcataatttttattacagaatattttccctttcaaagtgaaattcaaaaagtaccttataaatttgaataattttcaagaattttcataaattaaataaaaaaatttatttctttttattaccactgtcctctcgaatttcattaaacttaaataaacattttccggcattgtctattgtcatcgctggacccttcctaattataaaaataaattaaagcggtgcaaaattttcgttcacaattaaaacagcaaaaggttgccgacacaaaatacactttctctatctccatcaatttcttttgtcaattaatttaatttaaaattgaaaaataattatgtttaactaatttaattatttctccatttaagataacatcaagtatttttttgcaaatattttacaataaatttgttcccattttctgcccattttgctgctgctcccagcaatgaacagcttcatcttctgcttttccgttccactccatcgctttaccatcggcaacattttgctgctgttgttgctcatcgtttcttcagcgcatggggcgcaacggattgtggaggagccggaggatacggtggcacgggttggcgatacggtacaactgcggtgtcgcgttgcggaccaggtgaacaaattaattattcattttttgtatttattattcaatattattttgattttttgtaaaaaaaagtggtagtctttcaattaattaaaaatttaataatttttttcattacattacttttttaaatttggataagtaccgacagaaaaattctgagaactccatcacatttttgaacccaataaaaattagagcaattattttctaaaaatgtcatttttttgattttaattaaatttttttaaatccacaaaaatctaaacattttttttcaacataaaactctatcaaagatgaaatcaattagaaaaaactttctgatccacaaaaagcacaaaatcaatccatcttttccgcctttttatcggcatgattcaaaaaataaagaaaaccaataatggcataatatttttatacgcaaaaagaagaaattaatcgttttgcgggcactttttgtgtctccagtctctccccccccctataaatggcatttggcttctacatttttttgtggtggacattaggcggcagcagatggacatgctgataagttcccccatttcgcgttacacaattggcattggcacacagcaaatccgcccatttatacggcggacggagagggacgga

SEQ ID NO: 8043 - DNA, 1324 bp, Heterodera glycines
  misc_feature (1286)..(1286): n is a, c, g, or t
gacgtacgattttaaacaaatttaaattattatttttttaaaatttaaaattgacgcaaaaattactgttcccagtaccgtatgtcttttacagttttgtgcccagccaagcggagaatggtcgttggatggtctgtttggcggcacacgaattgtacgggcacgagtcgcgcagtgccagcattcagttggatgtgctgtacgcgccaaaagtgcgcattgaaaccatcccggaggccagtcaggtgcaattttgaaatttggaaaatgtaaaaatttttgttttgggtcggtcgtccgagtcatttttaaaatttctaaaaaacttttggattcattcttcaatttataccggcaaaagttggccgaacaataataatgtcaattatatttcctttttgcctaaataattatgtttttctcttatgaagcaaaatattaattaaatttatataagcaaaattttcatttattagaaattacagatttacgaaggcgggtacatccgattgcattgtgccaccgatgcacgtccgaatgatgttaaattgcgctggagttgggacggcgagcccagacggttggaggtggtggacgcgcaggtaaattattaattagtgaattaatttaaatagcaatcataaaataaacaatacaaatctaaaatcattggttgttaatacctaagaatttataatgtttatgaatttttatcaaagcttcacagatctgaggacaaaacgcattttgtggttttaatgagtcagggagggtttttttctattttgaaatgaggatctgttattttattttataatagattagggagttttcgctgattatttttaaaatatttccaaacatggttttctttaaagattgattttttgatgatttaaaaaaaaattggtaatcttatcgattttccaaactttgatcgcttttatctgatcaatatgggtgtgggaaaaagccaaaggttttcagaagtaatcgaggaaattttgctgcaatttcacgaatcacctaaaattttcaattatttttctggaattacaaatctatttatattaaatatttcatcaattaatattatttattaaaaattgaaattattataataaagcattttttaatttaagaatgttctgattaacggactacgattcaacgacaatggacgtcgtgtgacgtgcacagcggagaacaccatcgatgttggcaccggcgtgttcgagttggacgtgccatgtacaaacaattatttgtttattttttattattanaattttagatggaccccgcttcatgtcaccaatcagtc

SEQ ID NO: 8044 - DNA, 4336 bp, Heterodera glycines
cctccgtcctccagggcatcggtgacttgttcgtggacaccaacgacgagttttgccaattgggtcacattttgcaacggcttcttcattggctggccgtcgacccgtcctcttttgaacaggcctatgttcctctttgtctacccaaactgcttggcccttttgtgcgtcttcaacttgtcgactggcgaccgctgaaggtatttttttatttcataataatattgggttaatctcaaattattgtcgaataaattgaaaaaatctcaatgagtattgctttatcttattttaatagtctcatctgtcctaacaaaatggcaccacaaattttaatgaagaaatgatttggaatgggacttttgctttaaagataaattacgttaggctattagatgactttataaaacctgatgtgagattcctaggcctaaaccaatttaaaatgaaaactttttctcaggccaaactttttgagattttttcgtaattatgagacaactgaatagcagaataagttaatattttctctattagggacacaccaataattagtacgactgtttacttttgccccttttctttgccaggaatcaccaacccaacggcctttgtatcgcatgccctggtaccgtgcgctgctgatggccggcctggacaactcgggactggaggaccttgaacatccgtcgctcgtgtctctgatcccgtccgttgtggaaaagattgtttttccaaaaattgcaagtatacttttaggactatccaattttagacgcccctctttttgtctgttgaccatttcccaaatgtggtcaaaaaaaaccattggaaaacccatgcataaatattatgccaaaaaatcaaaattttcgcaactcatttcttgttcgccatgccattctcaatatttagaaattgtccgcgagcaatgggacccgttgtcgctgcatgagtcttccaacttagctcaattgctgcgttcactggtcgaggaatacccagtaaatttctgtcggcttatttgcaagatcataaccttggaatcgagtcccccgagatgtttccttattacgatttttttggttttagaattttggcttttcaattagtggtctgatggtttcatcaacgacatcgtgcaaaatcttttaatggattaaaaaatcctttttttcaaaggtggccaacgcaagctcgaaacgaatgcaagaactgcttgagggtgtttatgctcggttacgtgacactattgaccgcgacacttttgtgccgttgtacagcaaagagttacatcacattaaaaaccaattttttttatttttaccgatttttaagagccattgaatccactgagacggggtgtggcgcttttttggatcggcaattttggaagtctatcaaagtgagttgaatattttggatcaacttttcataaatcaatggggcggtggagagcgagctgcttcccaaatctgtgctacctttatatggcagttatttgttttagttgatgcgctccatcctctgcttccgctccattctctccgacgcgtgtctggaggaattggtcgtcgaaggactgcttaaccgtttcactgtgttggcactgcaattctcagtgttgggccaccagtcgacgctgaccaaatgtcgggcagtgatcggacaaattccggtgtcatcatttcatttttttcatctctaatttctgctttcgcttttagtcctcctggttgcccccctctcggcccagctcctaccgtcctttagccgctcttttaaaacaagttgttgaaatacaccgtcgggatcggtcggaaagaaattattatttttatttgtttttatttcatcaatttatttagcaaatttctcgcgcagtcccaacgtttcattgatcttttaacagtaaaggaagaagcagaagaagttgaggaggactgatgtgaaaaccccattgatggacattggatgattggaggacaaaacaaattttatttttaaataaatgatttttgtttaattccaaatcttctataatttattatatctcattcttactgttagttaaaattttcagctaagtcagtaaaaatgatcattttgctgggtcaggattccatcagaatttccagttccaggttttttcggacagaacactggggaggccaagtttcaagtcctggccatttggactgaatctagcgggacaaagggtaatagtttagatggtacccccccttttttaaaaattttttcaactttcaaaaaatcataaaaacatgttcgggatcgctgatcacgaatccgacatccatttcgaccgattccgaacccctgacccggattcgaacaaaataaaaaaattgattttttaacaaaattcacatttattgctaaaaatcgattcaaatgcacgaaaaagaaaataatcaatgttcgcatggataaaactcagagacatgcaaccaaaaattgtaaaacgcattttcacggtctccaaaacgctgacgccaaataaattctgggaaataggtgtcgtatgtttcagtcttgttcccaaactgctttttttattttgttcgaatccgggtcaggggttcggaatcggtcgaaatggatgtcggattcgtgatcagcgaccccgaaaacccctagaacatgtttttatgattttttgaaagttgaaaaaaatttttaaaaaagggggtgtaccatctaaactattaccgaaataaataaacagcaagaaaaggcaaacaaaaataattcggcattaattaatgtgtccgttctgttgtctgtcatcaccgcttggcttttgcttttgatcacttccgcttcaaccatttcggcagttctgaactcggcttcgttgttcgttgactgttgtttctgctttgactgttcgtgccaccgccgccactgtcgtgtggtgccgacgaggaaggcatcaccggacttggcattgctgctgctgttgcagttgaattgtctgtggagggcaacatgtgcaaaatggtgtccaaatagggacggaattcggtgtttgacgacagcctaaaatgagaaaaaagttttaagaatgcggaagtaaactaattgtaagcaatgaagcgttaagtggctatttttgagggtatcattaaatttggacttggagtggagttggccaagtgaacaaaaattgtactagttttgtctaatttttgattttaattatcaaaatcgtttattgccaatacacaaattcaattgaatcgacgtggcagaaatttaagcaagagcccaaagagagatttgacaaccacagatcatttttccaaatactttctgattttttgggacggaagaaattttggaggctcggacattttttaaattatggtcataaatcgctgaatttttcaaataaccatttcgaacaaatacataaagtggatccaaaccaaattagtacccataacataacgattatacaattttaaggagaataaatccatgttgaactttaccatttttgagcttcggcctttgcttccgtttgtgtgcagctttgaaaactgtcgaccacaaaaatttggtcggcgttcatttgctcaggtgattccggtgaattgtcggccgccacaattttcaaaatgagcacacttttcggcgtaatgcccgcgtccaacagcgaagtggtcgagtcgtctgatttcaattttccactggtggtcggaatttggcgcaattcgaaacgaatcgttggcgaaatgatttggcgcaggaaaatgaacagtgccgaaactgaatttctccattttgtttaatttgataaattggaacatgggattgggacaaaaggccaattagcaaaaacctggttcggtggagaggaattgcgcctgtaaaatttgaccattgttcaggcgaaagcgcacaatcgaatgtttgtacgccttgtgcttcagctgttggtccctctctttcatcagtttggttggcaacagcgaattctgtcttttgctggaagaatatgccaatttatggaccaaaatattcaattgaaaaacaagtcggaactctcctctttctttacctctcatcctgcaacgctttgagcattttgcgcaagtcttcggccgtcagttcatagaattggtcgtcctcctcctccgccgcattttgttgctgttgaacttccgccggtgccgctgggtcgaataaaagcgcatttcgcgggacggtggacgaaactgggagggaaggcgaggatgaggagggaccaacggcactgtgatcagtttgatccattgattgttgaataaaatatgaaaacactgattga

SEQ ID NO: 8045 - DNA, 2463 bp, Heterodera glycines
tttttgtgcaactccgcaccatcgtgctgttgttgttggattgcgtcgcgtgcacattcccacgcgtggcaaatcgggtcggacggctgctgaacaccaagcgtgaactgctccggcatcatggaacgcaattcctgctcactgccaattagcaaaaaataaaaattgaaataaagggctaagaaacaattttttattattgagtttgtccccgcccttttttgaaaacgttcaaaaattttaatttcataaaaacaagtttcctgtggtttttagaggtcgctgatcacgaaaccggcgtccattttgaccgattccaaactccgggtccgaattcgaacactaagtcgaaagttcaattttcgtttttgagttctaaatcggtttactgaaaaccaacaattctgcaataaaaaaagaaatttcgaaattcaacaatttgaatgaatttgatcggaatcagttgaattggtgaacctcggaaaccggcgttttttattcttttcggagcccccgattcggcgccagcccaagttttcggactataactttttttagtctaaaccaaatctaatatagttggtatcattcgaagtcttaacatgttttgaagcttttctaaggtattgctttacgattagacaaataccaaaaaagttatacatgaaaatttcaaaaaagtcaaaatttttgaagttttttcttaataattttttaaaggctagaatttttttggtttttttttgtaaggctagtagagcatgtgaaggactttcgaatgataccaagtttgtttgatttggcttacaaagaaaaaagttatacccaaaaaacatgggctggcgccgaaacgacctagtctgtgattctaagcctattttggtcatttttatggcattttgtgcctatttcactttttacgaagaatttttttccaaaaaataaccattaaaaattttatttacatatttgaggatttttgtacatatttcatacatattttagcattttttatacataaacaagtgatgaaaatagactttcaactaaataaattaataccgtattgcactttttataatttatccactgtagattcgaaataaaatatcctatcttcaataagaaagaaaaaatgatcaaggacaacagagatcaatcactaaattcggaagtatattttgaaataagaaaaatccgattttccaaatgaagagacaaaccgagaggttaaaaaaaggtaaaaggcattaaactaatcaaagaatgagcaaaatcataaaaaagaatggcaaattaaatgttattttgtgcgattggtacgattgtttccatttgcttcattttggagcttgcttttcattgcactcgcttcaactcgaatttgcatgaacagtccacgcgcagaatgaacgggccctcctgcccagcgacaaaagtcatcggccgaatggaataagtgccggccggcagctcatccaattggagaacggtgaagccaggcctggaaaacggaatgacaatattgtgccgacagtctttgggatgataacaaaacagctgaattacctgaacggtcccgagtcttttgtctcaaaagtccggtcatttctggtcagagacaccggtgcgagttcgaagccgacactgaactccttgggaccgcgcaattccaccagcagagcattgtcatcactgccgtcttccgtacacaggtgaaagaggggattgtttctgcagaaatcaatgtttgttgattaatggttggcgattcttttgattggtttaaaaaaaattgataaagctgctcgagaggaggatcgctctttagtctcgagaaatcccggatttataatcagttttgagaaagtccaattatgagcaacgcgcttaaggtaaagtttgccaatttgctcactgaaatgtctctctgctcgccccgtttccacatccgcctgcagttgggccacgccattccgccgcttccttaaaatttactttcaattttttcaatgaaatttgtttccttaacccactttgcggtggaatttgtacggcattggcatattaccgcaacgaaaatctgcgctcgaatacacccgcaaactgtagtaaatggtcttcatcttttcatactgtaaaagaaaatattgggagagatggatatggtaaactaaattaatattaaaataaattaatatatgatatttgtacttgcgcaatgacaagcgtaaagcgttgaatgccaggctcacggacaatcagttgacaaagataatggggactaattgaaatggacaaattaaaaaagggacagaatgatccaggcagaggcacctgttgatgcgagtgccctccaaaattggcttggggtcaactgaaaacggattagaatatcgggtaatgtaaattaaagcagccgaacgcacatggcaaatagacgcgcttcccatcatttttgta

SEQ ID NO: 8046 - DNA, 1694 bp, Heterodera glycines
  misc_feature (18)..(18): n is a, c, g, or t
tcccgccgtggtcgctancccccggaagagttcgtccgctgtcgttggcgttgctcagcgattccgtgccgcagctctccgctcccatttcacttatgcatggcgacgttccgttcgaatgtgaaggcagcaacaaacaatcgcccgcattggcaacagtgccattcccttcgatcactttgatctctccgacgatcactgctacgtttgctcctagtgatccactgttgtttttgatctgagtgtacggcgaggccatcggcgcgtagcgcgaacttcggtgggccatccgcgagtgggagaggcggtggcgagtgtagcagttgtgcagcacggactgcacctcacgattggtgaagcagtagatgatggctgaaaaggaaggtgatccgatccggaaactcaaaaagccttcgtaccgatcataaaaccctggtacatgtaggacagcgaggcacagtaagtccaaatggcaaagtactgtaaaagagagtaatcttagcggtgagtgtgggaggggggtgggtactgtaatgttctcttgagtgggcgagaaagggatggtctgcataatgttggggatgcccagcagagggatcagcatcagagcagccttcacggactttcttaagtggcggaatggaaaagcgaagaaaattaattaaattggaaaatttgaaaatgaaagcgaaagactaaggaaaaggcacattcaaagaatatttaagcccttctaattctgtcctgcccattactcacttcattcggccaatttcgctgctcgactgttgcgagtcgcgcactttcagccaaagaacccgtataacgttgaaaatgaaaaaggcgttcagctgaagagtaccgtatgttcttatttgagtatacagtattttttaagtgatactgtaacgataagcacagtaagtgtaagtcccaccacaagttgaagcagccggggtccgtccaaaatccaaaattccgtctccaaataatatgagccaagacatctctccaactgtccgtgtttcttcaccagaagcacaattagccaacagaaagtgtgggccaagggaacaccttaggagaagggaaaggccaaaagtgagaagacaaagcgagaagagagaacgatggccaattcaattttatggacattttcacatgagacgaaatgccaaaaaagggaatttgaatggggagaaaaatacggaaaaagcaaaggaattggagcaaattggcaaagaaactctcggcaagataaattgggaaaaaggaaatccgagtcatatgaaaagcgcagaaaacagacactctcctcagaatggactgaaacacttttccacggggactgaattgagccggcatgccgagaaaagacaatttagagaacaattagagaataagtgggaacatttgtggaagattttactgccctgctgacaatcagcagaaggatttgtccatcatagaaacgagtaagagtcacattaagagttactgtggaaagaacctaccgtatgctgtgatcagatagggccaaagttttggcgttttgttgaaaaaggcaaaaacgagaagattatgtaggtaaaggccctgaaaatggggaggaaaagtattaatgaaatgggaaagagaggaaggagaaacgacctcaagaaacatccaccaaaaagcgacggatttgaagtact

SEQ ID NO: 8047 - DNA, 1832 bp, Heterodera glycines
  misc_feature (91)..(92): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (112)..(113): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (124)..(124): n is a, c, g, or t
  misc_feature (127)..(127): n is a, c, g, or t
  misc_feature (148)..(148): n is a, c, g, or t
  misc_feature (160)..(160): n is a, c, g, or t
  misc_feature (171)..(171): n is a, c, g, or t
  misc_feature (199)..(199): n is a, c, g, or t
atccaccaaaaagcgacggatttgaagtactccaagaccatttaagtcagctcacagacgaacacctcaaaaagggacaactttaaacagnnccaaaggcangancancaannatnanaanagngancaacccccccccccccccccncaaaagaacgancagcaaaacanccacccgagggggaaaaaacatacagancagaccccaggccacataacgatgatcagcatcgttctgccttccaatgattatgactgaccatagtgttgatcgttttcccgtgcggattgaccaattgttggtggcccattcggtcggtgaaaatgaggtcaatgtaaaggacgagacgaatgagaacgacggcgagcagtgcgaccatcaaatggaggtgaattaagttgcgaaatacacgtaaacgcctaaaaaggggaaataataaaataggcaattaattaaaagggaccgaaacaaggagaaaatggcgacactgaagaaaagtgagatcagagaaaggccgagcccgacgaactccaatttgcgcacgttttttgccacttcttgtgccatctgacaaggaaaaagaccaattgaaaaattttgttaaaatcaccagaagagtgccattgtccatgttctgcataatggccacgacctgaagaacggacaaatcagtcgctgatcagaaaaataaaggccaaaggagcaaatgccaattaatgaaagtgcctgcctcttgagtaaaacacattgtgaagtttgtccagccatgcggacgggaaaaatcgtcctccgttttgcccatccattggccggacggatgacagaatttggtgatggactctgacaaattaatcagggattagtctgctggatggcattggccacttctcccccccaaggcaatgccaaacgaaatgactcactggtggtgtccaatcccttgagaggagggcaccttaaaaaacaatgccataatcatccgactcatatgaaagcacaatacctgagggacaccgattgacctccggggatcgcgggcctaaaacaagcaaaatgaatgatggaactgagggggagcggaaaagagtgactttattcaaccaaaccaaaacccattcattggcacagtcagtccaaatgatcggttttggctgatcggatatgcttttcgtcactgttcgtcctaccagcataaaacggtgtcccaagttgcgttacaccatggcattccgtcttcgcttggctctgcactgatgggaaggccggaatttttgagggcgtcaaaacatctgaggaaaagcgaaagtcagagaaagcatcgcagtgcaaacgaactgctccatgctttcggccaaactgaactgaaggcccctaagccaaatgtttgaagtgttggacagcagaaaagtggccacgacttcggaatccgacagatcgtcggcatcctccgagtaggcaatcatggacattaagctgaacagcaaaagaaattggcaattgaatggcccctcccccaaatcaaatggcattttcgaaacagagtaaagcgggacagaagccaaaggtaaagcaaatttatgccaaagtgccccaagtaacggaggggggggggcggcgaaaaaccatccatcaaattgtgacatgaagcggataatcccaaaagtctctcaaccgattttctttttccccgcaaataattcaattgcgattctttttttccagtagaagaacagaaagcgggaagagctttcatcggttttcctaatttgaaatgcccccaaaaggcactcaaaggaattggaaacttaggaaaagcaaatcaaaaaaagga

SEQ ID NO: 8048 - DNA, 2396 bp, Heterodera glycines
aaaagaagccgcaaaaggacaaactatcgaaagcgggagccaaagagacaagagagaaaagttggaagagaagccaaaaagaaaagaaagagcggggaaagggggagggagtgatggatagggccaaaggataagcaaagggaggggcaaaggaaataatgaaaggggcagcagatcgaacacaaagccacgcattttgattaatcattcttcagcacaagcttaatccatgcccaagttactagaatttgtttgctttttaatttcgtttccattgttttgccattcaattgaaaaattccatcgcgaatttttgctaacaaaggaaggtcatcagcaggtatccatagagtttcggtataaaattctgttttatttattaaatggcattttgggtttcagcattcgttctcatccctcaaaaaaagaaagtactcaaatggtgctcaatccacccacaaaaattcataccgaacccccacggacacctgctgctgctggggggacctttctttgtaaattgccgaagggattggaaatgaaattgaaaatgggaggaaagatcgacgaacacccgaaaataaagctttaggggtcaaatatcactcagtttatttgttaagtgggccaaattgagcgaaaagcattgaataggcacagattaaatgacaaacgaattaaacgaacggacagttgccaaaaggaaaccaatgtggacaaatcccatcattgaataaatgaatgaaagcatcatcatctttcagtgttcatgttctgttccccgccccacccccaggggagaggtgaaagggacacgtgccatggatgaaaactgaatggacatatcccttggcagcacgtacccaggacggggaaactccacaagaaaatagagcattatcggaataaaattctccatttggtccctctctttctcctccttaggtggcccagtacgtctcccgcccctgcccctctccctccaaccaaccttttttgccatttccatcaccatcttcagcagaatgtgtttataaatgttgtttctgttgctgctccgttttttgttcgtttttaagcgtaaaaataaaataaaaaaatttccgcagcacttttgacaaatgaaaagaagaaacagtgaatattggctgatgcagcagaaaatcttaaccttttgattaactgattggtctggggcggaatttgttattttgcaaatggtttgggaagcgccgcgaggggaggggggggggacggagggataaacacgtggggtgaaggatggcacggcacacaaagcaaagatgacataatccgaggattaacgagtgcaacacatcagcggaagtgcagcagaaacagcggagcaatacgaaaaagcgaatattttctttccgtcattttttggttttgaataatcgaaaaaagagggggagaacaaaaggttcaaagaagaagatgcaacgtgaagggatcgccgttccttaaatcattggccgttaatgggccaattctgcgactgaatgggtgaaaaagcgtcgcccgccattccttcgccattctttcgccattccttcgccattctttcgccattccttcgccattctttcgccattccttcgtccgtccctcccccccccccccacccgaatttgccccttctcaactataaatctttctcactgaacaattatcacatggttagagaaaatcaaccggcaattgttgagaatgggtggccaataattgcaatgggccaatggcaccaattccgccgggggggacttttgcggaccatcgacagtctgccaaattaaattttggcaaagtgtaaattaaagttcgttcagaaagaaaaaggcacagaaaaagaatgggaagaaaagagaaagtgtggggaagaattattttgttatggttcgaatagaaattaagcgaaagtttggggagaagcagcggaagattcaacgaaagtcataagcaaaggcacaatttcggcggactttgagtgcttttacttaaggaacagcgaattgggttatcggaagtgttcgtcggtcgcctcggcacagaaaaaagggtttaaaggacgtaaacaaacaaaaatggactttttatatgagaaataaaacttagcaaattgtgaaccaaaaaaacggaaattagccctaaaacgacgaattggcaattaattgccttctcatggatgcgattctgaggcaattgttaaaaaggatatttatccacttaatttttcaaataataaaattaaattaaaaatgtttactcaaaattggccaaatttaaataagcctatgtcgaaaatgcatcaatttatcacttcgattacgaacgttttatagtctgtgggacaaattacaattaaatttgtgaga

SEQ ID NO: 8049 - DNA, 953 bp, Heterodera glycines
ttcaatcagaaagtgtctcgtatttccattttttaatatatttttttttcggcattcgattagcgaaaatgggcatcatttttgttggtgaatggggttggaaagagtgaattttgtttataaaaatttaaatttttaaaattttttttactttatttatatccttcctcccctcgccgtttcgcaggtgttgcaagagtgtgtttccacgaaaacgggtgctccattcgcgcaccattcgcattgggcatggtccggtgtgcacgggcggctacacattcccaccaaatgtgatatgcaaccgcaagtacaacatgttcacatttgtgcccatggtaactttgggaagggaagggctacaaattttaaattaataaaataataacaatggacaagcacaagcaatgcttattcttacataatcgaccacatcatcacaaagtgccaatttcaacaggactttgtgccaatctttttggaataagcacaaaaagttactatttttaacggattaatttcgggatagcaaatgccaggaaaaggtactttgagcagaaagatgtgcccaagggattctttgccttttcgggcggggggggggagggagggaatgccatgcaaatgacgggaagaagcggcggtgaagccggaaaacagaggaggaaaagcggaattggcctcccaacaatgaatgattatttgcatccggagaacagctgagaatgaatggggtggccaaaaagtcagtcgcaggcaaaaccaagtgccaaagaaagtaaacggaaaaaacaaaacaaaattggactaacgaagtacggcatggaaatggcatcagtgacagacatcggcaaatgaatgaaaggacggacagtgagggacgaacgattggaggaggtcgaggagagggggcaaaagtaatggcaaattgggaaaatgaaaggacaatggggagg

SEQ ID NO: 8050 - DNA, 1552 bp, Heterodera glycines
gcaatttcgagcatatttcatttttttacatatttagagatttgagaaatttatagaaattttttatgaaaaataaaaatttttatgaaatgtatccctaaaaatatgaaaaaaattaagcttaaaatactacaaggtgattctaagcctacttaggtcattttatggcatttttgcctatttcaccgtttgcaagaattttttttccaaaaaatgatcaattttaattacatattttcgtaggatttttgtatatatttatatattccggggttttttcttatccatattttgtaaattttattacataacattcccatccctattaataatagataacgccgcgtcgttcatttttaaaattaaactatttcttcatattttagaccaaattttaacttcttttttttggaaattttttaaagccgtcatcataagaaacacaggctaaacccaattttataaggctaaaatcaattttacatattatttaaaaaaagaataagagtagtccctgtttaattgtatttgttgtataaatatgttttttaatttttcgattcctttttttcattaaaaatatttttcctaccaatataaataaattatttgaatttaagaaaatgtcatgtaaaataaattttggcctaaagagcagattgaagaaatattgataatattttatttgctaaattttttattttgggctaataaaattagagaccggaaatttcaaatttgcagatcccgctgcgggactggaactcaaaattttttgcgggactggatcccgcgggattaatcccgcaaatcccgcatttaaaatttgcgggatcccgtgcgggattgcgggattttggaaaatcgaaaaaatttcaattaaattcaaagaatttccaaaaatcaaaaaatgctgaaaaataaatttttaagggctggcgggatgcattaaaaggggctgattggtcgactaagatttttcgattggatccgacggtaaaaagttgatcggaaatcaaattattaatggttcataaatttgactatttttttcttttcaaaaccacttttttgcgccgtaagaaatcggaaatttttcaaaaaatatacaatataataataaaaatttctaaatattttaataggctaaattttttaattcttaaccaagtaaaaggtatttcacaaatgtttttagtattatattcgcttgaaaaaattattcaattattttatcaaaatcttttttgtcatttttcattattttagaacatttttgggaaaaggagtgactatttacacgttttttacagcgcgattttttcaaaaaactttttgggaacttggaggagggtacagcggtgccgataggcgccgccgggaaaatttcacaaattttgaatgaaatttgcgatgaaaaatgaggtaactttaattaaaattatttattttaatttatttaaaaatatttggcgatttcggtcttaaaaaaaaattttccaaaaaaatcaataaaatccccgcataatccccgcacaaaaaaatcaaattt

SEQ ID NO: 8051 - DNA, 3441 bp, Heterodera glycines
tgaaaagatttgcaaaaatacatggaaagaaattaatttggattaaaaatgggggaaatgggaatagaaagcaattttttccgattcggcgccgccgggaaattttttgaaaattctatatgaaatttacgatgaaaatgagtcaattttaattaaatttattatttaatttatttaaaaatatttggtattgtcttagaaaaattttcaaaaaaatcaataaaatcccgcataatcccgcacaaaaagtcaaatttgcggatcccgctgcgggattggaactcaaaattctttatgggacgggatctcgcgggattaatcccgcaaatcccgcattttccaaaaaatgcgggattgcggactgggatcccgcaaaatcccgcgcgggatcccgtcccgcgccggtctctaaataaaattattttaatgccaaaaaaaatcatttttttaaataaatttaatattattttatatagatttaaatctaaaaaaacctaaaaattaaggaatttgtggggaatcgcataaaaaaaactttgcagaccagcagaaattgtggacatttacttccgctccatttttaaaattaaaatttggcaattattgccaaatttttagcaatttttattttagaaattctctttagtcatcatcataagactaactcaggcaaacgatcaatttaatctatttttagctgctatatgctatagcaaatgacgttaaagccccaatcttaattttttttttattcatacaaatattaataaataaagataaaagtaataatgcctgtttaattgtatttgtagaaaaatatatagaaatatatatttttcgatttccttttttattattaaacaatattttttattaccataaattattaggaatttaagaaaatgcatataaaactaaaatttccaactttaccaatgccactggtacttttggccataaatattgtcatcatttcggcatggcaatttgagagtgaaactatgaaaaggggtataaaaaaaatttattttttaattatctaattagcataatttatccaaaaaattccactcaagatggtgatggcacttcttctcggcatggcatcgctttttccaattcgtcgtcaactgcacttgacacaacgacaaacgatgttggcatattacacattatttagttttcaacgagaatagaacgggaccggaatcggtccgggaattcccggttttcccatggcccggtttttattaaaaaaaattctaaaaattcccggcttcaacttttttcgtgccaaaaatggttttttttttttggaaaattcttcaacatatgagattgccttttatggttattggacagttttttttcttaaatttagacacaaaaaaacggtgctaaattttatggaagcaaaactttttggctacttataattttgggcttttacgcgtccttttttcaagaacactatttgacggacttgctcagttgggccggcacgggttgggctccagcatttccactataactttttttctctgtcttccaaatccaacatttttggtatcattcgaaagctcttcgcatgctctattagccaaacaaaaagcgaaaagatttttcaagcctggaaaaaattattaagaaaaaacttcaaaaatttcgacttttcgtaattgtctaagctcgaaaaaatggcttaggaaaagcatctaaacatgttaagcttcagaatgataccaacaatgttggatttagatgacaagaaaaaagttatagtggaaaatcatgctggcgcccatccgtgagcgcccaacagaggtaaaccgtcattctttattacttttcttagaaacgaccaaattccactttcttggcatcattcggctgccttaagtgttcgttcttctattagcttgcaaaattaaaaaaaaaatttattaagtttccaaaaattattgccagaaaaattcaaaaaaccggattttcgaacatttttggccataattttttgaaactcagttaacttttttgaaattttgcaggttaataaatgacacagggctatcgaatgatgctaagaatgtatctaagaaaagttacaaactctcaaaatatgccgcattaaatggctaatgactccaccgcccttctttgaattctttttccttttatgaaaaaaaattatcttttcttcgtgcaaattattttcacaaagcttttccttcaatgaatttggcacaatgccaaaaaatttgatggccctcctcccccgccgcccaaaaattgttggcacaatggcccccaatttctggcacagcgcaaaacacattgattttggccaccactttttaaaaacataaagcatgacactgctgctggtcgtcgtcgttggcgccgcggtggtgatggagagcctagccttggccgcagcaaatcggtgcgccaagatcagctcagcagagcgccgtcgggtcgccgtttgctcgaaagattggtggaagagaaacctgtgacaagcgtgagcaccaaaataacaaaaaggtcctgctgtgcaattgcattttgtcgcccgcccggtgggcatcgaacccacggcatttccataccgcgtgggaatgctctgaccgactgagctacgggcacggtgctatttcgttattaaaaaaagccataaaaagggcgttataaaaaaactaacaaaaatgaaattttcaacaaaaaaatacccgtaatttttctcaaaacctttatttttttttatataataaagtgaaaatatatgaaaaaaaatatttttttaattcctacaagataaaaataaccattttgaaattaaattttgttcattttatttaaattaaaataacttttgacatgcaaaatcaaaaaatttcgtaaattttgatcaaagttatggtcaagtgcacaaggaacaaggttttcaaacgtttttggtctaagcaaattttggtcagaatttttgatgatgaaattatttatgtataatgaaaattttttgtcataaattgtttcaatttttatttcctttaatcattcgatagccctaagtgttttctactatcctgcaaaatcccaaaaaattttactaagtttcaaaaaagttatggccaaaaatgattgaaaacctggttacttgtgtacttttggccatgactttgttaaaattaaagaaatttctgaactttttcatattaatacttaattctatcgaaaataacaagaattaaaattttgcgtgctggtgcgtttcttaaattccgccaatgagttcgaaaacaaaaaatgggtaacacataaaaattcataacttagctcaaattcaaccaaattaatattttttgttatcattcaatagcttatgtgttcactatcagaatatgattttccaaaattttttgcttaagtataaaaaaa

SEQ ID NO: 8052 - DNA, 1156 bp, Heterodera glycines
  misc_feature (33)..(33): n is a, c, g, or t
caaaaaattaaagatgagcccaggggcataatntgagacaaattgaaatgttgagggggtttaagcaacaacgtgataatgttatgaatgataattaaccacattgcatacgattaaacactgtggagtaattagagttatttttttaaatgtctttctaaattttgactatttaatatacagcaaaaggaataaaaaatttgaagatatcaaatttgtttgaggatgctggcaacatagacttaatgtaactgctccaaaacaaggtgcagaaaaaagtaaaatatttgattaaaacattttcctcctatttattcaacgctctagatataaaaaagattatttgttaacaaaaactaggaatatcagccttttaagtgatatggaaaagtttgctagtattgaaaacagtggaatataaaaaatttattgtaattttagtcaaaaaattaaagatgagcccaggggcataattgagaaaaattgaaatgttgagggggtttaagcaacaacgtgataatgttatgaatgataattaaccacattgcatacgattaaacactgtagagtaattagagttatttttttaaatgtctttctaaattctgtgtatttaatataccgacaaaaggaataaaaaatttgaagatatcaaatttgtttgaggatgctggctataacatagacttaatgtaactgctccaaaacaaggtgcagaaaaaagtaaaatatttgattaaaacattttcctcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgagggggattaagcaacaacgtgttaatgttatgaatgataattaaccacattgcatacgattaaacactgtggagtaattagagttatttttttaaatgtctttctaaattctgagtatttaatataccgggaaaaaggaataaaaaaatttgaagatatcaaaattggtttgaggatgctggctataacataaaacttaatgaaactgctcccaaa

SEQ ID NO: 8053 - DNA, 3509 bp, Heterodera glycines
agtgctgtggagctgcccgccctacattcacaaaaaacagcgagaattcgaaacgctggtggcacaaatgcaggggctcataaatgatccccctcagattctgccgatctgcacgacaccgaatggccgctcggcattggaaatttttcgattcggcgatcatttcaatacgcacatggtggaagaagacggaaaattgaaaaatgcgggctgtcgggcacttaaggcttggataatgactcagaccccattcccaggcgataacgaaatgcacattcgctcgctgccttcggccgtcattattccatcgggagatcgggccgatcaccgatcggaacagctggaattagggcattcttcgagagatcgggccgattctcgtagaattgttcctaatcgttcggctgatcgtccggccattcgttaccgtccttatgagactaatggccagggacagtacggtaacgaacgccgtcgggaattccgtctcaatcgccgctgagacacctgttggaccccacctttcggtttctgacttctaaaggcagggacgccttttctgattgttgagggatgttgtagaattttaattataatgactcattagtgttaattaaatttggcataatgtcttgtttcgcgttttttctcacttaaaattgtattctttgttttttctttccatctttcattccaattttttatttatctggtaatttttattgttttgcgccgtccaatttcttttgactttaaaattgatattcgtcaaattgtttctcatcgatatttgtcttttgggaattaaagtgtttggatttgacattggcctactctgtgtttggtataattgcgtccctgtcttaagtcagtagcaaaagtacaatttggcgctcccgaggaaacaggtacaaaagccccgatttttaaagagtttgagggtgagatcgggaataaaaaaatttttcggacgggttttaatttggagtgtattaagtatcagtccggaccggacgatatttaagttgtgaagtggaaattgactattccggatcggaaagttaaaaaaagcgacaaaaaactccagcgcaccgaaaaatttattgtttatcagaaaatttgagttcgggccgaacctttttttctgtctacatcgccgtataaactattgacaccgtgtcggtgcttagtttttctccgtcttctcgccgaatttttacatttgacttcgctggatggtcatcacacgcagtccgattttgacacggcaacgagcgttgaatttggagattgccgttgacagaaatggacatcagattaatgtcggtggaaatcagcagaactctccacaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcagacgcttgttggtggtcagcattgaacgtagccagccgccagccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgcacttctaccccaactcgaaatgttgaatttgaacagcaaataggaccattcccgtttgttgttgaccgcaacaacagagcaccaaccccacctttaaacatacggcaacaaattttccaccccatcccactgaatgcacaccgcattaaccaagtgtcggttaacgcgcaacgcaacattgacgttcagtacgtaccaaataattgcgttaatgtcccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgcagatcgagcaacctaatttggctcaaaatcatcaaaaattcactcgccaggtctttcagattccggaaacgaatcaagagcctagacatttccctacctacccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggcgttagaaagcaaagtttacaacaaagcagaaagagcttttgaggcagcaaagtcaaagcgccttaccgagtcaaaaaatttggaaatttatctcatatgcaatttcaaccaataaatttgaagaaattttgcactcaattttgaaaaatttatgtccatattttgacatttttgccattttatgtccatattttgcgatttttggtccatattttatggccatatttcgcgattttatatccatatttttaccatccctaatcatgaattaaaaatggcaaagggcgaccgattgaattaaataaaaatttaaaaaatatattatatataatagataataatgaacgaaaataaatgaataaaaaaaacaaagaagtaatacagtgaaaaaagataaggaatgaaaagcttttcgatgggttgggggaatgagcggcggatcgaatttcgctgtcgcatccgtttggatgggatgcgatggctttgatgggtgggcaaagatggcaatcggtgatggattcaaaacggagagagggggggggggggtaaaagatagaatttcagaggttttcttggggtgtaatttcagtgccattaggcctttctcgtggcttgagtttccgcgccctttttgggttgtttctccggcgttgaatttcagcgccgcgccgaggcctttttcgacagggcgaaatttgagacgagtcactcttccgccgactgctgctgctgcactccttccgcgccacggggaatcaaacgaagcaaagggaaaagccgcggcttcccttcccccccccccgcacactctcagcacccaccgctcactccccccgggggctttctttttcattggaattagcaaaaattaatttgattttttacatttaaagattgtttcttctttcggaattgcaaagcaataaactaaaaataaataaattataaatgtttaataaaaattcaacgaattaacaacaaaaaaagaagttatctctgcccctctttacgacaaaattaaattaagtaatttatgttcaataaatggccgatttttaccacttcaattcaaattatccactaaccaccaaatcattgtgca

SEQ ID NO: 8054 - DNA, 1350 bp, Heterodera glycines
atgaaagaggaggagcaaattagtgagttccctaattcgttgttaattgggagcagacaaaaaggcataaagctaacaacactcggccaattagtatttgtatttaagctggtggaacgacaaaacaatcggcgcacagtaaaggccaataccgcacgaaaagtggtgcaaaaagtggagagaaaagaaggaaggcatcaatgcctttggaaatggcaacacaaactgccaaaaacaacgccaattttcaaaacagtccgccattgatgccgcagcatcggccaactcccggcactttctcccctccgccgaatcgttcgctgtttccgccgcaaagccttgggattgttcaaatcggaagtaattcttgaatattttatgttgttcacaatttccctcactttagcctcacttcctcctcaaaatgagcagcctttgcttcgctttgccccttttttgcctcctccgccccctcagcacggcattttgcgtccgcccgtcccgctttttgtgcctccggcggccgatgctttcattccatcgcaatttgcgccttcgtttgactcgtccgcaacggcgtcaacaatcaatgctatgaacatgaacatggtcattcccccgttgatgatgctgcaccaacagcaacagtccaacaacaatgccgagcgaacgacggcgacagcggcggcgacatggacactttttgaaatgttggcaaaaggcacaacgccaaatggtcagcaacagaaaaacgaaatgggacaacaatcgcaacagaataataacacaaacagaggacaacaaaatggcacaacagaaaatgagggaccaataaatgtgtaagttgtgaagagaaattttgccaattattttgtatttgaaataattttaattatttgacaaatacaaaaaacacatgccaggtgttttcgacagtgattgaatttgagtaaaagctaaaatttttggtgattcgaacgatgcgaaccaaactcgactcgagaacaaaaaaccaaacgaccgaaacacaaaaggcaattctttccaacaaattcagcacttctccttcacattctttggttgtttgttcaccaaatttgctgagaaactcagaaagtgacgcgcaaattgatcagctaatggatcaaatgattgctcaaagacatgccgacgatgtgagagaatagtaaatgattgattaatcactcatcaaacattttaagaaattaataaaagggaaatgtttttttgatttaaattttaagttaattttacatacatcattttaacgattttaatgcatattaatgtttagaaagaactttcttctgatcgccgatcactgcattc

SEQ ID NO: 8055 - DNA, 598 bp, Heterodera glycines
caaaggagaaaacgctggtctcatggtgtaacggctatcactctgggctgtgaatccagctatcccagtttgaatctgggtgagacctaagcggaactttttgaatttcattttttagacattagccactgatcggaaaaattaaagcaaaaacttttgtgaattttcttctcgtattcctaaaaggtgcatcatactcgcgcatttaattattaattaggtgcccatcaataatctgcttcattaacaatcaattaattaattatcttttctgcttccattcccactcacttttcaatgctttttccctcaacagtcattgtctttttttttcttctaattgctgctaaaccggtctttttctgcccattctcgggtggtcattaagcaactgcgagagcgatggtcaacggagattagcattataataaacggtcatttgccttttttaaatcatcaaaatgcttctccccttaattgtctcttttattcctttgactgcgttttttctgagtgccatagaagccgacacagaaacaattcactgggaatggcgcgaatggatctgtcagacgaatgacaaaggtgcggataaatt

SEQ ID NO: 8056 - DNA, 2639 bp, Heterodera glycines
tttaaagcatatgactcgggaattgcgggcttccggcgggttacgagattagtagacggagctgctaaaataatgtggtgctagctaattccgttcatgccaataggtgaaatgttttaaatcacacaaaaagcttaaagatttgaagcggaagaaatggcacaaaaaatggccataaaagttaatctcttatcaatttgttttttaaatttaaacaacccaaagaaaatctagtccttattttaaatatttattaagttattctctaattttaatttagttgagtcttagatttgaagttgtctttttcaaaggaagaaattagttttaaatgaaattttataatttattaaaaaaaatatttttattttatatacaattttctatttgatagggttcgataattccaatccaatcaccaaaaaatttacttaacagcagtttgaataaaaaaaaccatgccgaaattttatttgcaaatttaaagccaaattttaaaattattttttatggtctatttgaatttattttcattaaaattaatttttaaacaaaattgttttatgtatatgccaaatatagaaagccgattttttattccttttcccgtttataaatgctaatcacagcaaatgacgcatgacattattcgcttaccaaatgcgcttcctgttggggaccatcactcattaatcggatacgaaaaaaaacagtcattagcgctgagaatttgattatttttcttaaaaaatgacaaaaaaataacatttaattaaactaatatttctttttaaaataattatattttagttaaatgccttatttcatttaaatttaattatcaataaattaatttatctacactaattatttttgcataaaatcgtctgaactttttaagttaatttttgtaaaattctgttcctgtttcctttttgtagcaatttcctgtttaaaaaaaaataatttttataaaaagagtaattaaatctccgcatttttcacattttttgcacttttgcgtaattaacggaagcaaaaaatatttgtaaattttaccgtatccttccgtctccgcttccggcatttgcttaattaggcaattaattattcatgttatacccattttttgtgtcaatgaagcgaaccccatttaaacgaagaaaaatatttacaatgttcacaatacaatcagttttaaggttcataaatgaataacaaattgttaaactttttgaataatctttttacagtttttggaaattaattaatttttgaaaataataaagaaatattttaaatatttaatagaataaataatttttaaacattaaattaaatcagctcttttattaatttacgatgaaaattttggtgatagatttcaatttaataaaaaaaataaccaatgcctaaaatacgggtccctaatggattacaacataaataaattaccattaattaaaaggaattttctattaaataaattttgattatttcatttgacctttacaagtggaaataaatattatcaaatttattttttataacaattttttagaaaaaaataaataaatgttccataattcgacgtattttctcattgtttttttgcttcatgaaattctcatttttacgtcggttcattgtacgatggctaaaaaaaagctacatcaacagcagcgggaggaaaactttgatagtacgacgtcagcattttcaccaaaatttgaggtatcatttagaaaaaataataaaatatatgcatatatacatttagaatatatataaatattacatacaaaattttcaaaaattttttacatgattttattttcatacattgagaaaattaacgcttttatgaaacattgatttttcagaaaagcatttattttattttatttaacttccgattaataaatatagaattttcagctccaccgtcgacatcataagcatcgactgcggcgtgccgtcatcaaaatttgcgtcgatttcaaccggcagcccattgcatgcaaatgggaaacagaggcacagttgcgcaaaaagctgatggcatgccatttgagcatcatcacaatgccattctgccatcggacagtgccgaaaattacgcggaaaatgcataaaattcaacgggaccggcgaagaggcggaattttctccgcattatagacaaaagcgtgaagaatttgagaattgtgaatttctattaatgaattctaattaacaaatttttttatcattcttgagaaaattactataaatttttttgaaaattttagggcgttaaatgctcaaatgatttcaaaagttgctgaaaacatatttttcatccctttcagtcagctgaaagtccaggaaaaaatgcatgcgcatataatttctaatcttgtacttaacttttttattaaataaaaattattttttcttttttttgcccggtttatttttatttttaataataataataataataagaatctttttgattttacttaaattaataatttcgttaaaaaggttcataaatgaataacaagttgctaacatgttgaatataattttcgatttttttgactattcaggggggcaagaacagacttgagtttgtttgttatagtcacagtgaa

SEQ ID NO: 8057 - DNA, 1446 bp, Heterodera glycines
  misc_feature (40)..(40): n is a, c, g, or t
  misc_feature (63)..(63): n is a, c, g, or t
atgaaagtaaatgagttccatttttattcatatattcaanaattaaatttatctctagtaatntatgaatagttacttaaactaatttggaaagttaacagttttcctgttcctttagcacatattaactgtgccactttacaatatcatagcataaaatattttcccaaaaatttttgcgtgctttgttgatgacatcgtaacaatttacgatgcaaatgcgcaacttgataataccgtttttcacaaaaatttgatgtaataattttaaaaaaattgattcctctgttcattattccatttattattttttagattaatactagccctattacagtgctttaacatggtcattgataaaaattgaaaagagtttagtgaaatcttgtaaatttttgaaaaaataattattgtaatgtgaataataatgatacttttaattgtataataaatattcaattaattttttattatgctttataagcattcatgtattaaaaatgtataaaatatattatttataattttttttataaagcttaaaatgtttgtatcgtatgaaatcttcaaattttggaagacaaataatgactccatccaaaaataaaaagtaaattttaaaataccaaaatagtgaaaattaattttaaaaatgagcaataagtatttttttaagtttttatgtgttttgctagctaaaaagcgttcaaaaattttcatttgactattttagtgcctattcgcggtctttatcttattcaattcctacttttgcgcgttttttcagttttcgggaacggtttttgtgctctagaatcacatccctgttaagaaatatttaatttgatttttataatcgtaataacaatttattacaatttaatttttataaaattttttttataaattctaaatatggccttttcttatttaaaaaaaattaaaattttgccaatgaaataatcaatttattggcattgtttcatcattgcattcattctatgtgcttatgaaagattcatcaacgtcatcacaaatgccacatcatctgaagagaaaatataaatttccattattaaattgcatccatttatatttgttgtattagccaaaaagaaaaaaattccgctttttgtataattcgaaaaaaattctttgaaaccaaaataaaaatgttgaacatttggatgcttttatttgttgtcctgaattttgtttatataacaaatggaaagaattgtgattccagtaccaaaaataccgtcgtaaagaaagcaaattcaaacaatacccaagtaaagaatggaaatgccaaaaataccgtaacagtcgagcagcaaactgataccgaaaccatccaattggcaagcaaggataatgtagcaaagaattcaaagcccaaaaccatcgtacattcaaagcccaaaactagcgagcagccgaaat

SEQ ID NO: 8058 - DNA, 1898 bp, Heterodera glycines
  misc_feature (30)..(30): n is a, c, g, or t
ccccccccccccccccccccccgtcctccncgcgcttccggacatttggacactggacaatcgacagtggacacatttcgactgtgaagtcattttggaaataacctggcaattggacagtggacatgaagacaatgagtgaataatttttttactattataaatggctttggcagtattaaaaaatttttttttatattgtataaattgcattttctttagtctgatcaggcattaaaataggtaagtgattccttctagtcacagaaaaattttttaaaaactaagattaaatttattgttgtttattaatgagccgggcggttataaattgactaatcggttcggaggaataatcaaatgttctattaaaataaaagccatttataatagtaaaaaaaagtcatttactgtcgtaatgtccactgtccaattgtccggttttgtccaaatgtccacgtcgaaatatccactgtctaaatgtccagatgtccactttccaaatgtccggtcatgcccaccacacgcctccccaaatatttgtttttgatttcaattattatttcttaaaaagataaatttcgggaaacaaacgaatgtgttttgagtaatttgattttttttttttgagttcctttgtgtctaatttttttgaaaatgaacggaattttttgaaattttgcaggaaaatagagaacacttagagctacgaatgttatcaagaattaaaaatttttacttgtgaaaactaacagtatatattaattattacaaatatgtcgtgtttttatcatttccgtagttttttgtccgtaattgttgaaatggcctcgtgtctaaaatgtacaacccgttattatttgcatttacatttttcatagtatcgcaatttgaatgggaattggtttttaccagttaacaatcgaaaaaaatgttttataaatttttttattataatttcatgtataatatttaatttatgaaaaaagccaatttaagaattttttttcattgggttgcatttttgtttttattgaatatttttaaagaaaaaatggttaattttttaggattactgaaattgttgttgaaattattttggataattgcgaattgttgaaaaaaattgataaaagcataacaaattttattgatgcagaattagaacaaaaaattattcaacaaaattgtgacgcattgaaaaatgacaaaaaaattgacgatgcaaaactgtctggtgaacaactaccaattctgatacaaaaacatgggcaaaaaatgttagaaaaactgaaagaaattgaaactgaaaagaatgttgacaaaatgtcccaaattttggcaccgacaaatgagcaacaacagcagcatcaaccaaattggcacaatgatcaaaaaatgcaaaaagctgtgataatttttaattttttgcgggaaatttttgctgttctacaaagcgattcaaatgctaatgatgatgatgatccaatggccaaaaatgccaaaagtgtcattcaacaatttttaacaacccaaagccaaaagcctacggtagtgccaatgccaagtgaactaatgggattggtcatcaaactttggcctatcatatacaacaatgcaccgcagaatcaacgaaaaaatcagtaggtgtacggtggtgtatttaaattagggaaatattattaattggcgatgatctcaaaattcgaataattgatgaaacaattaatagaacttattaattataattaatatttgaaaatatatatttctaattattctgaaattttttgtgttaatttgtgccttaatcggaagtcatttttggtaatgtatactatgctacgattggagctggagctcaggcatacgccatattttcgtagctaaataattaa

SEQ ID NO: 8059 - DNA, 895 bp, Heterodera glycines
  misc_feature (49)..(50): n is a, c, g, or t
  misc_feature (55)..(57): n is a, c, g, or t
  misc_feature (90)..(91): n is a, c, g, or t
atagggctaaatgttctttattagcctgcaaaattcaaaaaaaatatanntagtnnntaaaaaagatatggcgcgctgcgccaaaattgnncccgaaaatgcaatttttcgaggttttttcggccataacttttttgtgtctcagctaaattttttgaaactttgcaggttaataggcactatcaagcgacttaaaatcataccaagattatttaattttgctgtgaaatcaaaatgatatgattcgttctgcaccaaaatggccagaaaatgcaattttttgaggttttttggccataacttttttgtgtctcagctaaattattttaaacttttcaggttaataggcactgtcaagccatttaaaatcataccaagactatttaatttggttggtaaataaaaatgatatgattcgttctgcgccaaaatggccggcgcctaagtgggcggttcccaccactttttaatttctccatttttggttttaagttccctgatgacaccgatatgactgagtacctcagtaaaatggcccaaaatcgctaccatcgcgacaaatgggtgaactcggcacaatttacacaaatgcattcccacaaaatgccactttaggcgacacctctgatggattccatccaattttatgtaagcttttgtttatccatttcaatgaggtttagcattttctttgcacagcacaaatgttgcggaggaagcggtgctcaagactattcggagtcattttggtacaaaacgaacacccaaatgggaatgccaacctacggtaaatattccgatgtgcaccggggttgttccgggacgaaaaaaatatcgggtcggccgaaaaaccatcgggccgggattcgggtttcgggacgagaaaaatgtcggg

SEQ ID NO: 8060 - DNA, 1357 bp, Heterodera glycines
ttttttcttcatttcccattaattttaagtgccttattcttgctgtcgccagacgcaggacgcccgggcttggcacttgcagtccattgacccgatgtgcaatcagtacaaatacggaagtcgcgcattcaacgactcagtgaattggacggtaaagtgccgcccaacgcgatcaggagagaccattagcattagcccctttcagggctgcggtaaacccacctttgaccatttgaattggcttctgcttatgttgtcgatttgtctcattattatgatagtgctcgatgtaagtctttgtggtataatactgtgcttcgccccccctggaatccggcacccattttggccaattccgaacctcggacccgaattcgaacaaaaaacctaaattttcaagtttcacattttttggctcaaacattgtttaaaaacacggaaacgaactaagagtcaatagagtgcttcaatataaaaaatattttaaacttttttgactaaaaatcgaaattttgagtcacttttccccattctttagtcgcttggacttttgcttgtggtgaaatgtctctgtctaattttgtcgttttacacttccatcagcgattccatccgaagcagggttgacgcccgaatccggaatcccgaaaacccgacattttactcgacccgatgactttcggccgatccggcccgaatcttgacccggtattatgttggatccgcggcaaccctgatccgagcctgcgatgatgccaattgtgattgtgttatgatctcacaacacagtgccttcatgctttcttaaatatctcactaatttccttcacataacaattaattactaaggagtaaaattatatggaaatccatattttcctggactgagggcggcctgaaacgcacgaaaaacatgttgttagcttggtttgaagcttctaggatggattttctatatccattttttccatatttcgcgatttatgtccatattttggcatttttatccatattttatgtccatattttggcatttttccaaaaaaaccctattagaacggccccctcaggtaaattggcctttttgaccccaaagaccgaaaaaattcccgaaaaagacattttttagaaaaattttatcgaaaatattgattagattttcttaaaaaagaaaatttcgcttttcaggttgatttttcgctaaaataagtaaattttaacctgtatcgtgtttttttcatttaaattatttttaataccatatttagccatttttaaacgttttactttgcttttagctaagttgaacaattttgaaaaatttaccctcaatttgggggggggtctgtttagtctg

SEQ ID NO: 8061 - DNA, 2023 bp, Heterodera glycines
ctcaaatttggaataatttatgtccatatttttgccattttatgtccataattttcgatttttgtccatattttatggccatatttcgtgattttatgtccatataattttattccctattaattacccttttgttttttgtatggctttattttctctgtcaacaattttattcattgtcagtaaaaagcgattgtaaaattacaaaattaattaatggatatcaaaagaattaccgacgaattgattgaagaaagatcaaatgaaagtgaagattaacggaatatttttaagcaagaactcgaaagtgaagccgtgactcacggtcacgattaccgtgaatttcacgggtttttttactcacggtcacgattcacggtaccaatccacggttattccgtgaaaaattaacactgtataaaattgaaattttggttattttttgagcaaagtttgctaagaaacagagcaaaattttcaaaaatttcccaggcggcgcctatcggcaccgccggccccctcccctattcctgaaacttttttgaacaaagcaaactacaaatattgtgcgaaaaacaaataaaaagccgtttcaaggatgatcccatttaaataaaaacaataaatttctttaaaaaattcgctcaaaataaagctattttgggcaaactcagttaataaatcccaaaattttccactaaaaccctaatttttcttaaaaattaggttaaatatttctcaccaaaccattttaaaaaggtcggaatcgatttagaacgcaaaatgatgataaaaatgcaaattatcgagcgtgccaatgcacacttcagtacctgataaatatgttaaaaatggtcaaaaatcaatttttcatattttctgaaaaaattggctcaaaatcacataaataaaaacaattttttttttcattggaataatttctttaaatgcaggttttttgtcggccaaatgctccttttgaaaattttcagttgtgagccctgaatttatttttcgttttcgtgtttcgttttcgtccaataaaaaattttcgttttgtttatgttttcgacttttaaaatttttaatttcgtttcgcgtttcgttttcgtgaaacattttgtttttgttttcgaaaattatttttttggttttagcacacccctgcccctgaagttttcaaataaaaagtcatttctagtcataaataaatttttggaaattaaaaaaaaaatgaaataaaacctaaactttcaaagtgcagagtctaatataaaaataaatgcaaactcctttttagattctttattgttgttcactctcagtacatttccgaacaaatgagttcactgtccaaatatgcaagtgttgtttgtgatgctcgagaccgagacaacaaaaagttggagttttctcgaatcgagactcaagaccaagactctcgagctcactaatcgttgtacataatttgctctattattggtttgttcattgaccattgaatagtactgtttcaccagttcaggatatgtttaaacttttcgaaaattcgagtataaatttaatttttttacgaatgatgcacgattttctgggtatcaaaaaagtttaccacaaaaaaaaactatgtttttcaatgatattatttatatatagaaatcttaatagggcagcaatattttgggcatttttctgaatttccatttaaatttaatttatttaattaatccttgtgaattttggttgctttggggcattttttacttattcatggcgtttatagcgccctttttttacggataaactgaaaaaagcaagacatttcatgtttttcatattgcctttctcaaattcaggacaaatgaaaaacgaggacatttccttttttcagattgacattctcaaattcagacaaatatgtaaaaagcagtacacttattcatttataaggcgttgcgattttatatttttataataatttataaagaagaacaagctagaattttttttttgcttaattaat

SEQ ID NO: 8062 - DNA, 1607 bp, Heterodera glycines
gatttaggttttttttcgccaaaggtcgaaacaattgccaccattagtgagccattatttattactagaggtaatcttctttacagacgaattatcgaaacactgagcactaattcataaaaaggaaaaaaatttgttccataaaaatatacaaaagggaaaacaattttaaaaggaccaacggatattgaaaaaattcgggaagaatttgagcagaaaatgtataaaaatacgaagcaaaatgccaaaatgaatcaatgaaaaattttacactttttatttcgtcaacatttcataaaaatccttttcacaaaatgattgaaactcttctgattttttagaatttttatgaaaaattgaaaaaatttcaaaaaattttccatttttttcagaaaaatactgaaaaaggcatgaaaaaaggcacaggcaccaaaaagttcaagctagaagcttcaaaccaagttaaaaactggttttcgtgcgtattaggccatagcaagttagcaaaaaaaggcatatgcctcaaaatccagtccctattcataaagtaaaaacccaacttgtactgtttttcgacaaaaaaatcgtcataacttttttcaaagtcgaccaaattaaactttcttggtatggtatcattcgatagcccttaaaattttctatccaattacaaagatttaaaaaatttctgtagcttctgcacagttcgttttggcgcgatccctattttttaggcataagtttttctttgccaaccaaatccaacaatcggagttcagaattttttgtgaaaaatcgaaaatttctagaatttctggaaaaacttttaatctttgtgttagaaaaaaacttaaaaaaatacataaaatttccagcttttttattttttaagctttattccactaatattgtccaacttgaagtgagttatgagtttccaaaattagtctaaatttcctgggctcaaaaacgaaaatttttaaaaaattccactgaaacttaaaataaggtttatttatatttgtgtctaaatattttgatggtttgtcaatgttttgtaaatattttcacatttttcaaatttttcaaaatcatgagatctttaacaaaaatgcaataaaaaatgaattttttaacgcgataatattttttccgacttgcataaaaattttcaaaatttttccactaaatttgtttttaattaacaaaatattatgtttttaaattgttttttaaaaaaatattaaaatgttttctgaatatttttttgcaatttaaagatcagcaaaacagccctgatttcgttttaacaaaaatgaaaatgacgacgaatcgaaaatgacaattttgtctttaaattccttttccagatctattttttctcgagatttggataatcctactaatgattaatcatcattttaaataattcatctaacttaataataatatacaaattctatttagtaaaaaattgacttggataattctactgatgatcaatcatcaatttaaataattgcatcataatttaataataataatatacacaaattatatgaagaaaatttataaagtaaaaaattgacttggataattctactgat

SEQ ID NO: 8063 - DNA, 5264 bp, Heterodera glycines
cgaggcccagcgaattggccgaatggcacaagtgctgctggaggcgaccaaactgctgatggccgggtaatcagcaaaaaagggaatggatggagaacaactgattagcaaattgataattgaaaataaaaatgaataaattataaatattcaaaataaatgcaaaattataaatttaataattaaattatttgatttaaatttttataaattcattaaatttaatatgggatttacaaaactttttaaattaaattgaaaagcattttaaattaaattaaaattaaaataaaaatgtttcgccgtttattttctaagtggtggtcgtctctctgctgctgatggccatgccaaccgtgttgatgaggacggcgtggaaagtgacggctcgccagggccatcgccggtggaaaatcagccgccactgcaccgaatggacgcgcaaacattgcaaagggtgttggcccaattggacattagcaggtggccaattagcgggaaatgaatttaatcaatcattagcaaaagggcaacaaataccgtaccccgaaaatagactcaaggatttattggaatatacggtactcttaggcattcctttaattattttgccaaatatctccctgtgccctttttcaatgattattttatcctttttgtgtagcattctcggcaacattgagcccttcgtcaactcagttgagcacagcggcactgtcgaggagtgtttgccgcgggatcagccctgtgaccacactacaccgtataggttagagcccggaaattttaagtttgcggatcccgctgcgggattggaactcattttgaacgggatcccatgggattaatctcgcaaagtcccatgcgggatcccatcccaagccaggcgctagtacagatggccaaacccacgcagatgcaatgcactctctatgggcagtgatcagcaattataattagccattgattgctgatattagttaattgatcagaattttgcgtgctcgaaaatgcctttttattcggcgagggttgattaattaaattctcataaaatatggtttgatgagttttgtgatcaatgtacaaatttatcggttgtaagtagggctggtcgggaccgggaccggggcgggaaatcccggttttttcaggtcccggtcccggtttttggaaaaacagaaatcccggtcccggttttgccagtcccggtcccggcgggactaaacaagcactggtaagaatggggtctgggtgagaaaatagaaggtaattggtgaagaaggagaaatctttgagaaaaataaataaataatttattttatttattgccttttttcacgtcgttctgtggtctagcggctaaaccttctgactttcattatttgtcgcttgggttcaattccccacttgaacagaatattttctagtttttctttaccatttcaattaaaaaattaaatattccaagtttatttttatttaattttcaagcaggctaaaaaataacaaattaaccaaatattggtcattttttgacaaattctgttaacatatttcactcaaaatttcaaaaattttccggcggcgcctatcggcaccgccggaccctgccgccccctcaccaatgttcccaaaagttttttttggaaaacagcgccacaaaaacagcgattaaaagcaaaaaatttaagaaattttaatttattaaaaaatccagaattttgggacccagaaaattccaagattccagatccccccccccccccccgaaatgaaacagagaataatagaaaattcttcgaattcctcccccaaaagaaaatttaaaaatcttctgggcacatttttgaatttaggaaattttcgtaacaaagtgcactcaaattttcaaaattttttcaaaaaattttctcttgggaaaattcccggttggtcccggtcccggcttttctcgcggtcccggtcccggtcgaaaaacttggtcccggtcccgacttttctggtcccggcaagtcccggtcccggtttttgtcaaaattcccggtcccgaccagccctaaataaaatagaaaaatacacccgtaagaatcgacccaaaaaattttcaaaaatacagccctaagaaatgaaaaatttctcaaaaatttctctccaaaatttatttatttatttcttgacaagaatttgtgattttaaaatttttttagctcaatactgattttgcctattttttttttacttttttgattttggcagtttttagcacctataaatatcagccctagttgaaaggcttcttttaaaaatggatgagttgactcatttttatttacaaattacctaatttggcatttcgtttgaactgcttgaatttgaatattgtgcacaacaaatggcattgaaagtgttaatcgaactcctcgctgacaaaattttcactaaaaatttttacgcattcccaaaaattcaatcaattaaaaaaaacaataatttaattaaagtagcctggtgtaaacagacatatcacttatttcttttctgtcttcatctctgcaggcttttctcccaccaatatatcgattttttatggtgacaattttagttgtgagcagatagaaagaaaatggagaaatagtgtgggctagagaaatcaaaaatatttggaaaaaaggaaggaatcaactgaaatatgaaataaatactaattttcgcttctcttaaaaggaggccaactgcctttttgttctacggttaaagtggccttaaatggctttaatctggcagaatttttcgtgttaagaagagcaagggaattaaaatcgcccaattttatcagattccctcagccaaaattgaaatccctgaatttcaagaatccggaaaaaactttgcaattgttgagaagaatccgagaattgaaacaatcgcctaactttgtcggatctttcaggcaaaaatgctgctttaaaatttcccccatttcatttcccattttaaatcatttttctatgacaaatttggaaatttaccttttagaaattgttacaaaattaatttttttataaattgattgacgtacgattgaatacaaatagtttgtttttgttgtttttgaattttgtgacttttttgtgccttattgctattttatgatttttaattgtctttttaatgtgcttttttgtgaattaaattcccagccctacttataatatgtattaaagtcaattaatttaagatattgccgactaattcattttccattattaaattcatcatttttttcataaaatccggcataagtatgtgtttatgtgaagtgtacaccacataataaatattaaataatctttataaagcatctcatcaaaaaaccatcgactttgaaaagtgctaattaagtggtctaaattttctcacttttgatgattttcaaagtttgaagaaagtaattgagttagttttgagcaaaacattttcaattggcaaggtaatttaaaaagaaaataggtcgaggggtttgatgaaaagcggcaattccttccaacgccaatttcgaatttgtttttacaagtttatgaatttaatacataaaaataatgatgcaataaatttatgacaagtaaatgatttttacatggaatttggaagaaatggactagggaaatgaagataaatgtgaaatgaaaagtgaccaattagcagaatgatggaaagggggggagaataaaattatatcaaatttattagtatcaaaatgccaaatggcatcaaattgtcgtttattggcaagattccgtgttcctccgctcattttccccattttcatttgctgtccgtcgtcgtcggtccctgcggggcgggcgagccgttcaaacgcaatgaatcgtccgacactttggcgcttcgttccaacaaatcgtcgccgctttccatgcccgagtcgtcttcctccttcttctttgcttctctttgctcctgctcgttttccttttcctcctcctccttttcctcctttttctcttcctcctcctcctcctccgcttcgttccatcgcatttccgttctccaccaattctctgccactgtgccggccaacttttgtctgaacgcgcggcccatccgatcactttgctccttgctcatgtaattcttccagtctctgctggtgcccttccgaacgaatgactcgccgtttctgaaccaatggatgtggtaagaattttaaaaccccaatttaattcaaaaagagtcattagtgatgggcatgactcttacaattagcattagcaccagccaaaagtcccaattttaatttattttatgttttagcccctaaatgatgatttctcattcccaataattctgatcccctcccccccctttttttcagttggacttcttcttacagtgccgtgccgggaaaccatcgctgttggtcgcgctgcatcgcttccaatcgactttctgccacaatacgcgacaatgtctgttggtcgttcaccagtttttcagcatgtcccccaagaaagtgaccaattttgcgcacactcccttccaagtcgttgagcatgtcctcgtaccttaaaataattttataaaaacgacgaatttcaaaaaaaaacttcagcaaaaataggaaaaaattttttgaataaactttgaactccaaactgacttcagaaagagcacattggcatcactcagatgcggcaaccaactcagcagatgctcaaaatagtcgccgaatgccatcagccgaccttcaaggaacagctcgaaaaagtcgtcgaatttgccgtgagcccattcgtaaattttgaagttgcggttgtggtggaaatagctgacgcagcagtccttcgggttgcgcaccgcgaaaatgtacttgggctgagcagtgccatttgttgttgtcgctgactgttgtaaatgccgttttggcaagttggcccaagaaaagtgcgttttcagcagtcgcgggtacttcaaactgtcgcaaaactcggcgcccaaacgctcgatcattggcgaagtgaagcacagttctttaaaattcaaattaaattgagagacgaaattcatccacccccacggttaccccacatttgcggtccggatatttgcggccccagccaaaatcggacatttgcggcgcgacttttgcggcccgacatttgcgtcccggacatttgcggcccatttattaagggccattttcggacatttgcggcccaattttttgttggattttgcggccc

SEQ ID NO: 8064 - DNA, 1419 bp, Heterodera glycines
aaaaaaaacttcagcaaaaataggaaaaaattttttgaataaactttgatctccaaactgacttcagaaagagcacattggcatcactcagatgcggcaaccaactcagcagatgctcaaaatagtcgccgaatgccatcagccggccttcaaggaacagctcgaaaaagtcgtcgaatttgccgtgagcccattcgtaaattttgaagttgcggttgtggtggaaatagctgacgcagcagtccttcgggttgcgcaccgcgaaaatgtacttgggctgagcagtgccatttgttgttgtcgctgactgttgtaaatgccgttttggcaagttggcccaagaaaagtgcgttttcagcagtcgcgggtacttcaaactgtcgcaaaactcggcgcccaaacgctcgatcatatgcgctacgacattccactagtgcagtttaatgcacgaacgatggcggattaaaaaaataaaataaacacccaaatttttttgccaatgttcaaaataatcgaatgttaaattaaaaagcaattatgaaatctcaataaaacgaatttatgttcagagaggggggaaaaatttgccgccgttcttttgaacatgaatattggaggaaatagttttttaaagaaagacaaagaaatttatccagacaaatttactaccaatttttaaattttttggtaacagtgcacacagcaaagctaattcgcaaatgccttcttcagttgtttaatttgtttaaatggcattgaaagtgttaatcgaactcctcgctgacaaaattttcactaaaaatttttacgcattcccaaaaattcaatcaattaaaaaaaacaataatttaattaaaatagcctggtgtaaacagacatatcactagggagtgtaattatatggatataaaatcgcgaaatatggccataaaatatggaccaaaaatcgcaaaatatggacataaatggcaaaaatcgcgaaatatggacataaatggcaaaaatgtcaaaatatggacataaatttttcaaaattgagtgcaaaatttcttcaaatttattggttgaaattgcatatgagatatatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaattttttcgggtttttgggctcaaaaaggctaatttagct

SEQ ID NO: 8065 - DNA, 6209 bp, Heterodera glycines
  misc_feature (65)..(65): n is a, c, g, or t
  misc_feature (5577)..(5577): n is a, c, g, or t
  misc_feature (5615)..(5616): n is a, c, g, or t
  misc_feature (5639)..(5641): n is a, c, g, or t
  misc_feature (5649)..(5650): n is a, c, g, or t
  misc_feature (5656)..(5656): n is a, c, g, or t
  misc_feature (5658)..(5660): n is a, c, g, or t
  misc_feature (5665)..(5665): n is a, c, g, or t
  misc_feature (5670)..(5670): n is a, c, g, or t
  misc_feature (5673)..(5673): n is a, c, g, or t
  misc_feature (5689)..(5689): n is a, c, g, or t
  misc_feature (5691)..(5691): n is a, c, g, or t
  misc_feature (5697)..(5697): n is a, c, g, or t
  misc_feature (5701)..(5703): n is a, c, g, or t
  misc_feature (5706)..(5707): n is a, c, g, or t
  misc_feature (5709)..(5709): n is a, c, g, or t
  misc_feature (5714)..(5714): n is a, c, g, or t
  misc_feature (5717)..(5718): n is a, c, g, or t
  misc_feature (5721)..(5721): n is a, c, g, or t
  misc_feature (5730)..(5731): n is a, c, g, or t
  misc_feature (5750)..(5751): n is a, c, g, or t
  misc_feature (5758)..(5758): n is a, c, g, or t
  misc_feature (5763)..(5763): n is a, c, g, or t
  misc_feature (5775)..(5775): n is a, c, g, or t
  misc_feature (5789)..(5789): n is a, c, g, or t
  misc_feature (5792)..(5792): n is a, c, g, or t
  misc_feature (5803)..(5803): n is a, c, g, or t
  misc_feature (5808)..(5808): n is a, c, g, or t
  misc_feature (5819)..(5820): n is a, c, g, or t
  misc_feature (5822)..(5822): n is a, c, g, or t
  misc_feature (5831)..(5831): n is a, c, g, or t
  misc_feature (5833)..(5833): n is a, c, g, or t
  misc_feature (5837)..(5837): n is a, c, g, or t
  misc_feature (5840)..(5840): n is a, c, g, or t
  misc_feature (5845)..(5845): n is a, c, g, or t
  misc_feature (5851)..(5851): n is a, c, g, or t
  misc_feature (5853)..(5853): n is a, c, g, or t
  misc_feature (5857)..(5858): n is a, c, g, or t
  misc_feature (5860)..(5860): n is a, c, g, or t
  misc_feature (5868)..(5868): n is a, c, g, or t
  misc_feature (5880)..(5880): n is a, c, g, or t
  misc_feature (5890)..(5890): n is a, c, g, or t
  misc_feature (5895)..(5895): n is a, c, g, or t
  misc_feature (5903)..(5903): n is a, c, g, or t
  misc_feature (5906)..(5906): n is a, c, g, or t
  misc_feature (5913)..(5913): n is a, c, g, or t
  misc_feature (5931)..(5931): n is a, c, g, or t
  misc_feature (5937)..(5938): n is a, c, g, or t
  misc_feature (5940)..(5941): n is a, c, g, or t
  misc_feature (5943)..(5943): n is a, c, g, or t
  misc_feature (5954)..(5954): n is a, c, g, or t
  misc_feature (5966)..(5966): n is a, c, g, or t
  misc_feature (5991)..(5991): n is a, c, g, or t
  misc_feature (6020)..(6020): n is a, c, g, or t
  misc_feature (6027)..(6027): n is a, c, g, or t
  misc_feature (6038)..(6038): n is a, c, g, or t
  misc_feature (6040)..(6040): n is a, c, g, or t
  misc_feature (6047)..(6047): n is a, c, g, or t
  misc_feature (6054)..(6054): n is a, c, g, or t
  misc_feature (6070)..(6070): n is a, c, g, or t
  misc_feature (6078)..(6078): n is a, c, g, or t
  misc_feature (6089)..(6089): n is a, c, g, or t
  misc_feature (6117)..(6117): n is a, c, g, or t
  misc_feature (6146)..(6146): n is a, c, g, or t
aaaaggaattggtgccaaaatatctaaaaagtaaaggatttttattacataaaactaaaattttnttgtttgtttgttttagttatgaagtattctaatgaggaaaaattaagaaagacgaaagaatattttgaaattaaagctaaaaatccaaaaattagcgactcgataattgctacgaacttgggaattggatgggcaactcttaaaaaatggaaaaagaaacttgcctgaattacgaatttgtggtttttttgacgtgctgagccgaacctatatcaatttaataatatttaaattaattattaataacttagcttaaacttagtcaaattaatgaaacatgtggtattgggcgatagctctatgtattctcttgaatcttatgtaattaaaaaatctagcaaaaatttttacaaaaagttataactaaaaatttcaaaatttagattcaataatgtcgttccctaactattaaaaaaattttaaatttaacaaaattttatagaaatctttgagctatctaatcgtattaaggttgtataactaaattgcagtttgaacactatttacatgaattaaacgaccttacatttttgtatgaccttaaaaatatgaccaatttaattccttagtaactttttttaagaaacaaccaattataaaatttgactaagcttaagctatgttatgattaattatttagcaaataaatttaaaatgattattaaatttaaatattattatcattgatactttttaggttcgacctagcaccattttttgagagtgtaatttatagataggatgttccattttaatttggttttgtattttattaagtaacggaaaaaaaattgttttgaaccgaatttatataaaaaagaaatgagacgtatttattttgtgctaatttctttgattttggcacaaaaattatataataaaaacagaaatattgagcccaataattttttatatattaatctgcataagtgcatattgatgtgtatatattagaacttaatgcctaacaaattaactcaaaattccctaattattccagacggcgttttgtcggcagcgcctgactcaaatttattttatcgtaaaaagcaaattcaaattgctcataaatatgcattttattgcgatctctatttttcttattatttctagtgatttacataatatttgtattaaatgaatgggttttaatatcatttccttattatgtctacatatttacataatgtttaacgccatggggattatacattattatggttacatatttaaaaaatattaaacgtcacgggtccgttttgtatattgattgctctagattgatatattcatttccgtattatgcccacatatatacgtaatatttgttgggttttaatattttttccatattatgtctaaatatttacaaaatatttaaatgtttaacgccatagagattattccttattattcaagggattttgtttaatttctctagctcgattatattcacttccttattatgtctacaatgtttacgtatatttatattgaatggatattcctattgcgtcacaaccggaaagaaataatcgttaaattaataaagaaaataattaattaatttccctacatagatatattttcttcaaatacatgcatacgcatataaataatgagttgatgaaaaattttatttattttttatattaatttaatagcatgaaaatatttcattagagagatcagttaattattttaatatattcaaataaaaattttatggctttagacagcggaaaaatatttttttaaatgatgaaagcttttattttaacatttatcaacatctgccttatcgcttcaatgccaagtaatttttgaaaagataaaaaactccttcaaaaacaaccattgtgttttaatttaaattttaaccgattttattttgaattttaaatataatgaaaatttaaacaaaaaaaaaatcgttaattttccctatttgaggcactccgtgtccactttttggcactctgcagcttgagctgaacaatttcttggaatatgccaacgaaccagtcgggtcacttcgtcgtggaaactccgtgaacattcgcggtatgtcctggcaattgagtgccgaactcactgaatcagctgctgaggacggcaccaaatatttgggattgaatttgtattgcaacaataactgcaaaattggtaagtaaattattttaatttttttatggtttatataaaatgagtaatgttaaaaaatgtatgaataaaaattttaaaaattttgccaacccaaaattttacaagaaaaatttaattttggctttatggttataggaaagtaatatgtggttgcttattagtaaaggtataactgtcatcgatctattatgtaaaacaacagttttatttgtagtccataaattttttacctttttaagttcctaatttttaagaattttcttgttttaaaagtctaaaatattttgaattgtcggcctttgaggggaggcgcgatttcgacccaaaaattggcttttagggcgtacccagtcacttgtggccaagacatttgctgtcaagaaatttatggcccgaagattgcggtcttgtctaaggcccgacaattactgtacaaatttaaaaaaaggtttcaatcacccactttgtcaatctttattatttttaaatgattttaaattggatctgtggttcactggacctgtaccaatttttaaatcaggcccttgatggtaatcggctcgatacaccaaaaatttgataggaatacagaatttcggatggcaccggaataaatagttaaatttttttttaaatcaatgttaaatttgaattgaaaattttgcatcaataattcgattaattaagacgctaattggaattgtttctcgatgctggaatttcgtataactgttggacaggttgatgttatgtcaaaaaagcttcccgcaacaaatttcactgctcaaaattcatctctgggaataacgaattttattaaaatccaggtaagtgaaatgaaatgaattaattattatatgataatgtttaatttaaatcaaataaaacattcatttatatatgctaattaataaattttttttttatttgttattcaataaatttcatttgaaaatataataaaagtgttttagaatttggtagatgtatgtcgtcatctaaaagattacactgtccaaattgttgccaatgtaaagccggaccaaccctgtgggactaggtaatcatatttattcaattttaaaaaaaattaaattaattaaaaaattgcctaaaatttccggtgccatggtaatactaattaaaactcatccatatttttaatatcattgcattattttagtctgccaagaacagatgcaattttagtgaaaacaagcaatgatcaaattggcgttgaagtgaacataaacagaaatgttggtattttaaataattattaattttaatccaatttttaaatagtgtcctcgcgctggactggggattttaaaatttcaaaaaatttaaatttaacaaaatgaaatatcttttctacaattttacttttttttcctctttgtcataagttatgagtcataatataatttttgcggcgcattttcaaaatatttataaatatattttgtttaaaaaattaatttaaaaataaataaaaaaagagatgcaaaatgctttttctttgtagcttttggcagcccattctagctcgttcaacgattttttcgccaattttcaaccgccagctgaaagtacgtcctcaacaggtggattgagtatcatgcttgatgccccatcaaccgcggaacattttgaacaactgatggacttgttgcactatggtgattgtgtgctggaaggtaaagttttaagactaaatctataaaatgcaggtctcgaaaatcaaattttataaaatttactcagccttaaaaactcaaaatttccaaaaatactaattaaattcttttcgctatgtctattttgaaccaaaaattttgaatttgtatgaaatttcttagcagattttttaaaaagttaaaatattgattattattttttaatcaactaaattcttttagttttagcccatttttatttgccgtttatatgaaatttattaacagatattttttaatttcaattttgactattattgtcaataaccataaaattctcaaaaatttttgaactgaaaagcaaaaccacgaaccttcaaaaaatttctcctctgaatgtctaataattaataaatgaggaataacctcgtaattcacatatcaatcattcattacgtgtcaattaaactatttttttaaatttaaatattaaatttatgaatttactgaattattgggaccttttcatttatttattaatttcttaagacgaaaatttggaaaatgttttgcgtttggcgcagcaattccatctgcatgatattgtaagcaaatgtgcacgatttcttggcagtacaaattgtaatattcaaacaatgaaaaaatatcaaattgcagacatttatggattagatgcactgaaggtatgggaattttattattttttaaatacacttattatgggttcgatatttaggtttttgcctattttttcctgagctccctatggtctgaacgcaggaaaacattttttgtggttgttaagctatttttcgtgtttcggcctcaaaattcagaaaaatgcacacctaagaaccgtccctaggcttttgaaacctaaagaaatgaaaaattttctcaaaaattcatctccaaatttattaatttattttttgacaacaatttaaatttttaaaattttgtttttgtcttttaagtacaaaaattatctatagtaatttttgaatgttcttattttaaatagaaatgttaaaatatatacaaaaatataaaaatgccattaactgcgcttgagtaataaattaatttttaaaattataataaataatttaggaatttattttgtacaatttgcttcaagaatccgattttgttgcgcaatattttttgcaaaatttggaaattattgagcaattgagcgatggtgccaaaattgcactaaaacaacgcattaaagaactgcttgaagcagctcagtaattactatagtaattagctgaacgatgatagatcgaaacctgagaacattctgatgaaattgttgatgaattaattattttttaaagaaaaataaatttttattttaaagttcaatcaaaaataaaaattttttaagtcttataaatcataactttttggtgagatgattaatcgcttagcttctgcttaatgatagtttctaaacacgtagagctttcgaatgataccaattttgaagaaattaactgacgaacaaaaaagttatggccattcccatttggaattgtacgaaacgccattgtacgaactgctatcgacccaaaattacaaaaaattataaaattcaatacttagttagaatcaataaaacaaaaaaaaactaaanctttttatcaataaatataaaaaaacaataataaatanntaacaaaaaaaacaattttcatnnnttcatttnntaattntnnnaaatncctcnaanaaactccaaaataatntnaaattnattnnnctnnanattanatnnaanataatcatnntcattcaacacattcaacnnaaattanttccnaaccatattcanaattcttctatctnctnccaaatatttncaccnttttttctcanntnacaatccancnatcnaanaattntatttntnatcnncnattttctnttcacttctaanaacatcaatnaaatnccacaacnatnaataacnacaattaaacacaccttncaaacnntnntnctcaacttctncattattcttcntcctcacatctccatccaatatccnttaataaacattccactattccttactanacaactnttacaaccatntnccattanaacaatnacacccaacataattntccaaaancctaaaaaatnattctaaaattcaaaattttattttctnaccaatcaattaagggtcgaaaccccacncaaatttccaaattcgatcctagtaaggtcaaaggattcctgacatcacaaaaggaacgaaag

SEQ ID NO: 8066 - DNA, 4264 bp, Heterodera glycines
  misc_feature (4233)..(4233): n is a, c, g, or t
tttcccatttaatatcttttattcattacctcattgttttttagaaatactatttatagaattttttgatgatcataaaaaaaggtttatggctcggctctatcatcattttggaatttttatgaatttatccaaattttgccaattttatcgttttcccaaaattttgggcattcgtctaaatttttttcctctcccagtgaccagttcaagtgggacgatgcggcttcacgcgtgcggacattggacgaggcgttcaccaagctggtcgacatgaacaatctgatcaagcagcagccgccggtgccatccgtgaagagcaacaacaccaacccgtttgttgtctgatcactcgctcactccgctcgctgatcaacaaccatcgagaccgactgatcagttttgccagtggtcgcgcgcgcgtgtgtgtgaccgatcaattattgattgtttttcttccattttttgtgtccgtgtcttgtgaatgtgtgtgacagacattattacctatatcattattattattattaattattattttaattttgatttttgtggacaataacaataacgacaataagcttgcgtttaatttaatgtatttgtatgtttttcgccacacaatttcttaacacatacacacagcacacgcgcgcatatgcacatataccatacatacatacatatataaaaatatacagtatacatacaccacacgacatacatatttttctcatcattgttttgttttcactgtctgcccttcttcctgttcgtcatcaattaacgcgcatttttcgaccctcccccattgattgattgatttataattattgcttaattgattgtttgatttggtgtgccacgcgcaaatcgtctgtgaaaacccaaaaccatgcaaaacacacgcacccgcccattccccccattttctatcattgacttaacacatttgaattgattgatttattggtaataatattatgatgattatgataaaatattggcaaaggaggagagaaccgagttttacagtatgatttttatctttttactgtacaagctctcggtacactaaattcgaccctttgttcgaatttggatttggtccatttcaaatttgctaatagacctagattttgcgccaaaattatcattttaaatttggcaaaaaaatgaaaattttttgacaaaattaattttcaaattttaattaaaacggcttttcagcttttcatataacaaaatattttttttacaattgtttagcgcatataaatttaaatcagaatgggtcggaattaatgtcatagaattgtggattttttccaaccacgaaacatcggtaatcaaaatttaaaagtgatcaaaaatattacagaaagttatactagtccgatcatcaattttgtgtgtataatgtgtacaaatgatcaatgaatgaagaatgaatggctcttttcataaaggagagaaatgaaaacaaatgcgttgcatcatcaaaataaaaaataatttttcatattttcacattaattagtggggctgctacgatggtctcgcgaacctcagaaatttgttggcactttctgttttggaatcgcacaccaaaaattaaaaaaaatttgttttcgacaaaaggcgcattttatcaacaatggttgccggcatttatgtccctcctaaaataatgccgtgtgctgtgttgtgaattggcacgctttttttttttggtgtgcgaccccaaaataggaaaatgccagaaatttgttggccgaaactgtttttttttgttaattttttcactggaataataattccatcgggaagtcatggcaatgaatgaatggcctcgtgttctcgcgcatcatttgggaatattcccaattctcgagttttggcagcaaataaatttttcagtctcggccaaaacaagaaaaaataaattttttcatttttcaaattattgcactgccataatctcgtggcttttgtcttccgctgctgttccaccctcacaagctgtagcggcacagttggtggttgtgttgctaccatcatgattaccatgatgaagctcgtcctgctccgtctcctcctccttgtcgtcgatgtccggaacggtgggcaacattgactgctgctggtgccgaaagtgcgttcctcgtcgtcgtcgatgctgaccaccaacagtagcagtagttggagcagtgccattgttgacattggcaccatttctacgcatgccaagcgatgccatcagcagccgatggacctgctgatgatgatgatacttccgttttggaggaggaagcacaatgggggcggaggaggacgacgacgatgccgcaagggttgaggaggagaaggatgatgatgtcgggccaacaacaattggtggtgctgcttggtggtggtgaagccgattgtggcgatgatgccgagcaatctgctgctgctgaacagaagcatgtaagcaaaaaaatttcaaaattttgtttgagaatttcgaaattagtaatgtttgagacccagattctctcgagaacgtttcaattggctattttaatcattatttgcctgctgttgaactgatggggacgatgatgatgatgatgatgatgagccattattattattatgtgcaatggtggacaaaagcctgttgggttgaaaatgatgccgaaaattggagagcaactgtcgcccgccgacggcgccacccgccaatggcattttggtggcattgaaatgggtacaattccacattcttcgaaattcaaatatgcttatttctcaaataaatattaaggaaaggcccggcgcggcctctatttaaaaaaattagtttttttttgttgaaaaatccagacccttggattcgggagaaggggctaacactctaccatttttcacgatttttttttaaaatttttcggtttctgaaggcactccccctgaaaatgccattgatcagaaatccaaatgctcaattaaaactgtcgcgtatttgcctaattgaacagacgagaaagattgatcaaaaacaacggcaaccacctgtgctgattactgcttttttcaacagcatggagcatcgacggtttcttcacaaaatgatgcagacaatcactaccatctccggccaaagaaacaccaacattttcggcaaaagtgccatcatcgtcgtgatcatcattattgtcttcatttggcactaccatttttttggtccttttctccgctcgtcctcctccccatcctcctcttccaacaccaatgccatcaaaatcatcattatcctcatcatcatcgatggcatttctcatgccgattaggcgggaagcagcattgttggcaccacgaccaatgccgttgttgcctcctattctgaacagttcctcggtagatgccaattcatcatgttcgtcttgttcggacggcattggcagacaagcgcgggtcgaaaagcgtgccaacgaagaccgcggtggaggaggaggaggtgccgtccgcttcaggtgcttttgctgttcatcatcttcggcatcctcctttttggtgccaccaccatttgccgtttgtggcaattgccgttgttttccccccgcggcgcttttgttgtttgccgccatcattatcagatcaaagattggattttcgcaattttgtgctagcggcggcgattcttcgctggtgcgatgatggaatggcactgattgtcgctccaatttgcttaattaaaaaaatatatttttttttgttgttgaattagcagattagtaattaagaaattacaaaaagaaaaaaagactaggactcgtaatcgatccgaatcaattagcaccgataatttgaatatgagcccaatttcaaaataaatcaaagttcagtcccggacccgagaaacgagaggaggacgagacagtacagtacaatgatctacagtatatcagagcgcatactgtatgtacgcactttgtttgttggcctgacgccgagtacgtcgctggtgactgttgtggttgtatgggtacggtagttgctgctgttgttgccgtctttgtggcggcggtggcgacggcgggcagtaggccaaagcatgggtttgccaacgaaatgtcgagccgtgagaattcggtggacggcgatggcacagtaatgcagctggcgggtggtggtatgggatagtgatggctgctgctgctgctgctgtacggtaccgcaacgtgngaaaagccgttggagggcatgaaaagcgcgc

SEQ ID NO: 8067 - DNA, 1859 bp, Heterodera glycines
ctcggcatcagtgccaacaacgacgctggcccaactatcagcagcgatgggcggcggcttcttttcaacgagaaccaacgacgacgacgattgggtgacggcatttgctggatcaaataagaaaaattttttccaaaatttttaaaaaaatttaaacgaccattttctatgtatgtatgtcagtgtttccaattccaaataccatcattgtttgatggcacaaaaaaaaaaaaaatttaaaatcccaatatgtaaatgctggggctctaaaaaattttcgatactgtctcatttttgaaggaggaaaatttttaaaatcaaatattttttcgaggaaaaaaaaaaattaaatctgagggaacgaataaaaatgttcaatttcttattgcatttttgttgataacaattttccgaaaaatcctaaaataagcaccaaaatcgggagggattctcgaatcgggattccgtccaaatccccgatcccgatcaacccccaatgaatttaaaaaaagctcgggatggatcccggagtcggaaccccccccccccccccccagaattaatccaacaatgattccatctttaatcccgctggattccgaattgaagacgaatgccaaatttgtttgaaaaaatgccacaccattttggtggttgttgttggtcatcaaaatgggagaggacaataatggttggtgttgtttgggtaacacctggcagttaaaaaatgataaattttaatatgcaaaaaaaaaaaaaatttaaatcgcggtgtatctacatattattattgtactaccacaccttttggtcacgcaacagcttctcatactccatcagttggcccaaaaaattgaaattcggcgaaatggtcggccgaagattctgtgtgaaattcaaattaaaaaaaatttagatgaaaagttcgactcggacttggatcctggcagcctggggttttcctgggtccaggtcagaggcaatttttggcaacttagatttttcccttaatttttcctgggcctcaatttcccttgggttttcactgatttttttttgctgggcctggatttccctgggatgttccttggcctggattttttcacttagtttttcctggacctcaatttccattggttttcccggtactttcctaggcctcgtttttcttggaaattttttgtccacagaaattccagacccatgtctcatcagaggtccaggcataaaaaatatgtcagcgaatgtcgtccgtctctcaccttgacaaatttgtacgcctcgtcactgaccacttgctttgcgcgcatcacataagcaatgaccagggtgggcgaacgtgaaatgccggccaaacaatggaccagcactttgtgccccgaggcgcgagcggcctctgagaaattgaaaaattgtgtgtaaaaggtggaaattcacaaaaaatttttttgggggcttgaaattttgtaaattgcagagatagaggtgtcctgggaaattttttttttgtatatttttactatgagaaattaaattgtttctaaaaattttaaaccggtaggaaattttttacaagaaaatttaaattgcatttttttttgtgtacaaattgccatttacccaataaataaaatgaatgctgaagaaaatgttacaaaaaagtacaaaattcgtaagtcagtaagaaacaaaaaaaattttttttaaattccaataccaataggagaatttttttttttaataaaattcccaaaattccaaaaccgatgaattcaaaggcggcatcaaaatggggcaacagtttggcactgtacgagtctttgattggaatgcgcaaaaaatggtgcccatctgccggc

SEQ ID NO: 8068 - DNA, 1567 bp, Heterodera glycines
ttttttttctcccatgttccgatcactcttttctatacctgttcaatcacttttctctccccatgtctgatcattcttttctcttcctgtctgatcacttttctctatctgtctgatcattcttttctctccctgtctgatcacttttctctccctgtctgatcacttttctctatctgtctgatcattcttttctctccctgtctgatcacttttctctatctgtctgatcattcttttctctccctgtctgatcacttttctctatctgtctgatcattcttttctctccctgtctgatcacttttctccgtgtgccctatttcccctatttctttctgcacgtatacttttaatttattgcatttgctgctgctataaattacaaatttagtcattttgtttttggtggtgtttagcagcccaattgcccccccccctcccatttttccctcgggcggcgttttatttgctcttttctcacacaacagcagcagcatgggagtgcccgtaaaattcttttctttctctttctcttcactattccatttctttctttcttcttcttttccttttagtttacttttctttttcccatttcttgctcttttttctctcaaaaatttcctttttgcctctattttctctctctctctctctctctctttctctctgattccctttgttttcttttctcgttcttctttttcctccttcctttctctttaattcgttcactctcttttcctccagatttctatatttttctcttacctattgtattttcctaaattcactctcttctctactttctctctctgtctctctctctctctccctccatctttttctcttttcttctccacatttttccatccttctgtttctattgggagcaaaaacatacacacacaaaacagcaccacacgaacaacacacaaaactctcacatttttttgtcctcccgaaaaacctatcaacagaagagaagccgggggtgggggagaagctcctccgcttgcttgcttcaccatccatcgcctgcgaaagccaactgcgccacccgtcgatgaaagcgagaaaagagaaagcgggagagaatgagggcgcgggggagaagcggggcttaatacactcttattgttggacggggaagtgattgctcataagcaacagaagagttgtgggaagaaaacagcgcttgatcagtgtgctaatggtttgataataattgatcagctgccgctgttgctgctgatcagagtgccggccgaacagttttgtttagttctgatcagcggcttccaatcagttgagattggtgggatgattgcaataatcaatggctgatcagggagggttccgttctgatcagctgctcccggtcagctcggatcaattaatcaaaatcttttactgattgctgctcatgttttcgtttgctcagctggtccattattatcatagctgatcagtttctccccgtacactttctgatcactttgcttaaatgggatgaccaatttttgaaagatataaacacaaattttttttaaattaaattttt

SEQ ID NO: 8069 - DNA, 3197 bp, Heterodera glycines
catcacatcacatcacatcatcatcattagcccataaaatctcatctgtgctcaatgcatgaaattttttatgtttttttgagtgagcgccattttctgctggtgctgttttggcattcgtctgaacagcgagattttgttttctgatcagactttcggacatttttcgatgtttttgataggcaatgttgatcagaagaaaactggtgtattggtctgagcaaaagccaattctttcttaattctttttagatcagagcttttctgccgctgtttggcattcctacgatcagtgagtttttcatgctgatcaaatttttttttgtccatgcgatggtccttctgatcaattttctttggtgatttacaaacacattactgatggattaagcgaaatcctttctggcaattttttttggtctttggaatgcttcacgttctgatcagtgtcttcaagattggattaatctgatcaaaatgtctttcctgatcagcattctgttcttgtgatgtcatttccgatcaaaattgtgccttttccttaatttaatctatttaatcaacttaattacattttcttctgctgcttcagatcaatagtcttgggtaaacaacgataataacagcaaaagcgctggctgtgcgcaaattgtttgttgttgcttagcagctgatcgatcagccagcatcgcgctggccagtgatcagccagcagcagcattctgatcagatcagccattctttcatttccaatcactatctgatcagctcccgtctgtaattccatcgaagccggtcactgatcagccattgttccatcatcgatcaactgatcagcttccttctataaccgtcaaagcccatcactgatcagccaccccactcggcgccctcgtttcgaagccagacattagagcgcgagcagttcagttccaatttcttgttgggcacaaaatcaacggcgggccgacgcagcaccagcgcccagcgaagcagcagtcgatttggacgacgatcgcgtccgcagctccaccgcaaccgggattactgtgcccaggtactgtgggacaccggcggcggaagcagccgcagcctcagcagcgccggcggcggctggcgctgggccggcagcggtcggatggccatttcagcgccgggcgcgccagtgccatcagcagtttcggcactgtcgtcaatgagtcgctcacggctcagcacgtcgttggagcccatcggactggccgggacgaggtgagtcgacgagtgccaaccggggccgggactcaattggcgggcctaaggtcgcgagagtaatcactaattacccacgcattattactggctttgacccattcttgcgtcccgatcagttggaattcgattcgctgggcgcgcccgtcggcgggcgccggctaccgcaccagtcggctggccagtgcatttgagactagcggcgccagtgccggcggcgccacgtccgcctgctcatcatcatcggccgcctccaccgccgcaacggcaccgcgaacgcattcaccgccctttggctatgccaaactgcgctcgtccgaccgcgcggcgtccaccagccgtccactcaatgatggcaccgtgatcagagcgtgggcgcttttcctctcaatccgatcacttttcggcacttttttgcagtaactcgcgctacggcaccacattgttgagcagcagcggctactcgccaatcaatgcgcgtgccgtctcgcagcattctgtcgccggtggtgccggtggcggatcatcgtcgttcaaatcgccacgacaaaaaacggcgacgacgacgacggcaccggcattggtcgcgtaccggccgatcagtggcagtagcagcatcagtcaaccgcgcgctgcactgatcgacatgcggcaaaatttgcggccggtcaacaagcggcattccggtgaatgggggcctgaatttgagtctcgcagtcaaattagggaggtcagcatacaattcccggcaaaatccctcaaaattcgcgtcttaatgccgggaattttctaaaattattttttgaatgtttgcgaaatttcaaaaaaaatttccactaaagaatcatgcttcttgggaaatcccgtaacaaaactgtcttctgctgatggcttaataacaaataattatgccgctttaatcttggcactgactaattagtggccattaattaggccgctttaatcttggcactgactaattagtggccattaattctgccgctttaatctcggcactgactaattagtggccattaattctgccgctttaatctcggcactgactaattagtggccattaattctgccgctttaatctcggcactgactaattagtgtcccattaattattgtcagtaacggaccaccatctacaccattcttcttcaacaatgccgatacgaacgtcgtccgcaagcacactgttgagcaacagtgtccgtgccgcgttcgccgcttcgtcctccgccatggcaccaccgcccgctctgttcaccaatgtgtcgccaacatcctcatcagcaacaaagtgaatacaaatttttaaaattaataaaaacaatttttgcttggccatttcggtgccgctgtttgagttccataggcttttttcggcgcctttgatctgatcagcttttcacatttggcactatttttctgtccttgttgatcagggatactccagacaatttagcggttcattttcggggcaatgatttagaaattctttgaaatttaaggactaacttttgtgccacaatttggcgtttgattttgtaggcctaatgattttcaaaaatttaccgttcgccttaatgaatgttaattaggtaattaattaattaattgtctgttccttttcgtatagtagcaacattcttcttcttccttcatcctccttctcacattcccacacttttctcctcttcccatccatcaatcattctcatccattcatttattattgaccaccgtccgtccgcgtccgtcccattcattcattctttgtttgttttgtttgtttgcttttttgtttttgtgctgtcattagcgggcaggaaaagtagccaaatgctgatcagcagaggagttgctggaaagtgatcagcagccacacatcaatcaatagccgctgcttaatcccggtgtgggatggggcgggagcg

SEQ ID NO: 8070 - DNA, 1122 bp, Heterodera glycines
gggggaaatcccacccatcccgccgctccacgcccattgtttgtatgtgtgtatgttgcatgatgcgaaaaagcggactttcccataatcctttttgcaataggaagctttactaatccccgacccttcggggacaacgacactttcggggatttggtatttcggggattgggggggagggcggggatgcagacagaacaaacactgacatacaaataattcgctatatagttggtgacttttggggtgtgttaaaggaatgctcatgatgtgcccctttttctgtgcaaatgttggacattggcatttttctacccttttgtttggagtgccatgactttggggtgacaaaagagggacaacggcaaagtcatttgtcatggtcctgattagagaacggacaagggtttcgatcagtttttttcgataaaagatccaaaaaatattgaaaaaatgaaaaaaagcgatcaaaaaccgatcgtgccggtctctaatcctgatcactttaccgaaatccctggcaccgaggatcaaatgctgatcaaagttttttttctgactttgattcaatttttaacgttgcctttgttcttttcattgttttgtctgatctcggtccaaatttatttagaggaatcgaattttttgactccatttttggaaattttaaaatttcggaaattttgtcgaatttttactcatttttttaaaatttcatcgaattttgactccatttttttgaatttttgaatttgtctgccgttcagcaaatgcgtcacttcgccaaccatgtcgcgctcctcctcctccgtcacatcaccggtcaccacaatggcgccgaggccaatcccgaagtctgagcgaccgtggcgacaaaagttggctgacgcgcaacgattacggtaaacttttgtttgttgggttacggtgctttctcaaaaaaatgaaaaattaaaaacttggccaaaccccccaattatgttgctcatttttgcgctacgacatttgtggcccaagccaaaattggatttttgcgactaacagaacgccaaattatcagtctttttcaatttaaaaagtagggttgaaaaatttgttgaaaattcaaaaaataattgtaaa

SEQ ID NO: 8071 - DNA, 2685 bp, Heterodera glycines
aaaaaaaaaacaataaaatttgcttatattgaattggacaaaaatttttgaggtttatattttgattggtgtcgaaaaaattgggccgctaatatcttttattgctgattgcagcaaaagtttgaccacaaatttcgaggcagcaattttacaaaaggagtggggccaagtttagcgacgattttttgcttgtacggagaccaaacaaccgttatcgccgacaattctttgccatgtttcgaggccggcactaaacaaaccgaatggaatgcaaagaatggaaacggtcaatcggacggactcatcggcgatgccgcctttgtcaacggccccgatgaagtggcttttgcccctttcggcatacaaattgaagccgaattcctcaatgggaccgaaagcgaagaaatgcgccattcccctaaaaattattgcttcagtagcacccattttgtataatattactattttaattgattttggaggtttggaggttcacacattaatcaaaaatataaaaaccgaacattgccccccccccccccgaaacccaaaactctcgcagacccaaactcgtacttttttgatcagtgcgcacttcgcggcttcgatccagcggcctaattatttctcaattatttattagaccataccctttgatctgtgcgacctctgcagttgtgccggagttggtccttcaattggagtgcggttgtgtcgcggaattgtggccgtactgtaattaccagcaaagggaagcgcgggagtggcgaaggcgaagaaaattcggaggggacggggctaacaaaaaaaaattaattatgctcattaagaaaagggcaatcaaacaaaattgtccaaataagagaaaggcataaaaatgaatgccaattgcggcggtcaaatgctcatctgttggcattcgaaggtgcggttgtgccgtgccggtgaaacaaattccgcgtgccgtcccctgtttactccgtcccaaaaatgagagatgaaaccaataaatagatagtgccgaaaatgaagcaataaatagagagtgcagagaaaaatacacctctcatttcggcgtactatttcaatatctctgttaacagagaaaaacagaatttatttctctccattaacaatttttctgtatgtataatgttcaccaattttatataacaattcagaaaagcacggcatttaaacccagttttgaatcggtttacatatgtaaatagcgaaaaatagagccgaaaatcaaccaaaaaaaaaactttattataattcgaagactcgtgatgaattaagtcgaaaaaccagtggatgaagtcgaagtaaagcaaactcagagtttttctcaagagttaaaaaccgaagaaaattttaattatttatttaaatttaaaaattaaattttttttattgcgcttaaaaccagcgcacattcgactacggcggccaatagttgggctgagactctgggtcccggataaagttctcgcgtgatccgcaggcggttgactgattgattggcgggggcccttcagaccaccgcagtcaaccgcctgtggcgctcgtcagattgggtcgtccgccctccgtctcgttccgtttattgcacctctgtgttcagaggtcattcttcagggtgatcagtgatcaagatttagcaccccctaggaccttaattttctctaacaattttttagcataataaactccaaatcctccactgaaattcatgcacagacattctacaatcatttttgattttgaaaagaagcagacaattcagcaacattcgtagaaaaattagtgccattcaaaatgccaatgtaataaaatttacgcaatttttgcagagctttttcaaatcgaaaatgattgtcgtatgtctgagagtgccgcattatcacacctttttctctcttccctccgtttccctctcctctttcctatttctcgcttcctctctctgatcgcttctctcgatcccttatttccccctccgctcatttttgcagcccggacatttgcggtccggacatttgtggcctgctgataaccgggcatcgattgtcaatttataactttttttgtaaaatatcgaagaaggtaattataataaatgttaagaaatagaggaatacatatgttgttacaatataaaacgtcattgcatatttattagaaaatttattagagataattttaataacaaaaatatcactgtataattgtaattattcaaattgtaattaaatttttgatgtcttgtgaaaagtgaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgctgaagtgaccccgaccctgtgaaaattataagccctacaa

SEQ ID NO: 8072 - DNA, 2288 bp, Heterodera glycines
aaaagagatacccatttttctgagaattaaacatcaatttacgcagctctagcggtaatagaaaaaatttagaagaggctctgcggaatggattagcatcggggttacgagatagaaaattgtcctaaaaagagatagccattcttctgagaattaattcacaatctccgcacactcttgcagtaatggacaaaatcgtgacgagcatctgcggcctggagaagcatgggcattgcgagatagaaaattgtgttaaaaagagataggcaattgtttcagatggtataacaaatattctcgaactattccggtaagcaaaagtcggttccacgaatgtcccattatcagcagaccgcaattgtccggagcgcaaatgacttaacacgcagtgaatatggaagaaaatgtgcaaagaatggaattggcgatggattaatggaaacgatcagctgacaattatgtcaacaatggcaaatggaaataatgaaaagaagaagaccggccgtgaggggatttaaataagtgacattagggggggggggaaggcaggaaagcacgtatttcagttggaagcatccaattgaccaattatcatttcctccgtctttttccctttgatcggtgttctgtacttccttatcactgctcagcacagtgaacgctctgaacatcttcaaattccccaatcagtggaccaacaacaaacatcggccgggagcaggaacgtcaaatcgcggatcgttagcacgtataaggaagctagcgattgacggattgaatcattattgctaattaacggttaattaattggacacggcgaatttattctcctcacaatttcttcggtgaaaatgattgtttaagaaattagccatttccttgtactataatgccatgcctaacgtgatgtccaatgggaatccgattccagtgggctacgccaattttggcatagtcagatggaattatgagatctctgctgaagcaacattttggcaccaaaagagcccccctcctctggctatttgttctcatcctcctcttcatgttccgcctcctcctgcaccgtctcctccgcctcggcgcttcttctcctaccgacagtggattcggctcacccgaagtgaaaatgccaaaatgagcgggtgaactttaaaataaaagagttccaatccctatgagttttgctttgtgattgctttctgctaatagcgaatcgctgattaaaacatttccacttgctgattctcgtttcatgcccccccttctttcattaaattttgcaatttgaaactgatgactaatgcgttgcatgccgactgactgtacgcgttgcgacagagttgagcgcgatgaagtgaccccggcccgggcgacggacaagaaacagtcgattttgacgagaggacgaaaaactgagcgtttggagaatgaataatggggtatttccatcattgtttaggctatcgccaagcacattctcccaccatcattattataattattatttatttttttaacattgcaatattatattgaattatgtccgaaaatggaacaatgcccaagaaacgaaaaaattttcattaataaatcaacatataaattaatgaaatactgccaacattaatttcacaaaattctcaaggtgtgatgaattacaatgatcagagaaagttctttattgaaacaaataacaatacaaaatatgtgaatgaatggtttatcataaattaaataaatccagggctggggtatttaatttcaacaatttttcccattaaaaatttctaaaaattcttaattatttcctccctgcagattgatcaatctatgtatttcggctttaaagctttcgaagtccctttgcctcaagcagcggtaatactcctgtcgccacccctcatcaagcgtgaccggcgcgcatcgcatcccgcggcgcaaaatcaagttcataaacagccgggcggtgcgcccattgccgtcaaaaaatgggtggattcggaccttagaagcaaatactatagagcgtcttaaaaaataaataattaacggtattccgaaattttccgggagtaggactgggaatccagtaaaaatcccgtccatttttgttagtcccagacaggagcgtttaatgaactaattttgaaggggaattattttacgaaagaaaaaatgcatctctcttttctgttgcgttttttagatgcattcccagccatttttgggcaaggtgggggtggttaatgagtatgcgtcgccggagtaaaatagaaaaatgaatg

SEQ ID NO: 8073 - DNA, 1137 bp, Heterodera glycines
attcgggtccggggttcgggattggcaacggattctgaccagcgattccgaaaacccctgggaacatgttttcgtgacttttgaaaacataaaaaaatttcaaaaaaagggtgggggaggggcaaaatttactattaccaaatttttaaccgaacaatcctcaaaatggtcatttttgaggtaatccttcggagttttttaggctaaaaaatacgctgtgaccacaaatccgagctcggattttgcaaaatcattgttgatttttttttttacaaaatttttcctttctaacattttttggcggtaaatttcagggcaattactttgttgatactaaacattttcattgcttttgttatgaatgtcattttttagttttttttataacatacttttttgcgtgaaaaaggaaaaccaaattttagaaaacaaaaattttcaaaagaaaaatgaagtaattgatgaaaattcccagacaaaatcaatgtttttgcaaaatccgagctcgggttcttgattagtgcattttttttaccctagaaaagttatttttaagaaaatttttatatatttttttccgtcgagagaccaattccgaaaaattaccatttttgatatgaaaaccctgttaataaaaggcacaacactaaatggccaaagataagtgcctaatttgggaaaacttacacttaaaaaaaagtaattgccttgccaaaatcgttttttgagcaaattatttttttttaaaaaaaatctgaaatagtagcgcccatgaatcgtaagtaatccaagcaaaaaagtgccagaaaatgattaactaaccgaaaaaaccaaatggcattcaccgcccagagaagagggagacagacgaagcccacatggaaatatcgacggcacagcagcagccgatcggcaccactcaacttttgcagatcagccattaatcaaacaaaaaaaaaatagtgaaattgctgctgaaaaaacaaatggaaaaatttggggtacttgtgcagtttacatcccataaaatttttttttatatatataaattttttaaaaccaatttttatagattttcggggtcgctgatcacgaatctgaactcagggtcgtgttatttcgaatcccgaacccgaa

SEQ ID NO: 8074 - DNA, 2626 bp, Heterodera glycines
  misc_feature (2537)..(2538): n is a, c, g, or t
taatatgtcgcgggcattctgatggagataccataattcatctcatgtcattctattagactcctcagccccccccccttgcctacgcccttggccattatggaatattgaaaggatttgtgaaaaaaaatccaattttccacaaggtatcgcatttctcaattttgttaactttgccaacggtgtcgcattgtacatatgcattgaccaagttagaaaaaaagtaatggcctaagaaacgggggatttgtcttttattggacgcataaaagaatggttagatgctttgttttgtaacacggtaaaccggaaaagaattaaggaaaaaaagagattttagattctgtaacaaatttttgtttataaagccataaaaagatgttccgagagtttttggggtcgctgatcacgaatatgtcattcattttggccaatttcgaacagtagacccgaagttgaagaaaagtagaaaatccaaatttttaaaaattcgtttcgaaatgtacttcatttctaacttcaatcagtgaataaaattgtttgccttcattttaacttaggtatttacttagagaaaacagtaattttaataaatttcaaccctacatttgaaaattttttgcccctattttcgcccctatttcgcgaattttttgcccctatttttaggtccctattttgggctttttcgcccctaaaaatccgcgccctaattataaggttttcgggtcgctgagcacgaatatgacatctatttacccaattccgaacccctaacccgaattcgaacaaaaagtcgaaaacttgtcctttttgtaaagtgttaaaattgtttccaaacatgtacagttgggtcggggtcagtttggcgcggaccgttttggcgccgacaattttgaaatatgataacttttttgtaaactgacgaaatttttgaaattttgcaggctaatagacagggttgccagattaaaatttaaaaaagcctcatttggcaggcaaaaaagcctcattttgggtcaaaaagcaacaaaatgtattctaaacacgtttaaaatgttcaaatgttataccgtatatgctctaattatagcccagtctctattaatcccgtagtctccaattatcccccagtctacgaggtgttttgaaaaataatccctctatcataatcccccagtctctaattatccccccttttctgaggaggttgaaaaataatcccccatgggctataattagagcatatacggtatttttattgtccatgatcaatagggagtccaattatatggaaatccatatttgttcctggactctgggaggcctgaaacgaacgaaaaacatgtttttagctcggtttgaagcttctaggatagctttctatatccatatttttccatatttcgcgatttatgtccatatttccatatttttccatatttcgcgatttatgtccatattttatgtccatatattggcatatttccaaaaaacccctattagaacggcccccatgaggtaaatcggcctttttgactcctaaggaccgaaaaaatttctgaaaaagacattttttagcaaaattttgtcgaaaaaattgataaatttaaattttattaaaaattggttaatttatatcaaaaataagcaaaaaatggaaactttcgattttttggtcgattttctcaagaaattgctttttttcttctaaaacgagtttttataccgtatttagccatttctgaaagtgttactttgtgccaccaaatcttgttccctattataaatttgctccccttacctcggttgatgttgagcgttccttttccatttataagtcaacccttgccgataatcgaatgcgtttttcaccccaaaatttggaaatgtatctcatatgcaatttcaaccaataaatttgaagaaattttacattcaattttgaaaaatttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgacatttttgccattttatgtccatattttgcgatttttagtccatattttgcaattttatatccatatttttggactccctaatgatnncattgagcattttttttttgtagaataagcattttttgggatcctgacatgaaaaacgaagttgattttttgcggcgttttcccaaaa

SEQ ID NO: 8075 - DNA, 3714 bp, Heterodera glycines
aattaatttttttttccaatttaccaaaaatttgcttgggcatagaaaattaaaaaaataattttttttttaaaattgttaaattttctcattttttggataatccgaaaagaggtttttcatttatttttttaaattttgatttttggaaaattaaaatttcaaaaattccttttcgctaattaatctttgtgcttaatttcattttttaatctaattcatcgccaaaaaattaatgcttatatgttcactaaatattaatgaattctaaaaagtttcattatttgctatattatcccttaattaataaattatattgcctaaaatttccataaaaccgaccataattggtcttgtgaacacgtccaccttcgtgccaccattttgttcatctccaataacttggccactttcgttttgctgtgcttgtgcaacgctgcgcacctttcgctgccttttcgacttgcgtcttcgagtggtgtactgctcggtgacggtgtgccgtggcacagttgcggcacactttggcggtgttatgccagcgcagccattgtccaactttaggcacaatgtaatttggcacttaaaaaagtggacaaacgaataaatgaatgctgaattaatatccgaaaaataaaataggcaaaatgttagtaggcgcttcgtgtgggaaccgaaccttactcctccatccattcccaacagggctgcttggcgtaattacggattactggaaattacggcgtttttggaccccccccccgtcattatggattacggaattcggtaattgagaaactaatgccaataattacggattacgggtttccataactggaaatccagtcacgcccagccatgtttctcagtacattcacaattttttatagaattgattttaatttgccaatataattttcttcttgaacatttattaagaatttacctgaaactgtagcacagggcggtctgcatactgtaggaaggggaatcaattactggtaattaattggagattaaaattatgtaaaaaattaccaataaagattgacattaaattgctaaaaagcacttatagatacttaatttagccgtttttaattcatttagcctaattttgtgagttggacgattcagcttcaatttttccaaaaaatgtaaaattaccaacaaaagaatcttgaaagtaagcgaaagttttgaaaaaattacaatatcttgaagcgactttcctttcttattttatgacgtgccaaaatgtgtgccattattttcagccttcaaataattggcaatgatcttggactaccttgaacacatggtattccttggtggccagcctcaatgtgctgtcgtagtcgggagtgcgcaacagtacggcatccaagccacagccacgcgagtcgagaatgtccacccgatcaccgaaaccattatcaaccgaaaacaaaattgacttgcagaattcaataaataaaaaatttatttgctggttgttgttgccaatcaaagttgcagacaatgatcaaattacattataattagtggggtaggtcacggttgtttaaccgaaccaaacctcgaaaaacgggggcccaaacccggcctaaccaaaaactggtgataacggtttttcattttaaaaaaattcattcttaaaggtcgtggttattataaatgtaatcaaaaaacggaatgtttaattaatgttaattgtccaattaatttttaattagaaaaacttacaaaacacgagtggacaagcattccgaattgatcaccgttcagctcctccacacattcccacctatggaacacgctttgacctacaaaaaataattaaactaattagtttatcaatgcatcataatgatagacagttttaatttttatagattgtttcaattacagaaatttccaattactgcccaaataattactgtaaatttatagtgctcgatcgccttgcaaacttactgatacttaaataaaactatttttttctatgaaaaaagaaaaataatgagttaccaaggacggcatactgtactaccgggccatttgcatggtccttgcgcagtgtgtattcacagcgtggcatttggtacacttgttgatagaattgggttgtgatttgactgaaatgcaatttcctttttattaaaaatataaaattaaattaatttataaaatatttcgcaaaaatttatttaaccataattaaattatgaaacttctaaaaaaaattttttgcctgacttccatcggtactttgacttctttctcagcctccatgtaaaagcattgaattttaaccatttggtcaacttttgtcatgaaactacaaaaattgagcaataaattgtgtgaatttttaattaaattaattcgtttaaaaataaattgttttaaataaattagaattttacactggatggaacataaaaacaacctaaaaataataaaataatttattttttttcaataaaacttttaaaagatttaccgccatctctacaaaaattccacggggattaagctgaaaataaagccaaaggaattgaaaattatttataaattaattaaaatatttagtttagaaaataaattcttcattttaccgatcgatatcgacgcacattgcaatttctgaatggcacggtgatgccaatgattctggaaaatgccatttttatgaacaaattaatcaaaaaatggtgccattttacccccatcattcttaaaaagttaaaattaatttttcaattaaatactttgggtcgggaaagtgttcaggtcccgcccggcattcggcacgatcaaaattgtcttgcacaaaaacaatgccatcaaactgttttttggtgcttgcgcgcacaccaattttgtccggttcacaaattatttcaggcgtgccagggtcttggaaaaatatttttaaattaaaaaaaaaattatggcgaggtaattcaaagagaatttttgtaatactgaatactaattaatatatatttaacatttttactaatttttatttgcgtattttgtttttgttttttctctgttcattacgaactgaggaaagaaagtttttttttttataagaaaattctaagaaaaatttttttgatgtattttcagcgattttttggaaaattttttgaaaattctttgtaattccccataaaaatttcgcaaaaaatgttttttcatatttgttagaattttcttataaaaagtctttctaagacttttttttcttgatgccaaatttcataaatttctcagatacaaatatggaaggttttatggaaagcaaaatatacacgcaacaaaaattggcaaaaaaaagagagagaaagggaatggggaaggagtttggtgaaaagaaacaattttttgagtatttgttttccccgtgttttctttatcagaaattttcatggattttcccaaattatccgtgcaaaatgtgctggtgtcaaaaaaaaaatccggttactgaattcagattaaaattctgtttgttcaatcaattttaaaaatttgtcgaaatgtttacggaattcggtgctgcacatgtgccaagtgattgagtcggccaacgatttgtccaactgatcaaacggggggggggtgtgcacgcgaagcgcataaacagaagaagagaaaaagggggcgaatgttgaccaaattggtgacaccaattgcgta

SEQ ID NO: 8076 - DNA, 2512 bp, Heterodera glycines
  misc_feature (24)..(24): n is a, c, g, or t
aaagggcgccaaattaaattgaanaattcgaattgcaaaaaaaacttttatattttgaataacaaaatattttttctttaaagataaaaaataaataaatgtttttaatttaaaataaataaatacttttaattaaaaaaatacttttaattacatttaaaagaagttaaaaatcaaaatatatttaatacatatttattatataattttgaacaattttttaatattttgaattgtattttaaaagaaatattttttatatttaattttaattaacaaaagtaaaattcacaaaaagaattatataattatatttaataatctaaatatattacatattttttatatttaatacaattaaaaataaataaaatttttcaatcataaaataaatttatttgttgatatatttttttcttatcaccttaatgcctcccagatcatccattcccttggatttgttactttcgagcaccgaatatctgtaaaaaatattttttgaaattttttgtaaattttcaacccccccctaaacctacaaataaaattcttgggacggcgtcctcagctgttgtccgttgtcatcctcggttcccattgttgcgttcagcgattcacggcactgttgggtgttccatgtgttgttgcagcgttgccacggcacttcccactaaaatttgtatttttttggcattatatttttcaaaaaaaaaaaaaatttttgtttgaccccaacagagctgatgaagaagtaaacagcgtgtgcaatgactgtgttataaaagcaggagatgaacgtgcagatgaagcaaatcccgtagccaatcccttgaaaaatatgaaattttaataattaaaaagaaatttaattttggaaaaatttcaaaaaaactaaaaattaaatttattagtataatcggaggttagacgtaaatccgaggaaccaaaaaagagagaaaaccgtcaatttaaaaggatcgaagaaaagaaaatatagaaaaaaaaattttgtcacatttatttgtaaatattttaaaatgggagaaaattataaataatcgaaggttaggcgtaatatgtggtattattggcggatggcgtaagtgcaaaagatcagcctgcggtgggattagaacccacgtcccttcctttccgtggaatgctctaaccactgagctacacagggcgcctttgcactcctttcaatcccaactttaggggaaagaaagctctcttcattagtttgagagagtcgcatatcacaaataaatagggaaaaagaaatttcgtcaataccgaaaagttaaaattgctaaaactggaaaaaatttttaaaattcgtaaaataattttttcaattttctaaaattttttgaaaacgaatgtaacaaatatttaattttaggaactttagcaatcaaaattaaacaaatttttcccggacctttgaacattggacaaattttcttccaaatgctcaagcagcccgaccgatggaattggcccaacgccaattccatgtaaaacattggcagcccgccaaccaacagcatcacaaggtacggtatcagaaaggcgcctgtagggaaaaacgatttaataaatcattaattaattatttaatttattaattggacttaatgtaattctggtattttaattacataaatgaaatggaagaatttcaaggctcccttacattggagctgctccaccctttttaattttttccgaaatttttttcaaaaatagtaataactaaattacaaatatttgaatttcggattcgtaaaatatttcttaattgaaaaaattacgggtgaaaaatgtcaaaattcgaaataattattttaaaaaatgatatttttagatcaattttataaattgaaatttgtttttacctccaccatgtttgtagcagaccttaaaataccaagaaaaatttcaaaaaaaaaatcggaatgcaaaatttatcgacaaaccgatggaaaacgccaaatattgccaaggtcgacggcatagcctaagggggcaaaaatttttggaaaacccacatgggaaaatgaaatttttcaccaataacagcaagcagaaattcgagtttgctggcccatttttcacgtacaaaagaggaacgccttcggcgaattagggctgcctttaaaattttggaaattttttgccatttttttccataaatttttcaccgccgcctgcaggctgaaccgacgtgcgtttccgccgtccacagaatcgctgtgcggcacaattagcagagagccgcgcccgttctgttgcagtggaaaatgtaaaaataatttgctgggacattttatcacaaggacaaatgatcaccaaaattgttggacaaatgatacaatttatcattaaaaaatgtttacagtagccaactggcgagtttgtacagtatagcccaatttattccatgtcataatgtcgctttttgtgtgtccaaaatgtcattttttaaaacataaaatggaatttgtgt

SEQ ID NO: 8077 - DNA, 5478 bp, Heterodera glycines
ttttaaaaaattggggtgccaaatcaaaatttggtccctcgattccggaccaatgtgtcaaaaacccgggacagtttgagtcgagatatcgagactctcgagctctattggcccttcaaaaaatgttagtcccctcacattcggtgccgtgcccgacggtgaacccttcgccaccgccgcctccggcaatgccagtgccacttttttcctcctcagtggtggtgttctcgtcgtcatcgatggccaaaaggttgccataaccgcctccagcagaccacgaatttgccattgctgggccagtgccaaaagagacgaaaaattgaaaaaaaaattggattttcgccgaaaaaaattcaaattttttttttttttgcacacactttggcacaacggtgacggtgccgtgatgctgttgtgaaaatttgtgctcggtgtggcattattgttgtcattgtccaacattatgcctggcgtcgaatatttgcgtcgcccgcccttttggggatgtggcgatgggaaatttttttgctcttaaaattaaaaaaaatttttatcggaaaaattttcattagaaaattgtaacaatggaaaagtgtttttatttattataagataaataaacagcaactcaacagatttatggcttcaaaaatttttaaataaaaataatttttccgtttcttttaaattggacattttgtaaaattttattgtgttaaaaatttcgatttccgaattggggtctcgcaattttcgaaattccaatttgcaatattttttttacgccctgaaatgattttctggtaggtttactccccgtccttcggcggggattaaaaagtcggagattggggagaaaattccacgacaaaggttcatgaaatttaaaaatttcggggaaaattacaaatttttttggcatcggaaacacttagaatagattcaagggtgaaaatcaactaaaaatttgctaatttcttcctgaaattaatatgcagaacagctcagaggttgccatgacattacctaactattaaaaattccaaaaatttttttttgagccgtcggaattccgatttccgtttggctaaatttttgagggcatcggcacatatccctggtgcatattcccttgaaaaaaaaatttgaaattcccaaaatcttagcggggcttactcttacatccctgggttttcgcgtcctcccccctttttgtctacactttttgatttgtcccgaattttcggacgagagacaaataaatggttgtggtggtgatatcccatcatccacgataattttttgttggctggcaccggtgattttcatatgtaacagaaaacacatcacccacacggaccggcacagaacaaaatcaattggaaaacggcacggatatcgccccccccatttttggccccggggggggggtaaaaaatgtaatttttttttttttttgcattctctcaagaaatatgaacggtgttttgagaaaaggtggcccgcccgactgacgaggtgagtgaggagtggttgtggtgtgaaggtgggaaaatttttgagaacataacattattttgtggtgcggcgccaaaaatgtgccggtgccaacaacggcacacccacccaaacaaatggatgtggcggggataaattaaaggggacggcaaaatttggcagtatattttaaatatatatatatatatatatatatataaatttgagcattatccaaaattcagggcggctttaatagggggacggggagggaccgaacgataggtctccgatttggttaggggtcaggatttaaaataaaacaaggcttaaaaagcgttaaatgattaatatttatgtgaattttacatttttttttaaatgggtaattttaattttttgattgatttaaaactgatttaaagcatgactaacaataattttaagcttttggataatattagcttttccctcctttattgagggaaaatccttaaaaaaatttagaaaagaagaatttcaagactctctgtactacagaaaaattgaaatttacgcaatttcgaaatccctaaactcggcactgaacgacttgaaaattcccattttatcccttaggggaaaatacaaagccatacaccgaccctggccaacaattagttggtgtcgttgttgttgctgtttttgttgtaactgcagttgtactgctccaacttctcgtggttgctgctgctgctttactgctccaacttgttgcccctcacttccgcatctaccacgggcgtttctgtgccatgaacgcggctgctgctgttgttgttgcggctgtgccgtcgttgtcgccagccaatagctgcgccggcgatggcgcgccgccatgtcaccaaacattggctgcgccgcagccgctgcgcccgcgctgctcccctgtggcactgacgcgaccgtcgatgaaccaccgccgttgtcgccggcgccgccatgcattattgccattgtacgaagatggaagcaggagcggcgctgctgttggtggtgaagttggtgatggtggtctaaatagccatgagggactcaaatttgggggaggtgtcccaattagcaattttttatatgagtgtcgaactttcagttttttaaatttatgccgtatttttttttgtatacaccgtatgcttacttaggtaaaaaaagagaaaatggaagagactgaggcccaaaaaaggagaaatccctcgcttctcgaactcgagtcttggtatctcgaacagcactagtctttcaggcctgaatttttcctagattcagactcaggccattttccaaataccaaaaattcaaaaaaaaaaaaaaagaatttttgaaaattttcggctctggtgggcgccctcatggcctttgtccagcagcgcttacagaaaaaaatgttgtgcaaaagcttggcaaaatgttttttttgtttgtcaaccttggcacattgtcgacacaacgccaaacggtgaaaatggcattggcatttttcttctaacaatgctaatccctgggacccctatcaatttcagttttcatcactcctttagggggcgggggagtaacattttttggccaattagtgattggtgccggacgggttgggtcatcaattatgcactcagaaaggtgcccaattagctttgtccatgtgctcaatgtctgctaatgtttggcccagtgaaaatggatatttttgtggtggaacagttttactgaattaagaaaagcgagctttggaggcggctgtgcaacacgataaacacctttttgtttctgtgctaacttttacttttttgaagaaaaaacgtttaaatttttgagcaaaaatgcaccaaaaattatgtaaacaaagaaatttcgataaaaatttttctttattttccgaacaaaaatctttgtgaaatttttttatgataatttttttttttttgtaaaaataagaactttttgccttcaaattaagaatttgcaaaatttgcgtgctgagtcgtttcgtaaatccgccagggcgtttcgtaaatccgccaacaaaaatataataattcatttaatccaaaaattttcataaaaattatatttttgaatttcatctatagaacatttgtcggatgcataaataacagtctagacgacatatttatgaattcaacaacattttttttaatcttaatattatattgttccttcaaaattgttaataacattagatttgaagaatttatatcaaacgaaaccacgatgtatgttacataaataaatttcaaaaacgacttgactgtgacaaaagattttgcaattgcctttatgaaagcgctgaatgttctttaataaaagtatgtttttccgcattttttaaaaagttatatatgtatttagaatttactttgcatctctgttaaaatattgagtcaacgttttaaagaacagtgcaaagaatttgatttgattttttttcttaaaaaatgttaattttctgcatagaataaaaaataatgtgcatatttttcctattatatttttgttggcggatttacgaaatgccctggcggatttacgaaacgcccatagtggcggatttacgaaacgcccacgttggcggatttaggaaacgcccatagtggcggatttacgaaacgcccatagtggcggatttacgaaacgcccacgttggcggatttacgaaacgcccatagtggcggatttacgaaacgcccacgttggcggatttacgaaacgcccatagtggcggatttacgaaacgcccatagtggcggatttacgaaacgcccatagtggcggaatttacgaaacgcccatagtggcggatttacgaaacgcccatagtggcggaatttacgaaacgcccatagtggcggatttacgaaacgccatagtggcggatttacgaaacgcccacgttggcggatttacgaaacgcccacgttggcggatttacgaaacgcccatagtggcggatttacgaaacgcccatagtggcggatttacgaaacgcccatagtggcggaatttacgaaacgcccatagtggcggatttacgaaacgccatagtggcggatttacgaaacgcccacgttggcggatttacgaaacgcccacgttggcggatttacgaaacgcccatagtggcggatttacgaaacgcccacgttggcggatttacgaaacgcccatagtggcggatttacgaaacgcccatagtggcggatttacgaaacgcccatagtggcggaatttacgaaacgcccatagtggcggatttacgaaacgccatagtggcggatttacgaaacgcccacgttggcggatttacgaaacgacctagcaccaaaatagaggtcgtgaaatttaaaaaccaaacaattgtattcaataataaattaattaatatcaattaaatataattatttaagaaattaaaagataatagaaaaaaatttcgaaaaaaattatctttataatattaattaactgagctaatcaattttttagaatttgaatggattgcagaataagcagaggggcggatctagcaaggtattaattcaattaaaaattattattgataaaaaagagattatcatattaaaaataaaataactgagaacagctgaacattcatttattaattttgaacattgatcaattataaattttcaaatattaaaaaataaaaaacatatgagggctgaagccgaccatatgatgcgtcattagatgagggggacaagagtttaatataaataaaaacagcgaaattcaaaattataaaaaatgatacaatatttaatataatatgtatatattaataacaataaagaaatgaaaaaagataaaatgttattttaaaaatcattcaagatataaaaaaatccaactaaaatacattaatatcatatatttttaatagtattatgatatgtaaaaaaa

SEQ ID NO: 8078 - DNA, 1691 bp, Heterodera glycines
ctcattgtcagcagcagcgggaccgtgtccgtttggtgccgtcctatgaaatgctgcgggtgagcaaacaattaattgtttttcaaaattaaaatccatttctggctttttgtctaattgatttcattattatgtgctaaatgggtttcttttgttgctaaaaaggaggaacttggctctccttccacaagttgcgcctctgaccaattcattttgctcccattttctttggaagtgcgtattgaacagaattcgtcccgtttcccattgcttcgcaccgtcccaagcactccgcgtttcaaagtttcataaaattacaattttcactctaagacgcttattcggtaatattacagttggatgttcgatcacaacgcattgaattggagttgaacaagcaccaaattgcacaaatccaactgttggcttacgattgggcacaatttgagcggtcgcgcccccaccgaaaatggcgtccgcttgtctctgtgcacgaaaggtttaaaaaacatttattttatagtacagtcagccgtttaattaattgtaagtcattaatgaaaaattcaaaaaaaaaatttgtgtcacttttcagtccaaaacagtggtggcgttttgcaattggccgcacgcttgacgaagtgcgtgcgcggtgtcccttctttccgcgtgtgactgtgttgactcgagtgcgcttggtcaacggatatgcgcgagcttatcgccggaggctaaaaatgtggttggagttgcacagcgaaagtgccgacggcacaaagttatttttttaaactgattgtaagatagggaggggtttataatttaaattccgaaatttttattttttttaaatttattctttttaattcaatttccctcccatttagtgaccatttttcatgtccaccgcctccaatttcccacgaagacattgcattaataaaacaaattgagaacggctcggaattcacttacaatgtttggaacacgaaagagaatgtgttcagtttgcttttattttaggttttacatggccttagggaagctgtctttcaacaattgttgctcaaatccaatatcggcaaacacccgtcgtgttcgcttaatgaaagtccttttgagattatcaaatcgggtaattactagtgcaagtgtccaaattaaattaaattgacattagacactcggccgattacggcgcaaatgctggcaaaaggttcagcaccatcaacagggtggtacggatggattacaaattggtttaccgaagaagggaataatgacagcgaggctcaaaacggtgctaaaattatgagattcatttaattagcatcattttgtagaactcaaaaactgtggcaacgatgtgaatgaggcactgtatttgagcatgaagccgcccaaactgaaaaagcacaaattggaccccgaattgaaggcagtggaaagtcgaatggaagccgaaatcctacaggtaaaactggcaaatgattattagaaaatgagtttcaattggttgtttctgcagatgcttaatgagtcgtgggatgagtcgaccattttgcgcagggacaatttattggcagagattgtgctgaacgtggccaaagtgttcttcagacttagcgaagatgaggaagaaaacgaagccaacatggagcaaggaaagatgagagggggggggggggggg

SEQ ID NO: 8079 - DNA, 4838 bp, Heterodera glycines
tatcggcaaacacccgtcgtgatcgcttgatgagagtccttatgagattatcaaatcgggtaattactagtgcaagtgtccaaattaaattaaattgacattagacactcggccgattacggcgcaaatgctggcaaaaggttcagcaccatcaacagggtggtacggatggattacaaattggtttaccgaagaagggaataatgacagcgaggctcaaaacggtgctaaaattatgagattcatttaattagcatcattttgtagaactcaaaaactgtggcaacgatgtgaatgaggcactgtatttgagcatgaagccgcccaaactgaaaaagcacaaattggaccccgaattgaaggcagtggaaagtcgaatggaagccgaaatcctacaggtaaaactggcaaatgattattagaaaataaacaaaattaaatgagtttcaattggttgtttctgcagatgcttaatgagtcgtgggatgagtcgaccattttgcgcagggacaatttattggcagagattgtgctgaacgtagccaaagtgttcttcagacttagcgaagatgaggaagaaaacgaagccaaaatggagcaaggaaaagtatgaaagaggggtgggggggggataaaattctatatgggatttagggatgcgaaaatggaccaaaataaatgtaaaaaattggaaataaataaaaaaaactgcgaaaaaattaataaaacatttagactctatcataatgggaaatatcgcaaatttccacttttactatcaacgaataaaattcaaaaattaaaatgtgttttttctatccgtctttttcccatttagccttcctcctcttcgctggtcagtgaccgcggcggtgccggcgttgagacggcgtcttcgtcttccgctgctgccgatgttcagcagttgctcaccctcgacctcagtcggctgtgcagtcgcattaatctctcgccgaaagagcaccgcacggagctgtcgctgagtgtggccgacctaacggtgcagcgagtaaagcaccaccagcagcaacaccaacggcacaggacgacggaatcgccggcagaaaactgtggcgacggagcagcatcagctgacggcaaaagggcacgcttttggggagtgccattcccttacctccccttgccctattcccatttctaaaccatttttgcatatattcgtccctttttgaattgtacattattttttcagaagactgcggaaaaatcaccacttgataccgatgaattgggcttctttggctctgatgagtttgatgaatcactgttctacgggtttcaacagaaaaatgtacaaagtacgcaccttttgctggccattggacgaacatacggcgaaaattacgcaaaagaggcaaatggaaagcaaaaaaggtcgcaaatttgcagcatttataaggaatgggtcaaatgattcatcgggataaaagacattcattacatatcggacccttttttatttcagaagtaaacggtccaatttgcgtcaaaaaggccaacaaattggtcgtcgttctgctcatagtccatcatcatctaccgctgctgctgctaaaccaactgattatggtcaccaagcggaggacaacaacgcgatattgcgcctgttctacaagcgacttgcccccaaattggaggtgtaccacgagctgaacatctcctgtgctccgctgtcaattctttgcgatgagtgtgcgctgagcggaattttcgagccattcacacaaaaggtaggcaattaacatttgataaaacaaaagcgatcaattaactgcaatcaaaaattaaaatattcggctgataaaaattatgtccgaatggtttttttgattttcctaaaatgtcttttttccgccactttcaccgcaagagaacgatgtgtccctttctcattatgcaactttctcatatgtacacgccattctctgctgcccatttcttcactgtcgttacaatgtttttcgcatttgtgtctctgtccttgcccagcattttcatcgcgtctctcaactctcccgtgtcgcattgtcgcgctgcgaacattttgacaacgccaacacatgcggcctgctttgccacggcatagttttcctcttcgttgccgtcatcgctaccgatggcaccgcgtttgtccaactcgtcgaatgcctttgctgccgttacatagtcttcagctctgtgtaaaaatatattaatttaattgtagtgggaaaagaaaaaattttaaaaatcaatttgttcaacagaaaagcccgtgtaaatatttgaatgattaacagcaaattaggttaattagtgtagttaatagctgtaattaatgtgctctttgtctgaccgataactgtccatggcgaccagtttgagcaattgttgcgaattttgaatgtgtctttccttctggtacaagctccatgccgctttgccctttttgtttgcaatgtaagcacgggcaatgcacagacaatgggtcaggttggagatgatgctgtgccctgtgaccattcgaaacgcttcttccgcctcggcgaagtgttcacacagcaactgattctggccatagttaaaattaaaagtgtcgtcgtttgtgaagaaaggctgtgtagaaaaaaaaaataacattaattagttgagagaataatgatttgaaccttaatggaatccaagtacaccaaaacttcgacatattgttgtcgaagaaaataagccgaagccatgctttggcggccaatgattgtatcgcattcggccggtgattcgcccaccactttgaagcaatgggccgctgttttccgcaattctttctgtgtttaacgctaattgattgttccatctgattaaaagtcggtgtaccgaattttcttcgtttccttttatgcaaagtgtgattgccttcagcaagtactcgtaggtgctctgtggctccagatggttcatcagcacatgggctgagtcggtgtcatttttcttcaaatggtaaatgaccaaattgaggcgtgcctccggcacaacgtcaaccaatgttggcaacaactgaagggccccgtccccatttcggaatacaacctatgtaattaatgcaatttgcgtttgatgttgttgattggtcacaccttattatgaaggattacatcctttgcaaagcgaagttcactgctcgacaaatccttcagcactttgagttcattttctgccgccttcgaattgtaaagtctgtactggttgcaagccttcaaattaacggcatttggactgtccggatatttgtccaaatagctttgcagcatttccaacgacaggtcataataatccaatttgtagtagcaaagtgccaaatagacattcagcgccataaagttcttgttctttgacaaaatcttcttgtaaatgtcaattgcctgttggaaatgcgctctgaggtagtgaatggaagccaggcacagttggtcttcgattgtatctttcagttgagaatgatgggacagcactaaatgttgtaagctcttcattgtcttcagcagtgtgtttttgttttacattttttctcgtcacttaatttgtgtgcaatatgaaataacaaccgattctgtaatggatttttcggtcctgaaattaaaatcagaatttaattcgcgtggaaataattcacctttttcgcccatttttctcgcattttcatgcatggccaaaaagaaataagcacagccgaggtacaagttcacttcagccgggcagttcttgtccccgattaatgcttcgtaggcttcgcaagccttgcgaaaatttgctgcatgaaagtggcaatagccgagccacatggtcaagttgatttgttggtctgcggcagccgattttcgttcgtgctccaagatggagatggcaccggtgtagtcgcgcttgtccaaaaattggtcgaatttttgaaactcattcgaccaagctttgacatcagtcgcattccgtctacggccaggccgaaatcgggacagaagcatttcctccgctaatgtgcgccttttttgttttattgaactttatctgttttagtgaaagtccattgatttggaattaccatggaaacaaacagtccaatgggaatgtaatgcttctgggtatttttatattaacagctgctgggccattaaaaatagaaatgcgctcacaattttttttaatgaatttttacatattttaaggttcaagaacgctttgaccagaaacaacagccttatgtgcaagaacattcggagcttggttcctcgccaactgatgcagtaacgcaccaactttttgcttccgtttccattcccgaggtcgaatttgaaaaaagaattatttttaaatcatttatttgattttcagttgcttgtacagttgggaagccaaaaagcatcgcaaggttatttgatgaatccaaaaattggccacattgaaccgtccacttcttccactcaaagtgaaagcgaccaatcagtcacttcctcatttgtgcggagcagtgtccgctcacttcagatatcatattcgagaatagattcccaacggatcagcaagtgggagttggactttgatgacgttttaatttggcttttggagaaaggcaaccgaataaaaacgacgccattccttcgactaaacattcgtggtaatttggcatcactgattttgacttttttaaatgattgataatgctttctaaatccgtcttcatttcagacttgaacgtaaagagcgcgtcgagccgagttaaagccttcctcaacctgaccatcgactactaccgattgcgcactttgccc

SEQ ID NO: 8080 - DNA, 1870 bp, Heterodera glycines
tttcatggaaagggcactcgattttgtagcgcattcgaattcacttcagcaaattatgtttgcttctgatcaagctgatggattagaccggttgaggtggtgcttttactgttttgaatttattattgactcaatttgcgttttctttcatgtgcctaatgaaaatgaagataatttgctaatttatttatttttacattttaggcatttgtttcaccaacaacgtcaaaatgccccaggcaacattaaggttggtgatgatgccttgattggcagaagggaaaatttgtctaggtatacgatcatcatcatccttatgaaaccgatttggagtcgggtttgacaagtgactttgatgtgcagcttgaacttgccgatgggtttgctatttctttggttggcattgtggacgaggaaggggaaagtaaaggactgaagcaggaggaattgtgctatggccgattgagcggcatcaaattgaatgttggcaagttcaaagcaacatatcgcatcaattgccatatcgactcaattcaggtggtcatattctaattactaattttttaaattattatgtccctaatttaaattattcgcattattattgtcccgtacaattgcagatggacaaccaaatcattggggccgaccgttggcattttttgttctgtgatcccggtgcattgaaggacgaaccgatggtcggactgccagcattggcattcgaaatgagttacactcccagcgagtttttcgatgtttacgaggcatgcccatgtcctacattatttatatgcagtgaattaaagtgtgatactgtactttcagtgttttcggctcaaactgagcaatgcgtgcattctgttggatgagcaactgttgtggcgcctcgtgcacttttggcggtgtgttttgaaacgttggcaagaccaaagcgaccaacagcagcgagagaatgtaacaacaccaacagcagatgaaacgaaatgcggcacggaatcgccttcctttctgcacaacaactgctactttggcactttgcaattggaattcggcaacatttctttgtctggtagtcactttgttttgtttctgtttgtacttttgtccaaaattttctagttttaactgttgacaaaagtgtgctctgtcgttgtcaattcgtcaactgaaagattctttcagcaagcaactcactttgttcagttttgagaatgcccttgtcacattggcaccgttctgttggctccgttacttttgctcattgagccgtttgcttgaaacgcttggaaatttttatcttagtcagtttgctggcattttgtgaataaaacagagaattctattatttcatagacaaattgaagcgacaaaaattgaacatcatttttgcgatggatgcttttggcaatccaatggcacttggcaatgagctgaaggagggtctccaaggactgatctttgagggcgacttggccggctttgcctttggcattggatatggtgctgcgaacagcttgtcaaaggtggatgatttttggcttctacaaatgctcagcagaacaaaattttgtattttaggtcacgtcttcaatggcacaaggtaaaatttttattattaaacaaaaaattatttgagaatttttccctaaggtgtcggttcactaacatttgatgaaaagcatgtagaattacgtcgtcaaatgcggcgcgccaagctcgaacaatccggtccgttgactcatttgtacggcggcatcaaaggattgggcgtcggtgtgttcggcgaattgaccgcaattgtgaagaatacggtcaccgcaacgcagaaaagtgggctcatttccgtaagagacactgtagaaatact

SEQ ID NO: 8081 - DNA, 6161 bp, Heterodera glycines
  misc_feature (6153)..(6154): n is a, c, g, or t
acattaggctaaacggcttgaaaaataaatttccatcattagaaactcgagagaaaaaggcataaaataatcggcatacctaataaactcaagaaaatactgctaaatttgagataaaaatggttattaagagtagtggtgaagagtttcagataaatgtcggaaatttgccatttttaattgcttttccccatgaaaaggggggggggggttccaaaatttcaatcaaattttggccacctcttctgacatttggcaatggtttgggtccgccgggcgccggccctgcgcttcggttgcgacggccaacaattggttaagcattggcacatttgtgccagcggcggacgcggaattttgtgccgtattgttgctgctgttattattgtttgttgaggacattcaaaaagcgaaaaaagaaaaattttacagctaaataatttgagtcaaatgtcttaaatgggaaccatggcaaaatatgcattttttttttgcactttgcctacttttctcggctcttctcgttatatgattttaaaaaaaaattttatgcagcgaaattttgaatttttttaatttgaaaaaattaatttttttgtgtgaccattcaaaatttgttttttttttgtcaaaagcaaaccgcaaaagcgaaactttcttaattctaactgaaaatggttaaacgcctcctctcttttttccacaaaaaataatgattttaaatatcggccgactgttaatttttgccgtttttataaaaccaagacaaataaataaacaagtatctctaaacatttaaagtcagtcaattttgcctcgaaaaaaagtcgaaaattcatttttcataatctaaaagatctaacagcagctgtgaggaaataaaatgcgttaaaaatgcaaatcaacggaagacggccaacggattttgaatgggagagcgaaaacgactagcaaatgtccatttcgtgcattttcatcgattttggggcaataaatgtgatttttggtgaaaaatgaatttttgacatttgtaaaaagtgaaaatgtggggcctaaatttaaatttttaaatacctaaaaataaataatttagcttattgttagtttttaattaaacataatgcctttgactaaacaacacgaaaaagacgaagaggaagcgaattcaccaatgaaaacagcgaagaaacgccaacgaagcgaagcaaaggacgacaacgaaaacaacgacgacggcaccaaatcaattggcacaacatcaacaaggccttcatcaccaccagcagcagatgaagtgcggggacgacggtttagcgaacggttgcaccgcaaaacagtccgaggccaagccgaacaattgcagtattggcagtgccatgttggggaagaagcgggcggcgaaggacaacggcggaatgcaaacgccagcgccaccaccaacacgacggagaggacgacgaggaaaagggtggcggcggcggaatcggcgccgacagcaaaagcagtgccaactccgtcgtccaacatcaacaaaataactccgccgctcgccaccgccgtgccgccgccgtccgaaaagcggttgcgcctgcagacttatcaacagatcgctgacgactttggactgcgtcttacggcactttggtgagcacagagcatgaggggaaatacaaaaaattttgaatcattttaagcgagtttttcaaaatttataatgaattacataaaaaatttttcaatattttctttcatgaaattttcttataaaaaactttttcggggagggtggtggaccagttgctccccaattcttacaaatcaattctcattaacacttcgaaaacctttccctgcggcgcttttcggcaccgcttgaaccccgccgttcacaattttttttttttttgaaatttggcagccttgacatagagaaaaccttgtaatacctatttgtttttttacagtgaacaatactttttctcattgctcaccaatgccagcgtttgcctcgtgctcacaattgaccctcgtcaacagatggccaaaatttcctacgaaagggccttgggatggtgggtgattttttgcaaaaaaaaacaaaaattttaaacgccatccgaacatacgttcttttttgaaactcagaaatttaaaggttttattttgaaattcatataagacacagccgataaatctctataaaacacgtgaatttacacttcaaaatcaaaaaaaaagtgcgtccggccatcgattttttttctttacccccaaaaaaaaatttttttttttgaagattatttgagtttgttaagcgctttccattttaatttcttttttgtttgccaataaaactataagaatgccattttaagtggtgcactgttcagccaaccggtggaactgttctccttcgtgtggccgttgactgattggcaccaatttttgtggggtgtccgtggcattttcctcctcttttttgtcggctgtccccgcattcgcatggagaagcgtttggcaattcaaaatgtcaacagtgagcaaaacatattgtggcattttcatatttaaaatacaattttggcacgcttttttgcataggtgggactcaaatgatggcaaacgaaacatcgtccattccgatcgttgaagaaccgccggaagaagacgaaaatgaccacgaacaacaacaaaataaacacaccgagggagaggaagaaaaagccaacggcactttttcagtcaccgtctctcacccgtaagtttttgggaacaatttttcattcttttttgaatgtctcaaacaatgactccgttggtctcacacacctctcattgttatttttttgttaaagtttgatagctagtcaaaatcaaaaatggtatgccatttttggcattttgcaagttcattgatctttgggtcattcgaaagtgatcccttagttcaccggtttttttaacccaatttcacaatttttattttattttaggatttttaacatctaataggttgcccctttacagggatttgcgattggaaaggattgctggcgatttgctgctgcgtttggccatcgttcccgggtgtgtgatgcttttggcatttgcgtaaaaaaaattcatttattctttaacggcattatttcatttttattttttctgacttatttatttttaccacaattttggcactttcacagaaagcgtattcaactttcaccgcttgagcaacaatacaccaaaaagaatcggacgaagcaaaagggcgacgaatgtttgacttttgaggacttcaatgtggcgaatgacgacaggggatggatccgagtgattgaggggggcggagtcaggaagaatggacaacgcaaggtggaaaacaattattaataattaactaattatataaacacaccaaatttggaacatctaatcccattatattcgggtcattttgagcggaaaaaagcatttgcaggcacgcggactcgaaccggcagcactgggtagtgtggtggtatcgtgctctcggactatgtgggtccccaccggttcgaatccgcgcgcctacaaacaatttttttttgtcaacacaaaaacctaatcatgagtgaaaacgtctcttttactaagaaaaatattttgttaatttttattcatttttttccaaaattttggttgaatatgccaatttcaggcaacccggacagagcattggttgaagatttctcgggaattgttcacatatgccatcattggtgagcaatttgtaaattacctaattaatattaactgataaatgattttttgcaggaaaaagtgcagcagtttttcaagaaatttttccacgtgcaacaaacggcggttgacgacaaaacatcagcagacagatcaaatgaagaagataggaagagaagaatggaattaaagaaataattcatttaattgaccataaattcattctcaaaagcatttttactttatttaaattgttttgttgttataatactttgactttataaaatattataactttgcttttaataaagataaaaataattgaacgataacctcttaaataaataaatgtagtctggaattttggaaaatcagagcgcccgggtttccgtttttttggagtcagcaccgtaaaatatttgaattttatatttaaaaaaattatggcaaaatgttttttaaaaataaaaattaaattgaaaccaaaaattttctgttagtaaaaatcagtttaaaaccacaagctggtacctttgtaaagccgatcccgtttatttcaatgattatttcataaaaagtttcaatttcatggccaacacaaagaaacattccaagaagaaggaagacgatggagaagcggaggaaaagcattgcatctgcgattccaagtacatttatttgcataattttagattgtatttatattaaattgtcccagatttacaatttccacaaattttaaaaaattcggattggatttaaagcccgctttcccgaatttaaatcctgattttgtcggggttccgattccgtttcttttttcaaacaaaactgggatcggtaacccgggaaaattcccgtccacgttctagtgcacgaaaaatacattcgatgcaaaatccattacaattttcaaaaaaaaaaccccgtttttggaaactccttcctgtttatcctgacaatttttatcagcgattcaaatattatgttataaaataaaaatttttatagggattattcaacgttgatgatctgttgcgactactgtcttatttggtaccacgtcgaagggtacgggttgtgttgttttacagtgtcttatttttattgcaataaatcatcatttttgtgtcctttttacagtgtcaaagtgactgaaactcaagcaaaaatcttcaaaaaatttgcgtgccattttttgcaccgccaaaagacccaaagctgtgtaacgctgcacaagaaatgggccaaggggtgttgtgatgagcaaacatcgggggcacaaaaagcggcggaagcgccaaaaacaaaggttttttttgttgttggcattattgcaatttgctggaccaaaaaaatacttttacatctaataccataaattcttgatatcatttgatagccctgaatgttctctattagtctacgaaggttgaaaaaaattcacccaagattcaaaaacatatgacaaaaaagtgtaattttttaatttttggtcataacttttttgaaacataacgaacttctttgaagttttacaggctaatagagagagattaaagctatcgtatgttaccaagaaggtttaatttggatgcttctagaaaaaattatgatactttaaatttgttaaatttctattcgtgtgaactacgacagagccggttttttatcaaattttggtcataattaaacaaaaaacaattcattggggttttaaataataaaatttggctaattaattaaattaattaatccaactcccattttagagcaaaattctggcaaggaaaagaagggcgaaagggagacgaaaagtggtgggacagaaaaacgacgaagggaacgggaacgaagcggcgaatcgtcgtccaaaacagcagcaacaacaacaacaagcggtggtggtggtgccaggaaaagcaacaggaccaagacggacggcgaggaaagcgaagagacgaggaggaggagggcaacgcccgaggcaaatgccgtgccgccggcggtgccgccaccgcagctgccgccgttgacggcacagcagaagcaccagctggaactgcaggaggccaaccagaatttgcggtgcaaaaattgcatcggtaagcggtagggttgggtcaatatgattgcggcaaaagtgagttcccccaaaaagtttccatgcttcttgaaataaatgtcattttttggattttcgtttagattttggagtggaatgggaccaaatttttgtctgatgagtttggtcactagtcctacaaacctcaaccatcgggtgcaccgtgcacccccgtcgtttcccccacaaaatttttttattttccaaaatatcctagataattttttaagaaaattcaagaaataaaaagtggaaaaatttcaaaccattttttttatttttcccaaagnnacctgca

SEQ ID NO: 8082 - DNA, 959 bp, Heterodera glycines
tttgttcagctacgactgcgtttgatccttccgcaacggttcaatgccttttttggccaggcgccgcacacgcagacggagaacaacgcgcacattgagcagattcaggagcaaatggcggacatcaacatcagactggacgagctggaccagtggaagaacaatgtgcaccaattcatggtggtgttgaagagcaacaccttcgacaacggcaccaccatcgccatggacaacgacggcaccatcgctatgggacagcagcaacaacagtcaacgacgacgacaaaacgatcgccaaatggtggtgccgatgccaatggggacgacagggatggcggaaatgattgccatgctgcagaaaatggaagtgaggagaaaaagccaacaatgacgacggcggcagtgaagaatgaggacgagaatatggtaagtttttggagtactgcgcgagattctcggccttttgggtggtcgagaaaagcatccgaatacagacagacgccatcgggaattttttttggacgcttagcttttcaactgattgtgaacagtgttgcattctgttaaatgctaaccgaatttggtttaaattagttctcatttggttcatgtttcagctggtcggatgtccggtgtgccatggcgaattccaaatgcgcgaaatttgcaaacacgtgcacacatgctttgtgcgctcggagcgtcaaacaacgtacggcacggattaccaagtaagtgaggcgcaatcagccatgccattgagttatatttccttggctcattcaaattttgaaaaatgccaatttttatttgaaaaatgcatggtaataaggggtgcacttcaaaatctcgccgccgaaatctcgccgagacaaaatctcgccgccgaaattcaaaaaaaaaaattttcaaacttagaaaatttttcaggaggaaaaaaatttcttgaaaaaattttt

SEQ ID NO: 8083 - DNA, 3493 bp, Heterodera glycines
ctgtattttcttgatgttcttgtccaacacgtggcggagatgttggtactatgacctttttagtgacatttggaggtgactttggtacaatacgtgcactaggaggaaatgtaggctcaactgcacctctttttcttcttattggtgtattatcttttataatagattcgagagactccgcgtgattctttagagttgctgtaataaattctctcaaatgttcaatgattgtgttggaagcttttgggacagccactctaacaactctaagcttttcattttctaggccatcagtaaaatggatgttaatccattgatcatccaaggttccaattgtggagggccaagaatatgcataatttatgctgtgtagtccgcaaacccaagagccattgaaataaattggtttcgggagacggactcgaaatttatttggggcattatcagcatagtctgggctattactgggcaaatggacaaaaaaagtgttagacatttatacaaattaaaatgtgaagccaatgctgatttacaagtatttatacaagttgagtctcatgaatccattctctctcaggtatcctacaaatttcacgagcacttccattgttccgtcgggcattttccgtttccgaaaaacgcgttcaattctgtaagttgtttcagcatctctacgtacgggagccaattcttccggatagaaaaatcctttgaacttctctccttttgcatcgcgtaacttgtattgcattggtttcttgtggcgtttgacttcatcaatttcaagaatttcatcgccatagtttggtatatatcctttctcgaattgtccttttgctatgctcattctcaccgtttgtcctggcaaaaatttggccctttttctgtgctttccaaaaagggccctatgctgatcttctccgaacatcttttcccatatttgttgtgaatttttaaagttcacatcaatcggtcgcatcccatgcactcggctcggtgatttattaatgccatcaacaatttgatcaattacgtccacccaattgagggtttttgtttgggcaaagtagcgatatacacgatttttgatttgtcgtattgcgcgctcggctaatgctgctttcttctcagaatatgtgctctcatatttctcaacttcctcttcatcaaaaagttttttcagctgctgatttctgaattctgtacccttgtcggagaaaattctgtgtggtttcattggcatagttgaaaacactcgtttaaagccttctaccatatcatcggatttcttggtacgaagaggtgttacgaaaatccgtttagaaaggacatcgattaccaccattaaataacgattgccgctgttgtgtcgggaaagtgcttgaaaatcagccaaatcaacctgacagtcggtcataaaaccggctgcagtcgttcgagcgcgcagaaaatttacgcgccttgggcgcatcaaagtgtaggtgcgatgtccctccaagtaatgttttacatcatttttacgaattttatttcctaattcttttttggcttccagccacagtctgtcaacaccggcgaacgcagcaggggattttgggtcattgtagagaccttctaacacattttctattgatttttccatttttgtggcctgagacgttggcttttggttggggtttccgtttctactgttggcaggaccgtcgacttccgcttgactcccctcgttgggaaaggaagcatcaatccttcttgctccctgaatctcgcctgtctcattcctctgagtttttgtgatttttgctttaattctggcgcttggtctgtttgtatcaatttccgtttgggtcctcttggtggtactggtggagccgtccatgttcgcaaaataaggtctcggttgattcgatctcgaatgaattttgttcctggtggctgtctgaattgaggaattcgtccctctctgcgttcgataatatagtctaatgcttgggcgacactgctgtcggttattgggtttcctgcgctgttcaaaatggtgtcaccctgaacaccgtacttggcggggtttctattaaatacgaactgaagccgtcttctcttttgctcattggtaagttgcgaatttggaatgctgaaaagatgttgatcctctgcaaactgacgacgctgctcttcggagagtgcatcgctacccgagttcttttgcctttttggcagatttttggtaacacttggtgaagataatctctttcgagaaccaattctgcttctttttctttcggtatattcttcttcagctttgttggttttccgctttttggttctgctaagcaacgggggtccaggtgggagaggctcgacttgagccgaggtcccgggttgttgtgagagttcaaagtcgtccggcaaaggggcagaggctgcctcttccagtaagtccctctttcgagagtcaattctgcttctttttctttcggtatcttcatcaactttattgcttttccgctttttggctttactaggcaacggaggcccaggtgggagaggctcgacctgagcagcgaccccggggctttgtaagagttcaaaatcatggccatcatcgtccggtaatggggcagaggctgcctcggccagtaagtccctcggaggattacgcagttttgccaaggccaatgaattcgaatgctgtggtagggttactcgggatttgcttgtccttttctgtttgaaacgtagggatgcctcttgttgaagcgaaggaggtcttagctcttccaagccaataagactcttttttgattctcgaacatcattcaaagcatgctgtgccttccgttttctgttaagttgtggatgtataggaatagacggttgtggggctggctgaaatggttcttcctgctgaatgtcagcgggaatttgttcttcttctcttctccatgaaactggaggcagttttcttcttctttgtctattagcaattttagatgaagaaggaaccggtgcatcttcgtggcgcaattgtctctttgcgccctcctcccatgaggaataaaattcatttgctttccgtttttgccccctattttcaacttgaagcggtggagaaggcggcattaatggcatttcctcatcatcattgtaatggcgatggcgtcgaaggcgtctgcgactttgtgaagcggggcgttgggctccatctgaccccaaatcaaaaaattgttcttcttcatcactttgatctcctcttttgatcagtgcttttaacccttttgtaatctcaactttagttggacgattttgctgttcatctcgcaggtggagataacgtgccaattcctggttataatgaacattcttcgccgtcacattttcgcgttttaaaattgttttttaaggtacgttgcacgattttgtttttgccaatgaaccattaaagtgaaaccaattatgaactaatatttccaaatttcacatagacaccatt

SEQ ID NO: 8084 - DNA, 3031 bp, Heterodera glycines
ttttatgaacaatatttccaatttcccaagacaccattttttggaagaaaatgactttttctccatctttttcgtcttccttaaatatcccgcttcgaagcctcagcaaagggtttgaggcagcatgcatatcgatcagaaggtatccatagggtttattggtcgcaatacggtatgccgagagaaaataatccagtttcccgggaaagagttgaactccaatattccgaacagcaagtgctgagttgggggcccgcattagtaccaaatattgagcgttttgtcttgcaactttaatccgtctttcaaacaaattttgtgtgacaaaaacaacggcaaagttctgatggtgcgattttttggtgaataaagcactcagataggcctcatcaatcgatagcaaaaggtcgtcaaggattagaagcagtggtttaggtaagcgtttaattaactcttccggagggactcccgaatacacactaataccacatttttggagggtaggcacaatgctggacatttcaccgaatgcgtaaagaatggaagcgggcttagggccaataagttctgaggactcagcaataaacttgacgagaaggctgctttttccactccccgatggaccagaaataagcataccgaagggcatttttagttttaattctttatctgtgtaaaattggtttccaatcatgatgaatgtttagactaaatcgaacaaacacatgcttttaaatactttattatttacgggtgatcgacgcaattgctgtcatttcctcatcttccatctccttctttactttcttctttggctttcttttctcgggaacatccatgttagtcgttgcagcagacacgctctcgagaaattcatcgagaatttcttggtccgtctgctccttttcctttttggttctagtttgttgttgttcgctactcatccccatcgttgcggcggaaacagcagaaaatagctcggaagcatccgcctggttcggttcttttggctttttaactgtcgcttcagcaaaatcaaaccccttcgtagccgcagaaagagaaactgcgaattctgcggcatcggaatttaattgttctttttggcttggctttggtggtttgtcctgtcctacatccatccccatggttgctgccgagatggaagaaaagaaattggaggcatcaactggctgttgtctcgacttaggcttgggttttagatgttcgggggtcatccccatagttgcggccgaaatgggtgaaaagaaatctgaggcgtctgtcctctgttgttttctcagtttaggcttctcgtttttttgttcaatgtccattcccatggtcgccgctgaaactgcaccaaaaaattctttgccatcgccttgtcgcgtttggtgccgcgcaatgtctaatcccgtcgttgctgccgacacagagtcgaagaattgattggcaacacgttgttccgcgtcttggtgactttcctgctttcttttcgggagctgaggcggtggaggaggtggaggcaaatggtacacgggagtcggggtctgggtgcacgcattggaacggaaaccgtggtcaacgttgaaaacccgtcctttgtttcgaatctgttgagtaaataatttttgatgcaaaaaaaaacacacacacagaaacaaaccttgaaaaatgtgtaaccaggcaaatcgtagatcacatcaaatggcacaaaacgggggctaattttgaagcgtgtgcaccaaatggtaacgccttccttggaaacgcaccattccgtctcacattcggttgccttacattctcgacatttgccaagaatatcgaattgaaccgttcgtggtatcgcaattcgttcactgctaaccgtaatgccgttgttggtttgatttatctcaaccaccggcaaaatgttgtccatgagcgactttttgtcgtggaggttgatactcatattttttttgaaaatctgatcaaaatgaaactaaatttgtttgtccccatttatataccggaccgttcatcctttttttagctttatataatttgcataattttttgagatggcccctttttcttatcagcgtaataaatattgtgagtagatcgagacgcgaacggagaagagcaaacatatgccgtcaacgacgacgagaatgcccttctcattcatttctttttacattttttctgcaaattcttccaatggctcgccaatcgacaattttaccaatctacaaacgacaatcgcgaagacagcagcaacattaccatttcgaaaatgtaaaacaatttttaaaattcaaaaaacagtttatttatttcaggttttggtatttgaaggagcacgccatcgacagttccaacttagctggttctgcatcgcactgatcgtcatactttttgttgcctggttcctttggtaagtgaataatttttaatttacaaaatttctatagttaaattttaagaaagggccgacggagacaatccaaatggtgcatgaaatggatgatgagattgatcaaaaatgatcccaatttggttttttctatttaataatattttaatccatttctctcagggcaaataaagttttttttttatatgatgagttttttaatttatttgctcggaaaatttcaaaatttaaatgtgattttttttcaaaaatcatcctttaatctttttttccttttttttaaattctccattctctcttcattattcctcattctttttcgccgctgctcatttggcctccactccctgcaaaaaagagattacgatggaatgcattttatgcccacaatcctctcgcccccttcccataccacttcggcgctcgcctcttcggtgcgacgctcgggagggtccttcgagacctggacaaaagaaaacaaccccaaaaaaattttcctttccatcctccccccccccctctctacctcctccacaccgacgcgctcaacgcgcagcccgaagcgctgggtcgactctcgcccagtgcgacgcttcaaaaaaa

SEQ ID NO: 8085 - DNA, 1363 bp, Heterodera glycines
aagttgttaattaatattaggatccgaccccttgcaatttgagtaccacgtacaattagaaaaacaaaacaaaccaaggatttacgaggcctcggaaatcggaatcaaaaaatcggttaaattttaattttttcgaaaattttcccttttcctaatttttccccattgtttcgtgaaggcgcatcaaaaaaaaaaaaattttttttttctcaaatcaaacaaaatgacaaatgcttaaaggtcacacctttccatcaacagcgagcaggtacaggaacttgttggtcaacagcaaatagcgcaccatcggatggcccgtggcgtggccaacaaacacttggaacatgcgctgcaccgtctccacgtcgtccacgcacacttgcaggcccagcgcaattttttcatgcccttccagccttaataacgagatcaaaatggtaaaaagaaattgcgggaacacaattcgcagtctcctttttttgaaaatgtgggactaatccctcaaatccggtccgaatccgatcaaccaataacttttgggatttaatcctgcagccgcatccaaaaggattttttttttgaaaaatttctaattgttgagtgcaatttcctttaaaaaatcgttttttcccagcgagttgcccgctccaaataccaaaaatccaaaactcatgttaggcataacaaatagaatttcgcaaaaatttaggaaaaaaacactcacaacacttcgccctcaacgagcgccgtcccggtgtcctccaactcgctgagctcatcgtcctcacgcgttgctgctgaactagtggttgcaccaaacttgaactcggtggacgagctgttcaacgacgaggtggacggcacggcaacaatttgcggctgttggttgccaactcctgctggtactgcttggtgttgttgttgcacattattggcatcgataatgccaacatcatcgccacatgtgccaccacaaatcgtagtggttgcacccgtttccgggtcctccggcacgtaactgcgcaccgactggttctgctccttgtcctgcttggtgttgaggtgttgctggcgtttctgttcctgctcctcctcctcttcgtcggccaacaaagtgtcaaaattggtgtaacttttgcgcttgttgtgcaacatttggtccaaaatgtaactctggaatgggggcaatatttcaatttttttaaagacaaatttttagttttgaaaaaatgtaatagtttttagtttaaaaaacataattttttagagacttggattttcaaacatgtcttattttgaaattgttttaaaataagaataaatacaagtattttcaaaaaaaaaaaatgttttttttattttt

SEQ ID NO: 8086 - DNA, 3429 bp, Heterodera glycines
  misc_feature (13)..(13): n is a, c, g, or t
  misc_feature (15)..(16): n is a, c, g, or t
  misc_feature (33)..(33): n is a, c, g, or t
  misc_feature (35)..(36): n is a, c, g, or t
tgcaggtcaaatncnnccaaacaaatggttttngnntaggtttatggccaaaaaaaacgaaccaaatgactttggtagtgccgcattttgtgccggtgtcatgcgtcgccggatgttcatcggcacatttggcgtttgctgttgtacaactcgaacttgttgcttccgctggtgctgttgttgtccaccagcggtgccattgatcagtgacgagttgcaactgcttgacccaccaattggagacattgtgccgtcaaagaactgtgccgtgctcattagcactgctgttgttgctgtcattgttcttggcaatgcgattggcgtgtcctccggatggaaaacatatgggggctaaaaaacggggttattttccatggtaaaaaaataagaacttattcggtttgctgggacatgctttcagcgtttttcaaaagaaattttcagtgaaaaataagaaaaaaatccaaccaacccatcatcgaaaaaattttgttttttcctagcattggcaaaagctaaaaatttactatgtgcctcaaaaacaccaataaaaatggcccaaaaattcgttttgctcgcctcgatgttgaactggagttcggtgagctggtcaacgcgtacacaaatgcgcttgagcagtgccgtgttgcgcatgcacgcgttgcgctcgtaatgggcccgcttcagcgcgtcagcacaagcgatgaatgacaacagttggaagtgcaaattggccctaaaaagcatgtaatggattataatgttcgatttttcggcaattccatccgattttttcgaaaaaagttttcggtcattcaccaaaaaaaatttttttttttattggaggggtgggggaacgacgtgggagaatgaaatgctcccaatttgaccttctttttacccaaaaatttcaatgaatttatttgcacaagcagataaaagccgggggtcaacctgttcaacgagtctttgagccatgccaatgacagcgcgcggcggtttcggcacacccaacggacgcgcatttcggcacgctccgcgcttgggatgaactcgcgcgcaaaagcccagtagcatttgtctgtcttcagcaatctgcaaaaaatgaaaaattaaaaaatgaatacattttaattttttttcaagttgaaaatccaattttaaaataccgaaacaaataaattttcggtgatttttaggagtgcatagatatatttgcgcctagagcatttgtacatgaccaaaatcgggtgcaaatttattaatttttttttgaacttttaaatggcatgtaatgaaaccataattagaaaaggcatacagtcgagaatttcacagaaagtcagtcacctcccgccgcactcacaatcagtcaattcggatgcaattctcaacttttgatcgactattaccaaaagtcattccggtctccaatattataataatgaaaatgtcaacttttaattaacggaccaataaaataactcaaaattttttcgttttcaaattgtagcgtttatgtcgccaagaaatgcactttaactctgcacacacacacatttttgtgtgccttttttattgtaaattttgagggtgtatgaatgagcacaatcaaaaagtatccaaaatttggtaacactgacgaaatttaaattgtaataaacaaaacaaaaaaaaacccatgggcgaagaacgcgtcaagactcttgagcagaatgacagtgtccggatgtgccaaattgtacgtgatcgacggtttcgtgtgcactctgcgggaaggacagcaattagtggtgcactaattaacccattaattagttaatcgacactttttgtcggccgccgccgtttgtgtgcccaacgttccgccgccgccgccgttggtgttgagaatttcgtccaccgccccgttaatgctccgctcaatttgctcatgttggccctttgtgggtttaaatgcggcagcattttgtggaaggccaatgggagcgaagtgatgaaacattttttttttaaatgcaatgaatgcaaataaaagttgtaattaaaatagagtaaacaatctaaaaatggagaagaaaaattaaagttcgaacagtttggagggcctcaaattgaaaaaagattgaaaaatgcgaattatataaaacggcacaattttggacaatttgaaaaacggcacaatttatttagtcaatttgaaggcgtctgttgtcataattggaaaagtatttgaaaaaacccaaattaaaaagggcacttttgtaaatgggaaccacccaattcttacagttgggaacccccgaaaaaaggaaggacccttttggtttgaaattttttttgtcataataatacataagtcgtgagcttgttcagaggggtttttggtgtcgatgatcagtgatcacgaataagtcataaattatgaccaatttcaaactaatttgaacaaaatgaaattcaaaaaagttgaattttcggctttcggttcgagttagggattggtcaaatcaaaatttatatcagattttcataatcagcaaccccgaaaatcacagcggcaaatttgcaatgccttttttggatgaagcgaaattgtgggaaaatgacgagaatgaatatacaaatgaaacgagatcagcagatgatcatggacaatggagctaccaaatgtataaacaatgatgaatgacacaaacaaattactttaatgatccaattagaaatgcccaaaaatggaatgagcaaaaacggagggggagttcagctaattaaacaaaaaaagtcacgaaggacggaccaacctcctacctattttaagccatataattcatttcatccgatgaattgtatgagaaaatagaaaaagcattagaatggatttttgtcgttaaattttgctgataaaaatgggacaaaaaaaatcaccggcgtttgtccatgtgctgacaaacgaggcgcatgtgaagaagacctgctgctgctgctaatgttggaaatggaggggcaatgaaccaaatgattgggggatggagtgcggagatggcgtgtgataatttgtggaaatagtgactaattgtgtatgatggtaaagaaagaaaagaggaggagagtgggaaagtgggactgatcgatcaaccgaagataaatcataaaataactaaacatgaatctgaatcatattttgtaaccgtgggtccgaatcccggacccgatttcgaacaaaatttcgaaaattcaaaaattttcaaatttccatgttcagtccagtctaaaatggtttacaatcacactcttggtctctggaaatgtacgaaaacaggttgttgatacacaatgaagcgcaggggaacattttttgtgcaaaaatcctacataattggtcgaaacaagcattattagccgaccattgattttaatgatctaaac

SEQ ID NO: 8087 - DNA, 802 bp, Heterodera glycines
cctaaatgtgggcatttgccatttggccgcccttcgcttttctctttgcgttgaccatttttggcgttccggcatttgtcgttttcacctttgcttcagctaaccctttggcactctcgccctcggcatttgcctgctttttctcgccttcgcttcggccgaccccttggacttttcccttcggtcgccatttcaaatcccattttcccctggtcagcttcatctgcctcgggaaacggaaacattttattgcttattggtttttgagtgttctgctgaatttgaggaccccccttctcttgggcgtaccccctcctattcccattcgctgagcacacttcccatccattaatggcatcaaaagtattgaattcaaactgaacaacggatgaatgaacttggtcagaagtaattttttagatgaaaacatgaaaaaaacatggacacagaataatcgtccgttttgaactcccacattacctgtaaaaggaaagccatttaagtgtgagcatgcaaccattccccgatcacccatttatcactcactcactgtccgtcgccgccctgttgcattttggctcctcctgaacagtcgggaaaacaattagaaaccaaaactttttgatcaaaaactaacctccataggccggaacaggcacctggccaccagattgtgtgatgtagtctaaagaaaaaaacaaaaattaaatgcatggaatttgcagaacggcagtgcacttcgtttcaatatacgtcatttcaatatatgtcatttcaatactaaagcaaaaaaatgaggaag

SEQ ID NO: 8088 - DNA, 931 bp, Heterodera glycines
  misc_feature (25)..(25): n is a, c, g, or t
ttttctattaaattttttacataantcctagtctaggctccgtcccgtaaaatttccttaaaaattttaaaattttcaggaaattattgaaaggaattgactcggtgctgcacgctaaggctgatcaacatgtacagaaaaatgaaaaagttttgtcatttgtggagcaggcacggaatgccatgttggacagggccaaactgatgaccaaccaagttggcaagcaggtcaaggacggactgatgctggcatttggccgtgttgtgttcacattcgtctgatgagttgccgccaaattttgatgacgagacagatggccaaggacggcaaaaaaaatttttttaatagaattaaatattttgtaaaataaatttatttaattttttggtaaatatttagcaaaaattgaatttttttgtaaaaatctgtttatgtatagattattaaaattgtcatcattatttttgtttaattcatgtgtaccaaaaatttaaaaaaaattttttgaacagattttaatttatttaaaaaatatttctttgtgttcctatataatttgtaattaatagatttagtttaaaaaacttttaaaagtcatttaaatattattaattaggagcatgcaggcaatatattaaacaaaaacggtttaaataaaaggaaaaaaataagtaggcaacaaaattaaatgccaaatttgtgcgcccagcaacgggcgctaattttttgacttggcgataatccgattagaataaacaaaaaaagtttgttagtggaagattattaactgatttcaagccataagagcaaaatgtgaatagtgtaaattgtattgccttccgagttttggagattttaaacattttcttgcttcaaaatttcagaaaaagtaattttctcaacaaaaaaaaattcgttcagcgatgagtga

SEQ ID NO: 8089 - DNA, 3810 bp, Heterodera glycines
ttttatgcgtcccataatcattttatgcgtcccataatcattttatgcgtcccataatcattttatgcgtcccatgacattttatgcgtcccataatcattttatgcgtcccatgacattttatgcgtcccataatcattttatgcgtcccatgacattttatgcgtcccatgacattttatgcgtcccataatcattttatgcgtcccataatcattttatgcgtcccatgacattttatgcgtcccataatcattttatgcgtcccataatcattttatgcgtcccatgacattttatgcgtcccataatcattttatgcgtcccataatcattttatgcgtcccatgacattttatgcgtcccataatcattttatgcgtcccatgacattttatgcgtcccataatcattttatgcgtcccatgccatattaatgcgtctagtgacattacatgatcaaccaaaatttcttaatataaaaacaagaaagtattacggcgcatttcctccaaaatattttgaaatatttttgttttagaatgataacgacgaaatgcgtactgatacaaatatgttggtaacatttctggcgtagttccatggagatgtttcaggctttgctaagagccctccaggtagcttcaattccctgggtgtgtatttgaaggttggcgggctctacaatttttatcaaataatataatgggacgcataatatttcatgggacgcataaaatgtttatgggacgtataaaatgtcatgggacgcataaaatgtcatgggacgcataaaaccgactagaaccgttttttttcatttttaaattgttaaaaattattccttatattgcacgatttgtttgtccatcattccttgtacttattgttcatgaaattcagacaggcaccagcagctcaccagcaatattatacgtatgcgaaatgtgcaaatggctttgtgacaaaacttaaaatgttacacattgacattttatgcaaaattttatacattgccatattaaaaaagtagtttcatagaataatttagtttaatttcttattaagcctctttttgtgtgtgtttatatcaaagagtccattaaacggaaaattttttggtaaaagcaaggacttaaacacacaaattagcagttaaatttaccagacaaagctcaaggacttaaacacacaaattagcagttaaatttactcaaaagtctaagaaataaatagatatatataagcaaaacgaagaattacggaccggaacccgtcagttgggtgccgtcacgtttgggcgccagcaccttttcagctataactttttttctttgtcaaccaaattcaacattgttgatatcgttcaaaaaccctaagtttcctctattagtatgcaaaaatttgaaaaatttcattcaggctcaaaaaaatatggccagaagaattcaaaaaaccagattttccaacctttttggtcataaatttgttcaaaattgacgaattttttttggattttgcaggttaatagagcatattaagagcttttgaatgataccaaaaatgttggatttggttgacaaagaaaaaagttatagtccaaaaacatgctggcgcccaactgacgtagaccggttacggatatataaacattcttttgcatttgatgccaattccctgcccatttttggctatgcatttggtttaatacccattacaaaaagctaaaatttacaatttccaagcagacaaaactcatcaatcgttgtgttcgctgttgcgacaaacaactttcgagttaaaccaaaaaaaattgcgaaaaaagtcgaccgggttggggagggaggaggtggtggcactggcaccctcatctggcccaattcagtccacaacccgacacggggatggcataaccggatcacaaaatgaaaattgttgaatgaaaagatatcgtgccaaaaaataattttatgacagagggcatactatagcaaagtgaaaatgaaaagtaacaaagaaaaaaatggtgaggggtaaaggtgatgtcaagaaaacatggactttacggtaggatttaggaatctttttgtgattttttctaaatgatgctttgcggctttttgtggtttatttttggggctttttgattttttgggttttaggctttttgggtttttttggctcctcagttatactttttgacgaaaaaatttattttttccgttttgttgctctcagctgaaatgccaatgtgtccatctcatctcattcattttgtgattcttcttcctcctttccattgcgtttgttattcttcgacttcggctgctttttcagttcgctttcctctttgttcaattgtgacttaacgttttcgggtcaatggcaactcgcacaaaatgcaaccaactcgtatttacaaaataaagcctaatcctaggcccaagcactaaggctaggccttggcctagcctaaagcaggcttaagcctaagcctggcccaagcactaaggctaggcctagcgtaaagcttacgcttaagcctaagcataggcctaacctaagcgattgtacgagttgcctttatacaacattgtatgaattgcttttgtgtataacactgtacgttgtacgagttgccatgaaaccaaccttttcaatggcattttccaaatcattcattttgatgtgacgcaattgggcaaccgtctcccactggccaaactcatttctctcactagcatcgtgcaaaacgccaaggttcactgtttgacaaagatccaacaaatcatcaaagcaatagttttcggtcctcgatgctaattgccttaatttaaaataagaattaagggagagaattaataaattatcattgttaattttaaatcagtaattaaggaactaatgattattattattattagtcaaacgtgccgccactcacttgatttcttcgtctcttaactcaaaagcatgttgattttcttccacaattttccgtatcattttctctcgtgtctgttggcttggattttcaacaaaaattcgcttggcgaatcgtctgctcgcctctttgtccagttcctttggctgatctgtggccccaattaccaacacatgatacgccgagtttgatgacagtttgtccatttcaaccaaaaattgtgcctttccgcgttgaaccgtcccgctgcgtaaaaatgcgtcaatttcgtctgaacaaataaatggtaaaatgcttaatccatttgctataataaaccgatgaaaatgatggaaggttgagcatttttggccatttgaaaaagcactttgataaaatcaactgattcttcgtccttttttgagataatcactgaggaaggaatgctgaacaattttgtagaccattcttttgcagcagcttttgcctaacagaaaaatttgtttaaataaaaaaaaaactgaaactccgacagcagaatagaaaagatcgggcttggggttctttaaaatttttgtttttgaaaaattcaaaaataactttttatttaaaaaattggcaaatggtaaaaaataaattttttggctaaaatatgcagtgtataatgataatgtccatatttggggatttctttttggccaaatttcaatataattatttgagaaatttaaaccttttcaattaattcttactctctgtctctaattctttcttttataaatgacttacgagcatctcttttccactgccttgagcaccacccaataaaatggatttttgaggtaacaaaaggccttggaaacggtcgggatactgtaatgggagca

SEQ ID NO: 8090 - DNA, 2385 bp, Heterodera glycines
ggaaatcgaacggcggaaaatttagtttgatttgtttatctcacaatcagcaatcagtgatggaaaaaatcagaaatttatagggaaattcaatcattgacggttgaataagggaaggattttgtatccaaattgctcgcagtattcttctcggtctattggccgctgcttgcgcataagtcaactgaaaggaaattagtcatgattattcatttactaaacgttcaaatttagttaggctgattaaataaagcgaattaatgtcaaacagactcacccaccggtttaacgggcggcgatgagcagtggtcgtcgttgtcaatgtgttcgctggtgcccggccgttgctccgtcgttgttgagcattccatcacggagttggaaggcggcgagcaggagccgaagttggcggaggaaagtttcccttcctcctccgtcgtgtgcgaagcgccttgacatcagtgctttgacatcctaaaccaaaatgtaaaaccattttcctttcctagtgtttttgtttctttgaaataaagttgcaaatatatttaatgtgcggaaattctttgctttgacgccccccccccccccccgaaatccaaaaaagtaaattcagcaaattttaacttcttaacaaatcgcattaaaattctgaaaaaatttaacgggggcgcctatcggcaccgccgcacccccactttaccagatttttgaaaaacgaagactaaaatggcaaaaaaaaaaggtttttttttggcgaaaaacggctaagtaaaaaacaccccgtaatacgggatttcaaaaaatgaaaaatatactcctaaaaatcgactgaaaaaagaaaaatgcaccttaatttttaaaaaatgaataattatttttctttagtgaaaataagcaaaactcagttattgttaagttttcgctttacataacacaaaagcgttcaatgcaaaatcgaaaaataaataatgaataattttttaacttgccatagactgaatgtgcgtagccttggtctcgtcataaacacgtccattagattctttaaattcaatatttttataaaaaaaaattttaaatttgcttttatctattattaaattcataataggaagtagaattatatggaaatccatattttttcctggattatgggaggcctgaaacgtacgaaaaacatgtttttagcttgactagaagcttcttgggtggatttctatatccatattttccatatttattgttattccacatatttttgctatttcatgtccatatttcgcgatttgttgtccatattttatggccaaatttcgccattttatatccatatatttctattccctcattacgactgtaccgaataaaacgaatcaaattgtgagggcgggaggagggagggaatatgaaattttctatttaataaaaatatttcaattcacttaactgatcaagtggtaagcggcacacaaggcctcttcaaaaatttccttatttctcgaattgaataaggttgaaaattttctatagtccatttcccgaacaatatccttcgctatgataggcttcagaatggatattgcatttttcagcagttcttcgtccgtcgaactctttatccaattctccaaataaatcaagaccttactatgttttgtatcgtaaatgtccgttgctttttgtggcgcaatgtttgcgagtgccgccgtggcattggccacgagttggggatgtgacgcattgtcctcggacaaacaatcaacgagaaaaccaaaaacgttccttggaatggatttgttgatcagctgttcgtcaacgttgcattttagaatgaggtcgaacatttcacgaattttagtcgttgcttcaagtttctcaacttgtcgcctgtcttccgccattaggacaagctaaaaattttgaattattctttgattaaaaaaagcatttactgaattagagcagtcattaggaattaataacccccccccccgccctgaaataaattcccaccttttgacggggttaaaaataaagccgcacccccataaaattttttttaatcattttctttaattttattatttttattagtagcccggcgggagcgggagtcatgtgggagttttactggagtcccgctccagcttccggataatttttgattaaaaaattgttaaatttctagccaaaattaaaaaaaaaatttcccagtgatgcatattggcaccgccggaccaagaaaatccttaattttattaaaatactggcttaatttcgcaaaaatggttttttttctttaataaaagtattgcccttcaaatttgtgcataaaaaaagtatcccataaaaatttacccaccttctagggatttttttcgtttt

SEQ ID NO: 8091 - DNA, 1687 bp, Heterodera glycines
  misc_feature (6)..(6): n is a, c, g, or t
agagtntcatagcatataatttacaaattcaaatgaaaggaaatagattgtacaaagaattagagaccggacgggatcgggatcctgcgggatttttccaggatcccgcggggattaaattcgggatcccgaccctcaggaaccgtcctgagtgatttttaattcatcgggattgatcgggatcgggatttcatcgggatcccgaatcgggatccgaaaaaattttcacgggttctccgaaaatacggtgaaattttcgaaaatttgacgcgaaaagttaggtcatcgggattgatcgggatcgggattttcgatcgggattctctcccgactattttacctatcccgcgggattgaatgtcacgaataacttttcgaaaaattctccgatttttaattgaagattctttaatttaaattaaaaaatattgtcgattttctaattttttcttgaaaaatctcgtaaaaatcccgaaaaaattttcacgggtctccgaaagatacacgaaaaattttcgaaaatttgacttaaaaagttgaggtcgatacactaaaattttcgaaaatttgacgaaaaagccgatttgaacgaaaacctgagcacgaaaacttttttaaaaattgggtttgagcgaagatcccgataatcccgcgggatcccgaaaaaaatcttcgggattcgtcggggatgagggaattcggtcgggatcccgactcgggatccgtccgacgccagttgtccgcttaaagaacaaagaattgtcaaaaagttgttgctgcctcatctgctttttgcactctatgtacaagaatacttattaccttaaattaccttaataaaagaaattcatttattaatatttattcatttttaataataatgaaaaatagaacaattatttgattttgttctaatagcagaaaataatatatatgaatatataaaaattagaggaaatataaagcaaaagatatttattttaaagtcatgttgcttatactcatgcataaaatataaaagatgaatttgttcagttatgacggaaacaaaatgaatataaaataataaaatcaattacgatttattatataaattaaattatcttttctattgacgatccaataaaaatacttgaaataaatttattccttataaaaataacatttacaagctaatcaaggaaacaacttggaataaaaacaatatatggttttacaacttaaaaaatatatctaaatcttttttttgcggaaaacaacaattttaatacaaattatcaacaaaaaaaaaattctaaaagaatttaaagtctcagtcgttacaattttacattataaaaaacaaatcatcaatgaaagtttaaattaaatttctcaaatgatttatcctaaataaacttttttattaaaataattttatgtgattcttaacataatctcagaattaagttaatgtgaaaatatttataaaatattcaaatgtgtaataatttataccaaataaaatataatttatagtaaataaaataataagacataattgatacatagaattcgaagcattttaatttaaaaaacaataaatttataaacattgatataatagaaccaaatttatttaatgataataaaccgtaaatttgcaagctgatcattaattaaaaaatatcgaaataaaaatttatat

SEQ ID NO: 8092 - DNA, 3768 bp, Heterodera glycines
  misc_feature (3753)..(3753): n is a, c, g, or t
agatatgaagaaaagacaaatatttatttggagcacaaatataataaataaatggtcaagcggagggaagtacaatgggaggaataaatgacagaatgaacgagggagggagggaaggcagcgcttatatgtgagggggaatgtgcctaagggaaaggagtgaacaaagttcactccacttattgattggtctctcaacttctgaccacttcaggccatttgcttttggcatccatgatgatcagccacattgatccccaaaatggtccgcagaaatcgatgtgtattcgttgccacggtctttccggtgattcccacggatgcaatggcactttccgctcatccggcgcctcttcttggcaaattttgcatctttttcggattatttcgatttctttgtcgattcctggccaccacatcttctgacgtgccagggccttcattcggaccatccccgggtgggtcgcgtgcaaaatttccaacatttttgtgcgaaattttgacggaataattgtccgatttccaaacatgatgcacccttccattaaggcgagctcatttcggatgacatgaaaactttttagtccttcgactttttgtggccatcctttttcgatgaattctttcacttttcgaagaatttcatcctttttgacttcttttgcgatggcactgactgtgaccggcaggcatgaaatattttcggcctgaacttgctgaacttccagtccaacacagtcgatggttgtctcttccggacacggcaatcgcgacagaccgtctgcattgccaaattcttttgtcgaacagtacaccacttcaaaatcgaagttcatcaatgtcagtgaccatcgatgaagtcgttttgccgccacaatcgggagctctccttttggcccaaaaatcttttttagtggctcgtggtcggtttgaagtacgaactttcgaccgtacaagtactgcttgaatttgtcgacaccgaaaatgatcgccctcgcttctttttcaatctgcgagtaattgcgctccgatgaatttagcgttcgggaggcatacgcaatcacaccaactcttcctttttcatctttatgaaaaatgaccgccccaactccatagtcggatgcgtccgcggccagaaaaagtggtttttgcgggtcataatggaccaaaacttcggttgatgtcaaaacctttttgatcacatcgaatgccttttgttggctctttgtccatgtccatttggcatcatttcgcctcaattcattgagcggttctgaaagcgttgccagggatggcacaaattttccatagtagttcaccattcccagaaatgactgcaattctttcagatttttcggctccggcattttcaaaattgcctcaattttgccaggtgacgcatgtaaaccttttttgtccacaatgtgtcccaaatattcgatttccggtttgaggaactcacatttttcacgctttactcgaaggccattctcagacaaccgtttaagaagctgatcgattcttttgatgtgatgctgatcagtggctgttgtgatcagaatatcatccagataaaccgccacgccatcaatgccctgcagaacttcttccattacttgctgaaaaattgcgggtgccgaagcaactccgaatggcaatcgagcgaagtggaaaagtcctttgtgcgtgcaaattgtgagacaacttttggccttttcgtcaagcaaaagttgtaaatatgcgtccttcaaatcgattttcgtgaatttttcgcctccattcaagatgctgaacagctcctcggggcgtggaagagggtattgatgtacatccaaccaaggatttaccgtgactttgtagtcaaagcacagccgcagcttgccatttgtctttggcacaatgactagcggagtggcccattcactggttgccactggctcgatgattttctccgcctgccattggtccaaaactttttcaacttcattgcgaagtgaaaatggcaccggtctcggcttgcatcgcttcggttggcatccctctttaaacttcagtgacgccatctttttgcatcgtccgacaccgtcctggaacacttccggatattgacccaaacatgcgtccaattcctgtttgatctccacggcacgaattgtcgaaattccgaaggctcggttcaaatcaattttcagtcccatgatcaaatcgcggccgcacaaatttttgtgcttaccacttatgacatgaatattggactcaattgttctgccttcgtgcgtcactttcacctttgcctttcccaaaatgccaccgatggattttccgccataggctaccaatccttgagatggttccaattttggcctgccgatgcgtttccaatcaatctcgtcaatcactgtgacgtccgcaccgctgtccagctcaaactccaaccttccattatgaatgttgagttgaatgaaaccaggatcggcagaaattcccttaatttcatgaatgacgctgacacttgaacattcaatgttcttgatttgtcgtccgttggtctttggcttttgaccaaattgttgaccaaagttggcattaccgtctctgtttttgcttttgcaaccaacggcccaatgcccaatttctccgcattttctgcatgtcgaattctgattcgggcacacatttgcaaaatgtcccggttttccacaccgaaagcaacttctagtgcttttcgtcggcgttcttggtcctctttgctgattgccaactttcgcgacctccggcattgcatttgagccaattgcttgggcatccaaattggactgctccaacaaaacggctgattcgactgcgtccttgaattttaggtccttgtcgccctttttgatcaattcaacccggattgcatcattagagatgccattgataaacaatgcgcaaagacacatgtcaatgctgtcgcggctccattctgcctttgctatcaaacttcgcaatcgcaccgaatagtcccttatcgattgccctgtctgctgcttggctgaaaacaattcatgcctgcacgcggcaatcgattttgcttcgccaaatcgttccaccatcagttgttcaatttcggcaaggtccatggttcggacatcctcaggctgtgccattcgccgaagctcttcgtacacctgacccatttctgtgaacaggagcagacgctttgttgcgacatcggtcacgcctttaagctggatgaaaaattcgaaacgttcccaccatgtcgcccagcacatctctggcaaaaacggtccggggccttttccagcctttattaccgctgccatagttggacttttcttaatttgtcccactcggatcaaattcaagatgatgctgatcaactgtaatccgacttggatttacagtgatgtcaattgttatccgtcccggactaacaatcaaaatcgataacggccaatgttatccaactcggattaacaatgccacacagctttcagccttgcttttcaaccaattttccacttgctctgttcggcctcgatcagtgatttcaaatgttatccttcccggattaacaattcaattcctccaaattcggcgattcgtcgctggctgttatccgtcccggattaacaccagtaattgagagtgccaccacctgggtgaacagctattccaactcggaattagcttactctccttcgacgatttttggaaaattgctattccgtcccggaattagcaatccanaatttggtgcttttt

SEQ ID NO: 8093 - DNA, 3329 bp, Heterodera glycines
aagtatttaaatgttcgactgcgcgggaatccgatgggacccgtcccacacaaaaaaatttgagtttcctttcacgcatgaaattcgcaaaacgaacttcaacaactcgcataggtaaggaaggtatgcaccaatttatgcactgccaaattaacacgaaaattccctatttaactcggcaaattgtacacttcgcctcattccttcgatcattcattcctttcgtttttctcttttcccttcaattcttaaatcgccttcctttgccatgcttttccaatttcattactgggtgaaaaaggttaaatagcttcttttttcacaaaaatgtaaaaaattccaaaattttcgaactttataagaatttctcaaaaatctggaaattaggctcgaactttcgctcccagtttgcgccagaaagcggctttttcattccaaaaaaagatgcatcggcgctgggacggctacataaacccggcgccaagaaactgctttttctttttttgttaggtcggcttaaattgtaaaaaaaccagcttttacatacatatttgcatattccaaatgttcttttttttccttcttattttagagccatgaaaatgctcatcagaggcggacttttcttcattatggtgcgcgtttcaactattttctcgcattaatttcaaacgaattagtgcacaaatgtttttttggtccatggctttccgaataccaattctattctttttttgaggcccaaactcgcgcaaataagagtcgatgatttttaaaattcaggcccaaaacggaaaagtaccaatattttctgttttgttatttcaaaaacaaaaaaatatccttttttgttttgtttacccttcccccccccccccccccacagattgctttcaccgtcgcttcgttgcttgtcattggctttttgttttccctgtggttgggcggcttcgccattcgtgtggttgccgttgtgatcgaagattctgaggaaggataccacggtgggtggactcaatgttttgcaattgtttaataatgttaaatgaaattggaccattcgtactgcggctatttgtacttgtccaggactaagtttatccacccgatgcttttgtgtattttaaatcaccccgaaaaaccaaagggaggaggacccttttgttttaaaaaaaccccaaaatatgtgctaaaaaccaaaaaaaaggcctaaatatgtgttaaaaattgaaaaaaccaagtgtatttacgcaaaaaaaatcatatttaatatcagcctttatcaattttcgcccgaccgccagtcaaaatgttggcgatatcaatcaatttgtaaagtcccggattaatttttccatcagttgaataagttccttccgggaactttgaaatccagtgacgatttaacacagcgtttgatttgcctgctttaggcatttaaatatataaagaaattttctaaatgcttaagaaacgtaaagtagtcaatttttagggtgcattttcagattttcttgtatttttcttacgatttttttcaaaaatgccaaaatatgtgctaaaaaatccaaaatagcccaaatatgtgctatatgtttttatgtgccaaaacgccaaaatatgtgttttttggctcaacactgttgttcttgcgctgatcattttctttgccattctttttgtcgttcaggtgccgtgcctttccttgcctaatcttcaaaatgccattctccccactttttaatttaatttccactttaattcttgctcattttcagttgtgtttgttcgcctgtttggccctttctcagccctcaaaatacacagattactgatgataaacatgattcaatctcttccccccgttgttcaacaccaaaaatttcggttgtttgttttagctagggttcgccccgctctgaactttttttccatggatgcgttttgtctagggtaaaagagcttctaaactggttttagcgtgtattttggaaaaaatttcaacttttcattcgaatccggggttcggaaatgggcaaacccgagttcagattcgtaatcagcaccctcgaaaacccgcgtgaactgtttttttgctcaacataaaaaaagttaaattagagagatcccccattctttaggattgcgcaagcgatcattttttggctgaatttaagcgttttgggaaaaaattgcatgttttaaacaacagtttttagcacatttgcttagagttaaggcccgaccctgagctccccatttcccgacctgaatttaaaaaatttgagctttttccaagaaactgcagtccggcgtgcgcccagcccaaaatttaggaccgggggtcccggaaaacgggctttttgtcctgttaagcccgttccggtccattttccaagtcactgcactgttcattttgaaaattccggctttaatttccgttttattaatattatgactattttccgcttcatgaggttaaaataattatgtatattctgaaaaaatgtattttatgaaataaaaaaaagttatatttaatttttattaaaggaatttaattagcattttttgtgcacgttgatatacaataatttgatggaaaagctttactaaagtacaacagagggattgaaatttaaaaaaagagattaaaaatgaacggaaaggattgaacattaatcccaacggcaacaacaaaaaagagttagaccaaaaaaatttggtgccgttgggtttaattaacattaattttattaataagagccaaattccattaaaatgggcagcggttttttttggaggtggtgcacaacaaaaataagatgcttttgtgttaagtgaagcatttgttgggttggagagcggtggtgcttttcgagactctcgagattttccgccgacatttcgagactggaaagttttcagtctcgaaaagcacgcggtaggtaaagccgggataaaaacagtcacaaaaatattcggcaaatgaatgaataaacgatgaatacatttgaacagtactttggctggctgtgaatttggagaaaatggaattttgcgcataaaattaaaatgaaaaaagggaaggagaggcggcgagggagtgaaataatgcaacgaattctttgaaagacgcaaaattgagggggagagtaggcttatcaattccaagaaagtatgggttccctgatatataatttcaagggccgactcagtccacaagtacagaaaaaagacatagggatttttggaaatattttcaaattctcacggacaaacccgtactggaatattccaaggaagtattgcagtccctgatatataat

SEQ ID NO: 8094 - DNA, 1080 bp, Heterodera glycines
cagtccacaaggatagaaaaagaaatagggattttggaaatatttttcaaattttcacggacaaaccgtactggaaattccaagaaagtatgggtttcctaatatatatttcaagggacgactcagtccacaaggatagaaaaaagaaatagggatttttggaaatattttcaaatttttcacggacaaacccgttatggaaaattccaaggaagtattgggttcactgctatataatttcaagggccgactcagtccacaaggatagaaaaaagaaatagggatttttggaaatatttttcaaattttcacggacaaacccgtactggaaaattccaaggaagtatttggttccctgatatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaagaaagtgttgggttccctgatatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaagaaagtgttgggttcccttatatataatttcaagggccgactcagtccacaaggatagaaaaaagaaatagggatttttggaaatatttttcaaattttcacggacaaaccgtactggaaaattccaagaaagtattgggttccctactatataatttcaagggccgactcagtccacaaggatagaaaaaagaaaaagggatttttggaaatatttttcaaatt

SEQ ID NO: 8095 - DNA, 2084 bp, Heterodera glycines
aaaaaccgcggtgggggtgggggcatctaagtgcactccacagctcaattcgcagtcaaaatcttcatctaaaaaacatcatcttctctcacgtaacactctccgaaggtatcttcgaaaaaaattattcgaaatatagctcgtttaactcgaatttacctccggttccgtgcgttgctttgttgctagcttcggccatcctcgtcgcgaccaattgacggatgattactcatttttttgaagaaaatgaaagcgtaaaataaaatggaatttcaattacgctgaaaattttggattttaagtagatttatttcatgaaaagaaaaaaaatcacgaacgaacaactcacatacaataggaaaattttgaataccttatttattgaattagaaccaccccctaaaataaagcaccttttcgaatgggtacataattttttgtcggttgcctttggcccaaatttttgtgtccaaggggcttttgccggccgaaaaaattttgaaaaaacaccaggcccttgctgcccggttaaattcgcgccaacgttttcgtacaggcgacaactcgtacaaattgaaatgtacacagacaaatcctacaaaaggtggaatattttagatggtaccccccccccctccccttttttttattggcagaaatttttttgttaaaaatgcagtgaaaacatgttgctaagggtttttggggtcgctgaacagagactaaccctaagctaaacctagactcaagcaagtctaagtttaggcctagcctaagctatgtacgagttctgtgtacgagatgcctttgtaagataacgacacaatcaatgtcacggtgattctgtgtgtgtttttgggagtcctgaaggaaaatcccaaacggtcaatgtgttataaaatccgagctcagcttcgtgatctgcttcttaatttttttttcataaaccacaaaaccgtaccattgccaccaaatatgttaatatgttcgtgcaaaatacctactcatgttttatgcccaagtcaaatttcattggcctataattgcatggcgaacaactgctagggcgtgccaccccacccttccttatttcctggacccaatagcctcaattttagggctgtctttctctctcaaaaattccatatggggtagacacttaacagaatatgcctaggtcgagtagccagtgggggagtgcctgccacaaagaatggcagacttctaccaaagggccaaaggggtatccgaagactcacacgtaaggttgtattgagattagggtaacacgggcccgggtatttgggcaaaaaccgggcccgggtattaccgggcattgaaaagccgggtaccgggtcgaataccagtttttaaaccgggcccgggtcgggtacccggtaaaaccgggtattaaaaaattttcaatttttattttttttcaaaataataaacaaaagaaaaatttccaaagtcaggggcggttcatgttttcttggagggggtaccaccgcccggtagactttttttgtttttcacatcacttttttcggcacgcttttccaaaaaacttggaaaagaagggggtccggcggtgctgatggcgccgccgggaaaaatattgtagtttttaatgcgatttattaacagatttgtctgctcttatacagtttgtccccataaaattttttttaatttctaagtaaaaaaaattttatggggacaaactgtataagagcagacaaatctgttaataaatcgcattaaaaactacaatatttttcccggcggcgccatcagcaccgccggacccccttcttttccaagttttttggaaaagcgtgccgaaaaaagtgatgtgaaaaacaaaaaaagtctaccgggcggtggtaccccctccaagaaaacatgaaccgcccctgactttggaaatttttcttttgtttattattttgaaaaaaaataaaaattgaaaattttttaatacccggttttaccgggtacccgacccgggcccgtgtaacccaagtttttactattgtggacatttcgtggagtggactggatgttttgtgggtcagcgaatt

SEQ ID NO: 8096 - DNA, 1715 bp, Heterodera glycines
  misc_feature (32)..(32): n is a, c, g, or t
  misc_feature (69)..(69): n is a, c, g, or t
gtcgaaaaagtgaaattaatggatccgggccncggggttgaaatgggtgtcagaaatcacttgctccgnactgaaaaccccgtagaataattataattgaaaaaattttgaaaaaaaaatttttccgaaaaatcttggagtacccagtgaatttcttaataatattagatccatttagttcaaaaattgattacatattgtttgaaataattgaagaaaatttgatttgaaaattttcattaatttaattttgctttaacttttggatttcataaaataaaaagcaaaataaaaatttaattttgtattattttaaatattttttgaattttttaaatttcccggttggtcccggtccccgatcccggacaaaaaccgatgttccggtcccggttttgtcaatttcccggtcccgtacaaccctatttaaaattccttcgcattttctcttttttatgtctcttcaatcgtttcatttttattttgaaaatgaatttttggcaagtggaaaatgaataataatgatgatggcatgacgcgttgcattggcggcataccgcaaatttttggtattttccgttccgctctgacgcgttaggtctacttaattattgataactataataataacatcgaaaaaattccctggggagacaaacggtgggaggggagacaacggcactaaccatcaaagttttacatgacatattgaaattgaaatgccgtttctcaattttgtgcaaaacaaatggcgaaattggcgcaatataaacacaatttaaattatttccatttaagttttattaattatattgcatttttaaatgattgtttaggcgcagttaataaatttaaagttgtactgtaattagattaattaattatttaattgctttgtgttgtccgttccttcgatttcctcccctccttcaaaatgttttgccgttatcctttcgctgtgcttttgcttttcggctttggcattgtttgtgccaatgttcggtccgatttatctgaggaagacgaactgatgcttttggtccctttcaatgcgcggccgttggccaaacgttttattatcggtgaaattttatattttttgctttttttcattaaatttgcgccaagtttttcacagattttgaggtcgaaagtcgccctcagcagcagtttaacggacggactttgacgaagcgcggaatgccgcttctgttcccgattccattgcagcaaaagcagcaccattccatcgacacaaggcgtgcccccaggcgcaattggctgcattttggcagaaaataatttgtttttaattcgatcaatttaaatttacaattttggctttttttgctgtgccgtccgtcggtgataaattttgacagattttgactgattattaatttgaataaatatatttttttgttctaagagtgtaaatttattacacttgagcatattgtcttttattgcttttggcagcaaattcccaccgtttttttattattcaaaatgccattccgtcgctcattttacggcacaattttcatttttcgaatgttattgtcttggcaataacaattacaaacaaacacggacaaataattctactgttgtccatttcccattttatttattgggaaaagaaaaaaaaggttgaaaggttcggaatgtttttgactctttttcttatggctgttttgacgacactttcgtca

SEQ ID NO: 8097 - DNA, 1590 bp, Heterodera glycines
  misc_feature (166)..(166): n is a, c, g, or t
  misc_feature (1479)..(1479): n is a, c, g, or t
tgtacagtccaaatctctgatgctacaataagcccacagacggagaaagaattgtgaatgggacaatattagaaaataaaaataaaaatttgtgatttaaatttattttagcattgtgttaagaattttatttatttatttttatttataatgcaagaaaaaaccnccatttggcaaattgactttagcaaattgtctcggcaatttccaactgcgttttatggggtgcatttgttatttatggaaaaggcattcatgaaaaatgtttcttttctcatcagtgcgattgcctttttaaaaataattattttttaatatttattattttattttttgaattattactcttactgtatgtaataccgtatcaaccgaccgaccgttcgacatggccaccctttcctcgtccaccgtaatgctcctctttttgctgctgtttgtcttggccctcatttacgtggcgtttttcttcacccggtggcaacttcgatgccaacatcatccttctgaatgaaattggaaaaatgagaataagtgggcaaaacttaaaaccaaaatttagtaaaaagtgcgatttattttactgctttactttaaaaatctgattttatttccatttttttttgcaattttgttaatttatccgctcgcttttccttttttcggcatttttgtcctcttttacattttctctgattgcatttcacattttgagatggcattgccatttgaccaccattcaaatccaattgtgccaaaaaaacccctagggacacacagcgctaaaaggggcgaaaatgtcaatgatttgccttttaaggaggcgagggcgggcaaatggccatggaacaaaaggaaaatgccgaaaatttaagggggagaaaagttccgttttttgttccatttgtcaatcaaaacatttttgggaagtaaaaaatttaacaaaatattacataaatcattgaaaattaattcaaatttaattaaagggtatccttttattattaatgatttttggcttaattttgtcgcattttttcgtccttttcaccgtaaaaatccttttaattagcaatgaacatcatttggcttgtgtaaacgggctcaacgagtttaatattggcatgttttttgtgttttattaattggataataaataaataaaataattttcataattattttgcttaggcattttgcacttgcgaggaacgcatcaatggcaaaatatgaggtgcagtaaaagccgaatgctaatacattcttgctgcattcaatcttaaaattaaactcccaaggcatgccattgaccaatggaatgggcggcactcgcccgtttttggcttttaccttagcctcattagcccaaccgatgcgtcggccaggtttttggttttaattttcgtattttataaccaataaaatatcaaaagtttaatattattgcttcttttatccaattagtgtcgacattcgctnttgcgacatcgcccaacgccatttggtcgccatttttttgtcttcggactccgtcgtcggcgccgaattgtccgactttcgtattgccttgagcatgtaccatttctatca

SEQ ID NO: 8098 - DNA, 1383 bp, Heterodera glycines
  misc_feature (42)..(42): n is a, c, g, or t
ccggcacccgcgtctcttccgtgcccattcaaatgccttcgnccgtcgaacgctacggaccttttctgaagcacattcgagaacgccttagacacacaaatattgtgaaataataagccaaaataaattcaaaaattagcacaaattgtttagcttctgtacaccgatgaccttggcattgtccattctctgcttgtccacgcctccaaaatgaacatgtcgcaaacgcgatactcatatttggtgtccaatatggtgaattaataatcaaataaaatttctaattttgcaatttaaggatttgcatttgttggaggattttctcggccccgaattccattgcaatatcaccgggtttcagttggtccgtcaacagccgcaaataaaagtgaaaagtggactcatttaaaatgaatgtcatttctcccccgttaatttccctttagcgactaattcaattaaagtcactatttgaaaataatttattagaatttcctactttttcggagtgccattaatatttgttcaaatgtgaagtgacttggccggtcacggaatttctgttgcaattgcaaatttataaacaattccatttgtgttcatattttgattcttctaatttatccgaaatctttcgccctttggtcaatcggagacagaaaaaaaaagaattttagggagtttatctttcttaatcactcttttgttcagactgatttggccctggcaatggatgccacggcattggtcggtgccgctgtccacgcgttacgccagcgcaatttggagcccaaaccgcaccaattgttgtgcgatgcgggcgaccaatggacagacggaatgttaatgcaggagcaaattcggagagtaagccatggcatttattttgaattttaattaataaattgtttattatttatttcatgtaaaattccattttcatgtttaatttttcaggtcgatttgactgatgcggccaccggcggacattcggcgacgtcggcaattcgtttcaacgaaaccaccggcgaacgaatggacacttcccttttggcaatcacgcgaatgcccaacggcaccttcacagacgttagcttctgttgctaattaagtaattaggtacaacgtttaacagctcgggaaatgggaagaagtgacccgtcgatggacatttgacggaagacacgacgaacggaacaagtggcggttccgagttggacagaacggagcaccggaccttcggggggagagactgaaagtggtggtgtacctggtggggcttaatgcgtaatgcaattaagccaaaaaataaatatgatgtaaaataaaatttttgccattgttttaaggaagagccttttgtgatgcgcaaattggtccatc

SEQ ID NO: 8099 - DNA, 1449 bp, Heterodera glycines
aaatagggggacttaaaatttgccttttttatatttaccatatttcctataatatagctccccccctaaaataaagcccaccttttaggtggttgaaaagtaacctcccgtgactctattacaagaaataggtaaatttgctttaagcaacaacaatttgcttcctcttcctcaggagccgttgtccttttccgtttgggtcgctttggccgttgcttatgcgagtgtggccggcacaatgtggcttttggctaaatgttcgccctatgaatggtcaaccaattccacaaattaatcactttaattaattgttcgcaggtatgaggacgtgacgcgacgcgacacaattcgctgccgtcgcgacagaagtcgcggggacacacagccgcagaaggattggcggtgcacaatggccgaaaaggggcgggcaaaggcacgcgccgggccaatactccacaaaaaccaattcagcattgtaacgacaattaattgtgatgaaaattggcatttaaacaattaattaagttgaacagtctatggttcgccgttggctcacttatgcaacaaggaagtgacgtaataccaaggtgaaaaggcgaattagcaaagaaaaaggcatttatgactttttagagcggctgctacacgtaccgtagccgtcatatggtaacataccgtaaaaaacattaaaataaatcttcgtttttcaggtggttattcacgttaattctgatcagttcgtacaccgctcaattggccgcatttctcacagtcgaacggatgagcacagcggtggaaagcagcgccgatttggccgcgcaacaacgcataaaattcggtgatttccgttttcattaaaattttaaagcatattaaaaaggtgaagataaaagttggtggactaaataattgctaagaagtatcctcaaaaattctgtaattactttttttaatttttctctccacaggaactttgtccaatggcagcacaatggaatttttccgtgagtcgcgcattcccatttatgaaagaatgtggtcaattatgcagtccaccacgcccaccggtggttttttattttgaatttatttttattattttttaattttaattttcgtttactttttccattttcagtgtttgttaattcaagcagagaaggcattgcgcgagtgaaaggcggcaattatgcttatatgatggagagcacaatgttggaatattggtgagaaaaagggaaaaaacgaattgaaacaaaaattaattaattagttattcaccagtttaaaatcctattttttaaatttaggattggcgaagactgtcagctccaaaccattggcggactgctcgattcgaaggtgactacttactgtcttccacttacttactgtattcagttggactgtacattttcccaggttacggtatcgcattgcctaaggggt

SEQ ID NO: 8100 - DNA, 6817 bp, Heterodera glycines
  misc_feature (7)..(8): n is a, c, g, or t
cctgcannggtctatttgaacacaaaaataaattttttatcatttttgaccccccctttgatttgtttactttatattaatcaaaatttttactttttgtcagttttttaaaaaatgtttttgaaaacttccctatttccccgttcctcgatggttttgtgcctccccggctgattttaatccatattgaattgattaaaaatatatttaaaaaatattatcattttgagggcgaacaatgccaaaatcaaacgatttatggagaaaaacaatttgcacaacataacggaattggaaaattattacatccaacggttgcaagtgattgtcaaggaactttttgaagaacgacaggaaatggcggaaggacagaaaaaagcgaaacaaaagaaaatgattttttggcaggaagtgttcgacaataacaaaccggtaaatgccgaagatcgacgggcggtccgtccatctgatgggaatgccccgcggagtttccgtccgtttcgtaaatttcgctatttaagcgccttttcgagaaatagtttttctcgaattttgctatataagtcaatggctcgatgttctatatattattcagaattaaaaaagagagaaatgaattttttgctttttttgttacagctttttgaaacctatcgaaattttttgaattttttgtttcgaccagcggcatttttataaagagaaaatgttaaatcttgagttaacagtggatttaaaaaagcagtgtcaaagaaaaataatctaattaaatatgattatcagttagccataatccctcttaaattaattatatatattattttattgaatttatatttttgttggcattcttaggacccttcaaacacagttgtgcacaattggtattcaagaacaacgcaggagagatttttggacacaaaacgtgcggttgagaagggtttccaagtgttggtctcctcgtgctggtcagtttttatttttccggagaaatgaattgtatatttgttatttaaataatttttatagtaaaataaataaatttaattggtaaaaaattatgctcctaaattaggtaccttaattacatcaattatggccccgattggcgtgatggcactggcacaacccgacaaatttactattgcgaccctcgcggtttcgagggcacttatgagcagaagcaattagtgattggcggcattgcaacgatgtggggcgaataccttgacgggaccaatttggagccaaatttatggtagataaatatttgtaatacttattttgaatgtccatactcatattgtaaattattttgattttttgattgtttttttgcctttcttttgtccgtgtgtccgttgtttttgttggctctttgtccgtgggccctttgtccgtgtgggtcctttgtcattgtacgcttattttgccgatggattggccggggctgattcggccaacccttccttggtcacaattaaattgtttaaatttaccaggccaagggcttctgcggtcgctgaacgcctttggagtccgcccgagttgacccgtttggccgacgcggcttggccacgtctgcaggaacaccggtgccgaatggtggccaggggctaccgcgcggagccggtcaatgggccggacttttgccagacggaattggacgagcaaatgcttaaataagcgaagaaaacggatgtaggaaggagaaggacgagtgcttatgtttgcaaataaaattgatcattttatttaatgcaaaagcttgtttaaattcattttattcggaaagatttcaaaaacgaatgaatatgaattgtggaagaaaccctgacataattgaaataaaacggaataaagcactacaattacagatgactaaaatctgaaaatttgtgggcatcctttgttcaaatttggaatacatcgcctaaaaaaggtaaggggaatcgcccacggcggtgccaacactgatgccgccttcgttgacctgcaaagaaaaacgcgaaaaccataaaaaatatttaaaattattttatatttttaaaaaagtggatttgtttacgcatttgtcgtttgcttacccctgccgactttgtacgcagcacatgcccacgctgcacattggacgacacgttacgggtgagcatgtctcccattagggtaccgtacacgcccaattcactgacaacgaggccaaactttggcgcatagaatggacgaagaaaatagttctaaattttaacaaaaaatatttaaaaaaataaccaatgtatctcaatgttgcgataccgtattacttttctaatgattcattctcttacagtatgcctccgtttggagtctcacctttgttgtcattgggtgtaacttttgcattaaaatgtgagcagaacgttcttctcgggtcatggtgagtagtttttcacgcaatttgttgtcgtaataattatttccgccacattcgccgtttggcttcagcacataatttgacggatgttcgatggcattctaaccaaataattcatcaattaatgttaattgccgttcatccctaccgcaatgagctgttcggtttgcttgtcatccttttcgaggccccataagccggtaaaagtttcacggattgccttcactttgtccgcttctgcggggtcagggaaaaatctctccaaaatgccaggcgaggcgagaagctgaacagttaataataattatgcaattaacaaagaatttcaattttattgctgccacctgttggattttcttcgagctgctaattccaattgccaatgatggcgccttctgcaaattaaacaatttttgtgttttaaaagaaaacgaatagccatggaagagatttgattatgtgctaaaaataggaaacgaaaaaggtcaaaaagaatattcaagccatttttgaaaagtgtttaaacataaagcttcaaaattattctgcttataaatccacaaagtaatgttttttaatatttattaaaaaaatttatgatatttttccgacaaaagaacaattttcgttaaaaattttgaatttttgtcaaaaaattatttaaattattattattttcatgctaattgcatttttatttaaatcatattacaaaaatctcattaatctctctcttgccgctttttaaataatttttttttttgactattttttgattgattaattttatatttttttattttacaattgctgtcgacagttccactattttccgcgtgtgcatttccttttcatttgcttgatagccaagtgcggaaagccctgaatacacaacgccaacgattttgccatttagcaaaagcgaattatcatcggccaatgaaaagctaaaaaaattattgttaaacaaaaaatttgtttataaaaaatcaatagcgctagaatttgtttttctctaatttagcatttaaattgaataaatatatttaattaatgttgatttttatattttttgcagattttaaaacctcaaaaatattcgtttattttttaaaatttattttacttctcatatccttccaacagcggaacatattcaacgcgcaatttcccaccagacaatcgctccaattcatcctcaatgttgcgcaattcgtatttgtatttgttccattttgccgacaaaattacgaacaaagcgtcggaattgccaaaggattcccttaaattctcaaaatgaaactgcgaaatttggaaatcacttaaaatattcaaagagcaataataatttttttagaaaaatgaaaataaactatcatttggctttggtttttcccaattattcaattaaaaaacccaaaaatgtgccctcaaaaatgatttttaaatcgtttttatccatcctttcttcatttttaccatgccatgaacagtgagttgatcagattcgtatcgccctcattttgtggtgcgtttgtcgggtccctgccaatgcgttttaaaagtcgctgatgcaattcggtggtccgtcgatcaattcgcaacccggtgatggcgccggtgttcgcttcgatctaaaaaatcatttgaaattttacttattcattattattttttacctgtttgatctcgtatcgatccattccatcctctttgctgctcttcaccgtgttcagcatataatcctaaaaacacacacataaatacaatgatcattaattcactaattagctaattcattaattagtttatttgcttgccgatctcattatcatcagtgtctttggctgttttatgccttgttttttcacttcccgcagaatgtccaccagctgtcttatgtgtttgtctgttttctctacgtctttgtaagcgtctaacaaaaagtctaaatcgcaagcgacacggaagtaaagcaattgcatggcctgccaaaataaatagcaaataataattaagaccttaattaattaaatggttttattataaaacgaatgttttgtctgtttatttttaacctcctgaacagcgatggctttctcaaatgcttctctcggaaatggggacggaagaagcgaaacgggtgagaattgggctatgaaattgctaaataaggcaaaaataaccatttaatttttataattatttatttattttactgtctgatgtcataacgaagaatcattccgttgttaaaagcccaatcaattgcataattggccaacttttgaacttcgtatctgctactaaatgcttcttccacataatttagtaccgcgttgcctaaatattattattttaatatttacaaattaaaatatgaaaaataaaataatttaataaaaataattgtgatcaataattatttatttaatttaaatgcatatttaatggattttacccactttttgcgaatgtaaaaataatagtaatgaatagaaaaaaattcattttttcaaacactaaaaattaaaaaaatatataaatcaaaatatttaatgaatttatttgagaaaatttgtcaaatttatatgcaaaattcatacagaaatttgtttaaattacatcagactaattcaacttccgttctttattataatatgaaaaacataaaaacaaaataaattcacgtgaatttttttatcaatttcatttcatttccgtaaggaaatgaatagaaaattgagtaagtttaaattcatgttggcatttttcagtcatattttgccattttctgtttttgccggaattaaccaaagtgttgtcctctgtgagctgagattatggttggaaaatgctggcagaaattgccagcgttgaattgccgggtcagttttttggtaccaaaatccgaatttcaggtgccaaaaatgccaaactcggttctggcttcaagaatttggccaaaactttttattttatggaatccataatttttgtgacttgtagaaaacaagtcttttatgtcaacggattaccccagacagttgttggatcagaaattttcattaaaaacccgaaaatgataacataaatttttcaaaatgtcctgtaaacataaaattataataagaattgccaactgttcgcgaaatacaaaagccaaaaggcaccgcaagctggaaatcggacgagcagaacacctccagtaaagcattaagtcgccaacggtatatcatcaagtaaaaaattggtgcgatctttgacgaggtcaaatttggatcggacgaaggattgacaaattctttgcagttgttcggacttgtgatacatacaaggctttgtaggggcttaatgatgttcgtggaaacgaagaaagtggcgaagaaactgaggccaatgaaaaatgattttaaacattttatgtcgagttggcggaatgtcatttggcaaaatgtccgatttatgggtagttggcgaaacgtccgaatttggcttagttggcgaaatgtccagttggcgaaatgtcatagtgccgatccttctgtacagatacgaacataaaaagtgaaattcaaaaatttggactttcggtttttgttcgaattcgattcaggggtagaaattgttcaagatgaacgtcagattagtgatcactgatcagtgacccacccaaaggtgtttatctgagctcccaaactcaaaaacacccaaaaccacttttataggttttcatatgcgctgaaaacgatagtaaggaattggtcgaaatggatgtcatatttgtaatcagcggcccgataacccccgaatggaacgaagaactgtaaaaaaacagcttattattctctttttttatgggaccagtaaaagtcagtattacccaaaaagagtcggttcttatatggttagtacgccacaaatttaaattttttttaatcatcttaggttaccaaagggtgccaggtggtttcgacagtaggtgatttagacagtgaactatttcgcctatcttttgcttgtgtgaattcgacagtaggtgattacgacagtagttgatttcgacagtacccactaatttttaaaaatagtgataagttgcaatgaaaaaccgtaattcgacagtagtgagttcgattatttaatatttttcaaattattactaattaaatattctaatttttccttccgcattgatacaaaaatgaattaaagggtaaaagggcctaattatattgaataacctttgtgaattatttgtttttaccccttgagaacgttttttgtttgtcttccttatcaatgaacgaatgcagcaaagatggcattctcggaggaaattcgccaaacccggtgtaccgacatttcgccaacttgacatctcgccaactgacatctcgccaa

SEQ ID NO: 8101 - DNA, 1393 bp, Heterodera glycines
tgtgttaattattattgttcatcatgcttacatattttaatcttttttattccattattaaatgatattttgatttttatttcctatatatacattttacttttttaaatcaattatacctttttattgttatctgtgaaattttataaaagttaagttcgctaaaaaaaatttccatttatgctttaaattattacattgccaacatgtttaatatataatttatgaaagtaatttagttttcttgtagaagtttgttttatgacagtctgtccatgcagtttatattagattaaattaacattgattaaattcagctttttaatatttaaaaattcttcaattttataaaaatgaaatgatttattttgagttttaattttgttttttactatattatcgtgtttactacatttccttgctgattacatttttcgtttcaatgcctttttgtttaataataaaaattcatttcgtttcataattttctaaataaattttcttaattctccaaaattattttgctctcattttagtatttttaaatttctaggacaaatatttaataataaaaaataacccaaatatttaaataatctctagttaatgttgcgaatatcaaatataaatcatgcccagagcaatgaagggatttagctctagttcgctaacattccacaagtattattaaaattaaataaccatcaatttttaaataaagtattcatacatttttacctaatgtaatcattgaaattaaaacaatttaattgttataaaaaatcaatattcaaatatacataaaattcattttaaaataatatacaaaaatgcaaaaatattgataatattttttgaagaattttagcttcattgtatgtctcggtttcttatataattcaatggtattaaactaatcgaggtcgagcccgaataaataaaaatatacaattttaaattaaatatcaaaatagtgatgttacacttgaaacattgaaaaaatataatatttttcaatatcaatattaaataattttaatctatcaattatggatgtcgaattttatttctttgttttggcattcagttatttactaacttattcagaaattataatgtttaataaataaattcaattttataaatttgtacctttaatttaattttaacaattaacaacatgaatttaaatatactagtttattaaatttaaatattatttctgatatgtttattttataatatttcaaaataattattattatattttattcaatttacctttttttacaaatagaatagaaaatcagctaaattcttgcagtttgcatccacattccttgaaatattttatcattgtctaaaattatttaataaattaaattgatttatt

SEQ ID NO: 8102 - DNA, 3605 bp, Heterodera glycines
  misc_feature (28)..(28): n is a, c, g, or t
cgcacaatttggggcgtatgaaagagancggacctgggaaaatttaaagaatttgaattaaagatttgcgcggaaaaaaatttgttttttttgtaacggatctcgtgaaaatttgttagtttttgttgatttttggaaaaaattaacgatttttttctattcgggaattgggaaaaaaattattttctcatcttttcaaacccaaactcaataatgaaaattgccgaatttgccgtcagaaatttgttaagtgattttaaaaagcaatgatttttgcaatcgttgatttttcattgtttgtccatatttatttatttagtaaattgaaaatgatgtttaggttgctcaatatttatatctagggctataaattatatgcttttgcatattttctgcgcatatgctatgaagaaaggggcccaaaaatagcatttctgcgttaaattttttgatttggtcaaggtttttagtgcatataaatgcatattttgggggttttcgagaataaatgcatatttggccatttttgcattttagagcatatttcggtcatttttggcaaattttcataagaaaaatgcaataaaaagcgaaaacaaacccctaaggatcgacttttttggaaattaaaaaaatacacccttgaaaatcgaaaaattttaactttttataaaacattttcaaaaaaatttttgatgcaaaagatacaaaaaagtaatttaatttgagcataaaataaaattttaaaaaaaaaattcaaaattgcacatataaattttgaaattcaaaattttttgcacttgtctaaaaaagctccttagccattgttttggaacttttaaagtcaattctaaatgtttacacaatttttggcattttttttgagggctaaagccatttttggcagtttttaagacatgttttagtgcatgtttgggcatttttcgggtttttaaggcatatttaagggatttttagtgcatattttatgcgcatatttggcattttttagtgcatataatttatagccctatttataacacaaaaaaacgaacccggtgatgagcacagagtcgtcgaagacgaagaatttcatgtgctgtaaccccacaatttcgttggtcagttcgggcagcgcacttttgaggaggccgcgcaatttgggcgtatgaaagagacggacctgggaaattaaaaaattttaaagaatttgaactacctaatttaatggcgttattgaaatggaaaatttaagaaattgcgaaatttttcaactttttttggagcaatttcattgcccaaaaactcaacattacccatataaaatgcatttgaaatgtcagaaaaaatgttaaaaccggagggtaatatgtaataccagtgtcccgagctttgcgcctttgtccaaaatctggttcaaaactaaattttttcaatcaatgatcgcataaatagctttaaataagcgattaaaagtgattgtacccgatcatttgatcttcaaaaaaattttgaaaaaataataaaattttcaaacaaaaaattattgatcataatgaaccataaaaccgtgttttcttaattttaatgcttattaggctatcaggggttgaaaaaattcaactttgagtccgattttggacataggcgcaaatgtcggggccgcaaaagtcggaccgcaaatgtctgggccgcaaatgtcggggctccatgcgaattggctacacaaaattgttcttaaaaatacaaacaaaccaattgaaaataaaaatataattttgttgactaattaaattttctgcaattaggaaggaaaataaaataaaaatgataattcattgaattcaagtttaatgatgtaattgtccttttcattaaatattccttgcggaaaaatactgctaaaaaaacaaaatcggctcaaatgctttacaaattataacagattataaacattaaaattcgaaaaatatctgccaagttaacttttggttttgttcaaaaaaatatttcaaacaatgatcatatgacttcagctcctaagagtttatttgccgcttttcagtacaggaaaactcagttgtttttacttaacttttaaattttttatattaaggtttatttaattgtttaataaaaaaatcatatttttggtttttaattatttgtcacatgcttcagttattttgaaaatttcttgaaatttgaatttattatgttttttggctaataattatgtacaggtctcattaaatataaattctaaacatgaacagaatatatcaaaaaaaaaaatttttttttattattatcatctaattatattcaattatattgtaaatttaatgtattactttcctaaattttagattaagcattaatttgttttgtttaaataaaatagttgtttttcatagtggcttacttattctcttgctacattattgtaaataaaacttgacgttgtcatgagattaaaaaggttttttattttattttttaatagatttttttaaaaatatttttttacccttaattatttttttatttgtctctttttttatttgttttaaataattttttacttttctttttttatttttcaatttaattttttataatttattcttttgtaaaaaataaacatgtcaagcacgttgtattacgactttacaatcaattttttaaataaaaccgatttacttttagcatttctcagtattgaaaagccaaagtttatcatgctcactgattcatagttaaatactcaaaatctaacaattcaacaaaatgttatcagaaaattaacaaatttattccgctatattagaagaatttattcataagaaaataattaacttgttaattttacatctattattctgaagttatataataatttttatgacgttatttattcaaatattagatattacataaatttattaatctattgtacacataaacaaatgtaaacatttttttgaataataattttaatacacattaaaagactattcttgcgcaattattcgatgagcaattatcattattttatagattatgttgtttcatagtaatgtctattgtttactgccgattttttaagtctgttgttaatattgatgattattttaacaaacatatcaggacacaaaaattcattacataatttaaaaataatttttaaaatgaaaaagcttaaaattaaatattaaaaatgaataagaacgaaatgagtttgatttaatctccaacctaaagtggactatttaatttaacaattggtgaaattttattctttaaataaacacataataagtatatttttatttattgtaataaatgaataataataacctacagaaaaataatctattattgttttgtatttttgaatttaaatataaaaattaaaataggaaagttaaacaaaaataattaataaaggaaagtaaatattcaaaaaattttcaatttatatgcaccgataggttgcaatactaaattaataggtttcgcattgggaattatgagatggaaaaaataacggtaaaatatttaattagcgtttcaaataaattgtctttcaagtatgaatttga

SEQ ID NO: 8103 - DNA, 812 bp, Heterodera glycines
ttaaatacggtaatggttagagcccggacataaactgcattttctttcgtcctaaggttcttgtttttgcccgcgcttacatttatttcttagccattattttagaggaattcgttcgtttaattaaaattttaaacccctttgatgaaacttcgtccttttcattgtgtttgcttgatcaataaaatgaaatttgctatataaatgcacatttaatttgcttttatctcgcgtttatttttcgctcaattcctttattggatttgtatatttacgtctttcaaattcaatatttttaaggctaattggccatttgttgtattttggacagttttttgatttttacttcagaaaagtgctgaatcatatcacttgaagctcataccgaatttttgctcacaaatgcaggcgatcaaatgcgttgtcgttggcgatggcgcagtgggaaaaacttgtcttctcatcaggtaactaactaattgattatgtttcaaaagggaatgtcatgcaatttcttcctccagttacacaaccaatgcctttccgggtgaatacattccgacagtgttcgacaattattctgcaaatgtaagtgtcagtcaatatgcgtattttgtttacgattaagcgccttcaaattctgcgtctgttttttgtagtagattaaaggtaattctgtgttttattggtcccatattttgtgcaatacggagtagtacccgtgggttttcgggggcgctgatcacgaatattacatcaatttcgacctattccgaaccccggacccgaattcgaactaaagtcgaaattaa

SEQ ID NO: 8104 - DNA, 2772 bp, Heterodera glycines
cgattttattattgtttttaggttatggtcgatggcaggcccataaatcttgggttggttgtactcaatacgatgtgataaactggttttttgtttagactttgggacactgctggacaggaggactacgaccggcttaggccgctcagttacccccagacggactgtttccttctgtgcttcaggtcggtttctccgatgtccattccttgacatttgttgcccatttgataaaataattactaatgtaagtaatatttatcatttcagcatcgttaacccggcctcttttgaaaatatccgtgccaaatggtacccagaagttagccatcactgcccccagacgcccatcattctcgttggttcgtatcactgagtcactcatttttttttattagaattaagcatttctaaaacttttatcggtacaccccaaaacacagccgcagaaacacagccgggaataaattcttaaaaaatttgtaaacaaatttttcaagaaaaaaatatttaaaaaattttcttagaaaaattcgaaggagaaaaaaattatataaaaaattttccagcgatttttttgaattttttttgaaaaccagtaattcaccattaaattttgaaaaaaaaattttcttagaattttctaacaataagacttttttgaaaaatttctaagtttgaaaattttttaatttatttccggctgtgttttgtcctgttccggacttttatacccctaatattttgtcattgccaaggtacgaagctcgacttgcgggaagactcaaaaacgttggacaaattgagagagcgccgtttggcgcccatttctgtggcgcagggccatcaaatggcaagggaaatcaaagcgaccaaatatttggagtgttccgcactcacacagatcggccttaagcagggtaataggtttcatacttcgaaaacccttttgtctttctaattcccttccccccccccccttaagttttcgacgaagcaatccgtgccgttttgtgcccagtccaagtcaagccaaagaagtcttgcgccattctctgaacagttcgcgtccaacctaaagcgaggaacgagagtctccagtcaacaccaactaaacgacgtcatcaacgcatttaatctttaattattttctaattgcacccatcgcttaattaacacatccaatcccttaatgttgcccccttctgatcgttcactgttttggtgctttccatcgatcccttctgtggtttttgtcatcgattgattgttttttttgtgcttaattttcattttgccactaaatccgtctacttcatcctctcccatttccaaatttgcatttcctttttcgctcacttgctctttttgttttctttgcgttgtaacccaccagttatgttcttataaaattttcatctcaattaattaagcgtcctttcaaaaacacaaattgttttttattcgtctttttcgatcagagtctgaataatggtgcctttttggacatggactgtatatgaagagcatttagcctttggccagaatcagtaaataatgacttggctttcttcccattatttctccgatatggcaaattccccctcttcctttcccctctaataaattgagaaaatttaaagagtgaaaaggacggatgatggaatgggagggagggaggaacactgggccagactggcagaacagaatttggacaaaagaaagcatttggcacacaaaacaaactttcctattctcatttgcatatttcgaatgggtaagtgaatgatgaatattaaattgtgtgacgacttaaaaccaattccattgccccgggggccctcgaaaatgtttttttcttgcggccattcctttggttcgttcgttcaataatgtcattaagccccacattctgtgaacgttgtaatgttttgattcgaagatttttattggcacgcgatttttccggcaattaaagtgaaattcggcggagagtttgaaggattggcgaattgtcgattctgtgaaatttcgctcaatcaaaaacgcagttttgtttgtttgtgaattttcctctgctgtcatcgcaacactttgtccaatttttgtttgttgcttgaggcagaaatcaaatttgtttaaacccctggggcatcctccgccaacaaagggtgtcgcaaattgagtacgttcgttttgcatcgtcttaccggcaattggcactttgccatgcttttcctccgctgcctttgtcgtcgctccgttccatttctgtcctccgctttcggcacgtgctcattttggtcaaatgtttcaaagaatgccttcgcacttcccccccccccccataacaattgctgtggtcatttggtgtgataatgtgccgcgattgcttcacttaaagtgtcggatttccctcctccgcttaaagagttcttctcaccccccgcccggaaaagggggcaatcccagcggaaaagggaaaaagcgcgggaaggaggcgaaatttaagtgccaaaaagagcggcggcacccatcaaaataattatgcgacaataatcgccgaaagtgccaatgtcgtggttgtgttggtgtccaactgctcttatgttttccgtcattgaattcccattccttccccccccccccccccttcaatatttgctcattttcttagaccatcaaatttggttggtttgatgcctttcctcattttggcctcatttggtgaaacggccgaccaacggaagaaaaaattgttgtccccgaaag

SEQ ID NO: 8105 - DNA, 1760 bp, Heterodera glycines
gggcgagatcagcaaataaagcaatactatccaataagtgatggaaatcagctgacgcgcgaggagtcaacggcgtcaagtgattttgcggactctttaaatgactctcaagtttttttgcaagaggggaaaatttccagaaattattcaaccgtctatcgacagtttggtggactcattaaatgaaagggggaagaaattggtccagaatatgataactcgttttcgttctctgatggaaccgcgttttgcttataacgaatctacgttttcaaaaacaaattggaatcttctcgaagcagacttaatcgatatggcaaacgggaaaagtacaagacggattttttcaaaaatatataaacttacatattgcagttatcaaaggaatcaacgcgtacaataaatagcagtaattaggggcggggcaaagattaggcagggggggggggaatttgtggtcaaaacacggcgaatggacgtgtaaagcaatgctatgatgtcgttgtcttgtcaatggacgaaggatctgctgaaggatggcactttgctgctggacgatgagtgttccttccgacactcgtcctgcccaaacttctttaattactcatcggttcgtcaacggcggttggactgaaaaacctaaaatgaaattgcttttttttatgaaaagctaaattatttcctccaaataaagttgctcaattagtgaatgtgaacggaccatgggaagtttatttttggcgcaaaaaaatgtggcgccataaataaattaaaacgggcgtaattaaaaaggacgagagaatcaaaggaacgccgaaagaaatagaaaaatgttcgttgtaaaaccaaaaatgcaggtgaaatcgaatgaccaaaaaaattcgttggatgggcgaaaaagtccccaaatgggctaaccattttaactagaaattttcgaccaaaaaaggaaggaaaataagcaaaaaattgcccaaaaggatggacaagtgtgtccttcttcctcacttctgctgttggtggtggacaacacttccgttggttttggcactttcgtcgttaattgagcagttggccgtgccattcgcgtggacgacactttcagccgctgcctttccgcctttcgccttcgatttgtttgcgtagcgatttccccgtcgaaggtacgtttggtagaagaagttgcagaacagcaaaaagtacgacccgtagagaataaaagaagcgtacaaattggtccaagtgcactgacagctttccatgccgcccaatttgagactgaaaaggcaaaaggtgaaaagtaaaaaaaagacggaatgccaatcaaaacaaagcgaagaaaacgcactaaagggtgatgaaggcgagggagacgccgaccaccatttgggcaatttgcatgacggtgatcatcatagcgaaccatttgggcagtcgcaatttcatggcacgcaaagcgtagtaggaatacctgaacggatggtaatggtgaaatagccaaattcttttaggggataatcttatttatttatttattatgtgtcccttccattccatcttccccaactcacataaatgcgtgaacggtgtaattcatcgtaactaaaggacaaattgatgtcattaagtgcaaattatgttgccaatgactcactgaaccaacgtccgctcgccgtgtggtctttgtaaagcatccaagtgtaaatcagcacctaaagggggggggggggagggagttaaactgataacgaaacaacgac

SEQ ID NO: 8106 - DNA, 1184 bp, Heterodera glycines
  misc_feature (36)..(36): n is a, c, g, or t
aaattgagtagatgaaagagttggagttgagtgacntaagagggggtcaaactgactcgtttgcccttcactttgttgatgtaaccaaccaaaacagttcgggaatcattcgaacagcgcccattatggaaaaggtggccaagcccaaattccaccagaacagcgcctggtcaagtgcaaaaggcttttgtgagctcatcaactgaaaaggggacatttaattagtcttttccattcgagaagtaatttcgaaaggcaaaaaataatatttaaattaaaatttggccgaccttttggccaccaaaaatagcgacgacataaagcgcggaaaaggcaaaagagctcagccaattctcctgcatccaaagagtcgaatcggtcagattgaacgcccgctcggcggggaggacgagcgtatgattctcgaagccgtaacggggccaatactcgaactttgccatttttagtgctccagggatgaattagtgggcaattaataaaattggggaataaatggaaggtgaaagttaacagaaatggaagtggggaggaataaataggcaatggacctcgctgaagaaggtcactcattacacaacaaatcgcatttgagaaatttttgttgtaagaatttgtcgaacgattgtctaattttggctttggaatgtaaaattcgttcgcgtcacagagcaaaggcaaaaatgctcaaaaaatgatgaacgatcattgtaaatcttaagaatggaaaaaatacaatgcgaaaggttgccgatggaaaggggcgaagggaaagggaagggaccggtcgaaggaggcgaacggcggcgcggtttatcacaaaacaaattatgcagcagagaaaacgaatgcgaacggcggatgaatgaatggcgtgagttttttgggcggcgatggccgactttttttggcgaaggaatccgccgaattcaaaatgtttcaaatgaaaacaaattaaaattaagagacaaacgaaatttgaaccaaaaaccaaaggaattgattaaataaagtgttatcaaaatgtttgtgttagaatgtgaacaatttcagagaacggacgaagggaatgtgaaacgaagcgaaacgatcacctgaaagggcggagggatgagagaacacaccagaaggcaatcccccccccacctttttcccttttatcttcg

SEQ ID NO: 8107 - DNA, 2159 bp, Heterodera glycines
tatggccacatcaattaaattgtacgagttgcctttgtacgagttgccatgacacccattgaggcgaccgaccttcttgaaattgttgacccattcttttgcttcattgacaggcacatgatgcaacttgcaacacaatcgcttcggttgcccatcttttctcggggtgtgcaaccatttggacaacgcttggccagcagttgcatttggcccatcatcagcgatcacatcggggaacagatcagcagagcacattgaattcaggttgatcagatcgaagagaattgtcggtgaaatgagacgacgcaaatgatccaaatgaccaccatccggaatgtccaaatggcgaatgtttgtcacaaaaataggcaaaatttctcgtgacataatgtcccacttccgttgcatgatttcaatttcggttgaaggccgccggggggattcgtaactcaaattcagaacaaattcagtaaaaaaagaaaaaattagaaaaatgatattttaaattaccatatttttttcattttccatattttggtgttgttaaaaaatttcaaaaaattattaattttcactttccaaattttttttttgaaaaatcctagcttgcgccagtaaaattttcagcttttttccttttaaaaagaaccggcaccgcggcaccgcccggaaaaaagtgctgagtgcgaatcttagctcggttttattatgattagggatgccaaaaatatgcacataaaatcgtaaaatatgcgctaaaatatgcaccaaaaatcgtgaaatatgcatataagtgaaaaatatgcacataaaattttccaattgagggtgtaatttctcaaaatttcttcaaatttgttaaacataaagtaaaatcttcaaaaatggctaaatgtggtattaaaaatcattttaggagaaaaaaacatgataaagcaaaaatttactcatcttttgcgaaaaatcaacctgaaaagcaaaattttgcttatttttgacctaaattaaccattttttgagaaaatttatttattcaatatttttcgtgaaaattttgctaaaaaattatttttttggaaaattttccggtttttgaggtcaaaaaggccaatttgtctgtcgggggccgatctattagaggttttttggaaaaacgccaaaatatgcacataaaatatgcacataaatcgcgaaatatgcacaaatatgcaaaatatgcacatggaaagtcatcctagaagcttcaaatcaagctaaaaacatgtttttcgtgcgtttcaggcatcccgcagtccaggaaaaaatatgcatgtgcatatttttggcatccctaattatgatgatgccatattatctccatgctttatcgagcagaggtcgtatggaacataaattttctaaaatacttacaccacaggtcaaaattaagcttttgggctaaaaataaggattttatgtacatattctatttaatttttctgagttaggcagcatcattatagaaaaaccaagctcggatttgtgcacgtagcactttttatctataaaaagctataattcgaaatctcctatttcttaggattgccctaaattgcaagaaactcgaacaaaaaaagtcttaaattaaaacatatacaaactcaaatgaaggcacatgcaaatagaatttggtgcctctgtcaaaaacatgcttattggaacggagaaatgcaatgacggagtagtcaatgtacctgaaaaagaatgcatttactttaagatcgaaggtaccaaatgattaggatttagccgtaattttgaggttatttatgagtggaaattaaattccattttttgctaatgaggcttaagggttttcgaaattttatttggcttttttgcagtaaaaaaaatttaactgaggcggagaaacaatggtcaaattactcaatcagaaggtggtcaaagcgggtttttctggggcagcggtcgctccggcataggaaagtcctcaaatttgctttgaaaagcagtcaaaacaaagcgttgctcggatttggatttgactccaaatttgtcattcgctttttccatcaaaatgtgcatccactaaaacatcaaaacgtggcgaaagcaatgccaatttgaggccgagttgaggacggtcaaaaaacgggaaa

SEQ ID NO: 8108 - DNA, 2253 bp, Heterodera glycines
attgatatattttttgttgcattttatgcgttttagggctttggacggttcagtcccacagccatttggccacttcagtcccgggcccataactcggcccaaagtggtatcattcgtcgaatttggtttggtacacatattcttcaatttttcctaatagaattgaatctttttttttaattcgaaaaatttttctcacattttcctcaaagttcgattcttcattttcttgaattagaatacttcgtcacttcgttaattacttactaattagtccatttaataaagaagcatgttttttcgaaaattaaaaaaattaatattaaactcgcttaaaattttttaatgaattacaggctaaaaatattataccagtcataaacgcagaaattaatgtccaatggaactaaaaaaatgaaattcttggcgaattccgattgaaaccccgacaaattcaaagaaagatcagaaaattcaggaacatgaaaatgaaaacaggaccagggatgccatggaatttggttgactttttgaattcactttttttaaattattttttggcgccgtgaaaacattttgccaagtttggtagtggagagagatttggatgaattctggcgatgaaaaaaaaattgaataaaaatgtatcgataattgaaaggctttcaaatggttggagagagaacccaatgagcaatcggttttagaacccctaaaacttgaaaaatttcgaaattgggccctcttaacctttttaaacatattttttacgtttttaattgatttaaaattaaaatggtgcaaaaaatggaaaaattgcatttgcccgacgtttgccctaatttattttgaatgtgcccctattccgggcactcgaaatcgcatctgtatcatgtccagtagagcattttttgtatcagtcacagattaaacataagccatgaaatcatcgaacacatgagaaagatcatttttaaattttcaatttggatcttctaacttttcacgtttaactaacataaagctcatgaaaccttctgtcagattaagaagttgatcagaagcgactaaattgctttttggatcgacttaatcttgaagaatgaagaaaattggacgctcctaatctttttgagtggtcaaacctagacaaattaaccataattcgaaagttcaagaagatttgggtcaaaaattgttggggaatccgaacggaatttgagtcttctgggacctcatactaattccaaccagcattttaatcagctattattatattagcagaactccagaacttttctcatttctccggcggccattgcttaattttttctgccacaattagtgaaaatggaacagaaatcgttgggtccaattgtgataccatttggagaacagcagaaggagaaaaatgaacaatcgaacattgaggaaaatgtgagccaaatttggcaattccatggcattaagcaatcgaatgtcttggttctacatttcagttggatttgtactgatgttttgatggacattttccctctttttgaccatgcccaactcggcctcaaattggcactgatttcgccccgtttcgaggttttatcgaaaatttgagtgaaaaggggggctcctgaccttttaaaacgccaaactcggacaaaatcgacacttcagtaccaaaaaatgacgtaagaaaaaaaattaaaagcaaaaaaaaacgcaaaaaagagatgcagagacgtaacaaataggcctaagcttaagcataagccgaagcctaagctgaagactaagccctgacctaagctgaagcctaagcctgggtgagcagcgaggcagctttttgtttgacttattaaattattcatcgaatattcaaattttaggccatttgtctccgcccacaggtcaaaacaacgaaaaagacatcaattcatgaacctatggccattgggaagtgcatttattatttaagaaatggctcgcgccaggatcagtcagctggggacaaatcagctgacagacaacttagctgatgggaccactcggctgaaggacaattcagattcccgaagtgtcatgagaactcatacaatgactagcctaggcctaagctttgggctaggcctaggcttgcttgggcctaggcttttattttgtaaaaattttttgtacggctgagttgtctattaaccaaaattgccccatcagctgagttgtcctcagctgactagcccagaagccaaatggccgact

SEQ ID NO: 8109 - DNA, 1105 bp, Heterodera glycines
  misc_feature (1009)..(1009): n is a, c, g, or t
  misc_feature (1016)..(1016): n is a, c, g, or t
  misc_feature (1021)..(1021): n is a, c, g, or t
  misc_feature (1037)..(1037): n is a, c, g, or t
  misc_feature (1091)..(1091): n is a, c, g, or t
tttttttccaaatataatcattttaaaaattttatttacatattttggtttttgtacatattttgggattttttaaatatatttatgtaaatattttgactattttttgtacatatttttgacatccctattacaattttgcagattttcttatataaaattcccagccctaataattatttcttgaatacatttatttgggtatttaacaatggtgtttagcaaatgataatataatctccacaattacccttattaatattacatatggattaattattttttgcctatttatatgtaataaaattttgtttgattaccaattcaaaaaatattacgtacaatccgaaagaagcggagaaagaaatggaaaaagcaatgtaataatttcaaatttgaatttccatgctaattattttgcttttacgttttctaccccgaaaaatttgttttttttaaaagatatcaaaaaattttttttaaatattaaaatgtaattctaagcctatttaggtcattttatgccatttcgtgcctatttcaccctttaaagagaattgttttcaaaaaataaccattttaaaaattttatttattgtttatacatacctatttcgggattttatctacaaatcaataattatagtcgcaaaacaattggaaaatgcaaaccgtataccaagcataaaaaaagaaattagtaaaaagtgattgctcctccggcactgttcatttttacctaatttccattcgccatttcttttcgtctctttcttcgactttttctccctgacaataccttcaaaaatgattctgtacctgtgcgtttcaattttatccttatttttctcatttttagtctattcgattgatatcaaacgaagtcttaaagtctatagaattttttatagacctaaattcagggctaaaaacaacagacaaaggtaatagtgtacatagtactagagctgcacgggtccgggtacccgaccgggtcttttaagatttntgtgaanactgntagtttatcattacantaaggaatctcaaaaattttatataaaattactttgatctttaattataatttntaaaaaaagttaaa

SEQ ID NO: 8110 - DNA, 1919 bp, Heterodera glycines
aaaataatatggttaagtgatataaaattggttttgattatggccgattctgtgcggattgttggagaaaaaagcaaagtttggacgattattggtagcgatggagatgattacatcaacataacaatgtggaacaaaaacattgaaaggctgtcccgagaaatcgggaattcttttcaggcaatttttcttatataaccaaaaaataaattgtttttaggaaaaaacttacattctcaaaacttgggctgtttttaaagttgccgaaccatttaattatggtagcgttgagttggaattgcgtgcccaagaaggctcaactgtaacaattgttaccaaaactgattatgttataaacggcatcaccaaagaaatgtactttgattttttgggatcaaaactggcactcaacgaaacaaatttcatgccaacaaaaattgaaaatttacggaaaggggagaaattcatgtaaaataaacacaaaaaacacaataaaattaataaaattttagcgaagtcgaagcaaaacttatgagagttcagcctgttcgagaagtcatggttaaaggatcggaagcaaatgtgatcgatgtgtggattattgaaggaaagaataaagcacgtgtgtcggcttggaatattctggcattaaaattaattattaagctgttttaagggttgcttgatcaaattacaaaatgtcattttcaaagaggattcatacaaaggcgaatataatttcgtgtttaccaagtcgtcaaaaatttctattttggaaaaaacagaagaaaccgaaattgctaagactctaatgcacctttcaaaaaagcgtggtttagtttcatgtattttctgttataatatttaaaatattaaataaattaaaataaataatttaaataatataaattattaacttttatttttaaagtaatatattttaaaattcaattattaaaaaaggcgatgtccgagtgcaaattgcgagaaagcaaacggttctgaatcttgcaaatagacaagatgggacgttgtgtgtcgacaaagagcacaaggcgcaactgatttttccaaattcaattcagtttgatcaaaaggaagaaataacgctgcaaagcgtgaacattgattgtaacgacggtaacattaataaaaattttaattaatttattcttaaacaaaatattaagatattttaataatttcattaattttaagctggcgtgttgactctcactatctatgacaatggcgcatataaaacacatactgaaaaaccattcaaactcatttgaatgaagtggattatccaccaaccgaataattttttaagtatgataaacacaatgaatttttactatgttttaataaagatcaaagatcaaattgatcatttttgtttaataaacaagtttattaaaaatttagatatttgatttgtaaagaaattaataaaaaaaattaatacatttatataaaaaaaaattaaaatttaataaactaaagaatatcgcttttttatggtaaaacattcggaattgagaacttttcttgaaaatataaattgaaatattcaattataaaaaaaaatattgattttgatttttcgagactttaaaaacaaaaaattaattatttataaattgtgttaaaactataataagaatatgatgtaagaattttcaattcaaaatgaattaagaaattgttgcagtcttttatcattccatattgattgattggctttttggggtgtgttttttaacaaaaagcaaattattaactgtattattcagttattcctaaaatacgaaaaatttttataaatttttattaaaagaatttaggttatgttagccttttaataagcattagtttgtttgttagttggttggttacattataaaagaagagtgttt

SEQ ID NO: 8111 - DNA, 1939 bp, Heterodera glycines
  misc_feature (1857)..(1857): n is a, c, g, or t
ttattaataaataatattattccaaaaattgttttaataaaataaattttcatatcaaattgtagaaaaaatgcaattttttaattttcaaaaatatgcaataccaaacaaaaaaccaaaatcaaacttttgatttttatacgattacagataaagtagacaatattaaagaattaatatcagacaatttaaataaagttattaaattaaaaaattaaatattataaattactttctttgtttagcaaagataggttcttaaagaatcaaaaaataatttaagttcaaaagataaaaagtaaaaatattaaatttaaatataacttaatacaaacaaaaattatttaagataacattatcaaaaaaagcataaaacacggtcacgtcaaaatcacttaccgatgccatacgactggtcattaaaaaaaaaattggcaaaatacagaatttaatattttgaaaaacagaataatctaatcgaaaaaagaataaaaaatagagaaaattgaactaaaattaacaaaatcatgaatttttgattaaaacacgaaaataaaaattgcaaaaattaaaatttattactgaaaaattctaaatttctgaatcagtaacaaaatttaatcactcaaaaaaattttcggaatcattttgtttgctatgccttcttatagaaaactaatgaaaaaagataaaataatttttagaatgctaataaattttcaatataaaacaatatagataaacaaaaatacttattggaaattttcaaacaaaaacatttcattatatttgaattaactcatcatcattattaatctcatcaccattattattattattattattattaattaaaaatctaaatatactatgtgactgcgtcattctttaaaaaagagattcaaattaacgcataaaaacattatgccaaagaatagtgagctgccttaattagagagtggccaatgttttcgtaacattttgttgttgtttattgattctctcttttgcatttttttgttgtttattgattctttcttttgaaacgtatgttcaaatatttatcactttgtatggccattgttttatttatttatttatctaaatagttcttttataattcgacggaattctttcatttctaaattgctaaaaaatttatattccagttttttactagattataaatttgtatgttgttttttaatttagtattcaaacctaaggtttttttaattcttactcttttttcattgttttaacatttcattttaaattttttgttgtaacataattagtttttttttgcgttcagataaaatggttcgacataaacagaatttttctgttggtaatgattttccaacttcttcaaaaaatgatcagcaaatgaatgaagggttcatagctcccgtaaaaaaagcggtcaattgaatgaaagggttgaaagctccctaaaaaagcagattgacaaaaatttcaatgattatgaaagtataaaaagacagaaaaaatcgcttaaacgaaagattgatgaaaatgatgagactatcgatttagacaaagttccaatgagtttttttgacgctggtggtaatgaaagcatccaacaaaacgaatatgtaatagaaactgagcaattttcgagccaattttcacacatgggaatgatatccaataaaaaagacactggaaaaaatagtcgaaatcaaatgacagaggaacaacgacaaattatcagggcaaaaaacgcaatcgccgcaaaaacgtatagaaaaaaagtaaaaaacgtagattttttgcttttgcaagcgtctgaacaaaacacttataatgttgaattgtatgaacttagtngatttaaagtaaagtgtaagcattgtccggttatacatttttcagaagaagaaagtaagacaagcggtgccatgaatttttt

SEQ ID NO: 8112 - DNA, 2102 bp, Heterodera glycines
  misc_feature (38)..(38): n is a, c, g, or t
tttcatctaatttttaacaagtatttgtcaaattttcntgaaaatataatgatttaaatctttttgcgcctgcaataacaaatcatgctttgatctggttaaggaaactgatacattcttgtcgaatgaaaactttcgtaattctaaaaaaaaaaacaattttttgagaaataatttttaattttttcttaaggtgttaactgaataaaaaatgtttattaattttaaagtgtctataagtttttgctttcttaatataatttattcattttttagtacattaaattgtttttcaatttatattttaaattaaaatttggttagattttttgtaaactgcaattgagctttatttttattcgaatctttatcaataattaaaaagcttacattcatttaatttgttttgcaattttatttttgtaaaactggcgaaaagaatattaatcattttcctgaagatgacttctctcggtatgtttggggcggtcccttcccgctattggctgaaactatttacgccttacacttattttgtttttaaaaaaaataaacatttttaaagattatacttgcatcattgctccattagtgcgcgtgaacttggcgtggttcttgcatatactttcagttttatttatttttgaagtttttatcggattaagttatttatttattttttcttgtaagtcttaatatgtaaaaataaatgttcatattgagtgcgctaatatcagggctcggatcgaaaaattttcaaaatcagaacatcaagcccaaaaaatcagattctggggtcgaaaatcaggacattttgcaaaattgcttcaaatcagttatttttacaatttttcgatcaaaaatgtatcaaatattatatttttcgtctcccattatcgattttaacaattttgggtagaaaattagcaaatcatcaattttagcgcattcggaatcaaaaaaataaagatttttaactatttttttgcggcgcatttttccaaaaaacttttaggaaatgggcgagggggggagggtccggcgatgccgataggcgccgccggaaaattttttgtaatttcgttctgatttgttaacagattttcaccaaaaaatgccaattttgcaattaaattaaaagtcaagcgacgacttttttgctttaaaaacgctttttttgcgtcgcattttttcaaaaaattttggaggatggacagggggtccggcggtgccgataggcgccgccggaaaattttttgcgatttttaatcgatttgttaacagatttttattaaaaaaataaccaaattttgtcataaatcttatattttattgataaaatagtgacattatgccataaaatttcaaaattgtaagtttatttaagaaatcaggacaaagttgggtcactccctccaaatcaggacaaatctgacaaatcaggacattttaattttatcagatttggacccttcaaatcaggacaaatcagataaatcaggacagatacgcgccctgagttaataacttacccgggtaagtctacccgggtaacattacctcgttcattgccctgaccttcattatttttttctttggttcaattccccaacggaacatatactttttttctattttctttaaattattccaattgaaatttaattaataaaaaatatttctacttaaaagttattattttttcttttttaaacggactaaaaccacaaattacccggtctcggcttttctcgcggtcccggacggaaattgaggtcccgagctcgactttctgggcacgaaatcgcccaaaccaggctatcgctttttatgacgattttctatctcgcaaccgcgatgctaatccgatcctgagagcctcttcaaaattttttccattaccgtaagatgtgcggaaattgtgaattaattctcagaaaaatggatatctcttgttaagagaattttctatcgcctaaccccgatgctaatccgatccggagagagctcttctaaattttttccattaccctaagaaatgcgcaaattgtgaattaattctcataacaatggctatctctttttaggacaattttctatct

SEQ ID NO: 8113 - DNA, 1851 bp, Heterodera glycines
tctagagtccaacagtacgaggcatatttagggcgctatgtatttctttatttttaatggaaatgtgaaaagattgacaattctctcactaggaaagaatgtgaaacatttcaaagctatttggaggttttgtatgaatgcctgttcattaaacaccttgaaggtaaataattaattcattttctttaaaaaatttgaaatcttttctcagctaataaaccgtcgctggcacaacagtttgcagttattgaacggccaaaatttcagattggaaccaaaaagaatgccacaataattgacgtgttggacattctttgctcaatttgggcattcttttttgattatgattacggcaaaaaacatggaaaaagtttggaagctttatttaagctttcaatgaagccaatatttatagacaaccaacctattgggaaaaaaattgtgaatttctttcaaaaaattaaaaaatacaacatgccgtccgacgattcagcaatggcggaatcgtcaagcaacgaagcgattgggcatgaagaactacttaatgaaactttaattgaaaaaggtaaaaaacgcgaagaaaacacagccaaaattgaattgacccgaaaagcatttgacaatttgctggaatcgatgacggaaacggcaaaaaacatgcaatcggatgaaggatttggcaaaaacagacaagttttgcgttggctattccagtgaaaattcaatgattttctggcgttcgaaccggaattcaacttgatgaaatccaacaaataaattcagtctaacaaaaaatttattttctgaatttattttccttccccttaattgaaaaccttgcttttggccatgaacatgaaaatttaggttgggcccgggtcagcaattcacataaaaatacataaccatatattctatatttttgcttttattggtcatcctttggttttccttgttgttcatgtttttttctctttttgggtacatataaacttttaattgtaaaattttttaacaatttggctaaaatcggtggaggtcggtaattgaagatctgccagatttttgaattcaaaattgttgggttcgctggacacttatgagtagggctaagatttttaggtgctaaaaactgcaaaaataggtagtaggtgctaaaaatgggaaaataggtgccaaaaagttccgaattttggtggttaaaatgacaaaatgtattcaaaaaagtaattgtactttttccttgtgacttaagccagggacgcaattcaaccaaacacagagtagatcaaattcaaacactttaagcgaaaaaaacatgattccaaatttaattaacacgaatgagtcattataattaaattctacaacatccctgaacaatgagaaaaggcgaccctgcctttagaagtcagaaaccgaaaggcagggtccaacaggtgttttcagcagcgattagaacggaattcccgacggcgttcgttaccctgtccatggcgattagtctcataaggacggtaacggatgggcaatcgatcagcagaactattaggaacaattctacgagaatcggcttgatctctcgaagaatgccctaattccagcagttccaatcggtgatcggcctgatctcccgatggaatgatgaccgccgaatgcatcgtgcgaatatgcatttcgttatcgcctgggaatggggtctgagtcattatccaagccttaagtgctcgacatccagcatttttcaattttctgtcttcttccaccatatgcgtattaaaatgttccccaaatcgaaaaatttccaatgcagagcggccattcggtgtcgtgcagatcggccgaatctga

SEQ ID NO: 8114 - DNA, 3959 bp, Heterodera glycines
accagttttgcgttggctattcagtgaaaattgagctttctctggcgtttgaagcagaattcaccattgacgaaatccagaaaataattagtataatataaaactttttttcttaatttatttttcccttttccttggtgtaagcccgggtcccggccatgggtctgaaaatcaggtcgggcccgggtcagcaattaaaatataaaactatacctgtatcttctctgttttgcttttcattggatatccttttgtttttgttgctgtagttcatcctttctttctcttttttggtataaatttttaattataaatttacaaaaagttcgctgaaatttagtgatattaataagtaatagattagcgataatattttatttacgtatttttttatctttgctcccactttttctcctcaattttgcttcttccatctgttgtctaccggatatgatcactaaaatatgaacactaatcagaaggtcttcttctcccatcgccgtttccaagcatctcgatttttggttttggacatacacaaaacgggagattggagattgaaaaaatcagttgccctatttatttcatcctctctctttctctttctacgctctcgcaccagggctggccgtgattgaatttccaatcacggaaatccgtgagccgtgatcacggggcttccaaaaaaatccgtgacccgtgaaccgtgatcacggcaccccaaaacccccgtggtttccgtgacccgtaattgtaaacaatttttctgaatgaattttttatttaaatttattaacaaaaaacggaatttaatcgctggaaaaatatccaaaagattttttaaagaaacaaaaccatataggtaaacgctttttttttgcggcgtgctttttccaaaaaacttttcgagcacaggggcagaacaggtggtgccaataggcgctgccgggaaaaaatttgtatttttaatgcgatttgttagcagatttttcccaaaaaatgaccaaatttacgtttttgagccaatatttttgaggaaaataaagggctatttttgtcgttttggggtcagagtttcaaaaaaaaggtaaaatgagggtccggcggtgccggtcagggctgggcgaaacttcgagcttcgaaaacttcgcggtttttgggcttcgaacttcgagcttcggataatttacccgaagtttcgggaaaaatacacccctaacaatcgagttttcaaagtgaaaaatacacccctaatgattggcttatagtaaatttatgaaacataaaaatttaattgctgtttatttattagaggtgcttttgaattgactaattggacattggactggaagaattatcaaaagtcccaagaaatttgaaaaaaaaattaattcctaaaattaaaaaaaacattcataatgtccgatgtccgattgtccatatcagtccaaatgacttcattgtccaaatgtctgctgctggaacatccattgtccaaatgtccggattggttcctcccccccccccctcacgatcctccttttccattttcaatacttcccgacccgaccggcttgagatgattcagtgcaaaaattaaatttttaattatatttaaaatgtttttataaaatattttccaattcagattttctttctcaatttggatgttgccgttttgcgcggttttttcaaggctcaccttgatcagttggcatctgtcttctgattcaatatcaataaattgttctgcgagttctgcattcgacttgctgggtgaaatggcttttgaaaaaaggaaaacaaacatttaaaattcttatgaattttacttcaatattatttttattcgatgaattacggtgaataaattattcttaaaaaattaattttgaaaatgtaactaatataatgctcgaatatcgcttgatagaaatccaaatttttcggtttatgattttgcaaaagcctcattttgcaatgataagctataatattcggacacaattttgcaaaaatacttgaatcgatcagacagtgaaggatcgtaaccaaaaaatcgaataagaaaattagggaatccggagacctttttttactcagctgtcctcaaaatttattcccttagaaattttcagaattgtgggcaaaaatcccccccccccctcctctctattcatttctgtatgctcaatcacgaagtataaaggatttatgcgcgtttattgacgtccgaatgcggaacttatgtttttaggcccatccaaatttttcatgggttagaatttttcggactgaaatcgatgtctttcattaatttttaattgtttaattcaaaaataaaattaattaaaaaattaaataattaattttttcacataatatgtattagacaagatctaatggttaataaaagaaatgaaaaatgcaattgacatttgaataataattgtatttttgttcaaattaatttgtgtgagttcttcttcagcggttgccccacaagaataaaaatgaataaattctaattcaaataataaataggtcagaaaaaataattttgtattttattattattattttaaaaaattatatttcaattattttcaattctattcaattttaatggaataaatcagtaaatggttgtgagaagtagaggccggcgtgataatgcttgaagacttttggaattgggtctaactaaattctggatgaataaaatttgagtaccatttggttaaagttttgtaaaaaatgacctattttgtgatttagagccaattttttaaagaaaaattaaaggttttgtcagctctgacggggaaaattgtaattttgaaacagattttttgagaaaacaatccaagttttcaaaaaattttcatttaaatttgaatattcaaaaaagacaatcgcttcaaaaaatttctttataaattttgcctaaaaatccgcggcgcgccgcgcaaaaaaaattccgcggtcgcagatcgcgcatttggaaaaacagtgtccgtaaaataacaaaataacaatgtttgggacattgatattcatttcaatacggtatgaaatttattggaaaattgttataatcattcatacaataaataaaaaatttcatgtatcagttaaagataaaatgggtttaatttccctaaaagtcagcgttatccaaagcttttggtgttggcagaaaaattattaatttgataaatcataccgttgggataaatttgcttttcataattgttttgagagagaggagaacaactttttaattatatgaagtggcatttattatttatctatttttgccagaaacggtaaagttatcaaatcggaaataaaattcgatggcccatcggtgagcagcacataatggaaataaggaaaaacttaaaaaataaaaggaataaaaaaattgcataaaattacatttagaatttattgaataaaaaaggggatttgtagatgagttttttcagatccaattgtagaattaccaattccatatgcatccgcagcaggggtgagacgggtgtggttcgtgatcggaatcgggcagtttttctgccgaatttaggagcccaatccaatctagtctttttcccagagaaattttaaaaattccacaaatcttctcctattaaaaatatttttctaaagttataaaaaaaggaatttgatttggtctatgaacctaactaaattgaacacatccactagaagtgctgccaattaaatgatcagaaaattagatccggcaatccctgtagagcagcaactgctgatccctgtccatcaaaaattctttattttttaatgcgttcattcctatggccaatcgttgcccccttaatatccccatcacgcaacagttaattttcttctcagctcactgctgtgaaaacgaacaaggattgtcaccaccgttttgtgatcccatccttcgc

SEQ ID NO: 8115 - DNA, 7021 bp, Heterodera glycines
  misc_feature (48)..(48): n is a, c, g, or t
  misc_feature (50)..(51): n is a, c, g, or t
  misc_feature (54)..(54): n is a, c, g, or t
  misc_feature (64)..(66): n is a, c, g, or t
  misc_feature (77)..(77): n is a, c, g, or t
  misc_feature (95)..(95): n is a, c, g, or t
cagtttatctcaccggatgacatcgcatttaacggctcttctagagtngnntgnctaccgaggnnncgcgcgggggnactccttgaacagcatcnctactcgagacaccgtgtcaagctacaattccctcaactcccatgtataactatgtaccagaataacggtcatagatgctattttccccttgaacttttggattttttataaaatattacggctaacaggagtgggccttcacgttagaccgttccacccccgctagtcctaatatcactttaatttttattcaactttatttaacaaaaaaaaacaacaataaaatacaaaattaacaaaatccaaatggcatcacattaagctcctcatcgatgatccccttctggcagaccggcttgtaaattttgtgcttctccctcgtcaccactttcgaatccctcgtcggcctaaatattgatttattaatgaagcaaataatgtttaaaaaactcatccaaaatcattcttatagacgaagaatgccgggtccacctcgccttttccataattcagtaccatctgcctgaatgtgtcgtaatgtaatgttttcctattgtccacgtcgaatgtaatcccccttatcttcataacgtattcagtctcccccgtctgcttatttttcatcttcaatgcgtagtgcttcgctcctccgcaacaatattcctcaatctcatagccgccatattcctcggtcatctctccaagatatttacccgtcgtgatcggctccacgtccctatagtgcaaaacaaaaatactatccgtgtctgtgtacaaaatttctcctccgtttccctccgcttctctcatgaattccaataattttaacctcgccatactcgtcgtcctaaaattggtttatatacaaatttataagttttaactcaccataaactgatgattatgttacttgacttgtgttccatcacaaactcatccttgtccctgtagatcactctaatcgcttcctccgaatattcaacaatatcacacatctcaattttatgatcacacgccattttataatactccgacgccctatctattaccgcattcttgttcaaacaatttctcatcgaaaacttaccctaaaagttaaaattaatgaccatatatttattttttaattttcttacccataaactattaagcatcaatttgctgatgtaccgcaatcctggattcttcttcactttagtcaactcaatttcgattccatatttttccttatattcttctctccaaatattcttctgctcatccgtctcaactcccttcggaaaaccgctcgcctcctccttcagtttcaaaaataatctcacatatcccttgaataaatcgtccacctcctcttcgtaatgccacgctctataaaatctgtccacagtataaccgcattccaacgcctttgcctgaaaaatgtcaaaattttctttaaaattttttcttggaaattcttaccaattcgacgctggtgtatgttgccacgtatcgccgctgtgccgcatcatgtgggcacttgtagttacatctcgtagtctccttcttaaattttgacgcacatctccaacatagcggaaacaataatctctcatcgcacttcaactgaagaaccggaatccgcaaccccttcggcgggttgaccctcactttatacaatcccttatacttcaaatcctccggtctcatccaattaacattaatttcatcagtcttcggtataataatctcaggcaaaccaatcgggtaagctgtaccgtaattcactgacgggtacagactcacaatatcataaacactaatctttttcttctcatccgatttcgcaaacaatttcatcggtccggtcctccctcccgcatatgccatcctcggatcaatcggccccttctcatttcctctgtcgtcgaagaagcccctcatttcctcatcctttttcaattccttctcaatttgacacccctaaaaagtagaatttataaattcaaatgtcaaataaacatacccaaacttcttcgacatccaaagtcttccgtagctccactaatctctcctgagtctcatcgttcaattcctgggccgtccttcctccaatcagttccgccgccgggtcataacaattcaaacatccatgtatgtaacatcccataacctcgatgcatttgtccctagctccgttattcgcaataaatccatccaatttatattttccaactttgacctctcgtccgttccccgcgtgccgtatctcaattccatcccgctggctccgccactccaaatactttattgccatcacactggcgcgatcacaccgctcatttcccttctccggcacaatcgataactgctccgtcaacaaaaacattcccttaaaaatattcatcgcaacccccgcattcgtacaactcctcggtagtgggtcaaatcccttagtaatgtcgttaatcaatatccttcgaaactcaataattgacagcaataaaatctccgtgtcgtttcggcaataatttttcaattcatcatccaaataaaaaggtgtctccttgttttcgttgtacctgaaaaattatttattgttaattttgtccttcttttcttaccatttttcgaattttataaatttatccttgttcatagatcccggcgaatagtcctccatcggtggcagatgttccaatcgtattccataattttctttcttgttgtaataataggggaaaaagggcttgtcctcagagtccaaattaaatgtcgctttcagcgactcaagcttcaccggcatcaataaacatgagtctctccaaatcagctttgaatgtttcttcgagttttgcactttaaattcataaattttcaatccattgatgagcggtagcgggttcttcccggtacggcagaggtaattaaaaacaaaatgacctaaaaatttaggatttaaaaattaaattttgaaattaccgtcaaaacgtccggcgttatgtgcaaatatgtacatatcataattcgtaaaagcagttaaaatccactccacaaaatccttggtcggctcatgtccctccgcctcgctccaatccttgatcctctcctccccacaaattttgcaattcgtcctgtttttgtcatcacagcattccgtacacgtaactctcaccgaaatataattaataacatgctccttctggtcccccttgtaaatagaatcctgcgaagtctccgaatcctggagttaaagacttatttttgttgattttatttgtagaacttacccaaactacaattctgtagacatctttttcctccttctcctcgatcggcataatataacacccccgcttggggtcatggctcacactacaaagctggcaataagtctcaccacattcatgttccttcttcgggttaaataaatatgtcttgtcacagatcacgcaacgcctccataatttgcaagtctgatgtccctgatgataattataacactcccaattgtaaaagtaacggtgacactttgggcattcaatcttcactccactctccttttcacatggcattccccccactctattgcaataataacaccttgcccggcactcgaaagtatgtttgacatccttgtcaaaaaagcactcacaatcaatacaaaattttctcccacgattaaaaaaacagacgtaattcttcagaccatcccagtgaccattctccaaaaatatcggtacgaccttctctcgtcccataggggccttccacaaaacacagatcgatttccgcggatctgcagacttctcaaacgcaacaacccggtactttccggggtaaatctcatcctgaaaaatttattaattttgcattttttcatttaacccacccaatatttctgaacattcggcaattgctccacaccataactaatttcgtttccatcaattccacaattccgtaaaagttcaacagccgcttccttttgtcttgctaagttcttcataaaacgaataaacgaatatttatccataattaaataattcatcgacgacgccagtgcgtaaaaaaggcaaaatttatcagtattcacaatcctaaaatttacttttttttttttttttttttgcctaattaaattatttaaaataaatattttaagtttttttttttttttgtttcattaaaattttttaaaataattattttaaatttattttttactttctttatttttaattttattctgtttttttttgtttcattaaattattattttttcattttttttttctttaaaaaaaattttttttttttgcttcattaaattttttagaaataattattttaaatttatttattgatttttttctattttaattttattttattaaaacacttaccctatccgctggtgttccttgaatccaaagtcaaatttgtggacattcctcggcccctctccactgggcattgtaacgcatgtaattttcatagtaatcggttcagataataaaagcattttcttattttcatccccgtccccgctctgctccagcttattaatctcctccatgataacatccgcattattctgggggtacgcccgatacggcacccacaccgggaaagcaagcccggcacccgtaattgcaactccaaacatccgcacttttcgcttcattttttcttccgtagtctttaaagccacctttatcatgttgtcgatcgcatccttcatcgcttcatcggggcgctccacatccgggttgacacgaaattccgtaatatttttcgtaaatccaaatttttcgcaagttgtcgattggtaatccatcaatttataattttccatttcttcagcaaaattatttctgaacaaaaaaaaaatttttttttttgaaataattcttaaggggtattatcttataattgtatttataattgtttaagaaattatttttttatttaatttattaaaaatcacttacccgattgatcggaaatcccattttttggccattggcacggcgggttggaaggagttcacgcgtttaaaagacattttaaaacaagaaattgaaacagaagaattaaagagagcagagatttgaaaagaaaaagacgggaatttaatagaagatttaattaatgcaaataaaaatagagcggagagaaataaaattagagcgtgaagagagtttaatgaaatccaactatttagttgaatgatttgcgatttgggccgggtgtacggattgggcgagaggggaggggtctagtcacgtgactgtctgggtttgccttaatttagggggtcatcaatcatttcggtagacagctgtctcattttattcaaaaaccgtgcaaaaatcgtttggatattccttatttcgaaagtcatcaatcattttttttttttgacaggtttgcaaaattacgggccatattgcgaaatagttggacccaaaaataatggagacatttaaataagaaaccaatcaatcacattttattgacagctgacctaatttaggggagatattgcgaaataatttgaacaaaaagtcacgtgcagattgagaaataagggaagaaaaataaaaaacccatcaatcaatttttagttgacaggtgacctacttttgaaaaagttttttaatttatttattcattctttgattttacttttaaattggatttaaatagtaattttattgtccaattcataatcaaaattatttgctgccaatatcaattaatttgcacttcttccaaattccgttatcgatttttttttttgcgcgactcggcatcgcggcgcatcggcagggagtgagtggaaatgaaaaaacctcacgattttggctaattttcaaaaagaatttttaatttcaggatcaaaaaatcatcataaaaaaatttcaggattgagaaaataaaacgctaaaaggtttgaaacaaaagattaaaatttgcaaaagttaaattgaatttcctccacctgtcactttggtgacaggtggatgattgatgaccttcccgcggcgctgcgcggcgcgggaaaaaaacacccgcaacaatttgggaaatcggatttggtcaggcggcaacttcaaagtggtccaataggttttggttttgaaacaccccccatcgtggattttttgatggggcggcaacttcaaagggctgcacccctcccataggcacgggctcgtgcgggaaacacccgcaaccaacccgcaaccttttgacgctatatactacttcccccgtccattagtatctgtgactagcgcttcttttaccatttccttttcgcattggcttttttggtggctttgtaatttgtaactgtggatatttgccatcggagagtaacaacaaatattgcttaaccgatttcaattcgattaatgcactttctttcatttgacactcattagtggtctcgagaacaaatgcccaaccgatcacctaaacaatttcgattggtttttacagtaattttacttattttttgcaaataaatagtcgttaccaacctcaaaacaattcactttgttctcaaagcgcatttgtggcaattgctttttgatgttacaatattcgatgcattttataataatttttttggttttgccaccgaaaattattttatgtgccgtcacaatttgtcgcatcgcttccacaattgttaactctttaccacttttttcatcgataaattttggtttgagcgaaattttccccaacaaacgctcatctaaaaataaatttaaaaaacatcgataaaaaattaattattaagtcaccgtctttttttcagaaaatccctaccgatatttctatgctttccattctctaatgcgatacaaaaaatgaaaagccgttcaatagacaagtattgaaattgccattccgctaaggagtccaataaattctttggcactttttccgtaaaagtgccaagttttcgcccatgcttctctgttacgat

SEQ ID NO: 8116 - DNA, 1051 bp, Heterodera glycines
ttcaaaaactaggaacaaaggggtccatctatgccgataggcgccgtctgaaatttttgaaaattttatcaattaattaactgattttgaccaaaaaatgaccaaatgtcacaccttttgacttaattctacaggattaatgtcgatccaatggtgtcgataggcgccgccgggaaatttttttgcaaattctaggtgaaatttgagctgaaaattgaatttattttgattgattttattataaatttattcaaaaattttggcattccgtcttataaaattttcaaagaatgtatgcggatcctgccggatcccgcacaaaaatcaaatttgcggatcctgttgcaggattggaattcaaaattttttgccggaccggatccggccggatctatcctgcaaatcctgcaatcctgcaaatcctgcattttccaaaaaatgcaggattgcggactgggatcctgcaaaatcctgcgcaggatccggtcctgctccgggctctattgtcaactgagcgactaccgccttttttggcattttcaaaaccgggatttttcgttattggttatatcgaattttattcatatttgacatgctatgaaaataatatggaaatttgagatgagaaatttttcaagtttttcattgcgaatttttgatcttgagcgcaaatcccgaatcagtaccgaattccagttcaggcttgaattatgtaatagttaaaaaatcgagctacacaccgctgatgggcaataaaatgtttttaaaacctaattcatttcaataatgagaaaaaaatatcattaaataaaaaaaattaagtctatattttttattatgttttcaatttaagacaaaaattgtttgaaattttttaccttttatgaatattttttatttttaattaatttgttcaccaaaattgcttgattttttatagtgagacgaacgactttcattttttctaagatattttaaattaatattaggttatggccatcctcggggacccacggaatttcacgaaccctgaccttaactacttggatca

SEQ ID NO: 8117 - DNA, 6691 bp, Heterodera glycines
tgatttaatgagcgaaaaaatttttaattgtcaaaattagttttttaacaaatttagcttaaaaaattccggcccgagcatcgaattttatgccggttggcaacttatacaaacaggaacacattggagtaccggtggaggccacaagaagagcgcatcaacgtctatcaagtaattgactaattataatttgattataattaaccaatgaattaattagctcttttagtctattaaaacagaaattctccaaatttaatacaaaaaaaaaaattaattaattggctcttggttaatctattaaaaaggaaactccccacatttaaaataaaaaaaaaaattaattcaataattagtcaattattaattggctctttgttaatttctcaaaataattaattaattagctctttataaatctattaaaacggaaattccaaatttaattaaaaattattaattagtcaattaactaattggctctttgttaatctataaaaataggatttcgctaataattataaaattattaattaattctccctttattaatttattaaaacggaatttttgcaaatttattaaaaaattatttgcatcataggttgagcaatggtatataaatgattgggagcgcatgaacgaattgtacacattccgttttggctacctaaagctggccccaatacgaccaaatgaattgacaactccacaattactgtctgggtaaaaaattaaaaatctaatcagacctaactgttccagagtcaaatttgttcaagattggacaaccagatttagctcaagattaaaggcccaaaattttttcccatatattgagactcattcagagtcaatagaaaggccgagaaatgttatctgagacgaaattttatggaattaatcatttgcttgaactttacttaatttttatttcccaaaattttgaaattaaaatcgggaaatggtttagctttcttaaaaatttcgtgtttaaaaacatattttaaattcttattttagaatggaaatgcatcttttttacaatgtttcgtgtttaagtatttaaaaaggttttttgaatttgaaaatataaataatttaaaatgcactacgatgatcaaaatatttttagtttggtctctgcacccatctcagtgtactgatatgaaaaattgggaaatttgaattttgaattttgtgataatttttgtttaaaaattgtgaaacaataagtagaaaattgtttaattttcgtataagttttcgtgcttagtaattaaaaatatatttgaaattttaaaattttaatagaggaaatgcttgttttattaaaagttttcttgctttatgaataaaaaacttttctggaaatttaatcaaaaatttgtagctttttttaatttcacgatgatgatgaaaatatttttagtttggtcactgcacccatctcattgcattggctgtggacagtaagccaaattaaaaaattttaaacaaatttacatttccagttggacagcccccttttccaaacaacatcattcagtgctcaagaaacgaatactcgtgctgcatttgtggcccaaaaagccaaggaaatgtgccatgattggtaaatattggcactatttcagtttacgcgtctaatatcaatatgactatcctcagtttcttagggcataacttttttcgaacttagtcaaagcatacattcttgtgtattaatcgactgcttaaagtatcgggaatttaaaaatataaaaaaagatttttaatattactacaaagtacactgagaaaaaacaagaaattcaagttttaaaaacagttgcaatgttttttgaggagccatagcacatcaatcccgactctatatctcgttaggaaatgtttgcccgccaaatttttcagattctttctttgaagaccgagagaagcacgattgataaaataatttattcagatttagtctgggtatttaataatcatattttcacaaagattaatttttgtcatttaattttagactaaaatttaataatacaaagaatttgaggctttcgtttgataccatgaatgtaggcattgaccaagtaaaaagaagaaactaagtatggtttttgattggtcacgtaaattgtgaaaaagccaaaatacttttgcgttttcaacaaaaaataaatcatataaaattcccgccaatttttgaaggtatgatgaagatggtgctcaatggaattttattcgtgatgtggaaacaaatgcttcatgtccatgcacagaaaaacagataattatttaatcacgcataattaaatttgtcgataatatatttaaattaaaaagataacccatcaagttttaggctaaacttgacttgggccgttttatgcctcatccccgctgctcccaagaatttcggtaaatttttcccgctttcaaattcttgactttaatttggtctatcgtatttgtccggattaataattaattttattaaagggatattacatgctccgagatgatcggtgccaaaaattgttacatgagcgcccaaaatgtgtacggctcttacacgggcaaagccgattggcaatggcaggtccataatttttaaattttgcgaaaataaaatgtattaatgttaaaaattgattttccccagactttcggggatagaagatgtggaatcggggataaaaattaccgaataatttttttttgggatggcttaaaaattttgaaaaaaaactcacttagaaaatttcatttcttttatactaaatacaaccagacaatctaataaatcccaagcatttaatattattgatattaattctcctaaatttatttgataaaaaaaatcaaaaagtttgtcaaactgatcaaattcaccagcaaaaaactgatcaagacggaataataagggcaaatttatggctaaataaaatgagaaaaataatctctaaaattgacattaatattatttttatttttttatttaatattattcaaaaatgcaattaaacaaattgaggcaagcaaaacaaagcaagaaaaaagttttaatgaaatatttggccaaagatgaaacgatggaaaagaagaaaatctttgccaaattggtcaaataattcatggagaaacagttgatcagaataacgtattaggtcaaaatgaccaacaatttgatcaaattttggatgaaaatttggaagtgaaagaagaggaggaaagtgaagaaatgtcacaaattgtgaagaatcggaacaatttgcagaaaatagtggacaaatttgtgaaactttagatgataagaagaaaagagaaattattaaaaattgcataaaattaaagaaaaaattaagcaaatgggaaagaaacattcagaaaaagaacggaagaaaattgaaagaaaaatagtcaaaaaaattgggtgtcagttacgccaaaatttacaaatggaaaagagaatttggactgatcagaaatttgaattcggatcaggaaaaagataaaatattaaaacagtttgatcaaatctatggcaaaagtaaaaataaattaaaagaaaaattggaaggaaaaagcacaaaatataaaaaaataaaattattttaaagcaaaaaatgaatttataggaaatggaaaacactcagcgaaggaatggaaagaatttcaatcaaaaattatacaaaaattttgcgtgagttttttgacgattgaaagatgggccaagaaattaaaaatcaaaaaaatgtatcaaaaggtttgattcattaaaaattatctttacagagggaaaagtgttaacaaaatttgaagtgttatctgaaaaatgttatttttttcatggtactatgaccataattttgttcctgctttgttgattttttgtgttaaatatttgaatttatggcgaaatgccgaaagattaaaatacgaaaatttttttgtattgactcttaattgtgaaaataagacattttgggaaaacctaaagttcttcctcgatgctcgaggagtgaaggtcgaagatgaggaagaaatttccagtcaaatttgtccggaattctgggaaattgaaaatgttatggagtaacatacctttttaggggagaaaatttcataaaagtcttaaaaaataaaaaataaaattctgaagcaaaaaatccatagaaacgtgaatattctcagagtgcaaatgacgatttcgcaatttgccggatgtggaggaaccccctaataaaacctattaacaaatcacatgcttatctgaaccgcccgccagacccttacttttcataaaatttaaaaaagtaataaaaaaattaatcgtcaaaattttcctttcttaattttttagggcttatatctctaatatggatgacagttaaattcttaatctaaccaggatagttattatttcaaaacctaataataagtcaagttttaacattcgataatttttttgtatatttaacgattaaattttagatttttttctttaaaaacctgatcctggccagaatctatgtcaatattttgggaccttgattcaggatctcgaaaaaaaagtttaatcctgaaaccatgtcccaagcgaccggaatttctcaaaattctgggcccctattaacattttatttactgatagatgtcatcaaaataattaattacagttagctgaccttgttttcgttagaattttttttgatttgctggaaaaatttgttcaaaattttaaaattttgactctttccccatgtcgtcggcgatctccctccaccccttcaccaacctctttttacacctgtcccctaacccaatgggaatggggctccatttgggcctcttttcgggcccaaaccacataaaataaacaattcaatttaagatttaaatcaaagcttgaagattttttcagaatagaacttagaaatttcttttttgtctcataaatttcctgaatttttttacagtacaaccaaggctggggtggtgctgcatatacaactggtgctggtggtacgctgaatcgagaagggctcagagcaggggaggaaggcggacaaaagtgagaaaaatgttaaaaaacaataattttattgcaaaaaatttttaaaataaatttttataataaattaataattttatattaagaatttagtttaaaatttagtatattattatatttgtttaaataattgcagggagcttttaaaacaaatttccaatttaaaataatttgacagtttacagttaataaatatttattattttttcatttttttttactacaataaataatttcagataaaattttataaattaccaattattaaaaaaaattaattaacagccgatttgccacccattatggccaagtgtgctgctatgaccaggagggctatttgcaacagaccacctaccagccgaccctgaaagtgatcgaccaaatgttctacaatccgggatttccgctacgggcctatgagttcggctcctacccatatttgggccaattcgaagtgccgggtacacaaaaattttttactgcacttcgcactaataacctgagcactctaaaatattatcctggaaatccagtctttcgtgccttacctggacctggagtttttcatgtttgaccaggacctggatttcctgaagaaaaatcccggaaaatccaggcccatgaaaataccaggttgccgaaaaatggcctggacgaactctaataatattagttgtttttgttttaattaaaatgaatttaatttgcttcattaatttaaccaaaaatttcgaaacacaaattaaaataattcttttttttaattgtattcttaaaattaggcttgtcctcattccaccatgactatatgccttaccatttgtgttgcaaattttctaaattccgttgccaactgttttattggcgaaggccaagcagcggctgtcagcaatatcagccgccggctgtcggtaaaaataaatttataaatttgcaaacaaaaatattaattttattcattttaaatactaaaataattatataaatatttaaaattgctgattaaaatatattaaattataaaattaaattaaattttaaaattactaatttaaataaggctttgcactcggcgccggcacatttcacaccattgacaatcaaaaattcattttctcggagcccggcgtgtacacattgctgtacatcccgaaaaccatccataaccctgaggtgcgcatccaagtgcgtcttgaacggtacccaaatcgacgcatcgatttcagtgagaccatttgatgaaaattaaattaaaaaacgattaatatgcatgatattaaatattgaaaatagttaaagcatttagatttaaatattattttcttaaatcattaaaattttataattttgttaggtttatgaaaatcgaaaaatattttaaattataattttttagatgaaaaaaacacggaaattattattttattattattattataaaagacgaatgcttaaaaaatttgtataaatttggttgtaaattcgctattttgtcaaaaatgctaaaaaaaaaatggccggccatttttcggcatttcattctttgtacgggtgacttttattcaacccattttaacatgcatagagtaaatttttttttgtgactctaga

SEQ ID NO: 8118 - DNA, 3503 bp, Heterodera glycines
tgccttttgcccgcccccttcgaaaattgtctatttaagcgttcccggccaaggggtcgtgctcttcctccttttcttccgcttcattcattgccaagggatctgtcccttcgcttcattttcggtctgcctgtgaccaattcctccaacttggaggactcggaaaggagggaaaagcaccctccacactccatcacattcggcaaattctcgtgcggggccaaacggaggcgcccattcccgtcttgacccctccctttcccgacagcgccctcgtcgttctcccccaatcctcccgatcccaattcatttccttttggcattggagaatccgggaattggcccggagcatcagcgaatttcaagcagttcagactcccgcagcggagtctcgcggatcggtataagtctcccgccagccggagcaaccgttgggacggggcgaattcccgtcgtcgacgaatccaagcagggtagtgaaggaaggaagagccgagcggtgccaaatcgtccgacgaaaggacaggccgttcgtcagcgcaacccccaccagccggggaagcgcgcatcgatcaaaacggactcccaccagtcggagtgtccgccgcagtaaacgggagtcgaaacccgtgttcggcaagtcaaaggggtccgacaagcccttctcccaaaccttgtcggtggtgccgttaagcaagcagcaaatcgctgcacaattccctcaagcaccagtccaactttgtcacccctccccctcccattctcgtccccctttggcgctgatcggatcggtcagcagcatcagacccatcagagcgaacggcaaaaggggcgcaattccctttgcggcacagcgagcggagtgagcagagataaaagggacgagagcggtgaagaggagcgggaaccaatcccgcctcagctgggccaagccgcatttggccaaaccccgcccgagtaaagattggcgacaacaagtgtgtaaagaaatcgccgaaattttgaaggtttttctggaaatcttttggaaattttgacagctaaatcaaaaataaataaataataaggggaaaagcggggaatttttgtaataaaaaaataaataaatgtgaaatattcgcattttgctttgccttttattccgattttttattaacattttctaaaaattgattttgtaacaaaaaagggaaggtccccgggtgtccgtgggatttccgaatgaaatttggtgggtggatagagcacccatgggttcttaagaaaagtgtttttattttctgcgaaatgagtctgagtaccgagatatgacgtgccaaactttttttatcgcaataaattaaataaatatttgcatttttttgtgctgcttggtggtgcggaggttgtgctccggccttacctttttgccctcgcaggttcgattccctcttatgaatatttattttccccttttaatccttgcattttatgcaaattaacggccatttaaatcaattccattcggccaaaaatttttattccttctttttcattcaattttattcattttcacacaaatggtaatcattaaaaaaatggttaaagcataaatataattcacaataagcacaccgtaataaaataaaacattcacaaaatttcatttggaaatcccacggacacctggggaccttcctttgtgaggccactgaccgaccagccgctgaaattgaatgatttcgtgtgattatcgaattacacaaattccaaatttgaacagtccccaaaaggaccagtaagtggtttgacttttgtctaattatagattattggatcagtcgggatgataggtcatgcaaattttgtcggacagccaaaatttataataaaaaaaaaatttcgccgaaattggcatttgccccaaatgccaatttcgcctctgtctgccaattttcggctggtggtcagtcggcaattaaatattcgacgagtgactgcgcagaattgggaatggaatggacggtcattttcggtagcgcgccgcggggcgggtggagaaaacgcgtaaataaataaaagaaaataaaattgatgactttcgccgggggggggggggaatgggataaattgataaattgcgaattgacacgaaaaacggagaatttgtaaggcaatttatattttgaaaaataggaaaatgataaaacaattttaaaaatgtgattttagggcgataaaagtgccagaaattgttcagtaacttcattttttcctcaaagatctcaggaaaaatagggaaaaccgaaattgcagcctaactataaaaaatgaaactcaaaattttatgagacttaaagaaaatggcattgttggcagatttattttagtgaatacggtcgtttgtactgtacatcaattaccagcagacggtacggtatctgttgctggttttaacagaaagagaatgagtcagtcagacagtgctcaacaatttaaaaagcgattagaattttttttaagtgtcaaaaaatgggaatccgataaataatgaaatgacgcattgattgattgattggattggttgatgatcgatcacttcccctccgggggcatccgtcattgcttctgcgtgctgatgtacagcacgttgttgccccggatgaacgcgtccccgtacttggccttcagctgtccgccatggtactcctccgtctgttccagcgcaatgttcatgaagccgtccaggcaggagagaatgcctgcaaagttgtacattgagtgaaaaatcagctaggtaaagaagtgcctaattgatcaaaaggcatattttattggcccgaggcaaaatgaggcactctcagttttttttttcttcagtcgaataccattccaagtgttcgaattgggacaaaggcgtgaaaaagcaaagttgcgggattaaaattaaatttttggattccatttttttggattagggactcggaattaattggcaacttatcaatttttacgggtgaaatttttttttgccgtaccaaatattgaatcatgaaagcaacaagaccgaatattgacgactcgtcccgagacccaaaaacactgactattccaaactcaaaactctttcgacaatctctgatgaatagtcccctccaaatgcccacgaaatccaaaacggaccccgataatcggcacccgaattgagcttcaccaccaccggtttgccgacaattttcttcaaaaattcgctgggcgtttgtcgtctgctgttggtcgccaatgtcgttggtgcactcattttataacgcgcgcaaaaaacgctatttttttaaattttacataaattttgacagatataatatcatgacacatcatccatcagagcattttttgtgttaaaattggcacataaaatttcttcacaaatgttttatcctcaaaaaaaaacatggagaacacttttgcatgttgaattaattgtttatgtcaaacagcagagcaaatcgttggttgattgtcct

SEQ ID NO: 8119 - DNA, 2802 bp, Heterodera glycines
ggtaatcattttacaaaaggttaaagcatatatataattctcaataagcactccgtaataaaataaaattttcacaatttaatttttgacatatgtcatttttcggcacttcaaagcaaaatttaacaggatgacaaaaatttggcaaaggctcgtccccgtaatacccgacttttctccaggcaaaattaatccatccattaaaacgttcggcttgaaactggttatggattaacgattgtaatttaataatgttatccctgacgtgcaaatttattttcacatcataaatcattacaaattccgttatttttctggtaaattgcttaaattctaaaactattttttttatttttggcaacaaaactaccggaaaatgtaaacatccaatggttggcatattccagggattaaaaggggaaaataaattttcataagagggaatcgaacctgcgagggcaaaaaggtaaggccggagcacaacctccgcaccaccaagcagcacaaaaaaatgcaaatatttatttaatttattgcgataaaaaaagtttggcacgtcatatctcggcactcagactcatttcgcagaaaataaaaacacttttcttaagaacccatgggtgctctatccacccaccaaatttcattcggaaatcccacggacacccggggaccttcctttgtaagcataatgctgatttaatgctatttaattgctttttaaccacataaatgccaatttaatgcttaaccttttttaaaattgattttgaccagggttttttttaaaagttcttatttaaaaaaaaattctttatagtgccgaatttactcaatgtccaaatcagggctgggcgaagctcggtttggcactcgaagccgaagttcgaaacgaagcccaaaaattttccggggatcacaaaacagaaaagaaccttccttattcactacggcagatcaatcaatcacatgccaattgacaccaatttatgttgctgggaatattcataaatataaaattctagaaaaatgcatattaacaatgttgtatcgttatataatgcatgtgtctattggagattgattacaaattttatttcttaaaaatgtcggaatatggaaatatattcgaaattatttttgcgaaaatacaaaaaattgtcaatttttggcacttaattcatccgcctctgagcacttaggctgtcaaaaatatgttcaaaaattgatcaaaattttgagatgtaatttggtttgcagttgtgaagctcgaatttgatataatttggaattttaaaattttaaatccatttttagcagttttagtgtcttttttaagtctgtttaagcaaatattgaatattaacacactttttaaccaatttactaaaaaataaaaaaatttgcaaacaaaactttttaattatgagccgacaattaaaagcatttctcttcggatttggaatattttagctgttgtggtgattaaaatattataagtggtctttgttcggcatttgctctttggatgccataaaatttaactgatgagtttttggaataaccctaaaaatcaaaagatgaatgaatgtgcgattagtagggatgggaattttatgtaagaaaaatcgcgaaatatgtaaataaaatatgcataaaaaatgttaaaatatgtatggaatatgtataaaaaaccccaaatatgtactaaaatatgtaaattaaatttttaaatgttattttttggaaaaaattcctcgtaaaggctgaaataggcacaaaatgccataaaaatgacttaaataggcttagaatcaccttttaaaaattactttttggtatatttcaggggtacatttcaaaattattttttcactataattttcaaacattttctaaatatgtaaaaataaaaattttgccgaaattttggatttatttttgaggaatttccaagaattttcgtaaaaaatcctcaaaatatgaaaaaataaaaatatataagaaaaaaaatagtaccaaatatgtaataaaatcccgaaatatgtataaaaactccgaaatacgtaaaaatatgtaaataaaagtcccaatttttgttacaagcacaaaaaagaaagtggttttcctcctatttagagccaaggagaaatcaggaaaaaaatatttatttacataaaattgacaatcctattgatcagtagggataccttttttgcacaaaaatcagggaataggcacctaaaaaacgcagaaaaaaaaaaccgaaaaatatttttttcgaaaatcctaaaaagtattaagagcgctgaaattttaggcatctgtctacaaaaggaatccctaatgatcaggatgaggaaaaaataaattaagaatgccattgaaacgcaagttttgatacatatgatcatccattctttaagcttcattcataagcaaaaacagggtttacattactgttttcatcattacggatcaaaaaaaaattatggtagcattcatgttaaatttcaaatttatctgaaaattgttttcgaatttttaatcaaacaattttgagaaagatgaaagtacagaaaagaggaacgaaagaaagcgaaacagagaaagagagagaaagaaaaagaaagcggaaaaacattttaaaaagtaccgacaaagggaaacaaagcaaaaagaaatagtgattaataaacaaatctctgatcagaggaagggaaaaataaattaagcgtgcaaattgaaacgataaatcacataaatgaaaacaattgcaatggcaaccataataaaaacaca

SEQ ID NO: 8120 - DNA, 4269 bp, Heterodera glycines
cccccaataaattccaacaaaatttttcggcacaaatgaagcgcgttaaattggctttttgagaatttggaggagaaattggttgtgttcgttggtccgtttgatgccccgcctccgccaaattctcaccccgaatttcactttttacccctttccaatatgattggtggcggtgacggcgcgatgattaccccctccccgccccgggccgccgcccccttccgccgctgactgatcagttagctgttggtccgcctccgcaccgccgattggtgaccaaacacaaattccaaatgagacacagccaccaccgcattccgccaattcattcatcccaatccgccaaccgtttcggccagcggcgatgacagtttttttttgttttgtttctgtccggctttttcttcgcacttgttccgttccaatgtttgaaatttttcccccaaaaatgcgtcgaaacgaaatatcttatgccctcctgtttctcgctgttctcgcggtttttcgagtctcggcctctgtttgagtttcccataatctccaattcgtggttcattcacagttgttaaacaaccaatttcttccaactttccaaatcagcgggactcaattggcctgtgcccaattgtaccaccaccatttgcaatctgttcatttgtcaactgtttccgcttttactgagagcgccataaactcgcgcggtgatttatgttcaacctctcatctctctctctctctctctctctccgatcactttgtgtgattttcattttccgatcacttcccttcgtttatctctctgatcactttgtgtgattttcgttttccgaccatttcacttatttttatcgcttttaaatggtggaatctggggcatcatccttccgccaaatcgcgcagcagcagttggaagaaaacaatggaaattttctgcgctcattttgctgcgcgaaattttagttcaaattatcggcataccccaaattaatttgatttcattttcttttatcagtaaaaatttttctgtcatttattttttcagtttttcttactgtatgtttttttttgtagcgcaagtaccgtaaccaaacaaaaaagcgtaccatcaattgactggttgtttctaatatcaaatgatccgaggtataataatagtaaagccctattagcaaaagtatctgatcaatttcaaataaccaaaacatgcccaagcaaaatcccttaattatgggtaattaacaaatattcgatcaaaatctagcaaatctatcaacagatcagagatatacaagagtaaagttaattttaatcgcctgtttaaatagattttcataatttttaaagattttccgttttttaattgagagttttcgaaattttaatcctttgaattgtccaagccttgaccccattaataaaacatgcccgagctaaatcccttaattatgggtaattaacaaagaaattttcgatcaaaatgttgcaaatcccttaattagtgtaaaagcgcctcaaattaactgctgctctccgcaaaaagcggtcactagcatcacagtgcaattagtagaagaatgtcagtgcaaaaagcagcacatttcaatttctgtatcaaattattcacactttagcaccgtaaagcactagcaaattactccatcactccaccattttcattttttttgggggggttgggattgatcacaaaataaatccagaaatttgcgaaatcccaaaaatgtcatcagagtcatggcatccccttgggggtgggcactgctggccgggacaaacaggatggaaagtggtggaaaagcatgctttttaaaagtggtcgccgggattgggatttgggtgggaacgggtgagtcccactttaagaaatgctttaacgcgcacccatttgggacatcccaaaaatgtcatcagagttatggcatcccctcgggggtgaagcatgcttttaaaaatggtcgccgggatttggggggggggacgggtgagtcccgctttaacgaatgcttcaacgcgcacccaataatagcaacaccctgatcatgagcatcttcatcacatcaccatcatccgtcataaccccatcatcgtcatcaatgtgtaaaatgggagagacgaatccaaatttgtcctttgccctgcccccctccggcgcacattaattaatgcatttcattaaatttcatttttttttgtgacagcagcaagcacagctggtagtaggaagacaaatgaattgatgcgcaaaacatgctcaaaactgacgctccccccacccccaagttttaagcataattcacattttgatcatgctaatgcatgcgctcgcccatctccgtgttgttgaccatcagacaggacagggcaggaactgattaatgaattacatatatcattttttagggtttgacattacgcacagtcataattttatcaaatatttcatcaaaataatttaacccccccccccctatttttttttgtttaaattagagtaatgaagcttttttttaaataaaaatcggaaccgaaaaaaaacactaagaattcggggtcaacccaagtcttatcctattcttgtttaattatttaaattccccctattttttaaaattagggtagtgaggcttttaaaaaaaataaaaattgggaccgttaaaaaactaagaattcgggaccagcccccctgtcgaaatcccctgtccaatcctattcttgtttaattttagtttaattaaggtagtgaggccttttaaaaaaaaaccggaacaaaaaaaactaagaattcggggtcatccatcccctgtgggatccatcctatcctagtttaaattatttaaataaatttttgcacacaaaaaacggctgtagaaatttttcggacaaacatattggataagagcagaataaatatattgttaatttcttgtccacattaacattattgcttacaaattagcttgcacaaactcccgccacctcaggggccgatcaaaaaggattgctgactcatcagcatcactttgtttcgtcattagtccccacaagtcttgggtgggatgatcgagaaaatggggatgtgattagcataatgctataattatcgaatcgcgcaaatcctctccattcccgcccgctttctccccacttttatataatcatctcaatttcccattttttttatccctctgctgatggtaaaagtaataaaagcttaccttatttatttcttgatgagtttcctgaaaataatcaaatttctaatcagaaactgtcactggtaaaattctgattacattcccaaaaaatgatcaaaatgtttgccgtatttattgtttcttgatcagttttcctgaaagtgatcaaatttctaatcagaaactgtcactggtaaaattctgattacatcccatagaaaaaagtgatcaaaatgctgatcagggcactaaaaattttgtttctgatcattcttccatctctctcctttgattacattccaataaaaagtggtcaaaatgctgatcagggcaaaataaccatttgtttctaatcattctccctcatctttctccaaaatcactctaacagcatatactgaaactgtttaaagccgaaatatggctaaactagcagcacaccactcttttcctgtcttgtccatcaattcatgcttttcctgttccgatcgccattaatttggcggtttattttggatggaccaaatccaataattacgccacagtttggagccgccatattcaaacagtgttggaatggtggaacatcaggtttcatcacccaaccgaatcagcaacaaaatggggatgattaatgatgataatgactgactgattatcgtccaaatttgttatccaaaaaaaagtggcgcaaaatggggacagcccaatccccggttttgatcagcagagcagagcgatcgcctttaaaaggcactgaccgattggttggttagttgattggaaagccttcaaaaatggcgttatatacagtaaaaaaccatcaaatcaatctaattattaaacatatatggtagtgaaatataaaaaaatccaccaaggcatactgtattattggcaacaaatactgtacaaaataataatggtaaacagtttttgttttaaaacaatctatttatacaatattaacaataccataaaaaaagttttattgaaataaacaaaaaatttaatttaactaattaaaattttttatttaaatagaatataaaatatt

SEQ ID NO: 8121 - DNA, 5218 bp, Heterodera glycines
  misc_feature (3549)..(3549): n is a, c, g, or t
  misc_feature (3554)..(3554): n is a, c, g, or t
  misc_feature (3665)..(3665): n is a, c, g, or t
  misc_feature (3803)..(3803): n is a, c, g, or t
tttttatactttcagacaaaatgacgtgcacgacttggacagccgcaccaatacgttgccgtcgtcctgcaaaaattccgaccgtgagcacattctgctccagcttttgctaaagctcgttgttggtcagcgaccggaaatacaaaaggtgtggcattttttcaaattaatgactccatttccacggcattacttcttttggtgtagcaaattcccctcccaacatttcagggcaacctatttctccgtcataaacaagtgcgtttcgtccgtggcttttggcgacactgcgcttgaccaggacaccgaaaagcaaaacgttttcaccggcggcgatttgggtgtgtttttatgaattcgtaatcgaagagtttatcgtaaaaatacatccattttagatgacgagtttgacaagatggagcgggacgacggcatcaaacggctgaacaaacgtctcgattccgcggtggaggagaagcaggaagcggtgtcactgcaaatcaaatattacgagaagctcaaggagttgcaacacgagtgttcggaattgcgaaaagttgtgcgttttaattccatcgaaagagagtaattttatagggcaaacattttcatggcttttgtgccatgagatttaagtcaatgtgcccaaaatgtttaaaattttccaatttttattaaacaaaattgcaggcgccctccggacgcgcattgcccccggccaccgttttggacttgcccctgccgaaagaattgggcaaaattgtcaacgggacacaaaagcatggaatagcagcaggcgcagcatttcccacggggccaggctgtcctcctccgccgcctccaccaccgccacctccggcactgcttatgccggaccataaacggaacaaattggtaacggcggctggtggttctgtcccaccgcctcctccgccgccgcctccaccgtcggcgctgaggccgggcgggggcggccctccgatgccaccgccgcctccgcctgggtttggtacgcctccaaccgcatttctgcatgccgcctcgccggagctgcccgactacttgaagaagaagtccggcaaccagccggaggtgccaatgaagaagcttccgtggaatgcggcaattgttgggccaaaatttataaattcatttcgtatttttcgcaaacaaattaattactctttcactgccaacagattcgaccaaacgcgctgaacaagaactcgctgtgggcacagattgacgagaaggaagtggcatcggaggatgtgttcgactttttgaaggccaaattctcagccaccgggtcggttgaatggaagtggatggcattttataattctttttgcagacgaatgaattgccttccaatgaatttggccaaaagaccgccgtcgaaggcaaaaactccgttggtcattcaggacgcgaaaatgttgcaagctttgggttcgttcgttcatatcgcaaaatacaataatttttggaataaaacccgcaatttttggtatattttataaatttctttgacttcccaaaaaacttgtttcagcaattctgcaaggctcttgcaaactgagtttcaaacggtggcgaaatgcaattttggaggtggacgagaaagcgctcaatgccgaacttgtggacaaattgaagagcgcactgcccccgttggaaatgatcaatcggctgaaaaagtgcacggatgacgaaatgcagaggatgccagaaggggaacaggtgaacaaattggacactaaaacagcgatttttttgaaaaaactgtaattcgccaaaaatttcattctaaattttctttcctcgtcgtcagtttgtcgccaccctttcgtccatcagtggtttgccgctgcgtctggaggccatccatctcaaattgtgttggtccgaagcctttggagaacttaaatcgggcataacgacggtgaccgaggcgtgcgaagtcggcacaaatttcatttttatttatccaaaaaattttttaaggaattgctcaaatcccaagggctcaaacacttcatcaacttggtccttttggttggaaatttcatgggacgcacaaaaaactcaaaggacgccttcgcatttgaactaagcgtactcaacaaagtgcggttgttatatgtgtggcactttctcttatttttggatagtttctgttccaatttgagtttttgcttcatatttatccccattttgggtttattttctttcggttttttctaaattttaattccattctttagctggtcgacacgcgtgactgtgacaattccgaaacccttctccacggactcatccgtcttctgcaccggaaattcagcggaaaattcaccacttttgcactggacgactttcaccacgtttccaaggcgtgccgagtggacgtgtccgagttgagcaaaaacaaaattgaccaagtcaggaattccattgagaaggcatgtttttggattttatttattttttctttattttatttcattttctacttttaggtggccacgtatttaagcggctacaaaatgcaggcggaaaacgaccgatttaatgagagaatcggtgcatttgtcaaacaagcgaaggaagatttggtcactgttgacagtctatgggaaaatatgcagcgaaaatggagcgccgtccaagcgtatttgtgctttgacccgaaaaagtacgccatggaccgactgtttgcggacgtacacacattcaaggggcattaccaggtgatttgatgggattgttatgcatttttacattgccgggatccatgcctaatgaatttataaagttttactggaattactaaattagacaaagtttaaaaaattatttttttcgttataacattttgaatttttttattgttattctttatttttgaagttttttaaaataaaatttgatttaaaaaatagaaaagaaattagtttcaaaattttaatatatttattttttgaaaactcagcgacaaattaaaaaaaaattttaaaataaacgagagaaaagacggcttttctgggacatcttagtgcacacgacaaagtcattgaccgtttccacccttttcagaatgccagggcagaagtgttgaaggatcagctgaaaggggcggtcgacggaagagagggggcgaaagcgtcgtcgaggaaaccgttcaaaccgatccaaccgatcgcaagcgaagcggcgaagagagcgcaacagcggaacagcaccagcagccgcagggagttgctgttgtcgaacgaaggcggcggcggtggttcaacagcgacaacgcccgcccgaccacaggcaaccaaaattggtacaacgccaaacacggtgccatttggcgcgaaggatgctgccggcggcggcgacggaggcgtcattgacaaaattgagcagatgttggaggagggcatgtaccgaatcgagtgccaaaagaggcctttccgtgttcggcgaaggtgtggcgcgagtggttggcatacattaaaaaagggcgggagggtcgacagaaatttttgcaaaagctgngttgnggtgagatggctggccacctttttcgatttttcacctcaatttttaatgagaatttgtcagttttgggggccggagtgccgataggcgccgaaaattctgtaattttttanactgtttggtctttccagggacagccgactgtgtatgtgagcgttgctgacggcggtaataacgcgactccaacaacaacagcggcgggtgataatttaccattagctagcttgattcttttttatccaccactctanaccagatagtgtgaagaagccagtggtgaatgttgtcgttgctgaccaagaagagcgggatgatgatgccatgccaaaggtggggttatcaggcaaaattaaaggctgtagttgcactgggactttcggaaaataagaagaccaacgctgtacctctagaccaattttattgtttgaaatttttcaaaaatagccctagaaattttttaaagaaatttcaagaaaaaaaattttcaaaaatttttgtgctatttattgggaaattaaaaatagtatttatcaaaaacttttgaaaaaatcgttaaaattttttcaaatttttaagttggattttttattttctggggatggggcgggggggggaagttttaaggggaaccgcccattttggcgcaggtattttggtgcaacccaatttataacgtgcgcaaaaatggccgcgccaaaatacctgcgtcaaagtgaccccgacccgttttaagtgtacccgtccatgagccctcccgcttgtgctcatctattaaaaatcattccccattatttgtgccccagaaagctgtcgtgaacgagtacctgaatgtgcccagcagtgtggatttgttgctgcgtttgcggggattggacggcgattgatgaggcgcgcgcccctccccccaccggcggcctttctctttttgacttttgtgcctcccttttgcccgtgttctaatgtatttcttcctgctggctttctctcctcctctctttcacttttttgttttgttttgtgtgtgtcttacaatattttcctcattttctctgcccttccgtgggcttctcattttggcatatatttcccctggtttgatcttttttgtccttttcgccgatcggcagctttttcttccaaaataagcagaaatttgcttaggtttcattcattattaataattacggcgatcaatcatcattgtatttcccttccacgtcaatcatttcacttattacacatttcgactgtttgcctttctctcattccgtcaaatttcactctcttttttcgatatttaaagattacaatatttcattccgtcgttgccaccaaattttcccagaatttgtgatgattgtgattgatccatccaaagcaatgcttcgcttcaacaaatgtttgtttttgccaaacattttttctctccttttgattgtgtattgatgtgtcaccatttttatgtgccgccgacaaaattgccggacatttttactattttggtgtcgttttacgagtaatataaaacaatatggagcgaaaattcgtatggaaaaagaaacttgagttgcttttgtcacaatttcatctcttatcaaattttttgaacatgtatggacataccatatacaacagcagcaacaacaacaataggccaacatgaact

SEQ ID NO: 8122 - DNA, 1229 bp, Heterodera glycines
  misc_feature (18)..(18): n is a, c, g, or t
  misc_feature (124)..(124): n is a, c, g, or t
gaaaaataatcattacgnttccaaaagataaggatatacaaaactcgtgaaatagaccttgaaaagggatataaattttccaaattaggcgataaatttatttcttcaattttgcgaaacgacntaaaatgcgacaaatttttgtttatttttcatacaattaacaaaaaaattatggtgtttttttcttgagaatttttcggtctttggggaatcataaaataattcagctggtgtaggccgttataatagacgtttttttgaaaaaataccaaaaaagtatatagaactccatcctaaaccctacgcttttcaggcctcacagttttcccctttaggcaaaaaaagtttttttttgacagctatttcgagagagattcggatgaggaggaagaggcgaggaaagtggaaaaaggggaagagagcggccgaagacacgcgaaaagcagcgacagaaacggcggcagacaaagacaggacggcaaaaagatcagaagggaggaagaaaaacaaacggcggaggaggaggaggaagaagaagaggacccgttggacgcgttcatgaacgaaatcaacgaagtggcggaccaggcgaaggaggagagtctgcgcaaagagagccacgcgctgaacacgggcgaatacgcgggcggacagatgggaagggacgacatcgaacaggaggacatgcacggtcagctgactgactgatcgaacagaacaccctcccgagaaaccgggaatgaaaaaacctttttgagggaaatttagaaaaattcgaagtatagctcctagtaggggcaggacataacgtcgccgccgaaacgtcgccgcaaattttttttataaaaaatgaaaaatttttagttgcctaacctaattcgaaaaaaaaattagtttaagaaacaaaaaaatcaagtttgttttctgggaattcagcaaaatattgttttcagtaaaacctaggtttccaaaaaagctttaaaaaattttaaacgaattttacggctggcgacgtttcggggtgtacctctcctagtcagcaccgaaaccccaatttcttttggattttcaagtttaatcccataacaaaaaactatctactattgaaaatgattattttaatttaaattaacaaaataacccccatgcgcatccgtttatttttgactgatttctaaatttttcagagtcaatgatgaggttggtcatatcattttcgcaacctt

SEQ ID NO: 8123 - DNA, 2518 bp, Heterodera glycines
taaaagtaaataacggaaattcgctaatgtttccttgtgaatttctttatcagtttaattgtagttttttgaaaagagatggctgtttaaataaatgttcaaaaaacaataaatattcatgtacggagccattcgtacaactcatttgtaataattaattaattaattattcgggactttatttatttcataagaataaaaattgtttgttgttcaaataattttccttttttcttacattttgcaatttctttgataatgaaaacaaatccaaattaaataaaattaattgttactacagaatatgttatacataattttaatttatgaaataaaaaaatatgaaattcaatattgatatttcaaattttaatttttgaaaataaaacttagcgaattttttgaatttttgcaggtagaaaacacttagtgctatttaatgatattaagaatacttaattttgttgattttatgaaaatcttcatcagaattttagtgatcaaaattatttgatttctaattaaaaaattttaaatataaattgtttaaaaaataaaaaataaattattttaattgtgttttcctaatcgtttttatagtctagtgttgtgctcactttgatagaaatttataggttgaaatttttaaattaaatcagtctataagtttagaaatggcaccaattggcgatcggcgccaaaactcggtaataaatagaatataaacataagcactgggactcgaacccatgacacacatagcagaaaaggctgacacactaaccaattgaccaccgggtcgcttgtctccatcccatttatggtaattcccttttccctttctttattttttggaaaaaatcccgaccaaaagtgcttgaaatccctttttagagctcttcccggacccggaccaaaacaaccctggtatcattcgaaagccaagagtttgtagatgtgcataaacatatttgttttttgaattgacccgttttaagacatgcaaaaagcgttcaaaaattggtcatcaaaaaaagtgcaatttttgcctcgtttttcgaacgcagttcgaacaattcttaaccaataggaatgtgcttattttccctaatagcccttgaaaaactgcgtcgatagacaccactcgcgccccgcaaactcgctagaaagtgttaaattagtttttaaatgagttagaggggtagattcttcttatatagtgaaaaatattagacaattttttgcacaaattgttttgcagaatgaatcattttttgaagttaaacggatgaattaatggcatttattaaaacaaaattaaacaaaactttacacaatattatgcacaaattgacaattgttttgttggtctttctgagtgccaaatcacttccgtccccacaaattgtcgaaaagagtgccgcgattgttggccatcgaaattgggtcggcgtaataccattggggacgagcattggccggtgaagaaaggtgcagcaaagtgagcagaagcagcagcaaaacgatgggggaaaattggacggaaatcattttgtagaaaataaaataattaattaattaattatttgtgggaatttaaatgaatttgttgctgtttttgttgctgatgatgatttgaatttgagtttgaatttgtcactttgacctgcccttttatagggtgcgcaattggaaaggcacaaaacacagaagagacacaaaaataaaggcggggaggaagaaaagattaaattaaattttatattttgtgcttttcgctgcatttccaaattcgttttggtgcctttggttataattggaacacaaattctgtctaattcatttttgtgttctaacaaaccaaattaagtaaattgagctaattagatgaaaaatgagacaattaaaacgaataaaatcttcatcaaatccgactattgaaaattattcagaagtacagtgttgtacgggaccgggacctggtactgaaaaacacgggtaataaatccgttccctggttctaacaaatcacataattttcttcttaatttcttttgtactttagagcaagaaaatttataagcaaatgaagtaaatagagctaattgagctgaaaaaatgaggtaaaacgaataaaaatggtataaaacccaaagtgaaccgagcgattgttttcactaatgtcagaagaaatgattagggaaacggatttcatacagaaaaaccgacaaaaaaacacctaaaaaaggtacaaaaaatcacaaaataaaaacgcaaaaaaatggacaaattgaaaagaggaggtcaaaatttcacgagcttagaattctattcaaaaaatcttgggctgtgtgtgcattgtggtcccgaatcacttttttttttttaaaaattatttgagctcagaatcagtgtgatgatttacaggtttaaaaagtctgcgtaaaagtccacaaaatccaaatgattacctaaatatgtatttaaatgaaagaaggcaacaaataaatgcgaaaag

SEQ ID NO: 8124 - DNA, 4109 bp, Heterodera glycines
tcacttccgtccccacaaattgtcgaaaagagtgccacgattgttggccatcgaaattgggtcggcgtaataccattggggacgagcattggccggtgaagaaaggtgcagcaaagtgagcagaagcagcagcaaaacgatgggggaaaattggacggaaatcattttgtagaaaataaaataattaattaattaattatttgtgggaatttaaatgaatttgttgctgtttttgttgctgatgatgatttgaatttgagtttgaatttgtcactttgacctgtccttttatagggtgcgcaattggaaaagcacaaaacacagaagagacacaaaaataaaggcggggaggaagaaaaaattaaattaaattttatattttgtgcctttcgctgtatttccaaattcgtttttgtgcctttggttataattggaacacaaattctgtctaattcatttttgtgttctaacaaaccaaattaagtaaattgagctaattagatgaaaaatgagacaattaaaacgaataaaatcttcatcaaatccgactattgaaaattattcagaagtacagtgttgtacgggaccgggacctggtactgaaaaacacggacaactgattacctaagtcccggttttgaccagtttagaacgggaccgggaaaatttccggttttcccagccaaaaagtcccggtttttcaacccaaaaagtcccgttcctgtacaactctattcaaaattgaaccgagcgattgctgttgttttcactaattgagatgaaaaaatgaggtaattaaaacgaataaaaatggtataaaacccaaccgcgaattatttctataactttaggtcttctgaaaatttcagtttttaccttcaagttggaaaagtgatagaatagaagggtcagcgaggagggtgtgaccatgggacaaagtaaaaaactactaattacatgaaaattgttttttgaatttccaattttagattaaatttaaaagaatagagactgggggattatgatagagggattatttttcaaaacacctcgtagactgggggataattggagactgcgggataatagagactggtctataattagagcatatacggtagataaattcggcattttttacttcagataatttgcaaattcatttgttctttttgacaactaaggattagaaaatttatttgtgctcagcaacttcgattttcagtgttccgcgatgaatttaattgaatttttaataagtttatttcattttcaacatgagaagtttagtgcgtgaccggaaaatgcgtcagtgacacaaatattctaaattaaagttctgtagcattaagtattgtagtataaaagtaaaattctataagaagatcgttctgaattccaaaccctggacccgaattcgaacaaaaatcgataagtcaaaattttcgaaattcgtttttcattttaaaaatcggtttaaatacacggaaacaaactaaagccatcaatccttcaataagagatcatttatgccgtttttgaatcaaaaataataaattcgaaaaatttgggctttcgactttttgttcttgttcgggtccggggttcgaaattagcagaaatgaataccggactcgtgatcagggacatcgaaaatacaacgaacatgtttttatgaaattaaaatttttactgaagcattttctactgatacattttctactgacgtattttccactgatgcattttctgggcaccgtttagtgtgtgtctaaagatagaattcggatcacttaggaaccctaaaactcattcgaattttggtgattatcctatgtagaagcatttaaactcattttgctattttatgttaatatttgggaaaccctaaattagacccattttccgggtttttatgagtttttttgagtttttgacatttcgtgattttttactcttttgaacattccgtggcttggagacactttttgggggcgccagttcaaaagttatagacagtaaagacaccgttttatatttgaatgcactgcattttgttttttgcgctaacaatttattggcgcttttttttcgttttttacaatccgtgcgcctgcggtttacctcagttcggctctcacggtttggccccagcatgtttttacttattttttctgcggttttaactcgacgagaaatgcacgaaaaacaattttttttgttcgaaaaactttttaacgcccctattcgaccctaggaatccctattttgagtgtttgcccctaaaataattttttttatccctattttggcgtttcgctcctatttagcgattttaaaaattttcatataaaattcacaaattctttaacaaaaatgcaatggaaaaaaaaaattgttttgacgcgatcactttttttgtcaaaaattttcaaaaaattttccactaattttttttgaccaaaatttctgtaatttattttctttcttgtcaaaattttgaagttttatttattttagaaaaatgtattcaaaaatttcgcataaaaataattatttgtaactgtaatcaaatgaataaaatcttagtatttacatagaaaatgaggatgaaaaacaaccccccgcttagtttttgtgccaattttttcaaaaaattgtccttatttaaggctaaattgtatttttaaatggcaccgcctgccgaaaaaaagaaaaagcattcctccgccgaccaccgcctcattatttctgcatcaattggtggaaagaagcaacagcaaacgttgggctcagttattacatcatttggaaaacgacgaagtctccgcgtggccatgaaagagaattgccgaattttgaggaaaatgtgagcgccgtttcattttcaacttctattggcaaatgaaaagctttctttttgcatttcagttgggtgtgcaacgacatttggatggacattttccctcattttgatcgtcctcaactcggcctcaaaatggctctgctttcgccacgtttcaatgcgttggtggacaaacatttcgatggcataagccaattgacaatttggaacgcaataacaattcacaggatcggaacaaaagcgaaattggttgtagaggagaacaatgccaaatttccactgcccgaccatccgctgcgcaacaaaattcgctttaattaccttcgaatcgagtaaatcaaacaaaattcaaaaaagaattattaattgataaaagcatttgctgctttcaggtacattgactattccgtcatcacatttcttcgtgccaatcagcaaatttttgacaaaggcaccgatttgaatttgtttatgccgtactacgaccatgatgacaagaatgtccagccaatttgggatgattttgcccgtgcaatttggcccatttttgcaccaaacattcgccatttgtccttttccgatgcccatgcttttggcaatttgcgtcgccacatttcgccaacaattctcactgatctcaatcagttgaattcaatcgattccgattatttgttgcccgatgtgattggtgatgatgggccaaatgcaactgctggtcaagcgctgtccaaatggttgcaaattctgggaaaagatggaaagccaaagcaattgagttgtagcaattattatcatgcagctatgcctactatcaatgaatggatcgtcaatttcaaagaggtcaaaaagggactaatcacttttaattggcctttgttttttggtttccaattaaaatatttgcattaattgccatttgatttcggtttcgaaatgtttaggcatttcttcgtgccaccacatcatcggccagctacataattcgacttgatgcttttggaaaaatgcaaattgggccatttgaattgatgaacgaacggaccaacgaagtgctaacattggagaaagaagaaaacgatgatgaaaatatagaggaatatgacgaagatgatgaatgggacgagcgatgggtaattaagcgatgccaaattgggcaagcggcgacgattcaatggaaggaaaaaaagatgaacaatttgaacagtgtcaactttcgtctttgtaaatttgggtgagtggcaac

SEQ ID NO: 8125 - DNA, 4787 bp, Heterodera glycines
  misc_feature (50)..(50): n is a, c, g, or t
ctgcgcaaagatcgtctgacactgaacagtcatagcactgacgcgaagtntcagctggggaaggcattcgcgaatgtgatgctaaagggaagaagaacaaagcaatgacagccttttcaatttgaaaaacacaccattaacagtctgttcagtgtctttgccaaataatggatgccgttgattgaggccagcgttgggtattttttgtgcaagaatttcacctcatctctcagacattcttcgattgattttttcgctattatgtcagcctgggatctattgacactaaaacaaagcttatttaaaaattgaaaaatagctttttacattccgattattccaagtctgacaggcaccaatttgccagtgagtacttccatcgcgtcggttccgtggtccattaagtccaatttcgtaagcaccacaagagtacgatttccttaaattaacttacttctaataaataaagatgggtttgctcaccttccctgtccacttccctggccaacttgagtggttcagatgtcgcgaaatcctggttagctggagtcaccgcaagaataagcgaatttggattgcgtatgtaattgaggatcatttcacgaatcaaggtctaaaaattagattaaatcgtagagcgagttcaaaacttcaatgtctggtggttggtctccaacgggcacttttgtgatgcccggcaaatcgatcagcgacaaattcaccgcccgagaagaataaattgtcaatgtgatgggtgccggagaaatgcccttgttggacccggtcacacgctccgtctccttctcaatctcctcacgaacttgctgaaattcgaataatttgttacaaaatctgttgctattgtgagtgcctggaagtcagcataaacttcgtttggctgatgtccaaacaaagcccagtcttcgtgggtaggcgcttaattttgtatagaataagccacgaaaaccttaaatatgtttatgaaacctcctttttgcacacgtaaaggatcggcgacaggacaaaagtgaagatgaagcacaagcggacgacgagtcacaatgccaattccgcgaggcaagaaatccctgccgacaattccttcgagaaccgaacttttgccggcactctgtcaaacgtatcaatttagacgcattcattatttgagtaattctcaatgaaattaatcaaaaatctatcaataaacctgtgaaccgacgacgactatctgtggcaattggacttccgattctttgtatccagttgtagcaaaaacatctaaaattttgagttatttaataatgtatcatttgggacaccttgaagtttattaatgatcggtattagagattccatacgtaatggcacgtgaagtcaaaagatcaaaaatatatgtttacaatgcaatgccttaacctgtcaataaaaataggtacttcaaataaaaatttacaaaatgaaacaagaaagcaacgtagacaaaaaaaagcatcgtctttttttagcttggctgttttttaactttggcgattgcgttggcatttgccaaatcattttttggcataaaatttataaaaataaaactaggtaattaatttttttcctaaaaataaggaaaaggaataggtacctagttaggtaagtgattttttttttttttgtatattcttgcttgttttttttttgccctttcaattcccgaccgagttgtggtctttctgtccgttagccgtcgccttcgctcgcattccttgactttcttctgctcttttcctaatttttatgtcgctttctctgatgcccaaaaagtcaaaagtgaatctttcgttcttttgttaagcattgcattgccaagtgccgctgtctcattcatttgactttaattcgattctcttttgctttggaattcgctgaattttgctgtgtattcatttttatgtgcgctttctgcgtcagttttatttttggctttactcttcgttttatcttttaactgcacttttgcctttatttaactcaagattatgttgtttctttcttttccatattccctaaatattcccttttccaatttcttcgtttaggattattatttgggaaacttcaaatggatactaaaggtttttctacgagtgcttcttcttcgatgtgcacaaatgatgacgacatcactgacagtgaccagcaaatgcattcggtgcataatccggcggaatttttgaaaatgaaaccgaaaaagtcaatcctaaaagccaaacaaacttcgattgacgatttgcacagagcggtagaagaaatgcgcgaataccgtggccaaagcgaagaggtccaaaaggcgcattttgacgaggtcattttggcaaggctcaaaaaggaataatttcctccccatcattttataattacttaatttttttttattttagatgaatattcttgcgacgcatcatccgcccgataaggactacggacacatgaaggtgaaatgaagtttaactattttatcgaactttgtcttaaatttaagatcgatgagccaaagactcctttcaacaattacagcgacagtgagggcgaagaactcacttccggtggtggaacttctcgaccgcgaagggtgtcgctggttggtgcggtggatgcggacgaattgcgtaaaactatttcggggggcacgcggagccaaatgaaagtgttggacccgccgggttcgggcgaagacgacgaggacagcgaaagtgggatgaccgaagagcaaatcggtgagtgtaatttgagcactggacgagaaaaataaaagcagaattcagtagctatgagttaattactaaatgaattccagtaaaaaagcgtgaattcgaaaagaagcgcaagacgcactacaacgaaggcgcctttctaaagaaaatgcgggagagagcagcgaaggaagaggaggaggaagacgaacagtgatggagaggaaaggacggaagatggagaagacggattgatatacttattggagtagcccagaagagaggggacttaactcaaaccattgaagcaaataaacaataatgtttggattggacggtaaaaatgcatccgattaactaaaattatttcagattacttaaaattagagaccggttctgccgttttttaccgttccatatatgtgacatattttttcaaataatccgttaaaagaatgctattttttccttgtgaatttatttaccaatgcttacaattagttacgccccaattagatttaaaggccccttggttacaaaacaattaattaccgttaccttttttattaatgcaattgcgtaataagcaaccataaagaaatatgtgcaattttttattatcttttaaaattcacatacaataagtgggatttgttttatcccttcaaatgttatgtcggatttcacaaaaacggtacaattgttttctgtaatgttccatccgctcaccctccaccaattgtgcagaaactgacgaagctttaggaatcgaacctaaaaacatggcgatgtttttcgcaatttctgggccttcgaactccaaagtgatcatttttccttaatttacaatttcatttcccttgttattcctgggtagcaggtcgttttcccacactgaatttttaatattaagttttcttcaaaacaaaaaaattttccttgagaaaataaaaaaaaactacaaaagttaatttaaactccatcaaaaattttaaaataattttattatttacgaaaattgggagaagaaattgtactcccctccacttaaggcatttttttgccatataaattccttttgaaaacctactatttgtcatgtgctttttcttttgctgcttgttttggcacaacaacacttcccactctcccgccctcaggtcgatgtcctgcatcgccacgagtcttcccaggccacgcaaatcaatggccatttgtacggattcggcataaaaacggaggccggggttgaagccgtccacgggttgtaacagaaccaagacattgttgtcctaaaaagacaaattcctttttttcattgagtgtttctgtttcaccattaccttctcattgtcagttgtttgacagttttcgtctttttcctccacaaaaagtggcgaattatttgcatttccaatgcacaatttccaccggtcgaccaacggcgaatgggcgacaaaatcgttgaggcgttcggccaatgggaaattgtgaatggcggcggattggaaaacgacgccgtggggggacaaatggcatttgccagtctcaggggtgaaattgtgcacctaaaacaattataattttataaaaatgattgctttcgcttggatttggtcactttgctccaatggttcacaaatggactgagtccggccgaatgcatttgggcttaaaaatgcgggcgaacaatggccaaatgccaacaaatttgacatacgcaacagctccgaatagttcaacaacagtggacaaatggtcacgtccgtttcttcaatggttggcgacgtggcgcagaacaaatgggcaacgagttggcgacagtcgcgggtccgaaactgttggcaaacagccaaaatgagaatgctggaacagtcgcgcaagaaaatgctataaaatccatttagggctccttttttcggcattcgatggatacctcccctggcaagggcccgccaaaatcacacagtcccgcgagtcgtccacccgtcagagaggcggtccgatccatcagcaaaatcagcgagtcccttggcattataaaggcgg

SEQ ID NO: 8126 - DNA, 871 bp, Heterodera glycines
ccgcatttgttaccctagaaaaagtttaaaggaaatttttatctcttttttccgtcgggacaccaattccgaaggattaccctaaatctggccttacttttgctcagttttgaacaccgaacccgtattcgaacttttttcggaattaaaattctttttttttggtaaataattgcttattgtgaggcattgattgatttgtagcaacaattgagtaaacagtaaggattcagatgtgaatttatttacatataagttctcttattgttagattcttccaaaagcacattgtttgttgactctgcgtcatctgttttcaacgacattattgcaaccggtacttttctgttttgtgaccccccctgaaattttcaaataaaaagtcatttctagggtaatttggggcgctgatcacgaatatggcatttatttttcaaaattccgaatcccgaattcgaacataaatttgaaattcataaattacaaggaaaacatatttttatgggttttcgaggtcgctgaatacgtactgggcctatgcctaagcctaagctgaagcctaagcctaggcctaagcaagctgaagcctaagctgaagcctaagcctaagctgaagcctaagcctaggcctaggcaagctgaagcctaagcctaagctgaagcctaagcctaagctgaagcctaagcctaggcctaggcaagctgaagcctaagctgaaccctaagcctaagctgaagcctaagcctaagctgaagcctaagcctaggcctaggcaagctgaagcctaagctgaagcctaagcctatatacatgccaccaaattatctgcaaattttattacgcatttctcggcagtttggccaatatttt

SEQ ID NO: 8127 - DNA, 3740 bp, Heterodera glycines
  misc_feature (1502)..(1502): n is a, c, g, or t
  misc_feature (1511)..(1511): n is a, c, g, or t
  misc_feature (3526)..(3526): n is a, c, g, or t
ttttcgagcgaaggaaccgcgggcgttggccccgggaaaataaactgcgattcgacgaacactgtttgttttgtaatacgttatgaatattattttttgggcgactaaaagaaagtattttttcaatttgtttattttatttttcaagattccgagacgacgtggtgggacttatgatcgaatacgcgcacagcttgccgaacaggcgtacaaacaccagatgcaggacaaagtatggtcaattagtagaatcgccttaaacaagatgtcaaaagatattcctaaataaaattctttttattttaagcgttttcaatctttttggcgtagtgcgacatttgcggaccgacatttgcggaccactatttctgggttgaactgtcaaaaaaaaaaaaaaataataattttttcaaaaattgagtgactaagtagttttatttgtgatttttaccaagttgaacatcgcccttcaagagtaattgatcaactttctgcaatcaatatcgaaagaacccattttttaaagaagtttagtttccatagataaatatagtatgtagttgctcatttttaattttggacccatagttttaataacagcaaattacggacaattttgagaaaaagataaactattttagtttttgtttgttaatttaattggtttgacatgccggaaaaaattaagctctcggttaactaaagcgtggaagtgaaacaagataaaaaattttcttggtataaaattcttgaactgacttttatatttaatttagctaattttttcgccaatttcacagtttaattataagttagaaattctataaaaaagaaagaaaaaagttatgtcaaataagacttctctccaattgagacagatcgctttgcatcagcttaccttcactaatttcaatttgggaatattgaatttattaaaatttcttattatttttttctttatttagacagttctatcgagaaatagtggtccgcaaatgtcggtccgcaaatgtcggtccgcaaatgtcggtccgcaaatgtcggctaaccaataaaataggtgaatgaaaatattttcatatcctctttataccacggcagagtctcatcagttcacaacctcacaaaagccagcagcagttggctattggtcaataaaaaataggggtttttgaaaaaaatattttttttttcaatattttgaagttttgtcaataaatattataaatattttgtaaatattaccaatcttttataaatattttttttcattagggctggaaatattaattatatatgtatgaaaaaaaagcaaaaaaaaaaaaaaattacgaaatatgtaaaaatatctacaaaaactgttgtacaaaaatagttaaataaaaaatcgtttatgttttttgacaaaaaattcttcaaaagcctaaataaataggagaaaagaacacaaattatatattaaaataaatttcggtttattggcatttaagaaaattccttanaaatattanattgcgatttttcaaggaaaaatgggcaaattttcttatcatattccattaaacctaccaaaaataggaaattttatgaatataattatggtgccgggtcgttactcaaaaactatcaaacttattgacattttttatttcataggggtatattttctgaaaattgttgggatcgattcttaggcgtgtatttagtttgcgttcttaggctgttccaatattgcttcataaaatgcatctgtctgctgtacttcaacgcaaaaggcggtcccgtgtcaagttccaatgattcttttggcctatgttacctttttttaatcttaattatcttaagaaaaatcaaaaatatgtaaggctatacaatatagggattaaaaaacaaatatgaagacaaggccttggattaggagcgaagcaaaaagttgagtgaatgcaaatcatgacaagatcatgttctatccgggctctaatagaaatctattttttaaaataatttttaagataaataaaaattataaaaattcgcgaaataaatttttttcctaaaaatgtaaaaagaaaataaatgttatttatcgtgaaaaaaagaataaatgaaaagatattttatctcctcaatgttttttaatcctcatttaattcttcttcaaattgtttcttccaattgaaaatggtccattgactaattttcaatatttttgaaatttttgagtcactcatttttggattttctcctttcatttgccaatacattttcattttctccattttttctttctcatttattctttcacccattccaaattgtttcttccatctcttaattaaatcatggccaactccaattttcttacaaatttctgcataatttttgtcccattcttttgtcgaatattttcttccattttgtttatactcatttttcattgcattaaatttttgcacaatttcaattttttgtacatccgtttttgatttgttgtggcctttgtatattcctaattctttgatccatttgtaaattttgtttcgatttgtgcccaatttttttccgattttcaattcaattttatgccattcttttgttgaatattttctctctttttgcttaattttctctttaattttgttgaatttttgaacaatttctctctttttctgttcattttctttttcttcccatttttctccaaatatttcttcaaatgttttttgttccaattttttcttttccgctccaatttcaatttgagcaattaaaaatacaattgaaaagaataataaacagagtttcattgctgacaattttttaataaaaattataatttaatttaatttaacataaatgtataaataataatttaatattttttacaaatgattttatcgcttataaattctccattttagcaaattttttacatgtttattatattcatcaaatcataaatattggataatttctctttaataatattaaaataataataataaatgcaaataatacagatatgatgaaataaaattctaattctatttttcgcaaaattcaactattttaagtgtttttacattttttatcttttgaacaggcgtaagcaaaattcaaataatgttttttttttcattttaaggaaggaattatggaaaatgaaatcgaatttgaaactttgagctcattagaagataaatgtgattggaagggaaaacttaagttgccaccaccgtggatcgataggccgggtgtacggccttaactagggttgcaaccccgacgtcggggttggaaaattcggggttcggggttgtcggggttggaagtgtcggggttcggggtcggggttgccaaatcgttcggggtcggggtcgggggtttttcaatttttgccttatgccaaatagtcaaaaattttttaatattttttcggaaataatatttattaatttccataatatatttggtattgtttttatatttttttatttcttttttatcagaaattttgtatagaaanttttttttttcttgaaattttaaaattttttatttacctttttgttttccaaaacatcttttttcacgtcgctcttttctaaagacttaaggagaaagggaacaggggtctccggcggtgccgataggcgccgccgggaaaattttgaaaatttggttagatctgttaacagattttgtccaaaatatgctaaatttttgcgattttgagccaa

SEQ ID NO: 8128 - DNA, 3153 bp, Heterodera glycines
attttctttttcttcccatttttccccaaatatttcttcaaatgttttttgttccaattttttcttttccgctacaatttcaattgagcaattaaaaaggcaattgcaaagattaatgggaataatttcattgttgacaatttttctttttcttaaaaattaaaaattaaaatttataatttattcgatatgaaattaaaataaaaaataataaaattcctcaataaattactaaattcgaataactgatttttgcgcaaaattttccttattcatctatttttctttctttttttctgcaaaattataaaaaagttctggaaaaaaatgagagtcagaatttatttttgggacaactgtcagtataagcctttgtacagattcaacattcacttcaatagggaactattggggaaattgcattcatatcaaggctgcacgcaattacggattacggattgcggattgcggattacggaaattacggggttttgggagttacggactacggattacgggttacggatttttgggatttttccgtaattttgatccgtaatttgacttttggattattttttcgagacgatttcttgtaagattatttttataaaaaacaaatttttctattttttatttaaagaaaatatgttcatttctttaaattcttatttctttagcaatttaaaaatgtcaaacttaaatcctggtaattggtggtattattttgagcgtcaaggcaaatcaactgctaaatgtaaagccgatggatgttcctactcaaagacattaaatgcttctctcagtacaacagtgcttgcttctcatctcaaaaatcaccacccacaactttacaaacagcgtgaagattgttcaagcagagaagcaaaaaacagaaaagaagggacaaagtggaataaacccattaaaaagggcttttgcaaatgcattttatggttcaagtcaacaaattactgatgacgaagaaaaggaagcgccgatttcatcaaaatcacctattttaattgggctaaatgcaaaaagtatgatctgattttttttctatgcgttattacattttgattaaggccagtggagcacggacggagacgcaacaattggcgcaaatcgggcactaatggaaatgctggttactcaattactgccatttaatctcgttgacggtgttggatttcgacaattcgttggaaaattacagccaaaatacaaaattcctcggcgcaatcatttcgctcaatatgaattgccaaattgttttgaagcgatgaaagtaataatcaaatttgcgctttcataattctaaaatttagaaaatagtcactgatgaatttctgtcagttaacaaaatcgctttgactgctgatgggtggacttcaaaggataatcgccattctttgatttcagttactgggcattttttggaccaaaaattcaagccaaaattttttgttttgagcaccaaaccaataaaaagtttttaatatagtcagagtttgaacattttatttttcagggcgacacacagctgaatcaattgtgtcatttattagagaagcattaaatgattttcaaattcaagagcagaaaatttcggctttgacgcgcgatacagaaaatacgatgaaaaaggttggaaaggacttgggttttgtgtcagtggattgcgcagcgcatgttttgcaattggtgataaaataatttaattaaatattaaaaacaagaattttagtgcattaaagagggactgaggtcaattgaagaggaagaacgtttaaaaaatctttttgaaaatgtcaaaagatttgtaagaaaggtgcgaaaatcaagagtgttgacggaacaactcgctgaactccaacaaaaggaggaaattgaggaagtaccaccaacagttttgattaaaaatgtcgaggtgcttttcttctatatttaactattcttataaaggaaattaatttcaggtgcgctggaatagttcatacaaaatgattgaacgttttatcaatttgctgtcaattgaacattaccagcttccaaaatttaacgctgatgattggttgcttttgtcatctattaaaagcatactttcaccaatttacgaggccactgttcttttacaaaatagaaattcctcttgttcaattataattccgctttttaaagtcagtattaattttctccccaatttattttaaaattcaggcaatttcattcggtttacgtgagaacaaggacaatcgttattcaaatataaagaaaacaattgcgaatgccatcgaattgcggcttaaacaagccgaagaacaaaaaaacctagttcttgcaactattttggacccacgttttaagaccatttaccttgacagcagtcggctgaatcagtacaaagactggttgataagtgaagttgagagttaccatgcaaagactgatgtgattttattttttctatttttgtaacttaatttttttaggaaattgatttacaaattgacgtaagagactgcagtggttcaagttcggctggggatattttttctcgttttgaaaaggacgcagaatttgagcaaaaatgaatactgtaaataaactttatatacccctcataataattaatttaaggcaacatcccccagtccatctgccttggagacaagacaaaaagccgaagttgaagtaaatgaatatttgcgggatccaaaaatcaaatccagggccgatccatcattatactgggaagtcaattcacaaaaatggccaatgattggtgacgttgtacggaaatttctttctccacctgcaacaagttcagaaattgagaggcttttctcaacggccggtctaatttcagatgacttgcgaaagagtttattaccagaaaatattgcaaaacttttgtttcttcatcacaatttgcttgtaaccggtttctcaattgaatgatatttgaatgatttttgttttaatgcgactaaaaatttttttaaattacggattgcggattacgggaaattacggggtttttggacccccgtaattacggattacggatttccgtaactgagaaattcgccgcaattacggattacggatttccgtaattgcaaacccagttgcgtgcagccctgattc

SEQ ID NO: 8129 - DNA, 2891 bp, Heterodera glycines
  misc_feature (32)..(32): n is a, c, g, or t
  misc_feature (58)..(58): n is a, c, g, or t
tttaaatagtaaaaaataataattaaaaaaanaattttttctaatgcaaaatttattntaacattgcatttttcgctgattaatctctcccacaaaatcagtgtgcgtcgccacattgaatcaatcaatgattagaacgagcatttctgtgaagcttacctttccaataagccctttaattctacaaaatatattcatttttaaaaattaaatttttatatttatgctaatttttaatttaatgccaaattttgaattaaatttttatattttatactaatacagtaaacttccaatcgtttctacaacaaattgcccaaatgggcatttcccagttgctccttcaattgcgacaacgttgtctgccctattattcatactctaaaagtgatcaaaagaatcatcatcatcattttgcactcggtggtggcttgttgctgcttttactgcttgccatcggcacttttgaaagcccagtgccattggtggcggtgccatcggcaacgaccctaatcattggcacaatggtcaccttgtttttggcttcccaagccgatttcatctaccggtcatggctgaccttggaacgggatttgacgtatggaaaaagcatttgggctttatttaaaattcgcaaaactcatttttcgaaaatcggtaaacactgatttgaatggttgtgaccggaaatgatcagtgcaaaatgcgttagtgaatcataatttcttgaaaatgagatactgagtagtatgatgatttaaaatttaagcgtaaatcatctgggaaaaagcttaaacaataatccaactacagtatattcagtttttccggatttggctttttcaaaattttattaaaatttttggacatttgaaaaaattaaacgaagaaattcagaacaagctttttatataattttaaccttttttttactacaatagctaatgctacagaactcactgaagcattttccgggagcccaaattgaccttaaacgaaccacagaatgtgatacatgatccgatcttaattttctgaaaataataaatttaaaaaatgtttaaattattcagcggcctttttcttctgatcaaaattcgacttgacatgaggcgacggatgcgagagaacaaaggcatacaacagatctttgttgatgtggtaaatgccgttttcaactggcacattatgttttctaacaaaaaactagctatgggaatttgaaaagatattcttggcattgttgaatattttcaagggcacatccgttaatggatttttactttataataattgggactgtaaattatatattaaaaaaaaatcgcaaaaatagcatataaaaattatataacttaaaataattttttagctatttaaaattgatataccattatcaaaaaatcaatttttgggggtacatttttcaaaaaaaaaaaaattctttagaatttttaattttcagccctaataataaatcatgaattccctttaggtcaatgcaaacccgaatggaatatgtgccatcgatatggtctgagacacattaactaaattgtttatcccaaatttttaatcttcttttttaaattaagacatccaataaacagtacacattccgcgaatttaatgcacttgccaatcgttttgccaacacttttttacaaaatggttaccgcagtggcgatgttgtggcacttttcatggaaaatagtgccgaatttgtagctggtcagtctattattattgtagaattcaattaattgttggaatataattaatttagcatggattgggttggccaaaattggtgtcgtaacggcatggatcaactccaacttgcgcatggactcattagtgcagttaattattttttgcaaacaattaaataattttatttattttttaaatttatttatttctaaacgtaaaattgtttaatttttcagctgtcttcgcgtttctgaatgtaaagcagttttatgttctgacatacttaagccaagtaatcgtttataaaatagttgacataattcaaatttaaaaattaaatttcaaaaatagcattggaagctgctgccaaacaaaatgatgccacatttatggacgcattgtgcgtctacggtttaagcgacgcactgaacgccacacaaagtgacgtcaccgaaatggaaaaggagcccaaagtgcaacatgaagcggtgcccgactttcgttcaattctatgcttcatcttcacaagtggcaccacggggatgccaaagccggctcgcatcaaacaccttcggtgagattctccgctaatttggcactttgaccgagactcaaaatcttagacatgggcccaaacccaaaaagccttcgctttttttgtctgtaaataatcacatcaattaagctattattcgatggcaattggcattgcccaatcatttgacatccgtgccgatgaccgcctgtacatcacaatgccgttgtatcacactgctgccggcatcattggcgttggacaaatgttgttgcgcgggtgcagctgtgtgatccggtcacgcttctcggcaagcaatttttggcgcgattgtatacagtatgagtgtacggtaagtggtggctcattgattaatacgatatttaacaatttttctaacataataatgtggtgccaggtgccaactactgtaatacaatgtataattgcatacagacaagccagtacattggcgaaatttgccgctatctgttggcacagccggcacgcgaagcggaacagcgacaccgcgtgcgtctgatgttcggcaatggatacgcgctgaaatttggcgtgaatttgtggaccgtttcaaagtgcgcgttggcgaagtgtacggctccactgaagggacctcaaattt

SEQ ID NO: 8130 - DNA, 1434 bp, Heterodera glycines
cccccccccccccccgaaatcagaattttttgaaaaaaaatttattttttttttaaatattatattaatttttttgtaaaaataacaaacgagtttatgaaatgaaaaaaaacagatcatttacaattgaacgcgtctaatgcaatcaattcaatttttaaaaaaacacgaaaatacacccctaaatattgaggtttacaaaaacgaaaaaatacacccctaagaaccgactttttgagttgccccccccccccgaaacgaaggtcctggctacgcccttgcaacctggttccattaaaaaggtaaaactaaaacaccaatcattgataattgaattttttctgtagaggagtaagagtgattttttaattgaattatttttttattaaaaaaacaatatttcctagtgaattcaatttgtcgaattcaggtcaaacgggggcgatgctttccacaattcggccaaacaatccattgttggtgtttgacggttatttgaaccaagaggagacaagtgcgtttttgattctaatctatgtaaaggatttttattattgtaaccatttttaaatctgatcagagattctgatcagattaattcgattaattctttggtacaataattaatctataatttttttaaaaatttgttgaaaaaaatatttgttttccagaaaaaaaagttgttcaaaatgtgttccgccatggggacagtgcctttttaactggtacaaaaaataaataattatttaaaaataaatatttttttaatttgaggtgacattcttcactgggaccgtcttggttatttgtattttcgaattcgaactggtgacacgttccgattcaagggtgaaaatgttagcactgctgaggcatgttttcaaatttatttatattttaattaaataaatttatttaattacctaattggataaattcaaattttatttttaaattacactcttaaggttgaagctgtccttctcccgttgaaatgtatcatcgacgcggttgtatacggtgtacgtgtacttgagcttgatggaagcgtcggcatggcagcattggtcaaaaacgacgaggcaggaacggacgatgtaagactgagcagacctgggacattaaaaaatttttttttggaatttagggattaaatggtttagcaaaaaaaaaataatggatttagctcaattaaaaaataagtgcccaacaaattttatttttaaagaaatttcttcgagagttgagtgcccgtcttcatgccaaccttcccgcatatgccattccacgattcattcgtatttgcaatgctgttgatagaactggtcattgttttcaaatttaaaattatggaaatcgcaactagcataaattaattaatttgaaaatcttaattaaaccaaatccaagaagttttagcaacattcaaat

SEQ ID NO: 8131 - DNA, 843 bp, Heterodera glycines
  misc_feature (834)..(834): n is a, c, g, or t
ctgaaaatttctttttactcactgtgtgtaaaatttttattttcgcttatggtgtcacaattttgtccaccttttttttgcgcacataaataatattaaatatgacttttttgtgttcatccctatttaaattcccgctcaattttgctcccccattatttgcttgccgcacatttgtcccctccctgacaagcttagagcagaaatcacccgctagcccacccttagttctgtaaggcaggcgacggggggggggagggattaacgcggatttttggagattaaccgcgccggaaggtccgtcgtccatccctcgccccagcagcagcatcggggcaatgcaaaaagccccacacattgccgcggccccgccggtggttcaccgaagatggatgatcgtcgttcgtcaccgtcaaagcggggggggggggggaaaggtcaccaaagcatttccgttgctgtgccgccgcttttgtgcgcttgctgctgtcccatcttatcgtctcgtccgtcctccattccggtcatttttgtaccaacccccggggggggggcggagggaatcactcgctcttgaaaccgtacatattttctttctactgaatggacgttttattcgttagggatgttccgggtcaagaattgaagaacgggttttgggtttctgatcggtcggtcgaaaatagcttgtccaatgttctgaatatcgaataaaaaatgtttcgtattagttcaaatttgggttcgagattaaacaccgtaatttttgaataaattataaatttttaacatttaaatttaaaattaaggcgcagctgaaataaacatttccanaaaatttat

SEQ ID NO: 8132 - DNA, 4576 bp, Heterodera glycines
  misc_feature (4)..(4): n is a, c, g, or t
  misc_feature (20)..(20): n is a, c, g, or t
  misc_feature (89)..(89): n is a, c, g, or t
  misc_feature (110)..(110): n is a, c, g, or t
  misc_feature (232)..(232): n is a, c, g, or t
  misc_feature (1068)..(1068): n is a, c, g, or t
tttntggaaaaggaaattcnttacgccaaaaaaattatatgcgcacaaattcaaaatgatcagtaatttcctttttgtttttgtttatntgttcgcctaaaagttacacnatttatgaattcattctgaaagatttaaacagggaaaatttcctatacaattgttaagaaattaattcaaaattttatttcggatttttaaataaatattcgtgcggatttaaataatattntaataaaataaaactttactcttttaaaattgtgttattatttttcctacggggagtggaggagtaaaaattcaacaaattcacattgacaatcagcagcagttgttgaatcataagcgaaattcaattaatcgaatttgaagtgaacaaataatatgtaatatttaatggggaggggcgaatgagtcatcatctcatttgtcagtgaaaaaaaaatcacgggattcatcttttggggctgagaagaattacccactcactcactgttcattcattcatcaattgaaacaaaaaagtcaacagaaaaagttctgctttaaaaaaaataatagaacaaaagacgttttggcccttcggggcataaaaaataatgtttttttgaaaaatttaaatataaagaatttaattgtttcgaaaaattaaatttggtataaattttttgaaaggaatataaagttatttatttgaaattttctatatttttcactatttttgataaaattttcatagattatttaaattttaaatttaaaaataatacaaagaattcccaaaatgtctttttattacaatttatgtgtacactctaacacaatgccaaaaaaaatatcaaaataaatatcctaaattcatcaagtgaaacaaaaaagtcgaacagataaaaccctgcttttaaaaaagatataacaaaaaaacccatcttgacctcctttggggcttcaagctaaaaaggacattttttgacagtccaaaataggaaaaataattgtctcataaaattaattcggatgaattttttttaagtaagaaaaaaatattttcactatttttattanatttttaattaaaaaacaatttttcaaaaaaaattcgtaaaatgaaaaactttttcggtttttattattacaattatgtgcatattaaaataaatactccaaaatgttcacaattaaataaaatcataaaaatataaaaaaaacaaaataatttttcttcatgccttctttcatttccattctttcgaattcctctccttcactgatggctacctttatgcgccgtgaactgtgccgaagtgcttggcccttcccccacgtcctcctcatttacttccaacacccgcttcctctcatttccacacatgcttaagtgcatttgctttatgattattagggctgggatttttatgttttaacatattttttttgcggcttagttatggcgagagaagccctaaaatagcattttctccgaacaatttttgttttagagcgacttataaaaacataaaaacacatattttggcgttttggcacataaaaacatatagcacatatttgggctattttggattttttagcacatattttggcatttttgaaaaaaatcgtaagaatacaagaaaatctgaaaatgcaccctaaaaattgactactttacgtttcttaagcatttagaaaatttctttatatatttaaatgcctaaagcaggcaaatcaaacgctgtgttaaatcgtcactggatttcaaagttcccggaaggaacttattcaactgatggaaaaattaatccgggactttacaaattgattgatatcgccaaaattttgactggcggtcgggcgaaaattgataaagactgatattaaatatgatttttttgcgtaaatacacttggttttttcaatttttagcacaaatttttgcattttttaacacatatttaggcctttttttttggtttttagcacataaatcccagccctaatgattataggttctattgtacccgttctgaccttctgcggtggccatgaagcgctcagtagtgctgctccctcggacacgacatcttcataatgtatcgccagttgccggtagtccacttcattgaaggaattgaaccgctggcagagtgtgaccaactatttggtgaggcacatgttttaatttttacatttttgcttaaaacaaaaacttgatggaaagcgatgtttcatccattttagctctatttgagttttccttgctttttattaaatgcaaatgtttaacgcaatatcgattgctcaccgcagagtcaaaccgatgcttcgccattttgctgcgcagggatccatctccttgattgttttgctgtccggcagcatagacgaagatgaatgtgttgttcgtgtcgttatcgaagtagtcgcgccagactggcactttgtccaatacagcttcctgctgctcccacgccctgttttcggttgcccatccaccctactcctcttcctgcgttgccctccatcttcctccttttcctcgcggggtgtgaagctggtggggtaccgtatcggccagggtcgacagtgcctcaccggtggatcattccaaacccggtgttattgtttgtttggggcggggtgtgaagctggtggggtaccgtatcggccagggtcgacagtgcctcaccggtggacatcccaaacccgttcacttatgttcgggagtgctggattgcggcaagctgacccttcggcactctgacctttacctgataacaagcaaagaattggaagtgtgtttaaaggtcatttgctgtatagaccttccagcgtgattcttgaaagtaaccgagcccgggctttcgctcacggctggtctccagccaatagttcggtcgcaaggccaccggctcaggattgccctggccatatttgcctaaggcgatggtggtcaccgtctttcccccgggttggagaaaggtcggagtggtgccgatgtcagcctcaaaattccgtttgctcttgggcgtcaaaatatgccagtattcgccgctggtgcccttcatgctctaaaaacgcaatttttctggcacacagacattttcctagcaattatacctcgacaaaagcaaaaatgctcatccttacatccaaaacatcagaatgtctcggatggttgcagagcaggccgcaaaagcctggactatacacacgtttcatatctgccgacagattgcaaaaatagaattggtcttctacttttcgtttttgcgtgcgctcgtcacggagtagttgctgctcctgaatgccgttttgtcccatttttttatgtgctcttttctgtccttaataggtgcttaaggcgcttttctaagctaatttaaacttttctaaaaatcacacttctctaagtatacgcgtccccaagcttttgatcagactcactaagacttagtccaaggaaaattttctaacagaataatttttctgtgctcttttctgtctttaataggtgcttaaggcgcttttctaagataatattttaaatctttcggggggcggtacagtttcgggggggggggggggggtggtacagaaaacctaagccaaacctaagcctttttgtttgacttctttacattccaaaaacacgttaataggtaaaattttggggcgctgagtacgaattcggcactcttttggccaattcacaatcacgaacccgaattaaggcttttttcgcaaagtttctttgttttcaaaattaataattttttcttagaaaactttatgaaaaacaaattttaaaaaactttccagcaatttttttcaaaatttaacgatgaattactgcttgaaaaatcgctggaaattttttaaaattttactgaattaaatttgctagggatgaacccaactcatccatgcacaactcatccatgaccgcataatgaaaaaaatgccacgactaagactacaccacacaatcaaaaaatgccacgaccgagaccacataatgaaaaatgccacgactaagactatatagccaaaaaatgccaaggctacgactcgcatcgtgctatggatgagttgggtatgtatgatttggatatggatgagttgggtatggatgagttgggtttggatgagttggacgaaagacaaaaaaattccctgaattttttttgaaagattgtgtttgcccattagacaatattcctggcctttttaattgtcgctgatcacgaatatggcatctgttttttgttcaattcctattcataacccgaaatcgaacaaagttttttcggaattcggctgtttgctcaaaaagaagttaggggctcggaatttgttgaaaagtggcagattcgtgatcatcgatatctgtacagatatgaacataaaaaataattttgaattttcgactttttgttcaattcttattcataacccgaaatagtctaaatgagtgtcatattcgtcatcagcgacactgaaaactcacgtaagcatgttttcacgactttttagaacaaaaaattttttccgaaaaaggggggcgtcggcagta

SEQ ID NO: 8133 - DNA, 2012 bp, Heterodera glycines
  misc_feature (1890)..(1890): n is a, c, g, or t
ctgttggggcgacccataattcaaatattgttgtcattgggttcgttctttgaacgaaccaaatattgatttgtccccctttcccattaattccttccactcatttccccaatttcttcaataaaaatattttattgtgttgtccaccggcacaacaaaaacaccgactgatggatggacgctgcccgatctgagctgctcgccatttcattcgcatgtgacaaaagcgatacaccatacaggacgccgtcattatgcgaattttgccggacgagtaatgcaacaacaatggtgaaatccatggccaggtgacggcgatcggtcttcaaattgaaggacattcaggaaaattgaaggatttcgagaattttgaggattcgattgtccatgttccgttataaattttattgtatttttaataaatttattcattttaacttgtgaagtttgtctagggatagaattcggatcacttgcgaactcaaaaacttgttcgagttttggtcgccatcgtgtatagaattcttagtttattttggtattttatatttatatttgggtccagggttaggcaaggggcgatatgaaggtcgtattcgtattcagcgaccccgaaaaccctaaattagactccttttccgggtttttatgagctttttcgaattttggacatttcgtgttttttacccttatggacatttcgaggcctggacatttcgttggtcagcggtcaagagctttcgaatgataccaaatttgtcctaatttgaccttttgaaaaggttgtaaatgccctcattttgtcgggcccaaattcgaaccccgaacccggattcaaaaaactcgaaaattcatttttcaccaaaattcacgtttattgcacaaaattgatttttaggggttttcagggttgggaaaaccgattctgacacccatttcaaccaattcgaaccccgaaccaagactcgaacaaattcgaaaaaaacccaaaattcatttttcgacaattttgccgtattcatgtggagaaggatgataagaattgatgcgagcctgggcgaagttttggcctccagagattatttaatgtgttctaatgaataatttattctattcctgccatagtcattgtttaaaaatttgaattttgtgaatgtgaatttttttgaaaaatgggttttgacttttttgttcgaatccgggttcggggttcgaattgggcaaaaataggtgccagaatcagttttctcggccctaaagcaagtatattctaaaattttttttcaaaatctgggtacagataaccgtaaagtacccaattttctttctcatttattacaactgaacgaattaatgaacaacgaatctgtacatacatatataatagcacacatttacatatatttgggactactccacgccaagcggacttgtccggcatgtgatggggattgtggtaggaagcagaaagagggacaacgctatgcttcttggagatgcaaaaatggaaactgtcggcgccccgaagtttcgtttcttgtgggaactttttttgccggttggtctgctattaagttggggaaagaagcagacaaatttaagggtcacatttaacaaccaagcaaatcttttctatgagctattattgggcacaagaaatgggtactcaagaccagtggcagcgcgaatttgaaattggttcaccaaattgcgtggttgattggcgaaattttatgcgtgatgtttgtacagaatggtttatccgcaaccccattcgcattggcggccagggttaggacctcccccatgggaccttcttgcatttacactaattagtaattgtgtgtgaaattgacgaaaccatggcggtgcgccgtaagtacgaaaggngcagattggttgtgaacatttggctattcggaggcactgaacgaggacatccggaacgatgtttcatggttccggtgcagcgcagaaacgcagcaacgttgctcccgctcatcgagcagtac

SEQ ID NO: 8134 - DNA, 1202 bp, Heterodera glycines
tttctgtggcgaaagcactttggggattataatgatgtattttttaacttttggtctcaagtaagtgttatgtacccctgtgaacgaaatccataaatctattgtttttaatctcattcattacaaacttcgtgcatttaaattgatttgggcaataaatgtgaattttgtcgaaaattggatttttgagtttttgttcgatttcgggttcgggattcgaaatgggtcgaaatggatgccggattcgtgatcagcgaccccgaaaaactataaatcggtatttttttattcgaaaaaggaaaaaaaaaatttatggggcgtaaaccatataagagccgactccgtcaaatagctcagcatttctgtcgtcgtcgtaagcctgtaaaaaattgggagatgaaaaattggtagttaaaagttttgttcggctccgtccacgaccttttgagccaatttgcgaccctcttccggcattttcatgaatccgtgcagaaaaagggagaaattgagcgccactcccactccagggcgaatcggatgcaatggccgcattttctgctgggcaatgtcctacgcatcttcgttcgtcttcattgccttctggggatctgaaaatggggatgacttttcacaaaccgaaaatttgtttgattgttttttaccgtcaatgtttaagctgaacgaacaaatgcttggaaaatggcaccgaccaacgcctctcggcccttctcttccaactcgttctcgacgttcttcttcacctccttggcagtttgttcatttgtcgtttttcgtcttcttctctgttgcggagatggcacgccatgacgtttggagcatatcgaccgcctttctgtatgcaatatcatagttagtcgaatttgcagcaatgattggtcgatcagctcactgttggtcaaatggcgtttaaatttgaaaaaaagcatagacaaaaatgatggcattggacaaaggcgaacaaacccgaaccattcgacataaaaatttgaccatatcccaccggttaaaaaaactgagcttggttaggctttttgtgttaaataaataatatacatatctctgtggccccaattttcaacccacacgaaagggtggctctataaattaggcaccacaattctgcaccattgctagcaattgtataacatggtactttgaaagtggcttataattatgcagaa

SEQ ID NO: 8135 - DNA, 3785 bp, Heterodera glycines
agaaacagacagaaaagaaacagaaaaaagcatagtgaaagagagaaggagcagtggaaaagataaagggcacaatgtcgggaagagacgcagagacagagagaacagcagtgaaagaggagggcggaagaggcaaaaaggacagttcatggttggatgagagtgagtccagagaaagagtggaatggaaaagaaaggtgtcgagggggaaaaagcgaaccaaaatatcgccacaaaagcgacagatgagaaagaaagtagaggaacagagaaatgcagcattaagtgatcaggaggagagccgagagagtgaccaaaacagagaaacaaagaaaaaatgggtaaaaacaagcgcaggaaaagtgccaaaagggcaaccacagtacagtacccacgctgagaaagaggcgcaccagcgagacggtacccaggcagacacaggagaacggaatttgtcattgcaacaacaggcgaatgatgctttaagtcagcagcagctgacagaaacagaaaccgaccgtcctatagacggacaacagtacggtagatttgctgtccgtactgtaaaagggcttccgaaatggcgacgggacggtattctgacagaggcgagcaaaagcacagaatcggaattcgaaacggcaccatcaaaaagcgaccgccaccattacgatacggatggaacacaacaacttcggcaagaacaatcttttctgagtggtgccagcacagaattgtccgaatttttggtcgaaagagttcgaccaaaaaatgagtaccgccgttacggtaacagtaaggaaagcagtgcagaagccatggaaaagagcccccgacacggaattggcatgacaaatcacttaaatctatcatcggacgaaatcgaaacggaccaatctttggagagccatcgctttcatagcaccgaaacggcaagccattttttgagccgatcggaacaaaaagaaacggatgataaaaacagcgccgggtggagaatcaggacggtgaaaaaggggggagaagtggtgccaacggaagaagatgagcagaaacaggcacaatttctgatgagaaaaactgaaagtgggacggaaggaaatttcggaataatggccaaaagtgatggccaaaaatggggggacagccaaaatgccaacgatggagcagacaatgagcgcagaaaagagcagcaggaggtaaaacaattcaagaaataatccaaattttacctaggtacaaaatgtgtacatgacaattaagtcaagggataatctgcaatggtttaatgaaagcgaagcagattgccggaggaggggtaatcactggcccgcttctgcccctcctttatgggcactcgccgcctctgcccctccttatgccaaatttgccctgctaatgagtccatcccgttaatggaatattcgttccataatcagttgttgttcagctgttccacttggccaatgctcaaccggcactttggttaaatgagtttggcgaggtgtcgcacagcaccgaccaaaggggtggccaaatgggactgccacactctgacgggtcgcgagcaatggccgaatgtcgcggttgggaagatgttcatcgagccataaaacggttcgtcaaatttcaactggcaaaggaagcgaaagtcgaacaaaaggatgattcatttttggccaaagttgcaattcggccacggattttcacccaaaagaggcaatggacggtcaaaatgccgaagttccactggtttcactgatggaacatgcccaagtggtgcattccggacaaatggagttggacaaagcgccaacaatttggaacaaagttttggtcgaaagggtggaagaatgggcggaatttctgaaggaaaacattgctaatgacgacgaatggtcaattgaacagacggatcgccaagaagttttaagggcgcgagaagtcttgcaaatggtaaacggcagcgaagaattgctggagggaatggccgacgaaaaaactgtgccaccaatgccatttaaacccaccccggggcaaaaaggtggcattttaatgaaattctaaatattattttaattataaaaaaatattagcaatttggcaacgaagtgaatcagtgcggtcgttatcaatgggaagacgagaaacaattggaacaaatgatttaatggtaattaatggcaaacattcggatgaaaaaattggacagaaaagtgaaaatgggagagaaaaagaagaagcaacggacagtgaaaaatatgtaattttatttgaatttattaaaaaggcaatgccaatttcagaagggtcaaattggcattctcaattttgcccgaagtcaaaactccgacttttggctgggaacggcgaactcagtgaattggaattgccctgggatgggggacaacagcgatcggtgcgaggaatgggcaccgatccatcgggcaattcgtcgctatttgacatttctggacacaatcgagggaaaggcaatggccgagcttcgcgagtcggatctcggccaagtggcggtgttcccgagactgaggcccgaggcggacagcaaagggctgaccataaacaataaggtgccaaagggggaggcaaactcggcattttacttttacaaaaaacaattaggggcataaattgataacagaaatgatggcgagaattgtcaaatttaggcttggattgctcggctcgtggggaaagtttatgaccaaagacaacgcaagtggaaaatgaaaaacaaataaataaataaaaatgaaaattgaatagaattaaacaattagacgctaataataaaaataaattaaattaaattgtttggttttagggacaaaatatggacttaaaagaagcaatggagaaaagtggaggaagcgcacaaatggccaaaattgggccagctgaaagaaccgatggaattgatgaacaaagtgttggtggaaagggtgggagggatgggccgaattttacgcagagaatgcccaacaatcgctgagcctatcgatcgaagagtaaaataatttaaaatttaattgtcgaaaataaattcattattacttatatttagaaataaaaatgcacaatgaaataatttcgacttttcagggctcgaacaattctcactcacgtgttggttcaaacatttgacgagcggaacagaattatgccgaaaatagacatgaaaattgtgaaaacgccgccggcacaaaaagaaatttcaccggaaagaatttacgagcaaaaaaaggcgatagaatttattgaaaaatcagaaaaattaccaaatgaaacgaaaaacaatgcaccaaaaattgacgaaattaaaaaaacgccaaccaaaaccgaagaaatgaaaaaaacacccgtaaaaattgtcggatttgaaaaaacgccgacaaaaatcgttcgaaatcgggtgaaatcaaggaattatcgaagaaggaagtcaagctcaaagtcgagagaaacaatttgggagaggaggagggcattaaacgcacaaatacggcaaaaagtgccaaaaaaggacgaggaacaatcgcaaaataagagaccaaaaataaatgagagaaacagagaaattgaaaacagtgaagagaaaaggggggaaaaggcggacgacaaaatgccaaaggaaggcgacgaaacgccaacgcaaatttgggaacagaaaagggaattcaatgaaaaaatgaggaaaacaataaacgaaatattcggaagaaagacaatttatttggcaaagggcaaaaagccattaaaatcag

SEQ ID NO: 8136 - DNA, 6175 bp, Heterodera glycines
gggggggggggaaagggtgggccccaataaatcaaaaaatgcacaaattcacaccccccgaggagtgggcatacccgcctcaattgtccaacgtcggtcaaactttttgtcgcaccttgtccgagaccggcaacagaatgcgaaatttggtgcggagcttaacaaagaatccaacccagggaatttgaaaatcataaatttaaaggacagcaaaaattattgggattcaaaattggaaacacaatttgcaaaaataatgactaaaaaatgttaaattttgacggtttttaaagggaaaaaaactaaaatccggaaatttttcaagattattccctgatgagaaattccatgggatgtgtcaagttcaaattcagagcaagtggcgaatttggggcggagtttttaagatttttggactttctttccattttccattatatgtttttcagttccgtacgaatacacgcagctattcctttaagaagtgatggaattccattttattttgtcatggttgttgcgagttcttcactattttttctcaggaatttaattttaatttttacataatttttttttggcttaatttctcttaatttttgttttctttttttgttgctttatcacttttttcgatcttttggtttttacaggtctgtttcacttctgaataaacgtgtacttttttacttttggtccaccacttttaagttttgaacgcgatttcaacaaaattttaaaatgataaactgataatccaaataactgtcctcatctgactgtaggattttggaaaacgaagaaagcccaattaaatttcaaaaataattaagcgtagaaagagattgtatccgatcatctgatttcggctatcagggcttgaaggaattaactttgaatagaattttgggcaaatgtcggtgctccggtgtattatattactcaaacccatcaaaatgggcgttactcaataaaccataatgaaattcttcttgaatagatttaagcatcctattagcccgatagccctacgaattcctttatcaatcaaaggttaggtgccaaaagaaaatacggtccatgtgatttataagccgcggtgtgatcaattggatcatttgtgaagaaagcgcggattaattactcaaatcaaatgatgtaataatagaaagcttcattttgtgtatgcacataaatatatgagaagcatcatcatttttcattatcagcaataagcaaaagcagaaaggcgacaaaagtgaaaatcgaccgcattatcagttattatcagcaaatggtgctcccatatcacctcagcctcgtctcacctcatctgctgtacacacacaaatatttattcgtaaattcgttggacgcggacggacggatgcgtttatattgtgataattagcgatgattatttttggagagaaataatgcttttggtcgcgtcgccatttttgacaaatcgctctcgcaccgtcgattagtcccgacggtacgcactaatcaatagtgatcggagcggacaacagattgaattgtaccagtgcctgtgcttgatcaaatgccacgtttttggttaatcccagtgactgatctaacttcatttagaacttgttaggtgtaagccgattttgattgactctgaaagtaattgatcagcagtgatcggacagtatataaaatgtatccgtgcctgaatatgtggggcatgtcaaaatctcaatcaaataacaaaggtagtggcatttttaaatttaatttcgaaaattgagtaaaattcaaatcacaaaatgtttttgtcccattttattatggtaatcctcccagtgtggttgactctcgtgtcacccacttgctactcgcgatcaccatcacccatttccatgcctttcccctcgctctcgacacaaatcccgagacccattttattatccatgcgttaaccatcatcatcatcctctcaattattcctaattacccctcttccgaaaacgacctcttccgccccatcaatccccaaatccgtgcctcctcctcctcttcctgtgcattttatcccaacattcccatcacctatcgatcctttccaattctcgtcagccattcagtctcgccccactgcacacaccggcgagagtttcgccattttccgcttccaatttttattgcaaattttttatttttaatttttacaaaatgaaaagcgatttccgcattaaaacaatacagaatttattgcaacatatttttctgggatttcgcctcccccgccactcccacttaaggtccaacaagtgaactgtttgttatttgatattcttgtggccaattatttaatgtttatttaacgacaaaaatttattaaacgaattttttcattgaatttatgcaatttaaatgagaattaaagaatcaacaaaatcatataaacctttatctggatgaaataatatagaaatttctttaataagatcttgtatctgttttattttagatatttcaataattaaatatcaaaaatatcatcatttaaattcttctttatctatttgcgacttcaaaaagatgtagatgttttaacataaccttcgtatgctttattttccatcatcacttttttttctttttaaaattaatatatcctcaaaaattttttttgcttttatataaataaatcgatattcaaatttttgagatcagagccatgctgaagtcgacttgattaaaaaattcaataaaccgcaaaattttctgcgtattttttttttgtacgcttcccatttgattggtgcttattttaaacgttgagtttgattaaatgcttttggctgatcattctcagtttaaaaggaaatccaatcaattcttgcgagcagcaggtgatcaaatcaccccattgcttgccgttggctggtcacggtgatcaatcgatcactcaatggacagagacaattagtgtttaattgaccaattttgtgtcccttattggttttatcgtttatcatcattttgttaattttccttatcatttgtaccattttgcatatgcggtttaaaaagcaaaattttctcaaaatttggtgcttgaattgattgaaaattttaaatctaattttgaaatcaagttctgctggcgaccttttaaaatttccgggtatcacgagctttaaaaattcccagaaattttgagttatggcgtagaaatctggcaattatcaatcactcactttagcaatgatttccatctccccctggcaattcaccaagttaaatattatctctcccacaccctcatttatctctgagaagataaattcactagtctatttgatcacgattttagcatggaattcagtagtggctatttaagatttattttgacatatttattcattcgcctcttaaactgatcagagtgtcctccagtgacagcaaaatgtgttaatggatcctgcattgatcaagtacaaacaacaatacataggatggagaatttagtccaatcatccggttattatatgtaaatctgatcgatcataatctatctcgatctaacagtctgatcatttgtcacatttgagacctatcgctgatcaacttttttcgattgatcaccatctaacctgatcaattcgaacattcctaaacaaattcttgcccaaattcgctttgatcatttgcaattaaagctgatctcccacattaatcaatttaaataaattcttaccaaattcgatctgagcatttgtaattacagccactctccccaaataatcaaatcatcaaataaattttgcccaatttcggtctgatcactcgcaattattataactggactttccaataaatttgaatgatcaacccatcgctggcccaaatttcggcctgatcactcgcaattactccaaccaattcccttggccaaatttgtttgtttgcgcctcttttttaattgtcctccgctccgtccgtcgtcccccaatttttgttttattgcaaatgatctgacaatgagtgagatgagatgttgatgacaaactgatgattgttcacattttgtgtttggaatcgttcgatttgagaaacattaattgacagtgaatgaatgtcccacaacaatcataaaaaatgataattgcataattatgttttgcaaaatgccgcaccgcaaaacaaacaaagggcgcaccgatcgaaaaacgaacgaacgaatgagtgaataagtgcccccaatttgatcgcaagtcaccacagttaaaacaaacatttcacaagcaattttatttaatttatttttttgccaatttaattggttcccggcgaccattcgtcccaaatttcgggggaaaaaaatgcaatttttacgtccctaccatatatctgtatataaaatagcggcagatttttgaggaaaaattactgattgtgagctgtatctttaaggagagcggaaattttgaactgctctgaccgatatatttctttaaaatttgctgctcgagagtctcgacccgagaaatttttgctttcagtgtgtcgagtctctgcaatttttgattgagtctcgaatatatttatcaaccatttttatacccctaaatctcaagaccagtgacaataccaaagggatccaagaatttgcttggctgaccggcataaatgaaactaattacctaaataattaaaggtttttttttatttaacacgggtcattactatttcattttttcatttctacatttgctgatggacaccatttctctgcaagtactgctcgcatttgcgatgtttgccaccactgcgttggccggactgcttccgatcaaagtgatccgaaattattaatcgtggattttaattgagagaatttttagaagaaatttattttgtatattataggactgctgataatcttgaccaattttgattaggaattaatggatttttacaaaaatttaacagaaatataaattttaaaaaatcgaatagaataagcattaattattttaaatccaattttaatcaaaacatttgatcagaattttaattaattttcagcttcttcacgcgatcacacgtcgtcaggacgaaaatgatgagcagcggagcagaaaatcggattacattttgacgcttttgtcctgttttgcgggcggtgtgttcatgagcacttgcttcctggacattttcccacatattaagttagtttccgcttatgaatcccgattacattgtctggatatgtcttcgagagtcacgagacaaggattaaaattttaaaatatttatttaaaaattgaaataatttttatacaaaaatgtacgcaaaattccgatcagaatgtttgagttcgacatttatgtcaacaaataatgatccgatactgaacagcaaacaaatcctgacgatccccacttatcccccatttttcagcgagaattacgcccatttttggccaagtcccagtggaacaccgacttcccattcccgcaattctttgtctgctgcggctttttcttggtctattttctggaggagatttgcctaaaagtgttcgcgtccgcaaaacagcaccagcaacacgcgcactgtcacaacggtggccatggcggccattctcatggcaacagcgaagggtagggaaaaactggcaaaaaattttgaattcgaaacgagaaaaacatttgatggaccttgccttgccaccagaattggtttcattttcccattggaggtcctattttccaaatttatggtcctaaatcctaatcctagattaattttgtcggtttttggatttttcgaaacgaatacccctaataggcacagacaaatggtcgacattttttaaaacacaaatttgatgcccaatttttggtgcaaaaagcacacagcatttttgagcactagtgaaatgcacaatttgaaaatttcaacactaaattaaaacaaaatcataaagaaatgagctaacgccaaccaaaaaataattatatgtctgatacggtaaaatgccttaaatttctgctaattcgatcatttacagcaaatctcatcatcatcatcggcatggccatgaagagtgcaataatgagccgctgaaaacaaacgccggcagcgacaaaaaagggtcgaatttagggacaataaatgagagacaaaaataag

SEQ ID NO: 8137 - DNA, 2368 bp, Heterodera glycines
ttttagaaaaaagaatatgtgcatttgcattttttgcacattgtcattttgggcgagtgtcggcatttatccgtcgttacaccaaaaagcccacaataaagaaactgtaacaaaaattgtctttatccatctctttctttctaactaaattttacaacgattttttatgcttaaataaaccaaaaaaaatgttggaaatttggaaatattttaacaaaaagtctatatgtattatttattgcacgtgtaatatctgtgccaaaaaaaattgttcgaaatgatggttcgatgatggacatgtggaagcagtctgaagcaaaacgcaaacaataatttactgagttaaaaagaggacaaagtgacattggcaatttattaaagagcgaagtggcggatttgagtagagattttaatggcgaagtttttaacaacacgtcgaacagctcgggattcccacactttaccacttttacggtgtgtgacaattaaatgaccagaagcattaattgaccaatcaatttgaaaatattttgctgaatgaacaaaaataatttatttcaaattatctcctttcctctcccgttttaggtcattttttaaaatatttctcgctattttggtagcagggcaaagaaactggatagtctgagctcttataaattatgagattttatttttttttctctcaattttttcttttcatattaaaaagtaattaattgccattaagacaaaaattggagttgcaaatgttcggcggcaatttaccgaattgtgccgcaaatggacggtgtttgggatttcaggaaggaatttaaagaccatgtttttaacggtgaattatatgactggggatttaaaaatttcattaaattttcggtgaggaataattcaattttttgcttaattcttccaattatgaggtaattaaggaattgatggacccgagcaaaggcttttacaacaaaagcgaggacaaagtgacactaactgttgatttcattgtaaaagaagcaaaaatggcggaagacaaatcataaacaattgaacaaaaaaaagatccatcaattgtcatagatcgcattttgcattgtttctaagatttgtccggtactagtccagtttttttaccccattttttgatcaaattttttttcaattcttcacacaccatcccagaaatgagctgctgtaccaaaaaagatttgcgtgtgtggctcagtggtttttgtaagatagtaaagggacaaagggtggtggttcgagtccgttgtgcaacatgaatattttcatttatttatgtccaaaatattaaaaaatgacgaattttgggaattatttttgaaggtttttcccaaccaaattggaaaaacttgatatcattcgaaagctctttatgaggagaagctttttctaagcaactgctaagcaattggattgaataggaaaaagatattagggttcgaaattttggttctcgaataactttttagttaaccctttttttgcgtttaaaaacccttacattttgtttgtaatttttttctctatcgatatgcaaaatttggagtggatctaacgtatagaaaaaaattaaacgtagcgaagtaaattcgatttttctctattatcagagacaaagaaatagtacgccaaaaagagagatgtttttttctctgcactctctatttattggtacacatctcgttttttgggatggtgtgttcaataggccaaaataattgtcatattcgtggtcagcgacctcaaaaacccccgaatatttgttttcataaacttttaatccaaaaatgagttgaaaaaaatgttgactaaaaaatgggatacaaactgactggagtagcatttgtccttaattccgcctttcatcttcatcttcatcttttttttaatttgtctgattttgataataaataacaaaaaatggcagtttttagtcaaaaaattgataaaagtgtctatttttggcgcaaactttttatagtttcacattacccaatggtatttgaatatattcaattttcggctctgttccagtttacgcgtccaatcaatatttacgcgtccaatgagtgaccatcctcacttttttaaatcataacttttttattacttggtaatacaaaattctttttgtttacgtttggattttagtcggatcaattttttttaccgatggcaaagcgatgaaaaaatgcataaaaacaggggggggggaaggagcacaacgaaacatttgcatgtttttgctacaaatttcctcaaaataatcacaaagcccaactgaacataaagttttgctgattttgtgccgtggtttttatttcttgcccaattttgaaattgc

SEQ ID NO: 8138 - DNA, 2058 bp, Heterodera glycines
  misc_feature (1820)..(1820): n is a, c, g, or t
attacttaggtaatccaaaattcttaggtattaatctaaagcttaaagtttagcgtatttattaatacaagaaaaaaacaaatacttacatatattaagaaaaaatttacacttccccaaattttaagctttcgattagagcacaattttctcccactttttttctatccaaaaatacaaaaatatctttgtttattaatacgtttaggtaattatcgtacattgcatctatttttcaaaatatatttgtttacgtttgcatttagtcggatcaattttttttaccgatggcaaagcgatgaaaaaatgcataaaaacagggggggggaaggagcacaacgaaacatttgcatgttttttttttgctacaaatttcctcaaaataatcacaaagcccaactgaacataaagttttgctgattttgtgccgtggtttttatttcttgccaattttgaaattgccaataattttaccgcatttaaatagataattaaacgaatgatggaattgcttagcatgtccaaaccgttggctgaacgaatgaagcatttgttgagcgcgggagaggacgcggatgtttattttttggtgggggacggagacgcaaaagaggcgagtcttcaaattaaaaatttaatttattaattaaaaattggaaatttagtgaatggtaatttttgttgtatttttttaaatttaatccgcttaagcttgtgccagcccatagaatcattttgaagttggcttccgacgtttttgaggcaatgttccgttttgacgccaaaaaagaaagaccggaaaatggtaaaaaaataataattttaagggaaaatgccaattatgctatttgttcttcattttgtctctgctaatttccctaattaatttttcaattagtttctggtaattgtcctgatgttgtggagatacctgacattgaagcagaagcgttcaaagtgatgttgagcttcatttatacggatgatttaagtgatttgaatggagaaaatgcaatggctgtgctttacgccggtggatttaattttatgtgacaaaaataaataaattatttaattagccaaaaagtacaatatcccctctctggtcggctcatcttcgcaaattccaatttccgaattgcgcaatgttttcttcgcttttgcccaggcccgtcttctcgacttgaaagtgggtaggaaaaattgaaaaatgcgaaagaattaaaaatttgctaatttttaactattttgtcggtttacatttttcaatctcgtgaatttttccgtcttgaattttgctattatttgcattttttttgcaaatattttcctacactcaaatttttacaaaaattttttcgtttatttagaatgtataataaattaaggattttaagaccaattaattgctgctgtctgattgtgagatcgaaaaacccttgactttagactttttttttgtaaaatatgttcctcaaaaaatgaatgtttttttaagtttgtcaaaagccaaacaatcattagagggcttaaagaaatctcggtcttctaaactcgaaaacctagacaagaaaaactcgattcttttctcgctttggcactctcagagaaagactacattttaaagattatttttcctttgaattttagaattttgccaattgttgtttggcttacattggcaaaaatgcggacactttgctcaaatcggatgaatttttgcaaattgaccaaaaattgttgtgcgaaattttggagtgtgacgaattgcaaatccgtggagaaatttcaatttggaatgcggtaattttaacaattanattttaaaaactgtaaattttattagtcatttaattatttccattaaattttttaaaggcactccgttgggccgacgaaaagtgccgtgaaaatggcattgattgttcagcagagaatcgccgtcaaatgcttggcccggcactgttcaaaattcgcttttccgcttttggcaaaccgggaatttacaaaaaaaattggtaaaaaataagtcaaaatttcaaaatcgttctttgatga

SEQ ID NO: 8139 - DNA, 611 bp, Heterodera glycines
gcgagaagtcattgggagtgaacgtaaaagcgaaactgtgcacatcaaaggattgccatggaaaatattggcacaaattgaaaagaaagatgaaagcactgacaaaaatgagaaatggttgggcttttctctttggtgcgatgcttctgaagaaggtgtaaaattactaataattaatatatatattaacaacaattaattaattgatattgagcagaaaattggagttgcaaatgttcttcaactcttcgaattgtttcgcaaaagcgcggcgttgcggatttcagaagaaaactcgatgaccatgtttttgacaataaaaacagaggctggggatacaatttcatttcatttgctgtgagtgacaattaaacttttccttaattgatccaattatgacaattaaggaattgatggacccaagcaaaggtttctacgacaaaggcgaggacaacgtgaaattggccattgatgtcacagtgaaagaagcaaaacggaggacgaaacataaatgcccaatatgatttggggaaaaatgcccattgaatatcctccatcctatgttgaacctatttttttatttattaatttttcttaattatactttcaaa

SEQ ID NO: 8140 - DNA, 1568 bp, Heterodera glycines
  misc_feature (41)..(41): n is a, c, g, or t
tttatcggagattcgatcaattacacttcatgtgaacattnagcggacattattgcacattcatttgatagagacgacattaatggaattcttttatggacattttatgtgagaattagcaatttattccggagaagaataagcttaggtccatttttttatgtgatgcagtgaataatgcgctgatttggcaatattttggttttattttcagcataaaaaaataataaaaatttgcataaattcaccgatttctaaatgtatgccgacaaccctcggggggtcagcaccaactctgcctgcgggcaaaatacagaatttgattggagcaaccccgcctgcgggcaaaatacagatttaaaggtgaaaagtgaggatcaaaatgtagtgatcaatcgacctgtgtggcgcataaacatgctgagccacatgaactcgagtttggaattatttggagaagagtcagtccacgcttttgatgattgggctgaccgatttaaggactatttgtcactgacagggaaaaattggaccgaagaagaaaaggtcactcgccttaaactagcgctcaaggacacgccgagggaactattcaaagaactcaagtctaaccaaatcacgacattcaccagcgctttggaagcattgagggccaaattggactcgcctcaaagacgagaagtggcgaagcggaccctttcagtttgccggcaacgtgaggacgaaactgttgcccaatttttgagacgtcttacgccattgattgactcaacaaatccttctttaacgggtgatttgcgcaaagaaaaaatttgtgaggaatttctggaccgattaagaccaaacatgagctttttgattcgtttggtcgggcttacgcaacccaaaaatttggaaatggtaaaggcccaagcagaggaacttgaggcacttcttctcagcactggaggcggtgttacgcaaatcacacaactcatcaattcaatgacggaacaacgcggaaatgaagaaccgaatgaacaaaacgaaagaaaattcgaacaacaatggagcgacaatggtggggaattcagaaatgccacttcacatgacgcgcagtgctcgtacttagaaaacgaaaggagtgaaggtaaccaccaaaattggccaagaaggcgccacggaaatatgaaccgtagaaattggtccaattatccgacctgccaattgtgcaacagggccggacacagttcctacaactgccatgaaagaagggcacaatttgaagaccaagcaaatggcgaatggcaccaacatcgacgactaccatggaacaactggcgtgatcaggcaaatgaaatgaatgaaatgccgcaatcgacatcctctttggcacccgaattcatggaggacttggtaaaatcattaatcacactgaacttacaaaagctgaacaatacgaggccaaacaacagggactgaatcacaaattgcagtttatctgcgatcaatggaagtaatggagaagacagcaaaaaggttggaattggcctgcgggcaaaatacagaaaaactaagaataagacttt

SEQ ID NO: 8141 - DNA, 5580 bp, Heterodera glycines
gaaattccacttcacatgacgcgcagagctcctactccgtaacggaatgggtgaaggtaccaccaaaattggccaagaaggggccagggaaacatgggcaacaggaattgttctaataatccgatctgccagttgtgcaacaggtccggacacagttcctacaactgccatgaaagaatagcacaatctgaaaaccaaacaaatggcgaatggcaccaacaccgacgacgaccatgaaacaattggcgtgatcagcccaatgaaaggagtgcaatgcagccatcaacgtcctcattggcacccaaattcatggaggacttggtcaaatcattaatcactctgaacttacaaaagttgaacaatacgaggctggacaacagggactgaagcacaaattgcacttcaactgctcaactgatcaatggaagaaatggagaaaacagcaagaatgcttgaattggcctgcgggcaaaatacagagaaaactaactctaagactttgatcagaactctaattgtcttgttaattttttactctttagactaaattttcaacatttgcttcgcctgtgggcaaaatactgatcaaaaacctatcataacccaaattctgtaagtttccatcaaaaaaaaattgcttcaatcaaatctcacagcagatcatttggttggaataaaagtgatttaatccaaatcggtctcatccaaattgatcaccacaggactatctttctttgttttcgggactggcacccgcccttctgccttctgcctagcccgctgctcttgtcgctgagacgcaagctgctccttgctagtggtcctctcacgatgaccactttgctcatagcggagctttcgtgccctctccttggccgaactttccatttctctgcaaaattcaactcaattttcattttacattgaccaaatttctaacttgactccctgcaggtactcttgactctgctcctcggagtattggtaaaattctcggctgctaatgcaatcacaccgagttttctggccaatcacttaaaatgaagaatttcagaggacccatggacccaaatttgaccaaaattacatttaaattgcctcgctgccctgtggttacagagctctttgacaaggcagaccgatgccccaacatttatgccacagtggaggcccacagtaagcactgcgtcgcccggccgctggacatggaattcgaaaggaattccagccttgcgcagctgggccggggagaaaaagaagctgttgtggcccaaggggttgcgacagcggggccaacggtcgccaaacaatgacttccccagctccatggccttcttctcccattggccaccaacaaacaaccacaactgaacaaaatctgattttttttctttttttttctccattttacgcagccaaaacctttaaacccggccccaggttgtagttcaaatgatggacatgctcttcctccctgtgaagcgcaaacgcggaggttccgggaggcgcacagagcccacggatcatccgcgcatcgtccggcaaactggcctaggattaaaaccgtacaaaaaaaacacccaaattttgccaccattttttcatatgggccattgcaggactccaacaattgggtaatttgccggtaagagtccgtcgtttcggccggcggggcgaaccattgtgagccgtaataccattgtttcttcggcactaatccgctcacaaattcattgaaatacctatttttaataattgttcatatttcaggaaccaaaaaaaaaaccgttcaattccagcctccgattcatcagtgaaagccaaaaattcctggccaaaattcgtcgttgtcagcacagtcctgatgtaatactcgaagccattcccgacaatcaaataggacagtgcaccgtcccgtcggcaaacaccgatgcgctccattttcacacggcatgccaaaatctccgccggcaagccattttctacataaaccttggccgtaaattgctgctttcttcggctcggcccaggctggcactcctccaccgcctgttgcgcctctcccgcaccggtagtccgtcttgctgcggcctgcttcagctgctcattgcgaaaacggatgcctaagccacccgcattccagactgccgaccactttttgtcgtcgcgcaggtatgccaacaattctgcatagaaattgaccgccatccagaattcgtaggtttcgagcattttcactaggacttggtgaatttaaaaaaatagagagagagagagtggactgcacaatatgcgaacgagcctgagggcacaatactgactataaaaaaaacaagcactaagtcctataatttattatcgacataattcctattgaaaaacatttaaaataccccccacagttaattctatccaaaattacacatttgtaaaaaaaggcatttattaaatatttaaaaatgattttaaaaataaataaataaaaccatcatttataaattcatttatcttcaatttctctggtctcgccatttttcttctttcactgtgcccaccattcaatttgagccatcataatcgtcgccgaaccattcaacagaaatgacctgaaatagaaggaaatgcttaaaaaaaaaaaattttctctctgaacagcttggacctgatgccttgctgaaagccatgtttctatttttatacctattctttccctcatatcaattttccgtgctcagtaaatgcatcattaaaattcaataaaatcatggctcagttggttttctatttttttttaagggctaggttcaatgcccctctatgttaaatcatttttattcattttctcatttttccccgatttatgcaaacctgaaattgggcgaccaaaaagcagaaatccggcacatcggatacaaaacgaaatggacacgatgccttcaaagaccacgggacgagcgaagaaaagctaaaattggaaattttaattttttttttagccttttttaaacggccaacattttcttttctctcttttatttttctaaaatttcaaaaaaaaaaaacatttttttttttctttcgtacacaaagtgcaggtcaaccatccataaaagccgattgtgaatttcgtccagaaatttaaaaaaaaagctgattttaatttgagtaaagtatgaggcctgagggcacaatacaaagaaatattttgggggtttttgagaataagtgtatatttgaccatttttgcatttttagagcatatttcggtcatttttttggcaaattttcaaaagaaaaatgcaaaaaaaaaaaagcgagaaatacccccctaaggatcgacttttggggaatttaaaaaaaatataccattgaaaaatttttaatttttagtattaacaagattaaaaaaaaaaaaaaaaaatcctataaaacctaatttttgttcttaataagccggttttcataatttagtgctgtttaaaatcactaagattaaaacccctaagttttttttctcacccaccaattttttcgggacgatgtgtcgcctcatcaacttttgcttcaacataatgcaagcgagtcgtcggtgtacaatctgacaaaaatgagtacaaaattaaaggtgtttcaaaaatttaattagcgccaatgacagctcaaaaaaaaaaaaaaaaaaaaaaaaaaacttttttttattcggcccttaattcggcagtccttcaaaaaaatgtttaggtgtataataaaatttattatttctattactgaattgccttttctatggtaatgaattgtgataggcctgcgggcccaatactgactcaatgttttttgtttaacttaaaattggctccaaaaacccaaaaataggcattaataactcaaatttaaacgtttgaagcttaaaaaagggggtaaaagctaaaaatatcacccctaattaataataattaattcatttcttttaacctttcaattgtttcccaatgcttcaaattgtccttggcctttggtgtcaattcggtgccccaattcaccatttgccatcgcaccaattctgctgctatttttgcgtcaattgcctttcgctgggccttcaaccgttccaattcatttccatcgtcggacagtgcaaaagagggcatagattgtctataatgggaaagaacctatagttcataccaaattatatttttttttttttttgccaaaaaaaagtttatttttttacaattgttaaaaatggtttattccaaaaaaaaaaatctttaagattgagttaactctaccaaacctcaattgcccttttaccaactaaacatttatttttctcttactttcaaaaacctttttacaaaaaaaaaacctgataggaagagttgaagaaccacatgtgcagcgccaatgcagtgcctccccctcgcaataccccagcgcgagtccaatatcggcagaaaatgctaattggactgcgtttctcgccaatttatttttctattttttcttcctcattatattctctttcatttctcacacttacttatgcttatacacctaattaattacaatccaaatttttttttttttttttttttttttacttttattttattttaattatcacatttcgccaaaacttttcgtttcaataaattcactaaatttaaaccgtctgtcgtccgacggaaaatcattttttgccttttattcatctattattaatttttatcattaaccatttatattttagaaatctttaattaataaatagtacaataataataattaaatattcattttaatcgcctaaatgaccaaaatagaggaaataaaagtcaccaatgggactcttatggaaaacaattaaaatttacacatcgccaaatcaactttttgcgttgatttaaaccacatgtcggccgacatattggcccgatctgtcgttttatgtccatcattcatgtacaaatatgagaaaggcttgaaagcacctcacccaatttttacaattttttttctattattattttttctctccttcacattaattttgacttaatcttctaaaacaatctactgagaatgcctgcgggcacaatacaaattcggaatgtaacaaattgaagtgggaaaatttgttaattttatatcttagcaggcataaccaccccccaattattcgttaataatttgcatatccctcattcgtttattttgatcccccatttctgtttaaggaatttgttttgttttccccacaatttttaccaatttgttttgcacatttctgtcaaatgttgcacccttctcctttcccaccgatttttgtctcatttccttgccttgttgcacatccctgcctttttgactcagacagccagtgatggcctttgaatcattaattttattccttttactacgggcaggagacgaccgcccttagtctcttccttaattgcctgccgccgcaaacattacacatacaaacattcatacttactggcaaacccaccattagccatttcattcacataaaaatacttcatttcattttgtctctattcttcatttaataaa

SEQ ID NO: 8142 - DNA, 2776 bp, Heterodera glycines
aataaaagaatgggttataaataaggaaaggatgcgacactaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctcacccgccgctgcccgcgtagacagacaatcagacagtgcactattttcccaccatccctccctctaacctctacatcctagaaggagaaatcttttaccttctttttctgtgctatttcttttgtcttcttcttcttcttaactatttattttcgtctcttttctttatattctcttctttttcaaaacaatttcttttcatctcttttcaaattcatttttaacgcaaaactcaaacaaaacgccacacaaattcaaacagtgacacatacatacatacatacatacaaacactcaactttattatataggattatttcgtaggaatgatttgagtgaaatgaaaagtcaaaggaaatgttttgcgggcgacggtcactgatcggcccaatggcatttattcttttcgggacggacaaagcgtatggttgtgccgagcgatcagttgcctggtcatgccgcgtcactttgctcacctacggaggaagagcaacactaaaaagcgacaaattgaaatggcaatgccatgttggcaccccctccactaattaaagaaaatcgcatccaaaacacccttaattgcgttacgtcccaaatttgccaaagggccaatgccgcatttgccgcccaccccccaaattgccaatgttcgtcccctccgcgccccctccgttttcacctgttttaacaataatcgctgctgcggaagtgaggaccgccgctgttggcgcacttcggcataataaccatcacggacattggaaaacataaactgcatgagctgagaccaggccaacctgaaaaacggagaagggcattccatccaaattggccatttcttttggcattttttcccttttttcaatttccgtttttctttttttgcgttgtgtcattttccatattaatttgattgttcatttgttttgctgttttctgctcacaatgtttcacatcgcttctgcgtccccgcgtccaatcgcaaacattcggcgattgtcgcgtcggcgatggtggaaaaaaactcgggccgaaagccaaagtggcaaagttgggcatgcatttcgccaaaagcgaacgaagtggcggcgactttggatggcaattcgatgttcgccacacattcagtgatcagcgagaaaatgtcatttgccaattcgtccgctttttcttcctgcaaatggccaatgaacgatttgaattcggcacggagggcagaagctcttttcagaatttgtggaccaatgacgggtctgaacagaacgaaagtgcggagaatggccagaaaatgccgaaacacagaaaagaattaattaaattttaatggactgttaattggcaaatgtttcgctttaagtatgccccgtgtccctccttttcaccgactttgcgtttctgaagcattgctgaatgcgcagtcgcgtcagtgggggcatcgctcccccatttgcggtcgaagaggagaatttgcgaccgtttttgagaccatcgccggcgagtgcgtgttgataggagaggttggcgatcaccttaggaatggtagaatagcactaatcagtgattagaagaattacaggtgttcaattgctttccttctctttgttatctgttcactctctctctctctctctcgcccctctttttcacattccttcttttgttcttcaataaatgccgaattttatcacccctttttctcatggtctgattgatcactttcttcctcctcctcctcctgatctgttcatcttttctcctccccctttttcacattccttcttttgttcttcaataaatgccgaattttatcacccctttttctcatggtctgattgatcactttcctcctcctcctcctgatctgttcatcttctcccctcccccttccaaaaatgtctttttgtccttttctctgccgtgccaacctgacattccgccgctttcatttgtgccgtgcatatggatgtgctgcgaatgcgctttttctgctgttgttccaccgtcaaaagaaactccgaaacggccgaatctttgcgttgtttcgcagtcgaatttgcatctttggcatttttcgctaaataaaattccaatggcatgccgtgcttttgctgggtgtcttcgtctgctcaccggtccctccgtacgtcccctcgtcccccgggggttgcttcttctgctccgtctccacccgcttttcctcctcctttggctgcgtttgtcttccatttgtccctcttctgcccatcatccgtccctccactccatgcgattgttttcttcttccgttcctctgttttttgatgtacgctccgccgttcaaatttttcgattggtcattttgcaattcaatcgccggcgtgggacaattggaaattgggcttaaaaagacagaaatgggcaattaataagcatttgatggcacacggaaagagtttagctcataaaatgtgccctttcccctcccttttctcttcattttgccttaactcttcccctcccctcgctccctttctttcttttttttattcaaaattgaattgtcacctcttctccgctgggccttcttcaatccc

SEQ ID NO: 8143 - DNA, 1789 bp, Heterodera glycines
gcggggggtaatgagcaaatgtgagggaggagagaggagagggaagaggggaggcgtaatagagggaggggtggggagaagagtactaagtaggatgtcaagagtgtcaagggaggaggggggtcacttgtgataaatgcggcactctccacccttgtgcctatgtggtagtagaggattaagagagtgatttcgccccaagataaggtgaaatgagagtaatggagagaggcctgcgtagctcagttggaagagcacggcacggattgctggggtcgtgggttcaagtcccaccgcgggttgatcttttactcttccgcacaaagaacaggacgatacgtcaattatcagatagaccagcggaatggcgagaattaattagtaacctaacaaagactcatttttaattaagtatatgaaaaataattgtgtttttcgccacaggcaatcatttctccgttgcgcccacggccaccgccggttgcgtcgcctgcgggcagtaatccgatgcgagtggcacaacgaaatgccaataccacaacagccgtgggtgggcactgcccaacctcagcggtcactggcagccgttttacccggccaacaaatggcccttcgactccgtcgcggccgcctctaaattcgaaatggctgacggaaataaaaaatgaaatgctaaataaattggctgaagttgaggatgcttttcctcgggtaagcatgctgctgaagaaaatggcactttattttttattaaattaataatagaaaaataataatcatttttaaaggtggcaattcggccccgtgtatagttttactcgtttttttttacctttttagtccattattttggctaaacattaaaaaacaaaagattatgctgttattttttttgtgatttagtccaattagtcgatatttgccattttcggctttttggttcaaagtttttttttgttaaacgtgatcacattttatgaaacgatttagttaagatgcatagaaatgcggcctaaagtttcaaacccaaaatgccatttgtttttgatgctttttcagaagaatcacgcacttcgtcatagtaatccaacgccagaacaattaaaaggaattatgatcaaaatgatagaagaaagcatagcagcatttggtttcgagccaacagattatttggattcgaaagtcatcattgaacagatgacgacgaatgggttaaattttgttccaaaatattcgcaataaaaggacccagtttctaaattgattcaaattttagcattacgtatcgctttaccctcagttgggccccagaactttttggatataactttttttttttgcttcgcgattagacaattaccaaaaaaaaagttataatgaaaattgcgaaaagtcgttgctttttgtatggttaatagagcatcatgtaaagagctttcgaatgataccaacaatgttggattatggagacaaagaaaaaagttatagtggtaaaacaagctggggcccaaaagtgagagcgcaactgagagagtccgttaggtatggctttaaagtttaagcaattaagagtcccacgggcaaaaaacggcgctgggaaattttaaaatctgacagattttgtttcaaaatggacattttcactttttagccccatttttgaaaaataaaaaaaatgcctaatgtgaatatttgaacgagcttgtattgcttttatcttgctaatgacttttttggaccaaaatgtttcccttttttagtgacaacaatttgctggaaaaaggagcga

SEQ ID NO: 8144 - DNA, 1555 bp, Heterodera glycines
  misc_feature (1525)..(1525): n is a, c, g, or t
caacaaatcgtccgaaatcgtcaattcgctcacttcttttgcatcgactggcagctgctccaagttgacaagaagagcatattcgacttcttcagtgctgtccacgtcgttgtccgatgtgtgggcaacaatgacttcttagtctgtccggtgctcagaaatcagtcgagacaaaacgtcggcatgtccaaaatttgcagatttaaaattttattgtaaaatcataattggacaaaattagggcccaacgctgcaatcgggaagccgtgtagatcgggatcccatttttattaccgaatatagccaagagaggcttatgatccgttaacagagtaaaattacgaccgtaaatcatcctgtgaaatttttgaacagcgaagatcaaagacaacgcttctcgttcaatttgggcgtaatttcgttccgcgggggtgagcgttcggctggcgtgctcgatgacgcgctccactccgtttggaaacacatggctgatcgtggctccgattccactttggctgtcatccgcagcgacaggcagaacactggcttcacattttgcttaaaatgcagcgtggcgttcgtcttcacacaatgtccgaagccaggttgaaacaccttcgggaaggaagccttgaaactggctgttgggtggcacgctcgaaagggatgatccaatccaatgccatgatgctcggcgcttcggtgtctgccactgaaagttcaagccgcattgtgactcctctgaacagaacgtcacacttgaaacttcccaacaacttcaatttgtggcccgaaaaggaacccactaatttaccaactttttccaacctcggttcgcccaaactttgccaaaccgcaagctgtatgatcgacaaatgtgaacacgaatcggctgcaagtttgatctggtggccattgacttgtaatggaatccatatccattctttggtcgcaccattcacactgaaagtcgaaaccacgacgtgtgattgaacacgtggatgagctgaattggtgcaaatatttctcgtgtgcccttgctttcgacatccaaaacatttgacgtccacaggaaatgaacagtctcgcaccgtcagagtcgctttttggtgaattcacggttaagctcaaaaatgcgcgggcgtcggcagttgttgtgttttgctaacacataaacaagataaatttattaaatgaataaacaataaaattagaatcacaaaataataataaaataacgacggagtcaaattagagagtccgaaaataaacaccgaatgcaaaataacacaaatgcaaagaatgagtcgatgggagaggacccatcaacaaataactaatcaataaaagtattcgtgtcgaaacttaataatattaaatatcaacacatccaacacgtttaaagatgaaaattgtcaaaattaacagcctaattttgaatattgcccaagtgaatttattatgatatatataaaataaaatttgttaattgaaataatacaaaaattatttattaaaatttaanggaattcatctaaaaaaaccagaatgattt

SEQ ID NO: 8145 - DNA, 3609 bp, Heterodera glycines
  misc_feature (61)..(61): n is a, c, g, or t
  misc_feature (85)..(85): n is a, c, g, or t
  misc_feature (117)..(117): n is a, c, g, or t
  misc_feature (136)..(136): n is a, c, g, or t
  misc_feature (191)..(191): n is a, c, g, or t
ttgctaatacttataaaatatttttcgttttcaactactttaaatcagtatagtgatttantaaattaaaaagtttctaacattnaagcaaattcgttacattttagaattttttgnaaaatatatttatatcttnaggccggcagatttgttaattttaaaaattgtttttatatattacttaaatttgnaaaaactgacattagtttaaagtgtttttaactttagtattattatcgatttgttataattttcatttttttaaatgatataataagtttttttatggtttaaaatcctttttctaatcaacaagaattaattaacattcggcacgagaaggcatagaggatacagaatttagttatattggataaaaattgaataaataataatatttttaatattttatagtaataatttattttttatattccattcactttattttttgatatttttagtttttgtccgtttattttaggatccaatttctatattatttgttgtatttatttatcgcaattacataaaataaattaattttttaaattaattctaccttttattaaacattttaatatgttattctttttgaattatcaagaaattttctttgatctctgcgtggccggagaggccgcaatgcgccgaaaatatttaatttatttcaatttttcaaaggttgtttaattttctgcttctttttttgttttctaatttgttattaaatatgtgttaatgtattcgaaggtgcgccctcgctacggtaatttttttcgataaaacagtactaatgtgtcttaaacttttttttgattttatattcatgaagagactaaacatttaatatttattataattttttacaatatattttaatgaagttttactcttatagatggtcaacaaatgagataattattgttaaaaatattaacgcatttatttttaactgtttttcagtatgataaacaactaatattttgattaataaaagatataaaatattttactgatttagtatgttatagacattttgttataatttgatttaatttgaagtattaatttaatttattatttttactcctttaatgtgtagattttttctatgcaaaattaattattttaaaagttaattttatgtgattattaattaaataatattttattcgatgataattttcattttgtttttattaaaattgtataattgatggtttgcctgtatatttttatttgtttttataccctttttataagattttaatcattaaaaaaattcaattattaaatttacaaagaaattttccatgtcacacgttatcataactcgttgaatcctcctctatagacatgacaatacgaaaatgtaggagcaataatttttataaaaatatgctttatctttaacttatatagaatattttattttattttgaagattaataggaattttttgtatttaaatttatttcttgttaataaaaatttagttcacaaccataaatctattttctaaatgtatttattaaaaatacatctaaaaaaactaaattttgcactcgtcatttaagaaattgtattgagttttattattcgaatatggaaacttatgtagattcattaaatattacaaaacatataattaataataagatttttagcgaacttaacacaataataattattgattaattttgttgtctttttaaaatttaatcttattacttcttcagttaacaactgaataatttgtaatattttgtttgattttgtcctattttgaatttaaaatttatatgtttgaaaaatttatctatatttctggattaatttactactcttgaatttattttagctttaattcactaatactactgtttattttcagaatggttaataatcaagctttgtcaacgtgttgtttgaaatgatttttgcagctacaaaaagtctttgctctatgtcttaatcattttaaatagaaattaataatttatatttaatttaaagcggtaaaagttaatgaaaattggttaaaaactagctgtatgtcatgcatcctctatgccttctcgtgccgaatgttaattaattcttgttgattagaaaaaagattttaaaccataaaaaaaacttattatatcatttaaaaaaaatgaaaattataacaaatcgataataatactaaagttaaaaacactttaaactaatgtcagttgttcaaaatttaagtaatatataaaaacaatttttaaatttaacaaatctgccgacctaaagaatataaatatattttcaaaaaaaattctaaaatataacgaatttgcttaaatgttagtaacttttaatttataaaatcactatactgattaagttagttgaaaacgaaaaattattttataagtattagcaaatttagaaaattaaaatatttgtaaacggtgtgcgaaattttctaattaaaaataatattatgctagattttaaaccataaaaatcgagccaaaaaacttattggtacttaatacgacgaaaaaatttacgcactgattctcaagaaaaagagaattattgatctgcttaacgatttaaatggaaaattatattaaaaaaaaaattattttgttaaaatctcataccgaaagccctattaaattctcatttggaaaataaattaattttaatgctaatatataacaataaaaacaacaatataaaggaatggaacccaattaagttaaatattttttataaaaaatgttaaattagcaattatttggtgctttagcttcttatgttatttgctacaagaaaaatgcttttctttcatttccaataaagatattaaataattaataattagaaaaaaagataaacccacagggcgtaaaactaaaagtataatgactaaacatttttttgtccgaagctgaataaattcactatgagaagaaaaaatttaatgaagaaaaaatagttcagaatgaaatataaaatccgcatgtaatagatttttaacagcaaattccaagtgcttaataatagctatacaagaaataaagaaataaatcatggcattcattcttacaaaatgttttttctgcatgttgtggccattaaaaatgcaaaataaaatatttataaaatttgaaaaatgtcaaaaaaaataaataaataaataggtattttaacaataaatttcacgtattcctaaaccatcattgatagttattttatattgcaatataattattatttgtatctttatttttctcatttatttataatgcataagcgaattaaatagttgattttgaactttaatttttattcattctgtataaaagaatgaatgtcaatttttaaattaattaaaaatattttcaagaatttaatttttaaaattgcattaatcaatattaaaaaaattcaaaaaccatatatatttagttagtgttttaattaatttatacgaaagtaatgaatctttaaaaggcaggtatataaactatttgcgtgcagatctgttcgtaaccatttataaattattttaatttcgaattttcccctgatcgggattgcaggagtttttcgttgaaa

SEQ ID NO: 8146 - DNA, 6578 bp, Heterodera glycines
aagaaggacgagatttctagtacaattaggcagtttaacttttcaatcctattgaatgagaataaaaggcgaataggaaaacaaacaaataatgatcagagaaaacgcatcaaaaaaggataaaatattctctaccaatttccttcctttaaatctatgcccaaaacttggtacgaagggtcggatggagttcgtcggtgactttggcaaagtaattgccgcgttgttctgaattcaaatgctccatcggaaaggaaaaaactgtgcgaacgaaccgtccaactgggcttgcacttgagccctaacgtcctcaggctggccctggggcggcaagtcgaattcctggatggtttccccgtcagagctgtgaaaggaagggaacgtctccagcagaggaaggggggggggggggatgtcacgtgaatgtgcgccaattgttgcgcccacgcttcgccaagtccccggctgaatagagaacgcccggaacagctgtcgaactgcaacaaatcccatgctggtagcacaacgcgtagctgatctgttccaattcgctgagtttgatccgaggttcggcagtgtcgataacgacagtgcagcgcaaaggctgggcggttccctgtaaaaaatggaaaaggtagtgagagcggggtgtcaatttgtcaataaaaactcacttggatagtccgatggccgaccaaaagaaattccgtcagtgaggaatgcattgcctgaaattcaacataattgtccaacatccaatttgaaagtgcattcgacccttttgtccagcacagtgcccggctgacaattctgctcaggtgcgcgaccgcccgggcgaacgttgttcggaatgatgcgatagtttgagttacgttgacacacaatcagtgtcaacgcaggcttcttcgacattttgcgttccttcgtcagttcagcgaaagcagtggcgaatgccccgccctcccaatatgccaccttcaattggtctcctttttgcaactcttccgtctcgcccacctttttgtattcgccttccgaagcaccagctctgaacacgaagatgtgttcagggaagaacccgtttttggcattgaaagtcatcagtgcctccttgaccgcgttgaccatcggagaagccatttgtacggtggcaacacgcggctgctgcatccaataggtgccattcatctgcagcaagtgctcggagatcgtgtaggccatctgggaaacggcaaaatcaaactctgggacagaagcagcagcgaccgtcaagcccacttacgccaacaatcgtcggaatggccggcgcttttcccgtacgtcgttcgaataaagtctgtggcggcgcgtgggacatgtccaagccgaaaaacatccgttttctacccaaccattgttcggaactgataatgaaactggttcaaattctcacgaccaagcacttacagaatgtcatagcgaatcctattagcctctttgaatgcctgtgcagcacaaatttcataattggcaccgcccattttcaggttcgtcttcagcatgatgttgtcaaggaccatgatggcaccctggcgaccaagggccttgtccacggttttaggcgcgacatgttgagtcagaacaccttaagaagaaagagatggatggacaagagggaaagagagagagatagggagagagagaggggagaagagagggaaagagagaggggagagagaaatggatggacaagagggaaagagagagagatagggagagagagaggggagaagagagggaaagatagggaaagagagaggggagaaagagaggggagaagagagaggggggagagagagatggatggacaagagggaaagagagagagatggatagacaagagggaaagagagagaggggagaagagagggaaagatagggaaagagagaggggagagagagagaggaaagagaggggagagagagaggggagagagagaggggagaagagagagagagagatagggaaagggagaggggagagagagaggggagaagagggagagagcgcttgccatgttcaatttcctgaagtttaaaaacgtggtgaatatcaccagcgtgagccgactccttcccaggcgcgaagaaaagcacaaatttacagcgattgtttgcataataggcgaattgttcactaacatgctcactaaaagaatttaaaggatggctatttgtctgtccgttcatcccatcccaaataaaaccaaaactgattttttgtccaactcacatcgatgtgtcctcaaaattgtcgactcgtggtggcatttccatctgaaccccgcgcgcatgggcacatcgaatcaaacactcacagaacattctgacaacaatggggccattgaattcgctctgactccgttgacccacctgcactggtccctttgaacggagttttgcacgataacaaccgcccaaaccttcggaaatttacaggggacagaataacgaagaggcaatggctgtccacggtcagccaaacggaagtccaacactaaaaaaaagccgaacaaaatcaatgctaaattcgaaagacgcaactgaccaccacgattgttcggttcgattttctcaatcggcgccgagaagcaaattgccggcgggtaaaggagttgcgcttccgcttgcatcatattggtctcgacacgaatttcgtgcgcacgaaagaatgggttggcattttggatcatccctttgtcacgctgtgtctcaatgccacgcggcaaatcgacgggcagaacctggcattttttgatcatttgttcggcgagtttgggcgtctgtttgtccaatgacacacgttgtccatcgctaaacgaagtaaaaaaaaatacaaaaatacacaatgttaaacgaaatctgtccagggatttctgtaatcgcccacgggatattgtatccctaaaatggcaaacccgaataaagttggactcacacaatgttcagcacttccatcgggaagtacgattcctgattgcccctgcgatggatgacacacgcaaggcacgggtagcgcagccgcctgttgtacttttggtcgtaatactgcaccaaattcgtctgatggttgtcgatcgtaaaagttatttcgttggctccgcggtcagtcaaacccgaagcagagaaagtcatctgaaagggatgcaatgaaaaggaacacaaaaggaacagtccgaagaaacgacctgattttcaggcaaatggattgtttggacggcaaggcctgagtttgatgaaatttgagtaattctgaggttttcgaaatgttacctttgatttgcttgttaacaacgcgagccttctgctgaacgtcactttcgagacggtgaggatcggaattgatgaagtaaccgacgaaatcgacgagtccaatggccggaaagaaagccgatttcttggctgaaacaacgacattttgagtgaatggcgcatagcgtaccgtccaactgaatgacggcagtgctctgctggggactgtcgccgacgaagcgcacattcttctgcatgccctccttgcaaatgagcgggatgccctgcagctgcaaaacgctgttcttctcaaacattcgatttccgaagacaaagtgttgatttctaaaacgattcattgtcagtgcacaaccacccacttccatttactttgaacacgccgaagagatttaaatgtgaaaccaacgacaaaatgcttacttttcgtacattcgctgcgtgctaagcaactccaaaaattggcacaccgattggtcaccgcccggctccgtcactttcatattgcgaacctccacttcttctgtggcagtcagaaaggccttcacgcgttcgcagctgcgcagatacgcacggctacggacggacaacgcattctgcggaattgaaatgcaaaactaacaataagcaaagaagtaaataacataaacaagggcaaagggacccaaaaataaggcaaaggcgattttgaagggaatgccatgccaacaaattgaatctgtagtctctgagttattcaaatcggtttctttaatgcgctttacattttcggcgctactttaaaagcgtggcgttttgaaaaatttttcactttttttgttctatttttttacacatataatgatgatgaatattacggtaccgaattcaacgtcaacacgaataaatgtgaaggactctgggctcaattgaaacaaaagacgaaaagaattcatggaaccagtacaaatttaacgaattcatacatgtgtgaacaaatttttcgacttaatgctagggctaaaggaaaaactattattaatgctttctgtgatctccttcgttataattatacttttattccccataattttactgttaatgcttaatattatcattatgtgtaaataaaaatttaaaaaaaaatgtgtcaaaaaaaagtgaaaaattttcaaaatggacctctttgcaactagcgccatattttttatttaaaaataaggtcataacaagaaatttaatcatataaatgggtgttttaataaaaaaataaaataaatattttaatttataaaaaaaaagttttcaaggtggtaattttttatattattttgacgaaaataaatttttaagcttttgttcaaattttaaatacaaaacgtccgttttaattttgattaaataaggaaataaatattattcgtatctttaataaaaaaaaaacgaaatgccaatccggcttaaaatgaattgttaaagtggtgctaggtcgatccacaaaaaaactcagtgtgggcgatccaaaaaaaaactcagtgtgggcgatccaaaaaaaaactcagtgattgataaaattaaataataaatttaattattcaattcacaaaatcacggtgccgtccggttaaccctaatgtacgacgggcgcaagtcattttcaaattttttaatttttcaatttttcacatcacttctcgccaattttctcccttttgtagtagacaccgcctgacgcgattgatacctttttgtagagctcatcgagctgtacaaaaaaaaccgctggtaccggcacgcttagcttgggttggccaccgacagggtcgggggcgaggctgaggctcctccggcatatgtacccgacccatgacgggctccaagtgaatggagcaagaaccggaccgggtctgtgagatagcccttgaaaaactgtacaaaaaattgttcttaactgggccggtacggattccggatcaggcatttttggtgccccgaaagtggtgcgatcggcttccggaaaatgaccaatcaatcactgagtttttttggatcgactcaccacgatttaaaaccaccaaatcaaaatttaaaaaaaaaaaatttcccataactttgcttaaaagcaaccatttaattcttgatatcattcaataggcctaagtgttttctaatagcctggaaatttaaaaaattttttttattcattttcaacaagttctggccaaaagtacaccggaacaagattttcaaatgttttgaccatagcttttttgaaactcaacataatttttgaaaaaattttcattttaaagtttttatataaagacatagcatcacattcatttaataaaagagatgaataaattattttcgaataaaataatttctattgcatatcaatcaacaaattatgacatcatcgaatctacgaaattcacttaaaagcgcttgtgagacccgctggtgccagggttactaagcacactctcagagtcatgcacttgcggatggtctcctgaaaaattaattcattaaaataaataaaaataaattttaataattatttcaaacccttgggggcatccaagctgatttgcccaacatgaatgcccaacgcggcacagttgctgtcaattgtgccaacttgttctcggaactggacagccaaatcggcgttggcaccggcatgggaagcggcggaagcggcaatttcgaacatggcacggacgaagccgagactgcgagcacactcatctaataggagccaaattaaagaaattgaatttcaattaaaaaaataaatgattttaaagggatttaattgaggatttggtacctgatgatgattgagttgcgttgatctcgttgatgagtgtttgactaccattgccagggcaccaaattgttttcagttggttttccaccgcagcggcgactctttcggcactcatacaaagcgaagactttggcatcgaagcggagaatgtgccggtgtgatctttcatcatcgaaacgacatgttggctgccaggacagcatggatctttttaaacaaaaatgaactttaattaaaatttttattatttaatacggggtgccgaaaagcagcatttgcacagcaaacagacaattgcgacgatggaaatgattgaggagcagaaagatcaatccattttctgagaggatttgaacttttagatgatgagtgaatgtgacttgaatgatggttttatgcaattctcttcagagtccacatatgcaatgaatgaaaggtaatttaataccacttt

SEQ ID NO: 8147 - DNA, 1175 bp, Heterodera glycines
ttgtttgacattagactttagcaaattgacactttttaaattgaatttggcattttatttggtgccaattttgggaagtcagtgaaaaagggcaaaaatggagtgagaatttacaacggagaaaacacattcttctgatttaaaatgaaactattttcgtgctgaattttgttgatataatattttcaaaaaactggatcactaccacacccatctgattacgcaatcaataagccttaatcaagactcttggtctttatccgctcttcaacagcagcactttgaatcaaatgattgctgtttgtcaaaagttttctctatggtcaagaattaaatttttttgaaatttctactctaccaagagaaattttgcttaagaattccatggtagcatacgaaacgaattagcacacgattgacaactgtctgtctaccatactacctttgatgaaccgaacagtgagggcgactgggacctgctgtgcatacggtatcgtatgccaccctttgccaattgtggcaaagtgccattcactgcattattgtaacagttgttgttgttgttgctgttgatgttcatctttcggtgctgcttctgttgctgcttcatcatatgtatcttcggcttcatcgtgtccaaaatgcacattccgccgccgccgccgttctctttgccctcggggagcggcggcgccgaaagtgttggcccattgcgcagttcgtcgtcacttgacaacaatggcacggatgccaacattgtcgccgatgctttgcctcctttgtgaaggttgccgtcttcgtctgccaacgccgaatcgcccataataaagcggtggaaaagcggcacaattataaacagaaagtctgttttgggttattaatttaattaacaaatatatacaaatgatgatgactctcgagaatcgaaattgagaattgtcaagcacttttgagtcggtctcgactttcagcaatggcacagaccatattgtggcttcatttttttgggctgttcgtttgtgaaagactcgggaaaagaaagaaaacaaaagaaaacaaaaactgtttgggcgggtgcggtgcattttgtgccgaacccgttttggcgttttgggaggaggagaagtggaatggaaaggggcgatggagcggcggcgaaaaggccgacggaacgt

SEQ ID NO: 8148 - DNA, 5206 bp, Heterodera glycines
  misc_feature (98)..(98): n is a, c, g, or t
ggggggggggaaggttggggaaggaattttgtgagaagggtcacttgatcatgcacgcccgagacacacggattaatctaccatattcgagctgacgnaatggatattggaggctattggtacggtatttgaaaatttcagtaaaataaaatgaagaaggaaaatctctgagatttgggggatcaggaatatatctaatatcatcggttctaatttcatagttttttgatatagaagctgagctggtcaacatttaggcatgtccggtattaattgagcgaattcggcatttcaaagtgcccttaactgttaattgtggtatatgggcattacagtagcatactgtatatatgcacacttacgctgtctgcggcacgcagttgagaaatggcactgttctcagaatggatgccatccaatcgctgacatttggcaatgcaatttgccggttgggccacagttggcactcgtcagcagcaacggcgccatttgtgcgcgatacacacgaggcactttgatcaacaccgtcacagtgccgttcggcaacaaacagtggattcatcggattggaactaattgttcaaaaaatcagtatattttatccaaagaaatgggagcaataaaagttgctgatcgttgcggatgagtttttcaaagtgcctaacactctttaccaacagtcctgatcgttgattggctaaccccttttacgccttacagtatttctcttagtattttctagagcccggacgggatcgagattctaccaggattttcccgtgggttgtgcctttcacagcttttttttaaaaaaagagcccggatcgggagcttgttcaaatagagatttctactgtagtatgtactgcattaacaaagcgcgtgccactgaccgtcgatggcatcgccggccacagctgtgctgaaaactgcaaaagccgcactgttttgtactcgtggtcagctgacggaaataatccataacattggagacagcctttaaaattttggcatttttttcctaaacgatacagtgggcctgctaggtcgacacttatgagtctaatcactgcatgttttttcagctaatttggcgaaagcatttggaatgagctttcttagttgaaatttttaagtaactattaagaattgtgaaatcttttatttgaataaagtattttattttctatttttcgtttaattttaactcttcccataataagccgacactgacccagagataattagagacccaattaaaggtctaatttgttttgtcatattatccgttacggcctcccaaaaaaaattttatcgtgtaataatgggaacatggggtgtgtagttcgacaatgcttaaactgggatcttagcatcggaaaatttcgatttggccaagggagctcagcccaaatgagttcccgactgcccacatcatccatcacctgtccccaacgttctcgtaacagtttgaaaaacatgtggttccggcacccgcttctgcccggcaacaactggtcaaagtaagagcgctgccaacggggatcgtcgcctcgaagccaaacgccttttttttggggggggggggacggttggtgataatttgaatgcttttctatgctgtctttgcttatacatggtccccaatcggtccattccgcgcaattctccgccctcgtcgcattgccaagcatggacacgagttgcgcatcgaaaggggaaatggagggtgatagttaataaattaatgcgtccgtcgacaaaagacggttctaactaacaattgcaaataaagccgggacaggaccggatcctgtcggggcttttccgtactcctaatcctgatccgggtatttttggaaaatcgacccgggtggggagtcgtgaaaaacgggatttttaaccctgaaatccggtccgggtccatctgggaatccatgtattcgcctttttttcaatgtcacttttaaccaaatccccagatgaacttcccgatcatgatcctgaacttttcaagagcccgggtctaactataagcccggaattcgccaatgaattcttaccggttgaaaatggcagcaaaatgagtgggaaaacgcattggagaaagtaggagatggtcattggcttgatcatcgctcaagagtctcggcaccggagggcgggggagggaggggcaatttgttgagtttcgaattttgatttaaaaaattcgctcttctgctgcaacaattaaaactgcttgacaactatgaggaaggaatgttgcacacaaatgactgcaaagatcacggtttccatacgattaaaccccatttaaacaaatttatgccacccaaaggcattaagttggaattaaattccaacccccgaggggaaaagagaccggtccatcggcgcgtcaatttcacttcgatggactatgataatgatgatgctgtcataaatttcaagttttgttctgtgttataaattgatgattgaaatacaaaaaccagatttgccaaatattcgtactcttcgttcaagactttacctaaatttcaaggggaaaacataaaacgagaatttgtttccgacttttgttcaagttcggttcgtgattagaaattggtcaaaatagatgtcatatttgttattagcagagaccccaaaaactaccgcgaaccttttcacaaaatttttaactagcgccagtaaattcgtgctagtttttagtgaagctcgtgagaaaaaacgaaaaattttctcgagacgagaccgaaactctcgagtttcacttttagtaattttaaatccaaccgggtattttttgtatcctaattgaatttgctcggtttaaatgaataatgaacgaatttatcaatgaatattaattaaaatgacataagcgcaattagttaataatgcaattaataataataccacctatgcattgataccaccaacaatttttcacaacggctaattacggtcaatatgcaattttaaaagatgattggttcagggagggcatccgcaattcagattaaaagatattgacatattaaagcgattcaaaaatgcccgccctttcccccgacttttcgatcggtcgttgattgtctctgatcgaaattggctcctcattatcgttcattttaaacggctgatgccattctcgcacatccgtgcgctgcgcgcgttggcagctgtttgagcagtgccggcaacaaacaaacaaaaaaacatttgtgtcggatttgtgtggccaaattttggccatctccggcagataatttgatggaagaatgacgaatgaccaaagaaaataaaacaattaattagcaaaattaataaaatagaaaagagcagctattattacgaactaaaatggacattaattagtcagaaaaatggacatgtgattggcctgcagatttatgatcagcaaatgggccgcaaaaaggcggcttctgatcgattcccggggattcaatcctacaaaatttcaataatcagggaactaatccaaatctcgcgcgtttttgagtgtttaaactgatagaaattaattatgtccttcgtaattaacttatcgtcggtttgtggcaccaataaaattaaaatttaattgtttattggattttaatgaaggcggaagcgatcatttgtatatattgaaatgatgccaaacagagaaattttaaaaaaaagttttgaaatccctgcaacgcatcatccccaaaaaaattatgaaaaaagtgatcaaaacaaagtttaaaaaatgaaattacaacgattataggtggatatgagatcggtgaatgaatggtcgagagtgaaaaataaatcactgattgaaagaaaagggaaagagggggaggagggcggcagaacgcaacgtgttaaaagagcaaaagcacaaaaaaactaataataattcaaatcaattaattaattagttaagttcggaaagagagaatggggaaaagagagaaaaaaaggaaattaatggacgaacgaattaattaattaattacaaataaacaaacaccgggggcgaaatgaatgaattctgatcagaaaacagctgtcaattgatcaatttaaatttaattgcattggaaaaaacgaaaaaatggaaaaagcgaaaagaaaaaagaaaaattatgggctgaaaaaagaggaacttcggagcaacagcagctccaaaatgggaaaaagaatggacgaagtgatcggaaagacattcgaaattatcaaaattttgatcagcatccttctggaaaaaatgaaaagcaggaattcgaatcatttggttttacttttcctaattaatctttttggaattggttttttttaggtaatggggaacaaaattgacttttgctggtttttatttatttgttttaaaaatattttgaaggtaaactgatcttgaatttagtaattaattagaacgcaaattgtgaatccgcctttttgcgtcggaccaaaaaaaaaagtttaaatcctatcacgatcactttgacaaagaaaaaatgcaaagcactttttcaaaaaaaaaagtgaagcgataatttaaaacggcttcaacgagaatttttttaacggttttactaaaaaatttaattttcccactttttgccattttaaactgccaaaagatggaaaagaaagggaacaaaaatggaaaaaccatttgtagcatgagcactaagaaagtgaaaaaaagaaattaaggcgatgggatgtgtggtattaaataaaaattcaaaatgatcggttgggattggcgttatatgtcatcaaaaggaaaaaagaaacgaattaataatacaaatgacggactattaattttttttaagggacgaaaatggacggacggaggcactttaagcacaaaaatggcggaaagcatccataaaaatgaatataataaaaaggaacaaaaacaacgcaaattcatcaaacttttttttttgtctttttcattgtgtatcaaaatcaatcaatgatttgaaacataaaataatcataataataaaagagagagagagatgaagagaacacacaaaaaagcattggcccgtaatcactgaaagagttggagagagagggaaaaggttttttaattaaacaaaacgaagaaaaacaaaacaaaacggcggaataataataataataaagtaataaaataataataataataaaattggagaag

SEQ ID NO: 8149 - DNA, 3097 bp, Heterodera glycines
atttcgtggcgatatattaagtaaaatcacagcagaaaaagataaaaaaattttaaactgttttcaagacggatttttaaatcagaaatttcttgctattctatatgagagaattagaagaatgataaaagatgtcacatataattggtgcaaaaattatatttatgaaattttattaaaaacgcattttaaaagattggaaaatcaataattaactcaataaacataaaaaatacatattttagttaaattaatgaaaaatcgtggcaaaaaagcaaaaattccggcaatttaagataatgtctcgcctctaaataaatgaatgaaccaattagaatgttaaaaaagaaatattttggaaatagcttttgagaattatcgtatttttaatgatcaatggacctagcaacatgttaagtcgcactttaaataaagtaataaatattttaaagcaaatatatttattatttttgtggaagtctcgcgctctcaaaattaccgatataaagaagcttaatgtgtcgaaaaatacattgatatttgcaactagtgttaagccccaacccacgacccgacccgagacgttttttgcgcctattccccgccccgacccccgatatgtcgcccccctccgaggtccccggcccccgacttttggtgatgcgacatttgcggcgcttacatttgcggcgctgacacttgcggcgcagacagttgcggcgctcagtcaaagcgacacttgcggcgcagacatttgcggcgtgacacttgcggcgccgacacttgcggcgacgacacttgcggcgccgacacttccggcgcccagtcaaaaggacacttgcggcgccgacacttgcggcgcccagtcaaaaggacatttgcggcggcgcaaaattcaacgaccccaaaattatttcaacaatttatttccattaaaaacattgataatgactctctcagtcccattcttcaaagcctttcatccctaggcgatattgcaacgcatgaatgtgattaattatatcagcttgctttttgttttccttatggtcaaaatcgatgactaatcgtcggatcgcttcatcatttcttaaatatttttttaagcgtggcctttcagcaattccacgagttgggtcaatttcataaggtctcagacggttttgttggtgttcttcctcatttttgatggcgataatgaaccttattgaaattattttattacagtacccatttatactttgaaaatgctgggtggggcgaagtgaaacgttttctgaagctgttatgccacctaagaaattaattgcaatatcgcctagggatgaaaggctttgaagaatgggactgagagagtcattatcaatgtttttaatggaaataaattgttgaaatatttttggggtcgttgaattttgcgccgccgcaaatgtccttttgactgggcgccgcaagtgtcggcgccgcaagtgtccttttgactgggcgccgcaagtgtcggcgccgcaagtgtcgcgccgcaagtgtcggcgccgcaaatgtcctcgccgcaagtgtctgcgccgcaagtgtcgctttgactgggcgccgcaaatgtctgcgccgcaagtgtcagcgccgcaaatgtcagcgccgcaaatgtcggccaatcggacgaatcggagggaaaggggcagacaaagcggatcgacgatgaatttgtacagaagatgcacttcgaagtgatcagagacctttgcgagaacattcataaaaccgatgagatggttcagcagaaatttgcaaaaattataaaaggtaaaaaaataaaattagaattttattggcattttaattgaaaaaataattttaaattggaaaaggaaaggggggggggaggcactctatttcttaaaatagatttgttaaaagtgccgcttttcaacaaaatgccgtcctttccccccgtccctttttggcattttaatttaagggctaactgagagcaaagaatgtcggcagaatttgaattcatttttgaaaaaggaacaaatcaaaaagattttcgaagtgattggaattccatttgaagaaaaagactttgaaaaccctgaacaaaaaatggaattttcatctgatcaatcggaagaaaaaggcaaagaaacgcagaaaaaagggaggaaaaatcgacgggataaaaatgggcaaaaaactcaaaataaaaatgaggaaaaatgggaaagtgaaaaagaaagtggcgaaaaatggacaaaaaatgaggaagaaaaaatgccaaaggaagaaaaagaaagccaaaaagtgccaaaggaagaaaaagaaagccaaaaagtgccaattggagaagaaaaaagtgaacccgtcccagaagaagaggaagaagaacttcctaacacaaaaggtgaatttaaaggcctttaaagtgttaattaattcatttgattaagaattttgtgatgaaaattttatttttggagtttataaaaaatattttatggaaacggaaaaaacggaggcggaaaaaacaatcatttgggtggacataatgacaataggcaatgaaatagaaggacaattaaaaggcattgaagaaatgaaaaagttaaattttataaattatttttattttatggacggaaaattattggaaaatttaaaagaaaaatggcaaaaaattccaaaaacaaaaattgaaaaaagaaattacgaaaaattaattttgttaagagaaaaaatgctcgatattttaaatgaaattttaacactttgcgaattgagagaaaaaaatggacaaaaaagtgaagcaaacgcagagaaaaatgaaaaagaatatttattgggcaaaatccatcgaaaaaatttaacaaatgccatcaaaatgggcgaatttgaagaaaaatggaacggcacggcaaaggacgaaaaattaatgaatttattcaaaaataattatttaattacctcaaaattaggcaaatttagaagcgatgcgcaaaaaatgacgaaacaaattgaaattggtagtgaaatattaaagaaaaaaataaaataataatttctaaatattaaaaatattataattaatttcagagcaaatttt

SEQ ID NO: 8150 - DNA, 3608 bp, Heterodera glycines
ggcctcctccgaacacttccggacgccctctccttatatggccaacaattgtgggccgacctgtcctctcctcagcctgcccccccccccccctcttctcttattcgccttcgcacattcattcttccgtcgatcactttcacacattctgcacaatgcctttttggagtctttttcaccgcaaccacaaccgatcgcagtcccccgacttcagtcgtcgtttaaccgtttcctctggccaaaatgcgtccgcttccaaaagtgactctgctcggtatcccttcggtctccaccaccaccaccgtcactcttctgcccgctcctcctccccaaaatcgcttctccgcttgtcctcctcctctcatccccaccaagttcagttccgttcccgcgacttcaaccgcgaccgttggtggcgagattggcccactgattggccccggatggacacaattgtgccaagagtaagtgacggggaaaacggaaagggaggaggaaaaggggcaaagggagagggacaattccattgccatttgaagagaatcgaacaaaattacaaaattagggtcattaaattagccttttccatgcattgtttgctttttgtttatgtttacatttctcttccgttcttctgtttcccaatgctttcgctttcttttggaaatgcatcacaaaataatcggatgaatttgatggggggggggcggagagaggaagtgatggaatgggagaaatgcaagagtttatcagagaagcggcggcggaggccgtcccctcccctttttctccccccccccctccccctcccttctcatgatttgcctgatgatgacaaatggaaggttttgcaaaaatgacccccgtatattttatagattatttttattctatggacgaaacattattggaacattcaacagaaaaatggcaaaaaattccaaaaacaaaaattgaaaaaagaaattacgaaaaattaattttgttaagagaaaaaatgctcgatattttaaatgaaattttaacactttgcgaattgagagaaaaaaatggacaaaaaagtgaagcaaacgcagagaaaaatgaaaaagaatatttattgggcaaaatccatcgaaaaaatttaacaaatgccatcaaaatgggcgaatttgaagaaaaatggaacggcacggcaaaggacgaaaaattaatgaatttattcaaaaataattatttaattacctcaaaattaggcaaatttagaagcgatgcgcaaaaaatgacgaaacaaattgaaattggtagtgaaatattaaagaaaaaataaaataataatttctaaatattaaaaatattattattaatttcagagcaaattttattcgatcgaatgatggccaaagaagcgggaaaagaattggccaattgcttaagcccatccttcgccaaagcgacgcagcaattaattagcgacgaattggaccaacaaaactcacaaaaggtaattagcgctaattagcaggttaataaatgaattttacggaagttagcttgagcaatttgtggaggaaagggcaattaatggccaaaggacggagggaaagtcacggaaaaagcgcgaaaaacgaatcaaagcggcgataaacaaagtgaaaggaatggtgggcgaatgggtgagaaaagggaaatgaaaaaagaatcggattaatatttttaatttaattaaattaattaatttaatttaaattaaataattaaaatttttaattttaattccatctttcagtcaaaccatcaggccaaacttttgatttcgggctcctttctgctcggactgaacacaaccgattcggacatcgatttgatttgcgttgtgccgggaaaagcgatcgaaaaagaacacttttttggagagccaaacgaaatttgtgttgagagggaatgtgaaaagggcggcagacaaaaggacactttggcacaatcattttattgccaattgtgtggggtaattaattattaattaaataattaattaattattatttttgtaaaacattcgaatttaaaatatttttcacaaatgcatcagaatggaaaagttggcgatcttctaaagatcaccaaaggtcaaatagcgatgatcaaattcactttcgatggcatcgattttgacatttcattggtggcaattcccaaaatggaaacattggcacagcgaataacggacagaacattaaagcattatgtaaacaaattttacaccgaaaattttgaacaccgacagatgcttcgcgttttatcgagtaattaaaaaatcaaaaaatattaattatgtgtaattaattattcaattaattaattagctataattgatttaggttatctctcaaacgttcacattgtcaaattatttgacgagagtcagaaaaagatatttattctaaacgacgatatttacgatgaaaaaataagacaaaatggcagaaattatgaaaatttgcgttttttgactttggcagtgaaattgtgggcaaaaggtattaaattaaattgtcctttttcaatttgcaaattatttttgactttttccagccaatttcatttactccaacaaatttggctttttgaatggcgtcattttgacaattatgacatcaaaaatcgtgcttctttacccgaattcgtcgttgcgctttttacttctcaagtttttcttaatttacgcggcgaggttaaaaagaaatgaaaaaagaaattaattaaaaattaattaatttaatttttgaaaattaaaaagagagagagaaagagagagccaatgggtaattaattaaccaaaaataaatatttaattattcatttagtaaaatcaaataaattgaacatttagaactggtgggatgccaattcaactcgaacaaatcgaagaaaagtcaaaaatgagcccatttttgactaaaaatcccatggaaaatgaaatgaaaatttacacgacgattttcccggagcaaaacgccgcacgattgatcacttatgtaaacgcaaaaataatcagaaaagcaatgatcgaaggcaaataattaattacttaatttaattaaattatcatgcattttagcgctgaacaaaatgataaattcggatgattggccaacaattttagcgacaaattcaatgaattttgttgaaaaagtgagagaattttccaatttacaaataatttattgcccttttcagtacaaaacttttgtcgcaattaattgtcttggtcaaaacggagctttcgtccgcaatttttgccaatttgtcgaaggtcgaattcgtcttcagatgacttatgacattggccacagaggggcgacgacgaattggcacatttacccggcactattccaagaaacatgccaaatcacacacaaattggagcaaattccagcaaaatttcggtagaatttgcaaaaaggctgacaatttaaattaggaattgaattatatttattaattgcccattttccttccagctcaaattaccaccaatgcaaagtttggctgattggctctgatcagtcgctgaatggtactgaccagcggatgatcaatgggcagctgcgcaacttcgactgggc

SEQ ID NO: 8151 - DNA, 5451 bp, Heterodera glycines
gaggtcattccgctgcatggaaaaagccaaaaattggaggaaaagtcggaagacttacaaaagtgtattttacacggtcaatttttgtctgacccaagccccacgagagtatttatcatgtgatcacatccttctctttgagaatcacatttaaattgtgccatattcggcattacaaacaataattaatgaagttaacattaaaagttaaagaattctatcaatgttgtttgtacatgaattatattggcaaaattcaagaaaatataagggtttccaaaatcatatttctcaacaaaaaataggctctattgcagttttacacgaccaacctaataattttttctagaagcatccaattaaaaaagtttttttgaatttttctggtcatattttttgaaacatgaattatttgaaattttgcatgataatagagaactcttacgtctattaaataataccgtctttttagggtcgtgtaaactgcattagagcccaaaaatctaattaacactaaagaggtacgtcccatcagacttattatttatgtagccggaattgttcgaccaaattacaatagtaagtaataatgtcagtgtttgtgtccattatgggttgcagatgatataaaagagggaataatggccgacgcgcaaaacagacaaagttcgaccaaggaaaagcggggagacgcggggggtgccgccttctcccctccgccgagaagcatttcgcggcttccgctcatccctcccccagcgaatgctccgccacacttcgcttcctaataaatgtccacttcaaacgaatgtattgattccatttgctcaccacaagttcgggtagaacatgcacagttgcgatgtaaagaaatgttcctgcagagaaaagcaaaacaattccggtgaattgggagggcgtcgtctcttcgtggacgccgctcaaagagtcatccgaagacgacgattgtatctgaaaggaaagaaccaattaattatctctttcttttttggtacccccagcacagaccgtatgcagaaagatgaaagtgagtacagtaccaattggggacgaaagcgaaaaaatgagtaagtggcgacggactcgcgctttgtccattccgctggccagcaaaatgctaatcagagcaaaagcagtgggcgcctaaagaaacaccgcatttgtagagattgattggataggacagactaactgaccttgtgcaacattatggccacaaagacgaggatttgaagttcgagttgagaaccggcactcgacgcacttcccatggcaattccatcggctgcacttggaaaaaacaaaagcggacacctatttaagaacactcattttggtagaaacgcaccaaaagcgtggatgacaaggccgagggtgggcattcccttctgacggctgtgggacagtttggagagttggtcaatgacgtgcataaacagaaagccgaccagcagagagacgccgatcggtccgttcaacctttcgaaatcggtccgccgtgtcccttcctcgtgccattgtcccccctcttcgcccccattgtgcggttcgtctgccgttggcactttttctgcctttgcgtctttcttccgccggtctctcgccgttttcccttgtccaattgccccttttctctgctcattctcatcccaattttgcctgatatttctccgatgcattttttcattcgttttcctttctttttcctgtaatgaaaaaacccttccgttttaattttcttttcgtccactaccaaatttgaggctgcgtcttccgttttttccggagacattttcccaatttcacggtcattcgtttggacaaaggatgcagcggcaagtgaagaaatgccctcagggattataacgcaaaaagcagtgccaacgagaagcccagcgccgaaaatgctcgctatccgaactttcctctagaaatgaattgttcatactaattcttcaccaaaaagcacctcattaagcgaaaagaataacggaataaatccagccaaataagagccgataaacattgtcagcgaaatcaccgcgaggattggctcgtccatcatttcttatttatcaattaaaaatatttataataaaaatgattagagaatcgtgtcgaagttgaacatgggctttgattgaccataacaaacaaattaaatgacaaaaaaagtttttaaaaatgtatctaattgtaaactcgcaaaacaaataaataaatggttcaacgcatttcaatcccaaatttttgcgtgagttccttttcaattgccttgtgaatggcattcgcttcttctttgctcaatggccgttccatacttcggtaaataattcggtacgtttgactagtctttcccgtctttttgttttcaaattggtcgaagaaattgacctaaatgggaaagaatcaaggaagattagtttcttaaggtctaaggtgtcatcttttaaatcgcttaaaataatcattgagctcataaaatagaaaaatcaaaaattcacttccccagtccgccccattaactcctaattactcacctgttccacaatgtcacctcccaaacttctgatcacatcgtaaacatcagccttcagtgaatccacgccgttttgttttaccaaatcgggcaaccaaaaggacagatccatcgtcagttgtggctgtttgctgatagttttgtattttatcacttcgtccattctaagtccagtaaattgggaaagaaagccgctatctttggaccagaataatcgaatgtctgggattccataaaggaccatcgccagtcgttcgagtcctggaaaatgaaattggcctaataaaaccgataccaaaaatgtacaataccgattccgaaagcccatccgactttgctgccagcacccgcagaatcgagcagtttctgttcgatgatgccacagccaagcacttccagccaattgtcattgaaaaagacttccaattcgtaggatgggtgggtgaaggggaagtagcaagaagtccaccgcatcggcacattcggaccgaaaagcgattggcacagcgactccaacgtcattttgagttggacctccaaacatttggccgtgtccatggaatgtctctgttgcctcagttcatttctctctgcttcctcgaagagagagaacattctcgacattccgggacgttgttcagcgaacagttcatggagtgcataaagacgcacgcctaaaacatccgaatattggcaaaaggcacaaaaattgttgtttcatttcacattaatgcacatgcccaaagggtgcgccaaggcgaggccatgtccattgaagcagggaggggggggggggggggcttttaatggattttttccgaatattcaaattattgagaaatgataatacttagtttaccttcttttattcttcaacattactacctcgggacccattccccaaatagaaaccgttcccaaagtgtctaccttcaatctgatgaaaacaaggaaaatgcgtcctgtcgatttcgtcgcgtctgtacacatctccaacaaccaagaaattgtctagcccttgcttcaaaagtctaaattggtgtgccgaagtgtgcgcacgtaaacaatagtcgcggttgacataataagtgtcggaggcacgtcgactcggatggtcggaagggattagcagagagtcgaaattgtcaaaaatgctcaccaaccgaggctcatcctcacaaacggtgaaaagtggagaacttccacgaggctttctcaaaaacaatggtaataatggccaaccccaattaatcccaccggtaattagtgtcaaaaaaggcgatgattcgccgcttcaaaagttccaaaggatttccattctcacggagcagccgacggctcaacaaagatttgaccccttcggaaacattaaacaggtcgagatccggcgaaatgctgagaccatcgagttcaaaaggcacggaaggaagccccttgccagtgggagaatgaatggaagcaaattgtgaatcgggaacacccgcagaaaaagcacttaaaaatgagaatgaaaatagagcatttcctaaaaatacagacgcatgccagccaaagcattcacaaagctagtcttgcaaaaaaaaagttcaactcacttgaaatggatgcagcaacacactctaactcttggccacaataaattagaaaatttagaataaagcataattgactttcaattagtgttagattaaaaaatattaataagaaaaggaatcattcgaccttttaataactgtgaaatccaaaaatgaaaattcttctcattgaatgatgtctccgtatttcaatttctgttcctttatctttagtccgcttcccatcgttttttgggcgtgcaatcgttggtattccgcctcatcaacagttaaacctctctgcgcagcctttcgcttgaccaattccaattcaatccgatagttttgcacaatgataaatgcaaatttgccttaagaacacaatgttagtaacgatgaataattaactttcgattagttcacccggaaaaactttgctcgtcggcggatggttacgaaacaattcttccaaatgacgcattccatcgtctctctgcttccaaagtcgttcttcttctattctgacagcatcggcgattttgtgcttgttctgcgccatttcaggaaatgtttcaccctataaacattttttatgagtttctgcatttttaaattaccaattgttcaacaatgaccggcaccatcaaatgcatgctcatccgttccattccgagcatttgagaaccataaatcgtggcgcgtttaaacaattccttaattttacgcctgaaaatttaaaaactgactgattggaatgatttcctcacgagctctttttctgttgttgattagtaaaaccaattccatctgccaatgcaacggtcacagctcgcatatgatcggaaacgattcgataagcaacgtcaatactttctttgtcagagtccccaaatcggccttggtatttgtgtttttgagcagtacacttaaccaaaaaactaaattttataaattaccttttcgcaatggcaatgaataaacatttaaatttaggcccaattgtcaattgcctatattattttaaagaaatctaagggaaatgcaataagttaattcataacaaaatttgtatctttgtttaaagaaccttttgaatgacatcaaatattggaacaaacaaatcagtgtcatagttggatattttttgctgcaccactgacaccaatcgttcgagtcccattccacaatcgacgtatttgctggacagtggccttaacttagcattttcttccctaataataggataataatgatatttaaaaaaaagaaaaatcggtttacctgtagtactgaataaagactaaattccaaatttct

SEQ ID NO: 8152 - DNA, 2561 bp, Heterodera glycines
cacgcctctgctcattgtcagccttgcaaagcatttcttcagcattatgcaatttagtggctttgctgttagtaggcccagttgtcttaaaaaaaaaatttcggaatttcttacaaatgatttttttgaagtgttggccctctctgacaataaatttgcaaaataactcaaaaaagtggaaaggaaatgcgatataaatggacaaaaaagcgacaaggtttatacaatgcaaccaacaaatttgactttcgtttgttatttaaaaaacctttgaacataaaaatgtgaaaacgttggaatttgacaattttattagtgccggtcataccacttgacgtactgttttgaaaatggccaagataacatacctccagaggacggaaaggtggtgaaactgaatcaggaacagcggtaggagaagttgaggtgattgcgatgattgacgaagagcttgaagtggacaatgagccgggactgctgcgtttccttggctgcttctgctgaaaatcatttggtttaaaatacatagactttgctgtcatatgcatgaccattaaataagcctaattttataagcaacaaataaaacacaccttccccatatcagtttccccgaaattttttttagttttaaattaaaaaaataaaaacaaaaaaaattcgtatttttaagttaaataaatttttttgaaagaaattcattttaaacaaaaatcaaactttttttattagaaaattctataattgtaagaaattaaaaaactaaaagttcttcattttttaatttacatagaaaaaatatgagtgaaaacaggccactctccttttgtacatagtaatatgaagaattagctattttcaccttaggatcggtgtaattttgcaattgttgttgacccatcggtggaacgggagttggagcactgttttttgtcattgtcccaaagaatcggctgagtgtctatcaaaaaaaaaaattttttttttaaagtaagtataaaaactgttttgttctgtttcagatgccaggaaacctgttgcttcagtttgggtgttttgcctttgtccgtcaactccattggtttgctgttctcgtcgggagttgtgctggttcgatttatgcccgccatgcgcgcttttgtccgctgctcgcggtcgcgctgaaggcgacgacgttcagcacttaattttacataaacagtaacatgttaagttcaagttttgttaaattaattattgtcataaacctagtttgtagctcttcagcaactgtaggccaaattaattttatttttcccataaatgtctaaaagctgagaattaaatcatttttaagatttgtgaacataaaaatatgcatgcagacaaaaaatgtaatttgttaaggatgtatatgaaaaccacgctatgtgaagcgtaaagaaaagcttcaaaaaaagtttcaaatatcaaaattatttgtagtttcaattatcttggcgtactgttattagttccaaagaatttttaattctgtataagcaacactaatttgtaaggctttcattctagacattttattgtgatttttgtgaattaaactgttttcacgtaaaaaatctcatgcattaaattaagtttattcagtcaatcaaaaattagtttgaagtaagggattggaatacattggatttaacgaccacaagtacatacgaaatacaaaacaaacaaaaattgcatacaaggtctggcaatacatagctttttgcttgacatatttcacccatttacaagcaacaattttaagaaagaatgaagaatcaaacaattaaacattaattttcgtttttttaaaattataaattaaaaaggcaaaattgtggaaacaaaatgatgggaattcttaattaggcatcgcatgtggcatggaactcaacgcgtcgatcaatttcgctggtcacctgatcaatctgatcactgagttcctcaattgaggtgtgaaaattgttcagttccacgtctaatgaatcagcacgttcaatcagggctaaaaaattaaaaagcaaaaaataaattaataaaaaatagctcacaaattttctcttcccgactccgcttaatctttgccaacaattcggttgtgcgcttgcgcaactcttccgcccgctgtttccgctcctcatttccgccttctttctcttccaataaagctaacactttgtcataggtggactgaaattaaaaaattaattataataggcattaggagtatcataaattaaaaataaagaaaaaaaaattttattttgggaaagagtttgataactaatttttggaattccaaaaaaccatgccaaatgcaataaaactaaacagcagaccgatctattttttccattgtaatacccacccccccccgcccccttaaaacccaaatcgaaaatcttggggaccgtcacctgatttattatagacaattaaataattttcaatatcatttaaaattgtttctcaccttcatagcattgtgtttttgctcaacttggtccgcaatttccgatgcgccggcggcgctttggccg

SEQ ID NO: 8153 - DNA, 1437 bp, Heterodera glycines
  misc_feature (1405)..(1405): n is a, c, g, or t
acctcttgaaaagggcttcctttatttcaggggagggagaggggggggggggttctaattaaaaaatgatttttgaaaattaaaaaaaaaattggggcgaatttttcataaatttttttgggttttcctagaaaaataaaggtgcaatcattttttacgttttcagaaagttgtcgaatttgttcctcattgaatggaattgtgatgttcagaatgtgttcaaccttggccctgatgtcttcaggtctaaaattaaacaattcgcttaaataaattatttttaaattgtttattgtaaatttgacctatgcctttcggattcaaggaaatttttgatttgctcaatttgtgccaccaatgcatcatgcgttttgttgatacgttcggactaaattttaaaatttggcattttcccgtcttttttttttgttataattttgcctctcttttggagttttccaatgctttttctgttgatttgcgtgcctcctgcgttttgggcagaacatctcgcacttttttcagaagctttatataaacaattattatttgattaattaataaacgcattttaaatatttaatgaaaaacaaaaatttaaataaataaaaataattcacctcttcagcttctttttgctttgtctccaccttttcgagagcttcgtgtgcaaaatgtttggcttgttcagctttatatacggagcctaatataataatgtaaaaaatacaatttaaataatgggaaattaaaatcaatttttaattgttgcgttaatatttaatatttttcaaatttaatgtgcctggacacgatgaaccgccacaacgtgaacaggttggaccaggtccaccacacacggcatcgcatggagcagagtcggcaccgcaaacttccaaattcaatgcgggcagcgcaccatcgatggaagaaatctggcaaattaaaaaaatgtttttaaaatgaaatatccattaattatacgcaccgtgttgctgatgtcctctaagcgcgccttgttctcctcatattgacggtcaaagtcacgtttgtgctcattgagcaactgctctgccctgagtcgatcagattcggattggctgaattttggaataataataacaaataaaaatattaaattaatttgtaaatgatagaaaaagaagtccatcactttggagcaggtcgttcatgccgtgaattataccaaaataaaaatttaaaaaaacgcagaaaatttcgtagaattattaaaaagcaagaaaactctaaaattttcgaaattttggtttttaaatgtttaaaaaattagggcttttggcttaaatattgaaaaaatttaacaaattttctatgaaattttaagtttgatagattttaaaataatctctcggggggggggggnggagggggtaaagtgcagcccctgcacctgat

SEQ ID NO: 8154 - DNA, 1611 bp, Heterodera glycines
tcgacgagtccatccatcagcctctaaattaaaaattcgcgcattccacctttgccgctggccaaatcgtagtggagcggtgcgcactggtcacactggggcccgaccacattggcaaagcatgggcattggccagacacacgatcgcaagagccagcactcgaattggtgcccaaattattgcaaacgcaactgtaagagagatttgaaaaatgtccgttaaaaacatttcgccaaattactcccgccccgaccccctccccaccgtgtgcatgtgcgtgcttgcgcatcgccaaaaaatccgtccacacaatgctgacattggtctccgtctgtgttgtacaagcatttcaagcagtccccagtcgtcgcatcacaactctccggcacctttcaggaaagaatcaaataaataaattatttttcgtttccaaagcatcgcaaaatcacagacattcaaatcgatgttcccattgcagtcacatttttcacaggagccgctaaacatgttcaaattgaattataatatgctgaggaatgtgataaagaatcaaatccaataattttacccgatttcgcgcggatttccccaataattgacggcacactgatcacaacgctcgccagcatagccagacctacaaaattgatcaatacagtacagtacacagagcgagagaaatccatttgaaaattagttagtttgtcaaacgccaaccggcaattgcatgtgactgtcggactcggcggtggcgtcaaatagcatgagtcagcatgttggaagcccgagcccggcccacccggacaggggcatggcttgcaaggcaagttgatgccaagccgagggtcgccgtagtaaccgtccacgcaacttgaatttaaaattaattaatttgattagcgtatttttgggggggggggggggaatggtttgattcgggacggaagagagagaccgaccgttcgcaatgtgtgccatcggtaaggttgcgacagtcaatgcatgcgcctgttcgttgatcacaaatggacgcgtgcccattgcattggcaggtgcgacactccggaaaattcctggacaaatattcaataaattgcttttttttccacccccgcatcgttttcctaccttaaatttttttttataaaaaatgaaaaaaatttttcatagtgatttttttctaataaaaattagataaataaaaaaagttattgacaaatcgaaaaaaaactttaaatacaaaattcagtttttttttaattttctcgtgtgtgggaagcaagctgatcctaccaaaatcctggttggcattggttgcattggcgtccagtgatgccacgttcacggcactcgcattggcccgattgtttgtcgcacgccttaaatatgtttgaacaaattttcaaatgtttatagtaatcacatgagataaaacaaacatttgaaagtgatccgacactgtcacaatcgcaagacgaacagccggatggaccaaatccgtaagtgccaaccgcgcaacggtcacaacttcagtatgaataaacagggttaacgggtctgacccctgaccaccattcccgggtgaaattcccgacccagacgctatattt

SEQ ID NO: 8155 - DNA, 454 bp, Heterodera glycines
ccggtgcgtatgggtcctccgtgggaatgtgaggcgaaatcactttgtaaaccaactgaataattattgttagtttgtataccgtatttattctattattagacccggctctttattgttcgacccccctcaaaggggggtcttaaatccgtgggagggggggggggggagagtcgaataatcgaagaaataccgtatattgttttatggcaatgaatggcaattttttaaaaattaaaaaaattctgcacctctccgccagttgccggttcaaaactgctatattttttggtacaaatgacatcattgtgctttctgggaggcccctcgggaatgctgaaactcgatttttttttataatatttatttttttaatttttttttgcctacttcgggaacgaggccgagcaatcataggcgaaatagcggtaaatggtcctgaaaaggcaacaat

SEQ ID NO: 8156 - DNA, 2311 bp, Heterodera glycines
  misc_feature (12)..(12): n is a, c, g, or t
aattacaattanttattgtaaatataataaataaacaaacttaaaaaaacaattaccaaatgtacataatccatgattgacagaaaataggaaaaataaaaagaaaaaataaattttggacatttttcaatatactaaagaaaaagattaaaaaataaattaaaaaatgatttcaataaaactctctttttaattaaggatgtttgcatagatagccttcataaaatgtggattatttatttggattccttcagattcgagttgttttttaattataataaaatttacacgaccataaaaatacattatgataattagaacaaaaaataaacaaatttaattttaggagttaatttaatattttgtaaaaaatttaactgaaacccaaaaattttggaaacgaaataagctaacaaagaaacttttagcgcttgataaactggttttttctttgcccaggaaaagcatgtccggattaagtccaggccataagcattcccaaaattaaattttcaaaggaaaaactttaaatttttgttggtctacaattttggaagattttttcatatcttctttaattttttattattttttaaagtcggataaactgcaaagagccatagtttaagcataaaacaaaatgactgtgataatttacaattatttttcagcagaaaccaaaagcaggcaaaaatcagctgattttgtcattggcattatcaagccaaaatattcacttaaaacagaaaatcatgtgaccaatttgggccggattttccgacccaaccactcttaaacataggaaatgcaaagacgtgggaaaaacttttattttttttgaatttatgttttcttaattataccgtagtaaaaggcctatttttcagagtggctataatatcatattttctggattggttataatattctgtgatctgtaccatatttttactaattaccaataaatttaaagttcaaacaaataaatgtgccaataaagtaatccaattcattcatcattctgtgatcacttcccaaaaaaacatttcatttttttcgtcctccgcgttctttcaactgaagttgcactgaagcattcggcataaaattgtagtaggccaaactctgactgtccttcatgaaaatgccctgttgaaatgggaaaacaaaacgttagccaattaatgcaaatgacttaaaatgggaattaaatttgtgttcacctcgtagactaatttttgtttggttgcaggaactccgatctgctcttggattaacgattttaacgcagtgacctgaatacaaatcgatttatgtgcaagccccaaaatagtcattaatttgttaaaaaactagctttaatttttaaaaaagtggaaaaagtttttaaaagcacgtataaaaaatttgaaaaattaaaacccgtaaaataatacttgcaaaaagccctgctaataacgcattgcttgatcatcctaacttatgactgaccgatgaactgatgtccaactgaatttgtactgtgttccccttcaggttccattcatcattttgcggcgtagcgatttgcacagcgatttgaccgtggacctgtaagcaattaaagatatattttttcctcgttttagcaaatatcggtggagaccggcgctcaccttttgaagccaacgttcttccggttccagcgtttcttcgcgcgggcgtttgtttggcggctcatcgccaacagaggcgccggggggcggaggaggaagcatgaaagagccatgcggtggacgcatcatgccaggaggaggcattccttgaggaaaaattagaaaatgaatggatatgccattgagtaatccatttatggtgtgtttgtccaaagaacaatggggtgacttcattattactatatttagggctaaaccgtgtttcgagttttatttagaaaagatagtgtttttgaatagcattgaaaaggcattccaattatttgggaaatttcactaaaatcgaaaggaacggactgatcctcatcatacataaacaaggggtgcgccagtcagaccctcatacgtcggacgtttggcgcaggggggggggggggtgcgccaggaccaatttttcttacgtcggcccccaatttcccccggcgacgaccttttttgttttgtttttttctattctgaactttttttctgacgaccttttttttattcaaaccaaaccaccttttttgcggcgcgtttttccaaaaaactttgtgggaaggggtggggcggtccggccgtgccgataggcgccgccgggaaaaattattgaattt

SEQ ID NO: 8157 - DNA, 4859 bp, Heterodera glycines
  misc_feature (4847)..(4847): n is a, c, g, or t
ccttgttcatgtatgatccccatatatgtgtttgtttacccggttgcatgtgcggtggcattgcgcccataacgccgtgcggtggcatgcccatatgaggcggaggtggcatatgcggacgaccgcccggcggctgcataaattgcggtggcatttgctgcggaggacgcatttgttgttgttgctggtgctgtggtggaatagacatttgcggcggctgttggggaaccggcacaattttctgcacattggacgcaatgccaccggtggactgatgaggcggagggcgctgctggaaacacaaaattttggcaacaaaaaaaccatgttatcaacgaagcaacgttttaaaaaatctatcttgatattgtatattatcgagaagaaaaattaatacaactatttacaggtggagccattgaatgtgaagtcggcggttgtccaccgccgaattgttgtgagggtgtcgaagtcgggggcggcatcgacggcaccattcgttctgcggctgggttcggcaaatacccatgctgtcgctgaaattcaagtgtaaatctttccaccccctccattttgcctatttatatttcgtttaattccgtcctctaacctggatttcgctgatttgctgctctaacgaaacactctgttgcgctgcgcgagtggtagcatcaatcgtcgacaattgtccgtcccaaatggtcttcgggtccgaacgcggcatttgccgttcctcctcccccaactttttgccgatgattgtttgttcggctcccttttcaccaataccgaaaatgtctgttcgacgttcggccaatttggcaatatttcgactaatttctgccccgggcgccatcactaagtcttcgtcctggcgatccatttgttcactaaataaaaaaggtcttaaagaactccagcttttaaccccattttttcaggcgaagtaccttttaacttaaacccccttttgccaaaacgcaccggtctcgttgctctttgaactgtgggtcaacggtgttgtaacgcacatgctcgtgcagtttgtctgcaggaatgcgttcgtttgtcagcggcgaaattatgtacttctccgtggaggcagccgcagttttggacaccggaccaccacgcgctgaaaacaaataaaacaaagaattaaactcatcggaaatcaaaaatattaacagttaaagttattgagttgacaagtcctcgtaaaattaccagaagtcaagcattaaatattgtaaaatacccacattttttagggtcgtagtcgcggatgattacgctgccggcggtcggcgccgcgggtgccggttgcgtcagcgttgagccggtgtgttgcttctccgccccgatgttcaagcgttggtgcagttcgccagccgcatcctccgccgcttcgattgcggctcgttctttggccgtttcctcgtcacccgactcggcgccgccctcctcgtccgactcgaccttagcgtggggggtggggatttttacaataaacatatttttaaggcttcaattgttttctacaaacagtttgcgattgcctcgaatccccgtgcgaaatttacccccttcccaccccatgacctatgccggaatatctttaaaaaaaaactagatcattgttcccattacatccatcgccacactctcagccgccgctttggccgcttccgtacgttgttgcaacagaattcgtgccccgacatcctttggcgtgcacaggggcggcaaatttactaaaaaaataaaaaaccgaaccataaaaataactgacaaatagtttgaaaacaacatttgaaataagaaacccctaaagatttctttgcaatgaatcagggtaaaatgagatgataatggctacaccaaatcttgcaaaatcattgatttaacttaagagtggacctaatttaatcgaaattcaacccgaaaaatgtaaggctcacgtgtttcgctgggctgaaagtccaccgtttggacaacgacaaattcgtgccagtcgatttgattgtacgcaatgcgctccttctccaccgcttggtcctcgcggtccttcagcgctttttggtggcggtcccaaccgacgcggtaacgcacgtcctccaagattttgtgttgagtgaccgaagcacgtaaatcatccacaatcgtttttggcgggatcagcacctgtaaataaggattttaaacgggcaataattattaatcttagcagtcaagtcaatgtagattctttttgaattgccataaataaaccttcgtatactgctcgaccagcttggtgaagtattggaagttggagtgttgaggctttaagaaatcaaactggaagtttcgcacctcacggttcatcagctgagtgagaaattgacggccgttccgcgccacaaacaaagcggtcaaatggatgagatccctgaaaaaggaggggttttgattcaaaacgatggaaaattaaacacacagtaagacaaaaaaaaaaagagaacttgggtaaaaagttcaatgcgccacttacaaatcgaatgcgtttagcgtcaaaggatcggcacagaattcgaacggtttgggcggcagccgcggaataaattcggcccgctgcacatgctcacggacagcctccggcaacttcactttggactgagtgtccgccgatgcaacgcccgtctcaaattcattgacctgaaaatgagaaagtacccatataaattgacatttgcttaaaaaccttgttgcgatagtaggcaaagtatgggtcggtagggttgagaaagttgaaacgcatgttggaagcctcgcgctctttgattttcatctcaaattccaatccgttgcgagccacgaaaagcgccgttttgtccacaattgctgcaaagagaagaaaaaggcgttagttacaataatatggagcaattgcgaaggcgaaaatggcaaattcactaaaatgaaaaaagtcgaacttcgaatgtcgggcggtggaatgatcaacccgactatttgtttgccactcattgacggttcgatgttctgcgcgtcctcctcccgattggacacgcgtagttcagccggcaccgctggagccgccggttgtgcctgaggcgtcggtcgacgcaccaacggtttatcatcatccaatctgggaatcacaatttgcaagggcggctcttgcgccatgatctgaataggctagtaaatttaatcaatgcttttgtggttttgaaaccgttttgactttttaaaaagcatacaatttaaataacgaggcttaaaaaattaataaaaaattttggcgtaatgttttcttactttgctaaaaagatcgaaatctaattctatggtaacatgtgatttcgtcagaactaatgggatggacgaactggccgctttgataaatatatttgttgagtgattctacgtgtgtggttttttatgaatttaacctcactcatttgcttctttgactttttgccctgaaaaaatgagtcaaatttaaaagttgttttcggtcaatcatgatgagatacctatatatgaaattatgctcaaaagcaacattctttgtgttgaagtttttaaagttaaattttgttgccgaatggacattggcaactgttgcatttgcctgggtgggttcggcgttgcacagatgggcgtgctgccgtgcctgcacactttccaccactcatgcattcagcgcgcactgggccaaaatgcgcagtgtccgctttgccgtcggcacgccaccgacacgcaaattgtgagaccgaaatacgaaggaagctgccgcgaggcgggcgatttgccaagaaaggttgtcgtgtttaatgggcgggcgccaatgaatttgaatttctgttcgctttatggattttagtcactattcgtttattcagactagatggaatttaaattagcaaaatttcctttcctcaggccatgcgtgccgcgttagctttttacgaccgcaccgttcgccaccgcttcgccgatggttcgtcgggaggcgaagcacagcgcgaggaattgaaactttgtctcaatgtgctggtttttcctaaaattgttttagctgcgtgttcatttaaaaattccattgtttttatatattttattttgcagcaattttatcgtctctgttcatcaaattttaattttacgacagttttcagtcattggtcagcactttggagagcgctgacgcggagagagaggcgaaatgggaacggctgaagcaatttttgagggtgtgcggaacggccgcaatttttgccgttttggcatttctgttcactttgtattggccggtgagtgagcgaagggattaacggtgctaatttaagcaaaaagtgccattcacgtgggatgaaattattctacaaaccgttagaaattttttctacggtataatgaatttgaaacttttcgaacttaatttgggttgaaaccgctctaaaaatttgaattttttactttttgttcaaatccgggcaggaatcaacaaaaaatgaagggtcagcgacccttaaaacctccaaaacctgacgtgtaaagaaggccgctttatcccccccccccctcaaattggccaatttctacgcttctttttcggctcagttgttctcttctctggcggttggcgttgtgcgcaccgtttggactctgatcagttctctgcgcgatctgttggtcgcccattggcccgatttgctcttcggcggtttgctcctcagcactttcgtcgacatggaatcctccgactcgcagcaacagcaggcggaaaaacgcaatattgtggaggagccacagaatatggcggaatatgatcgatgatncatcatcccccc

SEQ ID NO: 8158 - DNA, 4436 bp, Heterodera glycines
ctttagtgatgccaatttttagtgcttttttagacaaatttcaagtatcgtttacccccgaaaagtttttgaaaaaaattcaagccttgaaatttacaagaaattttagaaatttttttataaaaaaatatcaaaaaaaaattttttttttgaaaaactaacgattttttcagttttgcaaaaaattgctgaaaagtcgcataaaatttttctaagattttctttaaatttctaattgtaaattttaaaaaaatttacggcgaggggggggggatgaaacgagggggagggggacgaacggctcatgttttcccccaccttgattcgtgtgtccggtacattgccaaatgcgtctttctcccacagctccgcgttggtggtggccttcccccacagcttggtgccacgctcgcgtatctccagctcgtagtcagtgatcggcgtgcctctgtcccgcaacggtcgtgtccattggagcatgattgatttgtcggtggtgtacagtggcttcggcgggccgggccgcactggcacattcaatgacgccttggccagcagccgttcgtccgcacagcgcacctaaaaattggaaaatattaattcattatttcaacaaagagcaaaaattttaatttctgggttttttgtaataaaaaattaaacacaaaaaatttgagtctaaaaaagctttggattttataaataaaacggataaaaataataatatttgttatcataaattcgttaattaatgataattatgcatgttttattaatattaaatcaattaaagttgattaattaaatcttatttaataaattttttaaataaaaaaaatacaaaaattttaattataaaaactaaataaattttaaataaaatcaattagcaaattgcattcactttagcaaaatttccacggcgcgtctgcctattggcaccattggatctcaccacccatccccaaaaaaaaatttaaaaaaaaacacagagaaaaaaagtggcaagaagcaaaatttggccccaccccctcccgcctcaaaattattcccacctcaaccgtcgtcatgtcgagcagctgctgctcctcctcactgtcggccacttccacctcgtctgttgcctcttcgcccgcagcgcaagccgctgctgccgcctttgccgaccggtccgccgcggtgctgccaacgcgtcgccttccgctactggacgcggtccgctcctgttcatgattttttatgcattaaatatttaaagttttttttcgaataaggggacaattttaaaccaaaatttttacaaagaaaaaaaattatcatttagaaaaaattttttgcctgtggatgcttttgtcaggaacaagaccaacagaagaggaattattgagaaaaaaacaaaaaaaatgtttgtataaatattttataaaaattcaaaaattttgcatcacttttaaaaattggttttgggttcaggttaaaaataaaaaatttattttctcaaaattcccaataaataattttaaaaaacccgaatttgctcaccatgtttttgggacgtggcggcgtcaaatggctgctgcaactaaaaaataaaatgaatgaattaaactttctttttcgttttttgtttgttaaaccaaccactgcatggcgtccaagagggtcaatgcagcggcttcctttctggcactttttggtctgcgcgactcgctgcgacgggcggtggaggacaatggttgttggtctggtgagtctgaaacaaaatgcattcttttaataaaacatattctatataaaattatgtgaaaattatctaatgaaaaaaagcaataatttattttctttaatatgaaataattattttaaaaaattaaaacatttttataaattttatattataaatatacacaattttaaaaaatatatattttaaataaaatgaaagtattaatttgataaaaaagtaaattttaaaaattaaattaaaaaccaaaaatgtccgtggaaaatgtttaactgcttttttttgtccgccccgtccaaaacataccctccacagtgacaaatgaattggtcggaactccgttcgcttcgcatttgtacttgccgctgtcgtccgggtccgggttgttgatgatcagcgtgatggactgcttgtcgatcagaattttgtacttgagaccgtccgagaacagctccttgcggcccttataccagcgcactgaaaagaaatattttggcattaaatttaagaaatttttaaactttatttttttaaaaattaatatattttttattatcctaaaaatagatttgaagatatccttaattttatcatttatttttttcgtgttttattgaaattgaaaaaagtaaatgattttatcagtcgtttaaataatgaaaaatgatcaatttttcaaatttaattttaataatcacctttggcattggcgcgcgagtatttgcatttgagctcggcaaatttattctcctgctgctgaaattgcaacttttctggcaatgggtccacccatcgttcttgaggcacttcggtgggcggctcggctgctttgggctgaaaaagtgtaaaatatttttttgtttttttactaaaaattgcattttttttgttgtaaagcataaaaaagactctaattcttaaattttgactccaagataagaccgccaactatcccaaggagggagggggggggggggcatatcgcttaaatgattgagcctttttaaaaattgataaaattaaaattttattttttggacttatttgcaaaacttttttgagcaaacatttaatcaatttatttctaacaaggaaacatttctgacagtaaatattcaaatcacttttaaaccacttttattttgtggaggtattctatcataaattctcgacctttttttggccctcaccaacaaactgatcagaaaaaagtgatcaaagtttcaaaaacctaaaaaaaattaattaaaaaatcaaaaaaatttcaattttttcggattaatttgagtcaagacaatatatttttatacggcatcatgacccaagttttttgtcggtaccgtttgaaaattttagtgtcggatattttttatacaaattaattccgaattcaattttattaaatttttatgttttttgtccattaaaaaattattcgtttatgcacatatagtcatggtcatatgtttatgggagccggtgataattccaaacaaccgataaggttttgcttaaaaagacgaacgacaatgttttcattactgaaaatcgttttattttgtgaaaatattcaaaaataagaacatttacaaaaaggataaaattttgtttattttttcgtttgctatttttcccttttcgtttttcacccacctcgtctggatccggcgagccagcaaacacctcgtcgtcaaagtcaattctgattggcgtcacattgacatgacaggcactaaacaaataaagaatttgtttttaaaggaaacagccaaaaattttaactgttcagatcactttaaaccctttttatcatgaagagcaattggatttgctattcctaaattttcagctatttttaatcttgacctcctaactgatcagaaataatcgatcaaatgagaatcttgcaaaaatacgttaattttatgagatttttcaactaatattttaatgcccattgtcattagtttggatcatctcaacagctaatgaattattttttatttttcctttattaatttggaatttttatgaatatggaatttaccactgaaatcaaattgctatacacagtaaaaagtgattttagaatgaactgagcgaaataaggaaaatttattaccggtgtttgtcaaatgtgtccttcaagtcacagccataattgcaatgttggctgaatatttatacaaataaaaaaagataataagaatcaaaatatttttaccatttgtatctcccattgtacccatgattgcgagaatggcttgccaggtacaaaggacgagcaaatgcatctgtgcattctttgcacttgtatagctttaaataaataatagaaaaggtactttttcgttatgccataccccccccccctaaaaatgtcataatcccgagaaagaaaacacattctatggtaattttaggtgttaattaataatctgaagttaaggccgtaaaaatctatgaatttgttgatgttattacaaaatccacaaaaagcactgatgagggtgagaataattttctttttaaatcatcaacaaaatcatatgaagaaaatcatagataacagtatagattttgcaattttgagttagactcccgatcagtgcccaaaactaccattgaaaaaagctttcctttgttcgtatcatgatattttttcggggggggggggggggcgggggcgggg

SEQ ID NO: 8159 - DNA, 1756 bp, Heterodera glycines
tttaaccagggttgccagattaaaattttcaaaagcctcctttaggtcggcaaaaaagcctcattttgggtcaaaaagcctcatttttacaaatttattcaaaacacattaaaaatattcaaatattatatttttattttccatgatcaatttgagcaatatttgttagaaataagcattttgtgaaattcttagcacgaaaatcgaagttgattttttgcggcgcttttttctaaaaaaaaacttggggaaaagggaggccggcggtgccgataggcgccgccgggaaaaattttgtgatttttaatacaatttgttaacagatttgaccacaaaaatgaccaaattttgcgattttgagcaaatttttaagaaaataaaggatccctggagctcaaataaatgaattgaaataggaaacccggcaaaaacccaaaaacccggcaacttcaaaaacccggcaaaaacccggcaaggacccccaaaacccggcaaatgccgggtttccagggcaaaatcgcacgcctgattcaaaggtgtgaaccattttttgtaattttaaaataaaaaagtgtgaatcattttttaaataaaagtgtgtgatttttaaaacaccattaataaagtagtcatatttctaccctattcaaagagaggaggtgtggtggtaaatgccccaaagcacatgtccttaaggcattttccctatttcggtaaaacctgtgcctataaatcatttttacacaaaaaattgttatgaatttttaaaccattagatcaattagtttaagaatttccttccagaatggttgatctaaagacattattctttttgagtgatttgaccaagttggtgaaaggaattttttgataagcatcaatatgttggcatgaatttcttattttcaaatttttcttttttcccaaaaagctgctcttccagctgaaatttattcccctcacatcgtccagcagttggcgttcctcccgctcaatgtccaattccaagtagtcgtccgccgccttctgtttccgaaacattttaaatctttagagaagacaaaaatttaaaaataggtttaaaaattttttttaaatattaaagttgcatatgatatcaatttgaaaaaacaaaactaataaaacagacataaatttgtaacaaaaatcattttatgaaatttgaacccggttttgaccgggaccggggaccagtctcgggttttttccggttttcccagccaaaaattcccggtttttcaacccgaaaaggtcccggtcccggttaagcccaaaattcccggtcccgctctactctatttttaaataagaatcctaaccgaaaaatatttgacgtaaattatttacgtgaaaacttgaaaatataaattaaaaaattaaacaagctgataaaaatagagtttttcaaccgggtccgggtttcttatggtgaattgttccctgatttttggccttagcttgtcaagagctttcgaatgataccaaatttgttcgaaaatttttatttaaaaattttttataattaatttttggtgcaattaatgattttataattgcaagacaaaaattaaaaaaaatttgaaaataggtttacactcttcgtcgaagattttttgacattcatcaacaaaaaaacatctatcaattttgaattttcattgcatgaacataagcattaaatgcccattcttacgggggaatacataggaggatgcaattgattaatcggagcggg

SEQ ID NO: 8160 - DNA, 5407 bp, Heterodera glycines
  misc_feature (881)..(881): n is a, c, g, or t
  misc_feature (889)..(889): n is a, c, g, or t
cgaacaattgggcgcagtcagctaaaaagcatacgacataaacgcatttgttattcatttattacatctccagacgagagtaatttttggatttcaacattctgccgccggtcttcaagtggacgaaaacgaaccgtccacatttcgaccgccgactttcatcgcgtcaaaaaaccaatagaccccagtagggtgaggttccgccaggtgcggttttcaacgcttcaaaaaaccaatagaccctaaaagggtgaggttccgctaggcgcggttttcaatcgccgaaaaacctatagaccctaggcgggttgcggttccgcaatacgcggttttcatcgtccatttcaacagtcaactgaaaagcaatcgaaaccaccgacatggcacaacaagccaacattcaacaatttctggacgcaattggccaactcgtcaccgcacagcagcagcaacaaatcaaccaaccgaatccgaacaataatgttccgattccggtgctgcctgacatttcggtcttcgaaccgaccgacgaaaagggacgtattaccgaatggatcgaaaggttttcatttgctatggactgttcggcaccaaacgcaaccgacgcagtgaaagtcaaggcattaatgaataaattgtcggaaacggcattcagcgagtattcaaaatcgtgtttgccaggaaaagtgacggacttcgacttcaaccaatcagttgaaaggcttcaaaagctttttgcaaagcctcaatctatattcatcgacagatatgaatgcttaatggccacgaaaaccgaaaggagaagattttcgtcaattcgtcaacagacacaaagggctgttgaatgatttcaagttcacatcacttaaggaggaacattncaaggttntgatgctcttgacagctctaaagtcgccgaaagatgcaacttgagacaaagaattttgtcaagctcggcgccgaaggagataacgtcaaatatgatgaaattgtgcaagattgtgtcaatttcatgacgacaatcagcgaagtaaagctgattgaatcatctgcggccaaccgaagcataaatgcagtcaagccaaagtggcacaaaaccgaaaagggaggaaggccaaacaacaagcaaggccaatcatcatccgctccggcacaacaatgttggcgatgtggttggacaaatcacagccactgggagtgtaagcataagtcagcaaagtgccaaaaatgttcccaaaatggacatttggaaggccaatgcgacaaggtgcaggaatggagacggagaaacaaattgccaattccaaaaaggaaaattggaaatttacgaattggaacggccatgaaagtgaactccgcttcgcttttcaaaaccgacgtggcggcagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcgtcggaaagggagtcgcaaatttcaaattccgcaatacaagggcgtagccaggaccttcgtttcggggggggggcaactcaaaaagtcggttcttaggggtgtattttttcgtttttgtaaacctctatttttagtggtgtattttcgtgttttttttaaattgaattgattgcattattttgtgtttcctttgcataaacgcgttatttaaattaaaataaaattattccggcgatgtttcaaaaaaattttttcaaaagaaagagcgcagatgtggggggggggggttgggcgggggctgagacggaatggagcattggatgtgcgaaaaactgaattgtttggccaattttctctccacacattatctgctcgcctgtaccttcaccaatcggctggaacaattttttctgcattgacttgggtcattgaacgccgaaataaacctaataaaattgttttttctaatttccgcctttgttagatgaaacgtaaaaatcctggtcgccaagacattagaaattttttcaatttgccttcgacgagcgtctcgcgtccactctcgacagcagaaaatatattcgagaacaatgctgaaagcgaaaacaacgattttgtcggatatttatcagaaaattcagaggatgaggaaatctcaaaaaagaagcattggaacggccgattcgtttgccaaaaaatttcgacgacaagcactttctccacgagacattggtctgactaatccttttcattttcaaatttaactcgcacgcctatgcatagactattcaaccggtctgaacaatgcccttcaagaccaccaacacccactgccgctacctgaggatattttcgcaaccttaaatggaggaaaatatttttcgcaaattgacctcagggatgcatatctccaaatcgaattggatgatgaatcgagaaaaatctgctcgatttcaacacaccgtggcaattatgaagttaagagacttccttttggcgtgaaatcagcgccagccatattccaatcggtaatggaccaaatcttggcagaatttgaattcgccacagcttacttggatgatgtgatcatcgtaagcaaaagcgtcaaagagcacgctgatcacttgaaaaatgttttggaaaaattccaagagtggggattccggatcaaattggaaaagtgttcgtttttccgagaagagatcaaatatctcggacaaatcatcgacagaaacggacggagaccggacccggagaaaatctcagcaattagtgaaatgcccgcacccacagatgtgccatcgctgcgttcatacctcggaatggtgaaccactaccagcaattcgtcaaaaacatgcgttttgtacgaaaaccgctagacgatctgctgaagcaggacagcgaatggaagtggagtgagaaatgcaaacaggcattcgacaaaattaaggaaattttgtcatccgatcttctgctgacgcattacgatccaacaaaagaaatcgtggttgcagcagatgcatccgaactcgggattggagcggtaatctcccacaaatttcccgacggaacaataaaggcaattgcacatgcttcatcagctctaacaccggctgagaaaaactattctcaaatcgagaaagaaggattggcactgattttcgccgtgcaaaaattccataaaatgatctatggacgaaaattcacgttgcaaaccgaccataagccacttcttgccattttcggaagcaaaaagggagtgcgccagtgcagtgccaaccgacttctccgatggtcgctgatcatcctcgcatacgatttcagcattgagtacatcagcaccaatgattttggtcaagccgatgtgctttcaaggctgatcgcaaagggaaaaagcgacgaagatcgactgattgcatctctccgatcagattcgaaaattgactacattttgatcggatcaattgaagcagtgccaattaaatttaaggaaattgtcgcagctgctgaagccgacaaaaccattcaaaaagtcaagaaatttttgacgaatggttggccaaggaacgtcggagacgaaagtgccgaaataaagctttttcatcggatcaaagaacagctttgcatcacgagaaattgcctgatgtacgccgaccgagttgtcatccccgaaaaacttcggcagaaaactcttcattcattccacaagggacacccgggaatcaaaagaatgaagcagttggcgagaaattatgcctattggccaaatatggacgccgacatccaacagatggtagaaaactgccaaccgtgccaaatggaagcaaaggcaccagttaaaagcaaccttcaaccgtggccaaaaccatcacttccatggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacacggcatcccggaaattttggtgtccgacaatggcacccaatttacgagcaacgaatttgctaaatttatggccgtcaacggtgtcaatcacctgttttcagcgccgtataatccaatgtcaaacggccaggccgaacgtttcgtggacacgttcaaaagaacatttcgaaaattgaaaggggagggagccccaagcaaagaaatcattgaaactttcttggtaagctatcggacaaccccgaatgactcgttgccaaacagcaaaacacctgctgaaatgttcctggggagaaaaccccgcacaactttggatttgttgcggccgccaccttcacaaccgatcgacagagatgttgaaatggcgagacgcttcaataagcgatttggaaccaaattaagggaatttccgatcggaaacaaagtgtttgcccgccaccgaatttcccaaaattggcaacagggccaagtttcaaagcgaactggtgtgatttacgacgtggcattcgccgatggaagatcagggcgctaccacgccaaccagcttcgtccccgaaagacgtccgactccgatgatcagatctcggtgatgttcgaaaccttcgacatcccaagaccgattgctgttgaggatcagagggaaatcccagtggaaatgccattggaggacccgcatggcgaacaggaaaatttggaaggtcaaattgaccatggacagcaacaacggtaccctcagcgaaatcgccgtccgccgcagcgcttctcaccgtaacctcggaaccgcgcttaaggggggaggtgttcggggcactgccgccgaagtttgaatgatatgacataatgccaatcgatttctgttccatttcatgttccttccctcgcccataaatatgctcccattctcctctaagattgtcttcccttcattcattttgcatttatatttgttccccaaattattgtgactttcttttccttctccaataaataaatatttaattggacttaaacaaatccctcggaccgaacagttgagaattgagaatgaatgttatggaaaggcattgatcgattgatcagtgattgattgggtgggatcacctcttccaaagtgcgttctttgaagaaatcggcacgggcgggcagcaacggagtcaacggatcgccgttcaattccttcagtgagccgcgctgaacaccgccaattggctgaaaaggacaagtgagaaccaaatcaaattggcattggcattggcataccatccaaacggcggaagggaaagtgtgccctggggggaagggatagaaagtattaaggagtgaatgaatgaattcggctcattct

SEQ ID NO: 8161 - DNA, 1493 bp, Heterodera glycines
atttaagtttgaaaatttttatgcatttaaatgtccttacattttttaggatgaccataaaaatatgaccctattaattctttcataacttttttctaaaacaatcaattttaattttgtttatataattagatagcctaaagattactctattgttctgctaaatttcaaaaaattttattgaatttcaagaaagcttgggtcaaaattgttgagtcaaaatttttcgcacttttttagtcacaactttttgtaaatttttactaattttttgaaaatttcataagtagcagaggatgcttcgagctgtcgctaaatacttaattttattaatttgactaagcttaagctaagttatgattaattacttggaaaataaaattaaaataataattaaatttaattattacaaacacccatatttttgtcgcttcgacatagcaccggaaaacaaacacccaaaataatgacaacatctcttaattagctcattaaaaactttcattttcatttttcatttttgataaattgcccctctcttttcccctatttccccccccccccctccgatgtccgtcgatcgaccgttgtgccgttcctccgtccccgccacccattggccatttgctgctccgtcccctccctctcgcccccgtcaatttccatcttcggcctctttgaactcttccggcaccaccgccgaagcactgacagttttggaaagggtcggcaaaataaaaactaaaataaaacaacattttcactgctcagagctgtgcaaaacttattctagctgaagatggctttgctaacagtgcaaaaaacagggccaacggcgcgcgggagaattcgtcggttagagagccattgctaattaatgggtcgccgaacaaccacaaaccgacccattggtcgacttgcaaccgagtaattattttatgaatttaaattcattaagtgccgccgagaaaatttagaaaatttattttatttttatcatttatttatattttatttttaataatttttatgcaatatttaatctattagcattttttagcaaaacaattgtaaaataaaaaatttttattagttgggcttcatttttaggaaaatgcctagaatttctgcgcacttaatacgctcagataagcacgaaaaaaagacccctatgaattgaatcctctgaaatttttttttcttcataaaaatctttggtttaaaaattattcgaaaaactttaaatattataattgcatttacaattgaaataaaaccaaattattaaatcttttcaattaatttttatgtgttttgctacctaaaaagcgttaaaaaattttttgcctatttttgtgcatgcctttaataccttttcgctattttttgtgcctgaaaaacaaagcctcatggtggtggtagagtaaccttttgaaattttttttcacttagtgtttggtcaatttttttgtttatttttacacataataatg

SEQ ID NO: 8162 - DNA, 3289 bp, Heterodera glycines
aataaataaacataaataaactgaaatacataggcacattttattcagtaaaggaaattcaaatggaaataataaactgccaaaaatgtctattaacggtgccatcgtttcatctgttggccatttcaattttaaacttttttctctcttcaagaaatcgtcgaattgtttcgcccaaatattccaacaaattgtccgaatatgaaatgtccacctcgagctctgccaccgataaatcttccatattttgcactaaattttgctaatcgtttcggcaatttaataatggctttttttactgattaaaaagtgctcagatgtgttcaaaatgttcagcaatcccaactcggccatgcccaattcgtccaaatcgccgtttttggcttcgataaccaaagtaaaagtgagacttaattttaaataagaaaaacatattttatgggcaatgccaaagaataaaactgcgataatttaccgaatgttcagctgcgtccattgagttaaaagtgcaatttgattctgattcaattcgtagtctgaatttgatttaggtttttcgagttgaaatcgttttttctaattattttgaataattgccaatttgccgtgccattaccgctctgatggtctaagtcaaaggattctgtgagcaattgcggcatttccgcgtcgtttcgcgtcacgcattgttcccgcgaaaagtccaaaaagttccattcgacaaaaactcttccgccctcctcaaaatgcgaaaagtgcagagacgctgaatggtccaaaaattggagcctcccaattcgaattcgaacattggcactttttggctgcactaaatcaaccgacgatccctccaggccgctttcactgttccaatcggactcgggaacagcagggcgaatctgaaacagccgaataatcaaatagctaacaaacaatgcgacctcaataattccacccagggtccgatcactaatattcagtaaattgattcagttttggattagtacgcgtgctatttcccattggttggagttttgaatgattaatgtcaatttgtgatcagttcgccctccgtctgatctgctgacccttatcgccggcgttggtggcaccggtgcgatttcaattggcgcttttgtcggcctttttttccttggcactttccgctgcttttcctccccctcgccctccatcttttgtcggtcgttcgcatttggtggtgttccatttgaagctgtcgacccaccgttggcttctgatgtaattgatgaccgttcactgccaaaagtgatgtcatctgcaaagcttgaggacacttcgctggctgaaattttagtttaatccaatttcagggccttacaaattagctaacgcggaattgacgagtgcaatggctccgcaaattcgactgcttttctcgtcgttgaccattcttcggccgttggcagagggggcggtggtgccggaagctaaagccaatgggccaattaattgcaaaaaagtgccattaaactcattcttccaacttttttgagctgttttcctcctgtcgttgtaattggtgggattgggccgagaagcgaccgtcgaggagcgggcactggtgccattgttccggtcggcttttcttcatcagattcgtcactttcgccagttttctcatgaaattggtccattcgtccttgcaaatcttcgtctcgaatgatcatcacctcctcttcatcatccgttcttcctattacacggggctcatccatttcaatcggaccaagaggctaagcaaaaaatgttcatcttttaatttgtttttttttgaaaattttcattcatttttctccccttggccattgttttccctcttttcaccccttctgctgtgtaagttgcgtccgatctgattgatccgtcctcttcttcttcgtcctcctcttcggctgcttctttcttcgctggttcatcgccttcagcagcagaatttgagccttccttaaacaaatcctccgaaagttcatcagatgtcgtcctttccaatgctgtctctcgatcgaccacaattgttgctgaactccttgaactttttcccgactttggcatttcgtcgctgagagaatcctcagaaattttgctgaagtagattttataaagcattaataatatcagttttgctgatttgtttgatccgtcctttgtctttctttcttcgtccgtaccttcggtccgattcgctttccgttgctttttccatttgacttttttgtccattcgtttcaatgcttttttgtgttattattttttgttcattgccctttaaatgaaaaataattattttttatttcgcttttttatttatttttattttttgcatttttcattggttttggcagcagcaaaagccgtcttcgcagctcctcctccggcatttgttcgccccattgctcctccgccgttccttcgctttcgcttcggtttgattcgtccaccgatgagtcccttttgacggaaaggcgcacttttcatttattttaattcggcaattccggcatataattatcattttagtattaattacccttttgttttgtcggtttccctttgctttatgccaatcctttccaatgccttttgctctttgctaatttcccttttttgtgccatttcttcgggctttttcttctcttctccctgcggcggaatgacgtttaattaatgggttactgattagactgatcatcacttttttaatttatttcattattttattaattgcctcctcttttttggcattttcccccgcaattcgctgcgttttcctttgtccgttttcctttggcccattttgttcagttaattgagcgaatgttctcaacggaaccttaaaataaattcaatttaaatgaattcttttgacttactttttcttcgacttttaaattttcgaatccatcaaaagcataagcgaatttccaataaatcgacacatcgatggacgcctcggaaatgacagattcgtctgcctaattttgatatatttaaaaacaaatacttttttgtccttttttctactctgtctaaaagaggaaaagtgccgcgaattttgtgatttcgtgccaaaggaaaaagcggcaaacgaacggaggcgagcacacgcgccttcggcgacattttcccggccgaagtgccgccgtccgttccttcgtcaattaaataaagaagcaattcctaaaaattaaataattatttgctaatttatttattttttccccgtttgtccttcgctgtgtttactttt

SEQ ID NO: 8163 - DNA, 2036 bp, Heterodera glycines
tctcttcctcccattctctcctttccgactcattttcgttggcgttctgttgcatttttgcccgaaggcgcactaactcctccagggccgcttttccactgttctcttgctgcaacgacctgtgatttaaaaattaaatataataatagctatgattgctcttgctcatttgctaaataaatttaaatttaattttcctttttttaatttctttttatttttgctcacttttccaccagtcgctcgtgcgcatttcgtagcgcccggcactcctcccgcgcgatggccaactcgcggtccacgatttcggcactccgtgcgcttccgtccgctcgtcgttgcgcgtcctcccgctcgctgttcagcgagtcggactgcgagcggagttcgcgctgcgcttgtgacagctcccgcgccacgcggtcgaactcagtgcgaagcgcggacaaacgctgaaattaaacaattgcacttaattaacattaaaccaattaaccatctgaacattctctaattgccttattcacgtgccttttcacttttctcgagggccaagtgcaactcctcgttgtcgtccgtcacttttctgttttgcctttgcatttcccgcagtttttcctttatttcacttctttaaattaattttaattattcaaattaattttaattatttaaattaatttaaatatttaaatttattttattcgaatttactcttttctctcctccaacaatcgcaagtgtttgttttgctcattgtctgctctttgcgtcatttctctgctcacaacttcaaattggtgctcgctttcttcaaattcgtcccttcaatttttaattttcataataattatcttttccatttccgttacttttcttcaatctccggctgactaattggcctttttctgttattaatttgtcgtcctaattgcgacgacatcatttgctgaggccttttttcttggtcactaattatgcattttgtttggttcgcgacggagccaacgaaggcactttggggtctttggctggggcgattctgctgagattagaaaacaaaaatgagaaattgcaaattatggtcttaattttcaatgaccactttttgctgctgttggcgcgtttcgggccgataacgacccgttaaactcgttgatgagttgacttttgtgtagttgagaagttgatgcttcaacacttttaactaaatttagaattattcaatttgcctaaaattagcatgtaattatcggcacttttctgttttgaggcatagtttattttgacatttttaaagtcacaaaacattcccggcggttttcatactctctgatcactttatgacatcattttaaatattagcagaaaattctaatttttcaaaactatttttacatgtaaaaccaagtttaaatacataaacgaaatgaaatcaaacccatggcaaagaataatatttgaatcggtttgtctcgtaaatacgggatataaaaaaataagtttaatactgttacggagttcgaattgttcgaaatgggtgccattttcatggtcagagttaccctggaaacatccgggaacatgtttttattatttaaaattgtcaaagtcaaaaaaggccccaaaaatagaagagtaccaatatcatcagttagtgccttttgtgccatcaactgattggccctgtgcaattcgtccaattcatcctttttcggcccatttggcactgtgttcctttgcgaatttcttccgctcatccgtccatttaatcttttaatttttgttggcattttaaataaaaattaactattttttaaattatttattgttttacattttcacttctctctccagtctattgtttttctgtttgagtgtcgtcaaattgtccgcaacggaatggaaatggtcctccaattcgcttcggctccatcgctcaatcggcggacgattagtcatggtacggtaggagaatggacgggcaaacgctaaaaagtttacaaaaaaataaattaatgaaaaaagaaaaaaca

SEQ ID NO: 8164 - DNA, 3524 bp, Heterodera glycines
  misc_feature (3464)..(3464): n is a, c, g, or t
  misc_feature (3487)..(3487): n is a, c, g, or t
cattgcttatcgcgacagaatacgtggaaagtaaaaatttgtaatccgaaatcccaatttcaacggaaatattccgtattgggcaaattcgagaaaatcaggtcgccgaacaggctgaagacttaagtgatgaacagaggaaagagtgggttgaaaagaccaaaaagagcgaattggcgtttgtctatgagtttttggaaaaacgcgttttgccacatgacgttcgcgatcgagaaaattattgtcatctttgcacaatttttcgttaatcaacggacttttgttccgcaatgagaacgatggaaaactacagctttttgtaccaaaagagttcagggaaatgatgataagagaaaggcactcgggaatttgtgcggggcaccttagcggaaaaaaaatttttcgtcagctctcggagctttacttttggccaaatatgtacggagagtgtatccgggcggcacttcgttgtagagtttgtgcacatgcacgaaaaccacgatcaaatgagcctcccctgaacatagtcgagacaaaagagcctttggaattggtctgtatcgatattttatcgattggacccgcagcatcttcaaatcggtacattttggtggcagtagatcatttctcgaaatacctcgtggcctgcgcgatcccaaacaaaaatgccgaaacgattgcgaaaaatgttgtaaaaaacttcatctgtgttttgggaacgccaaaaaagcttcatagcgacaaagggacggagtttgttaacgaaacattggaggaaatttcaaaaacactcaaaattgagagaacgacaacctcaggatatgatcctcaggcaaatggtgtaacagagcgcgttaatcagacgatactaggaatgctacgaaagtcgacttattcagcctgggaatgggacgaaagactgccttttgtagtgtttgcctataattcgacaccatcagaagtcacgggtatttccccacatcatttaatgttcggaaaaccagccaactttccgttggaacacgaattaaaattcgccgtaaatccgctctacacaatagaccaaaatacgtatattcaactttttcgtgagtccctaatgcaattagtggacgaagcgcgaaaaaattcccaaataagccgtgcaaaaatgaaagaacacttcgacgcacaagcaaaagtcacggagaacaaattccaaatcggcgacagggttatggtcatttttcccgggtcccacattcgatcaccacataaaaagattttgtggaaccattttggcccatttcgtattacggaattgaataaatcgacggcgaccgtaatcccgtccgataatccatacggtaatccaatgacagtccctcttgaacgattagtgcgcgtaccaaaggaattgccaaacatttgtacaatgccgaaagggaaaaacccctataagaatgttttaaatggactgataagtgtggccggattgatttgccaagaaaacttaaaatttgacggggaagaaaaattgaactctaaaccggacggaataattgggcaattgaggtcaattgcatttttaggcggtgaggaggagcaaatggaaactgaacagatggacgacaaagaggcgaagacgaacgagagcgaaaacgaggaaaatgtggaggaaaagacggacgacaatgaggttgacgcgaaccggagcgaaaaagaagcgaatctggaagaagaagaccaaatttcggtcaggaagaagaggagccgaaaacgctttcttggacattggcatgtgcaggagacgggcacaaatgctgttccgatgtggtcgtggccgacttggatgccgtccttgaccgatcaggcattgggctcacgaagatcgagaatccgctaaaagcgctgttggcaatgtttctgctgaagtctgaagcggtcgcgtcggcatcagctgccaaaaagctcatttcgcaaattctggacacggatgccgattgggaactcgcaacatattgcagtgcccgagaatacgacgtcaaaaacggcacatttccatccgaatcggacgtggaaagcgttttgcgaatttggatcggccactgccaaattgcccgaaaagaagtcgaaaaatcggcatttgggccaatttcaattgagctgccccaaggcctatcacttctgcccgaaactgaaagagaaggcatgaggaaatcgctcgaaagtgcgccctttttgctggagaagatccgtgccacggaaatccaaaagaagacactcgtcaccgccgaaagagtgattttaggcgattcaaatgcctaccaattgaagaaactatggccgagatcagcatttgtcggagtgcaagaaggatccacagccgaagtgatcagacaatttgatcaagtggtgctggcctcaaaagtgaagtggttgattgcgatggtcggaaaggactcaattttggctggcgactcggtggacagtgtcatcgaaaaagtgaagagactgcgccaactttgcctccgatttgcgcatgtgaagatcttctggctgttgccgccttttatctacaacaaaaaggccgaatctgaagaattctgtggaagaatgagggcgctgtttcggaagaaaagcgaaattgagctggtggcagtgacagaagaaggaagaagtttgctggagatttggcgtttcgggaagagctttaacaatgaacatgtcaaccacaacggatggatgacagaaaaggggctaaaaacgttcaatgcctggctgacatcattgatcccgaattttccgggcgacagagagctcgggatcagaacagtgaagtcaaaagtggtgaaaattggcgccttgaagggtggtggtccaggagacccttccccgattcgttccaatgcacaggagagaaatgtgagaggagaaggcccaggtgacccctccccatctcgatcgatttgcatttctgacgatggccccacaggttccgcccgaccaatgatcattcaaaatcgcgggtttgagtttggacgagtcggcacaggttaccgctctgtccctcctccgacgttccgtggcccgtcttcacgtttccatccgtatcagcaaagtcggggtcgtccggcgttccattcgactccgatgaatcgccgtaatcagttcgagcctcgtcgctgaagcagtgatcccagacgagcccccaccttttaacagccgaatcgaatctcgttttttttgtttgtctttctttaacggcagggacgccgctcgtaattgggtgggatgtgatatttgacctcgtatttaatttaaataattaatttgtggcattttgtttccttaattttgttccttttcgaaatttgttttgtttcggggttttttttcttctcatattataatttggcgtcaaatattggtaatattatattctcatcgctctctccgacttttgattttttttattgaattanattggttgagttttgtgctatgngctttaatttggtgtgacttatacagcgttcggtttt

SEQ ID NO: 8165 - DNA, 1427 bp, Heterodera glycines
ccccgatccccgacatgtcgctccccgaggtccccggcccccgactttttgccccccgacataattcggggaatggtggtctgagtgaaaaattagagatgaaaattggagataaaagaaaaaattaaaaaataagcataaacatatctttaaaagcgataccgccattgtgcagatggcctagtggttagtctacttgactttcctttcttcttttcccatttttaatccctctacagaaataaaattattttaaattttttttctatattcattggtttcctatcgacaaaatatgattcctcatagtttttttcaattaaaacatattttatcatttttaaatgaaaatccgtacaaattcttgaacctggtaatcccaaccagcctcttttttttgtttaaaatctgttagcaaattaactcgatttttcaaaatttcccccggcggcgcctgtcggcaccgccgtaccccttttttccccaaaagatttctgggaaaagcgcgccgaaaaaagtgacgtgaatagcaaatttgaatttctaataatattcgatcatttaatccaaaatgattaattatttaaaataattaaacaaatttgatttgaaatttttcattaatttaattaagctttaagttttggattttataaaataaaaaattaattttgtattttcacttgaaaataaataaaaatttgaattttttaaaattcccggttggtcccggttctcggtcccgaagaaaaatcgaggtcccggtcccagcttctcaggtcccggcaagtcccggtcccggttttgcccaaaattcccggtcccgcttcgctcaaatttaaatacaatcggttcaaaaaaatcatattaaaaacaaaattttgcgcacatttttttaaagactttttgggaacaagcggggcggaaggccggcggtgacgacaggcgttgccggaaaaaaagaagatttacgagcatttaaaaagaaaaattggttttttagttaaaataaaatttggtcattcctcgattggggtccccgaccaccgacaattgagctcctccccgtccaattttcaaaaaaggtgaaaaaactgatccattaaattataggccggtgtcattaaccagctgtagagtttttgaacgaattttgagtagtaaaattttagaatttctgaacagtacaagattctttgataaagaacaatttgggtttttaaaaaatagatcgactacaacccaaatattaaaaacgatggacgatatatataattctatacaaatgaatcagcaaattgacatcatctatattgattttgtcaaggcgtttgattctgttccaattgatttattacttcaaaaaatcaaaaagattggaattgaaggaaaaattcaaaatttttttaacttaactttttaaaaaa

SEQ ID NO: 8166 - DNA, 1642 bp, Heterodera glycines
  misc_feature (58)..(58): n is a, c, g, or t
  misc_feature (1625)..(1625): n is a, c, g, or t
gtgtgaaactgatttttcttgcagacatacatcattatgtgaccgcattcgtgtgctntcatagttaaattagttttaatttttgtcaatcatatgcattattataacaatgtaactcattttaaaattgggccgccggtaattattttattagcttcatcatttaattatcaatttacgaagccaaattttcaggtaaatccgtttgtagttatttaattttttttttgattaatttaattaattagttatatttttaattgtattttgaatattcctttattttaattaaaattttattttcattatttaatgagattattaatcatataaattaatagtatttcagatgtttttaaatttatacaaaatttcaacaatgaaacaaaatttacaaaacaactctgatttttattttttaaatattatttttattttagtttaatttcgtttttgtttatttttattttaattacgattttaattttttattatttttgtttgactttaatttttattaaatacttgattttttttagttttttgcgaaagaaattgtaatggataaacgcacgacccaatttgggtatatatacaaatattacattatggttaaaaataataaaatgattatcttaatttttcctaaaaatagtaccttgacaaaatcccatatttgggcaaggtttcactgattcagaaattagttgataatttttattcggattctttttcacatcttagaattaattcttctactgaaaattcagtttttaagtttcgaattttgtcttcgagttcatcacaacatttcgttgcattgaaaatattaataatacagtgagttcttgatttttcgggtaaaggtagaaaaaatcttttttaattataatttgtcttttgataatcttcggtaaagtattgattcaattatttcccattcttttattatttggtttttcctaataagataaattatttctctttgatcatgataacaaattttagttccatttttatcacattgaaataattcacagtaatctgcagttccaatcgttagattaccatcccctaaacaacgaaatcatatttgatttgacatatgcataatgaatatttaaattttccattaaatatgtgcttatcacacacaaacgaaatgtaaagaaatttcctttggttttgcggatgcatttcgtattttgcttaaattaacaaataatatattgggtttggctttttgaatgagttcttttgtttagcccaatttgaacattacatttagagccataatagccataatacggtatatgtattattgtagacaaatgcttatttagaaaagataaaataatcgaaacataattcgttaatctatattttaagaacaatgttccttcttcaacacaaaaaatgttaaaatagttgtgtaatttttaatatttttggacaactataacttgagtaaatattcaaaggaaataaaataaatttagagaaataaaagtaatttttaagggaatattgaaggcttaaaattttttctctatttaatgataacttatttaaattaatattattaaaataagtttgatcgtaatgtgcgacatgatttagacaanagttattgtataaatta

SEQ ID NO: 8167 - DNA, 2913 bp, Heterodera glycines
ctgcgactctgaaattttttgaaaaatttaatgatttatttttttatttgaaaatttgggtgactgaagtcttggagggggtacaccgacaaggaaatcgcaaattcaacataaaaactataaaatactatttttccttaaaatttcgagtgtggggtatcttaggggggcaatgggaccgtcgctgatttagggtcctttttatcgcgtaataaatgcccaatttaacttatttttagttggaaattaaattttttaaaaatatggcaatttctgtgccgtcccaattccctccgcccgtcactcacccatcgctttggtctcctcacgtttggcgttcagaatagaaaacttgaatttggcgcgcacctccgtcttgttgcattggacgagcagcaaatacagggacaagtagtccttggattcttcgtcgaggcctttcggattgatgcgcaggcaccacttcagcttgtcgttcgggccggcactgaaccaatggacaaattttacggcgtaagaaggcggaaatgtgacaaaatccaaaattcaagtcccacgggcaatgagtgaaccgactcaacccaaaaatcgaaaatttaaatcatttttgccaatcaaattttcaaataatatgcagcccaaaggtttaagaatgaacacgaacccaaaaaatattctattaaaaattttaattaaaaaaacgttttaaaagggaaaaacctgaacgtcgaactcttcaaaacttcgcccatttcctcgcgacaaaaagaaaagttgttaatctaaaaaaggggatatatcagacactggtataattgaagttcaaattaaaatcagcaatgccaaacacaactcaccgtccacatgtagttaaacctaaaaaagaacaataagaatttgattggtgctaaaacattgggtgtactgctcgaattccaaggctgagcaaagccaagtcaaagtaatccaaaagttattaacaggtaaagaaattttatccatcttgtcatggaaaaaattcgacaaatttgcttggccccgccctgtcttcccctattttattttgcattttccccgtcccatggcacttacttgaccaccttgacctgcgtgttgcaccaattctccgcaatcggcaacatgcccaggccaatgtccagcggaatcactgaggaggaggacgacgaggaggaggaggacgtgctgctggtgccagaagctgaagaagcggccgccatgcccaggccgctcagcggcgacatggaccggtactgctggtgggaggagccgaccgcactgttccctccggcaccgttcccaccgccgctgctgctgcttgtactgctcccgccgccgttgttgctgctctgctgggccatgctgccggtcggacagttggcaatgtaaccgggaccatccgtaacctttacaagggggaaagataggcgatgcacacaaaacacacgaatgaactggcgagatttcgaggtccatcgggaaccgaccccatccccacgggtgcatttgacccaagaaatatgtcgagttaatttggccaactcgtcaagttttgcaaagtaatttggtgttcggtgtggtgaaaacccaactcgtactgcaccgaatcgtgttgttttccgacaaaaaatcgtcataacttttgtcaaaatcgaccaaaataaacattcttggtgtcattcacattaagattctccatgcctaaatttacaatgtttcgaaaaaaggtgactaaaattagaaaaacatatttaatttggttgaatttgacaaagttatgacgacttttttgtcaaaaaacagaaggcctagtacgaattgcgtttcgtccgtcggtataccattcgaacctcctgccaaatatttgtgtttctgaatgcccataaaacgaaccatctcatcctgcgcagcaccgtcaacgtccatcacacagcgcaaaggtcacaggtcaaatggatgagtgaagtgaagtgaatgtgggaagaatgagtaaaagtgaatgagtgccgtcacttttccgcgaaaatttggcgttttaaatggcgtttttaaacaaatagtcgaattgtgcagttgtaatagctctaaaaaggtggtgtcttcttacaaatacgctaaaatgaaaaattgacgcaacaaattgaaacagattttgaagagaatttcaacgaaaaaagggaaaattttgatgaaaaaatctatattgaataatttttgtttagcattttgttcattaaaattttaaatatttcctgtatccttgacttctaaatactgtatttgaaaaaatattttttgattctccacaaatgtacattcgaaattctgttaattcttggttatctgtttaaaaaatctaatcacaaaaaggcacataaaatgaaaatatattttatctttttttcgctttgcatattttcgaatttaatcagataatcaaatcacgcacacaccgatcaaagtgcgaaccatttttatggtaatttaagtgctggtggatattttttgtatgaggttaacaagcttttcaaagtgcaaaattagcgccttaattgccttacaaaaaatggacaggggggcattaaaagggagaagcaaaagcaccgacaaagtgaggagcagcacagcacaggacaaggcaacagggcatgcttctgcctgctgccattttcaacatatacacacaaattctaatggcaattatgatggtggtggtgatgatacgctgctgctttgtggcggtggcggcggtgaccacaaattccttcccctttctcccccaagcagcacagcccaaccaacacaaaccaactgatgagagccccccaattgcctccgtccgtccccgcccaatttgttggggtggcgattatgtgatggtgtgggggggggagg

SEQ ID NO: 8168 - DNA, 897 bp, Heterodera glycines
aaagtcgtcagaaaatagaaaagtggtcggttggttttctctcatttggtgtgtgtctgtgtgctcctcctctcctcctcctccctccccttccttctgctgctgtttttgctttgctttgctctgtccaatccaatcccttctcatcccttcccccctcccctcccccacttttcttctcaatgccctccaatgtgtggggaaattgcaactccaattaagattaggacggagcgagggagggagggagggaagggagagtgaaattaacattatgtgattgtggcgagtgaaaggggcaaaaattaattggaaattctcgtctgaaattcgaatgggcgcacaaaatgccaatcagttttaggcattttaaaatttaaaaaaggaattcatttctttttctgttaatgtttaataccgaagggagccaaacatggaccgaaggggtgggggggggggaagctcatattaaatggccaaaatctgtgaattaattttcgaaccgaaaagaaaaacggaaattgaggggggggggagagaaattaattgggccattttaaaaaatggattttaaaatgtgcgaatgaaaataatttatgaaaggaaacaaaatcactttgaagtgggaaagaggaaaagaaactgtgttgtatgtatttataaaacggggggcggagggaagggggggggggacgacgacgacgaggaggagatggaggacggacgatgctgctgctggtgatgaggacggacggagatggaggtggaggtggtggcgatgcgacaagcaaaagcaagtgggcgaagaaaaatgtacatattataggcagaggagagaccaaatgggggagggggagaagcaaaatgggagggggggaagtgaatgcaaatggcaag

SEQ ID NO: 8169 - DNA, 1939 bp, Heterodera glycines
gacggacggaggactcctccagcaccgcccactccatgccatcgcttttccgtcctccgtctccccccccccccttctcactgctctttcatcaccatttctttgctcttttgccccaccggacggacggggagcagcaccaaaccgctgctgctttctcgtcgtatcggctgtgaccaaattggggaggaaaatgtgcggcgtttggtggccgcaccaaatgagaaaacatcacacatacacacaaatttggtaggatatttaggcgaggggcagcaggacggggccaatttgtatggggtatactgctacagcttccgctgttgtatgttcatcaccagcatgtagcagcacagccattaattaattacaataattaactcgttaattgatgcgacgtttgtgtcgcccgccgtccgttgggtgcctctgctgaactttaatgtggcactttatgtggtgccgttcatttgctttaaatagtgctctttttgatcagtagatgggcctaattacaccttgccgcgccgtttgtactaactgcttcgactctttgtgtgcacaactgtcagaacattattctttgcagtgaaattttaggggaaaaacggaggatggaaaatgaaaaaagattgtacttatgagttattattgttttttaaattcttttaaatcaattttaaatcagggcagctgggattcgtccttaaaatggcaaatcgtccttgaaattgggctcccacacttgaaaatatcctggaattcaagaagaccttgaaaataagcacccaataaagattcataatttacaatttttgaaattttctcccaatatttctattaactatgtatgtaatattttctagtgtcctttaatttatgaaaatttccctttgtgtccttggaaaaggggttttgacgatgcaaaccctgtgttaaattattttgttttttagacatgtgtttttgtatataaatttaaggaaacattacaagaaaaaatttaaaatggtttctgaattttcaattttattagtacaaattgttcattgaatgcattgcattggttcgccgcgttcgtaaaatattttcgcgccggggggggcaaatggtcaaaaacggacgaacgaacgaacgaacatggagagagagagagagaatgtggagggggaggaggggaatgaatgaatgggaattgtgaatgatttgacgccgcgggggtaggcggggcggacaaattttgcgaagagtgaaattttgaaagtttgtgtgaggtcaaagggacaccaccgggtgaccgacggacggttgagtacggcggcgaaggcgggatcgggtcaaatgcacacgggaacaacgaccgacggggggtttgccccgagacttttgagtaactctcattcagacagagagcattgcttctccaggacaaacaatgagtgtatatgttttccagggtaaaaagccaactcgtgctgttagtactagagatcggaccggttcggttttttcggtatttttcggtttcggtttttgaccgaaaaaaccgaccgagaaatttttgactttttcggttttttttcggttcggtttttttcggttttttaaccgaaaccgaccgaccgaaataatcaaaaaaccgaaacaaattggagcgatataacctgttaataataataaatttattgcttttttgtgctctttttcattttgaagaattttttgtaaaatattttctgctattttgaaaaaaattattaacaaaaatgcaataaaaacgaaaaatacacccctgagaaatggaaaattttatcaaaaattcatattcaaaatttatttatttatttatttacttgactacatttttgatttttaaaatattttatctcatttccatttttagcacctattttgggggtttataatagggttgctcccc

SEQ ID NO: 8170 - DNA, 5790 bp, Heterodera glycines
cagccgattataatcaaccataatcatttggtcgaattcacccaagacaatcatctctacaccaccaagcggaattggtgaattgaatgtggctcgtacgtttgttgtaccgaccgcttctcaacagctcaaatccacagctgtcgtcaagcgtggatgtcattggaattacaaaaaaggtccacgcttttttgaactgggccattgaaatgtcaaatgaacgttcagagttagccattccgagtgcctcatacatgtcaacaaaggcgctgacaaagtgatcatttgaaaaatttagtttataaggaacagctgggtaaactacgccaccagcatgtaccaaaatctcacgcaaatcaaacggctcaaacatgaagggactcagtttgtagtcaccatgaaatgctgaatttccaaccaacgttattgtcacgcgtcgatgaatggtcgcgctgaagacattgtactcaaattcgtatcgaccgacactgatgaatgaagacttgatttcggtcttgcgtactgcataagtggcgggttgtttttcaaatgttttgtaaaggctcatgttcaatgacggctgaacctcaaccattttggcataaatcttgacatcgtgaactgtcaaacgatatttagttgtatcatttgcttttaaagtttgcaaaagaaaaacatctttggctttgtaaattgtgaacagcaaatccaaattgtttaagagataaagctcctggtttcccaaatcaaagtcgagacgggagagaaattgcgcattttttccacccttaaaaattttacaacgctctttgaacccctcgtctgttgagtcatcttagtttacggtgtgataataccctgttgccaagaaaatttttctttgcatttattggtaagctcaacacattggtgatatacgctttgaatgggtataaatttccgctatcgtatacttccgtgttgccaaccgtaacttttagttgctggacaaatgtttgaccaatctcttgaatggcagagacatagtattcgcatcctctgtcgcaacccattgaactaagaaaatgttcaggccactgttaattgctaatggactgctgtcactgattttttgtgttattatttatattctttgaaaattatgctttttacaaagttgtttacgagcgtgtccggttgctgccctaatgttcataataatccaagtgcaaaggagaagcgcaataaatgcatacccaatgagagctacgcgaggtgctggggtcaagattcaccaccatacaatgtggaagtttgacaattgccccggcttgtatttggtctgccgcaaaacaaccaatatagtagtggcgactcacgttgtttcttgccaatgttttgtcaatttctaacgtgttcattatttaaaaatagacatttttctaaagttttgtgttaatgtacatgttccgtattggaatggcatcaagcttccgatatttgtactgatctcaatcaggatttcagaaacttcctttaataaaattttgtgatattatatggcaaaaaattgttcttcaatcacttggtcgggtttacgggctcaacaagcacctgtcgactaagagtatcaatacagactaacaagtacttgtagccacggttttgtttagcaattcggtcaaaaatagccaaatcggtctgccattcagtgtgtaagccaggtgccaatgttggcaatcgacggtagcgccgcttggcctgacgatgcagtgtgtttgtacgttgggtggctaaataattttggacatcggttagactaatttttggttgagttttcgcgcctctctcagcagcggttcaacgctcgtgaatgcgacaggcaaacataggtccttgtacaagaactcaagcaaacgaagctttttaaaatccataatgatggcttaaatttcattgtggtgtttttataaatgccttttgcagttggctctttgttttgagcacgtttgtccttgttcagcaggtgactaataatgtcataaacactgctggttataaaaagccgcccacccgctctcaagacctgtccttcctcagacactccaagagattgggcgtttttataaattaattttaagatttccgtttgttaaggttgtcgtttatttgaactcgatgcactcccgcatttgttccgctcgtgggacgccgctgtgtacaatgactggcacattgccaattttgccggcgcgctgcagattcatcacatttgtgttcagctcaccatagctataaataacgcgttcaatcaggggtagagatcattttatccacatttcgcaacagacgcattatccactctgacttcccactacctgtgctcccagacacaatcattgtgaatggatgacgaaattgtccatcctcccttttaaattgttggaaggcgtccattttactttttttttatgtaattttctttttatttatagtttttttttattttcacagattttaaatggatttaattcttgccaccgattggataaacaacgcttatcccgaaatggatttacaggacgccaacaaagagaacaaagagccaacgaaaaagcaagaggaggaggcggaggatccaagctggatcagcctgattgacgaggagatgaagcgcgagccgctcgctccaattggtgaggagacgccagcaacaagttgcttttgttttaaacgtatatttaaatttaaatttaggcactccaaaaaaatgtgcatgtgccgaacgccgtcgccccgttccgctcgtggaccatctctgcaagcggttcaaatgcagtgcccatgaactgcatgtgcttttcaaaagcttagagaaacgccgggacattgtggagcatttgcgctccgtccaactgcgcactgcccacctgcgcccgtccgtgcgcaattttccagtgcgttgtaatgacctgtccatcctggacacccactcggcccccgcgtaccgaggctacctcggcataacggtatttttatttgttttgtttgtccgtaacaaaaaaattaaaggtccggatgcactactacataaagcatggcatccgcttgcgccaccccaacttgccgtgcgtcgttgaatttggaggcggagatcacaaaacttttttccctcttgaaattttgtccattgttttgtagatgtgttcaatttccaattgtactgttgtttttaaaataaatgttgaacccttaactcgagagcaatttttggcaattgcacagcgtggcgcaaacacggagtacaacgcacgccgcttccacgctatcatcatgcgaatccgtacaacaacgggcaaaactgtggcagcactggtcttccaatcggcgcgtgtggtcctcaccggagtacccaacccaaacagcgcaaataaaatggcggcacgtgttttgcggcgcatccaacacacacagagcatcccactcggaatctaccaactgcgtgtggtcaacattgtcggcgttcaaaccttcccccagcgaatcagtgtagagcgaattcaaaacactctgggtggcacatatgatcccactatttttccagcccttagatgcaaattgtcgaatggagtcacgtgcctaatttatatttcgggtaaggtcattgtcactggggccaaaactttggatgtcatccaacattcatttaatgatttgtctagtattttaccaaattattatcgttgaataaatttattatttacaattatttgaatgaaatgaacaaaaaataaaaagacaacatcaaaaccacccggaatgccctggttgggcggggtcatgatcaacaaaatttctctttcgtcgctccgtccgttgtccatcgttcggtggtccatcatcctccacatagccaaagggacgcgtctgcattccggggcggacacgcccctttgcgtagaagggcctgtagtctttgtgtgcctcgtgtgtgtaaaggtcggcgtaagcgttgcggtcaatatgtgggaagttgacccgaatggcgcgatgctcaccgcctccgaacacgtagaggtcgtcattgtccagcacgtcgtcgctaagattttattatttacaaacttaatgataaattgcaaaactcacattggtccgtcaatgttgtacgtggccagcgtgagctctttcatcgcctcaaagttgagcaactgttgggccgcgtacgacaggcggaagctgcggatcttcaggttggcacgctcatccgtaccgtcccgcgcagtatgccggatgccgtagttctttggaccacccgcaacgaactcgacgattctgcgatcagtgtgctctcgcttcatctggcccagtgcctcgccctcagcaacacacggaccacccatcttgtttacgtagtagatggagtccgtgtctaaagcataagcgtgtacaccaaatgttttgtgaaaaaacagcataccgcagtagagcagctcagctccgtcaatcgccaacacctgctcaatgtagtcgtacagatgcaggcgggcatatgaagtgacgaaggaagcgaccggaagacagttggtcagcggggccttggcaaactcggggcgcttccgcacgacacagcggtccatgtgctcggacacgtggacaaaatccaacttgtccagcgacgggtcttcaagcagctcgtggaattcagccggcgtccgcgtgtagcgaatttcggttcggcccacccgctgcgcgagctttcccctgtaaatttttcgtttaaaaataaataaattttattattaatgaccaaagtgagtttgccaaagttttggcgatgaggcgcaggccggggttgaattccattttggcagggtccagctggatgccctcggtgcgctcaaagtcctccacaaatgcctgacgctgctcgtccgtgacacatccttcaggccagcccgtcgcctgcactttgagaccgacaaatgtgttgacgtacgagctgaacagtgtgccgtcccactcgtcgtagtcccaaacctaattggtattttgtgcaaaaaaattttaaagagtgactacctcaaaaaggtcagtgaccacatagccgagctgcagggccttgttgagttcggcatgcgtgtaggccgtcacccacgaacgcttgtcgtcaccgtgacggcacggtcgctgctgtcttcggtcggcacaccacccacacaaagggaaggtgaagcgctcatcctttgtgcggtagccgagcagaggcacacggatggtgcgtggcgccagcacccggacaagcagcagcccccggaaggtgttgttttccggcgcagtccacgggaggggtgccgtggggggatggagcagcacctcgcgcgtcagaacccgcgggttgcccaccgggaagcggtttgccttctgaattattgacgataaaaaaattaaggaaacagttcaaatgaccaaccataacgtatgggtataggctcacgatgtcgatgcacaaaatttcttcgttgtcgctgcacacgtggtggagcttgaacggctctgtgcggcctcccctcagggcatcgttgcgcggatccaacgggcaggggacaaacacggcctcgtaccgtcgtttcagctccgggtcgtgacggagacgctccgcccaatgacaggcccacactttgtgtatctcacaaccgtggtcgtgctccaactcaaagagtcgccgctccgtacgttcgtacaagtcttctgctgttcgcccagccgccagttgttgctgtcggtcggggaagcactttggacagcctt

SEQ ID NO: 8171 - DNA, 3765 bp, Heterodera glycines
caccgcttttcatgcaaaaaaatgaatttataattttaaatgtctattaggaaatgtgaatttgcttaaaattgtgaaacctgaggttgtcgcagttgacaaaaaaggccaacactttgaccgccaaagtggcactctctttgttgttcttctccgctttaagcgcaatcagtcgctggttaagttcaccaaaactaaacttacaatttttaaacgatcggattagtttaagaaacaaaatgttaaagggaaagcggacaaggaatccattttttaacaaaagtcgcgccgcgcacctttcgttttcggtcctttccatgtcgacgtcattcgccccattgacgtggttgttgatcattataacaaaaaaatacttcagacagaaatactaagcaaaaaaaacaataaaaacagagcaaaacaatgaatttttaagcaagtacaactgaaaatttttgattaccgggcaacggaataaaattgatgattttaattttagttattttttggcgtaatgtttgttgcatttaatttaaattcaatgaaaaaattttaaaattaaatctggaatttttcgaatgtacgcgtaagggatacaccgctggacatctaaactgggtacaaaaaattttttaaaattagaattcttatttttgtatttattgtctgaaaatcggaatattagtaaagctactcggacaattgttctgatatccatcaatcctaaaccatggaggatttcattaaatatcaaattatttgaacatttgcattttttgattcattttaacagataaattaaaacgagcaaaactcgctaatacaaaacaacaacaacaataattacagaagacttagaagtcctgaggctattgaatttatataatttattatggcactttgtgctattaattatgtgacaaattgctttttgttcgccaaatattccgcacattctttcatccacggctcttccgaccgttttgcgctgtcgcttttcgtttttggcatttgattgctgctccttttctgcactttcttcctcttcaccggcttctcccctttaagtcccaacgcggaaatgtccggcacaatttcctcgttggccgtgccacaacagagcaacacttcgttgatgtcttcgtccccctaaaatttgagcaaaattaatggatttaaaaaagcaaaacaaacttttattgaataaacgcatgggaaaatggtggaaagcactctcttcacactttgagatgcttcttcgtctcgagtgaccaaattaagcgaaagaacgccgcctgagggggaatttaatgcattgggaaagagcagacgaagggcgttaggtaattagttaattatgtgcctttttcgacaagacaactgcgcatttgcttcagcgtgtcctccgtgacaaattgggccggtggacagtaaaggccgccctttccgacactgccgccggacaaatcgaccaaaagcacatcaaattttggacaatctgtacaaaatggggcataattatttaattggccttttaaattgccgaagagtatgtaaaaagagcagaaattttccattttgtggagcaaaaaaaactcaccttgcgcagaattttcgcgcaaaaaatccatcgcatcgcaaatgaccacttccaatcggtcggattctgtcggaaagtcgaaaagttttcgtgcaattgccaacacctcggggtcaatttcgaccgcaacaatttgggactgaaaaggaaagactattttttaggagggggggggagatttaaaatttataatttggccaaaaaaagtttaatgaaaataatgcccaattaatatacagaaaataacacagcgaaacaaaaagacaaactaaaacacacacctgcttgaacttgtcgtgcataaacttggccaaaattccacctgataatggcatttttaagttatttttgcaaaagcctatttttccaataccgccaaggccgagcagtgcaatgcgaagcggcgcctccaacgcatccgccaaaccggcagaggacaacgacggcaaaagtgcaaacgcagagagcatcattttgtggtgttggcatgacaaatcggaccacacaatgtgccaacggttgccattttttgactcttaaaaataatgcaaaagtgtcagtcacaatataagtaatttttctcagcaaatcccccctttttgctacggcactcacttcgcaccacctccacctcggattggatcaaattggcactgtccaggaacaccaaacgccgccgcgtggcgcccccctcgacttcgacctgttcaacggaccatttgccactgatttttgaaaagccgtgcccaatttgatcagtgacatcggcagagccaagcgacagcaaattgatctgaagcgggagacaaagccatggaaaaccgttggtaggcgattctgctgatttaaattttaatttgccattgcttccgtgacaaatcgtcgcttactttttggccggcacacgccttgggcataaagtccaaaatgaacacgttcaattccctctgaatgtcctcaaccgtgccgtatctctgaccacgaaaaaggctgacgaaagagtaaaaaaatgcaaaaaattatctaaaaattgtgttaccgtacgacgacgagtcgatgaagttcgcaattctttctgagaactgtgcggccattttgagttgcgaaaagccaatcattttccctaaaataaaaattaaatggaattaaaacaacggaatttcaatgagccgttcgctccgccaatagactgtttggatatttaattcacaaaattttgtggctcccaaaattgggacggaatgccaacctgcctaatggcactataaacgcgccataactgcacattgttttcaactgttggtcatcgaccacaaacagctcgtagcgttcggcaccgtccaatgcagaaattttgatggaagtttggtcgacggggcctctgaatgaaaaaaattaaagcaatggaagaattggggaaaatccacctggaaataaagtgccgaaaccaattcatttgttgggcagcgcaaattcgctccatcaatttgtccaaagagtgcaccaattcgggcgactgtccgtccgaaaaagtgccgacaaattccattggccgccgttcggtgagcgccgttttgaatttggtgataataaactgacaaaaatggaaacatttacaatgcttattttttgtatgggttttcaaaacccacggcaaaaacgggcatcgcaaaatcggcattggtccgctcgcaattctgcactcggaccatgaaagagttggtgccgaaaaaggcggacaacctttgaacaatgtgaggttgggccaaagtgatctgaaaagggcaagtgatttcaggcaaagcctatagccgagggagcaaaagtacttttcatgggggaccaatttggattgcacttttagaaaattaaagtttttggagtcgttccccgaatgatgccatcaaatccatccaattcagacaaatatttacggaggagttatatctcaaaaacggcaatcgtaaagaatgggggtcccaaatataaaattattattttaaatttgatctcaaaataagtaattgggggttttcgagggcgctgatcatgagattgaactcggatttgcccagttgcgaaccccggacccgaattcgaacaaaaagttggaatttttttccaaaggtacatttttctgggtaaaagcttcgataatgcttcat

SEQ ID NO: 8172 - DNA, 1250 bp, Heterodera glycines
caaaagggcatcttaaaaatgagacaattctggcacacaaaaacattgttgaaaaaagtaacgattggatgattaaatcgcaaaaaggggtccatttccgtggctttttgtgtgcgtttgccacttcgttcgcaaatgccgtgccactcacccaaagtgcccttgtccaacacaacattcgccgacgcgtccggcaatccgagctaaaaatgccaaaataaaaaggataaatttgcaaaataaaatgtgacgtcagcggcagaacgttgctcaaatttgagactcggacgcttctcggagtgtttctttcgctgctgtgcaatcacctgaaattgtgaaaatgagttaagttggaaagtcgcacaattcacaagttccattttttaaagtttttcgtagtgaaaatggatggttcggtgaaagaatttttgcaatttcttatgtttcaatttctaaaaaccttcccgatatcgaccccaccggaccccacttttttaccaaaactttgaattttaaccaaaagttgcaaaaactgcatttctataacaaaaaaaacaaccacaaaatttctgcgttttctaattctcgtttggaccactttgatgtttctttaaaaggtttatcaaaaaattaaaattttcattggatttcatttatcgtatttttccattttacttgtccatcgatgtcaatgctgtgaatgttgcggaaaccgttgtcataaagcttaaaaaaaagcttagtaaaaagaaaaaacaaaaacaaggaaaacggctgcgtccacctgctccgctaaattggagttgccacagccaatttgcaaaatggcatccgatggacgaatgtatttgtccaaaatggggctcaatttgtcgtaattgccatacctaaaattgcattttcaaaatttttttttctttttattatcagaattgctttaaatgacaaataaaaacgagttatgtgtttattgggtacagttcagcgatttgtgaccacaaattataaaaaatatccggtcccccaaattgcttacgccacaagaaatccgaaatatatgtggaaaaaagtgatctgtgactgccaaatctcgcttatctttaagcttttcggcaatcatggagtttactggtcccgttttttttctttaaaaatcatggaaaatttttttaagggctattttactgtgctgagcacgaatccgaccttatttttggccgattctgaaccccgaaccctctgattcgaac

SEQ ID NO: 8173 - DNA, 1098 bp, Heterodera glycines
agattacgacgaacggcagaggcagagggacgaaaagccaatagaagaaggaaagcacaagcagaaagtggctggaatatgattgaaccaatttccaagtctgaaatttttaatattggataaacattatgcactttcttttggccatcattttcctttttctctcctctcccattctttcccgtgcgtctcatttcggcactttctccccctccctccctctgtgtgtccctcgcccattcgtttgctaattggattttaccaaaaatgccccatcccatcccccccccccctctctctctctctctctctctctctctctcttctctctctccctctttttgtttcctgttgcctatttcactttcccataaacttttccgtgaacgcgcaacaacactttggtgtcgattctcctttttttgcacagtctctccgcccacttcccttctctgcccactccaattaatccctccctctgtccgtctttctctccccgttaatcctccaccccggcacttctgccaatgacaaatcccttcttccgaatttcgccttcttccactgctgcgcgtcagttgtgcttttcaatcgcttccctccctcttttgctcccttcccccgcccgctctttcccttccggctcgttagctccctctccccccgtcctgccaatgtctcaactttggcacttttcgtctcaaattgtccttttgtccttttcgtgtcaatctgccaaactgctcactcattgatgggttccatttttatggaattcaaaaatcccaaaatctctttctctccccacccattttggcttcttccattttctgctgtttatatccctcccctcttttacttctctttttgccgatgaatgaatggtgccgagtggagcctaaataattaatgtgcacggaaggctttccaactcctcttaatagtttctcctcctccgcatccccaatttctgagatggctttcccattgtatttgttccctgcaacaaatgatgatgattagagggggggggggggcataaaaaggggtaattggtaaataaaatttgttgggatttgtttggataagatgccgatt

SEQ ID NO: 8174 - DNA, 3839 bp, Heterodera glycines
ccccccccccccgccaaatgttggccaatttttactttgggcaggcacaatgcttgcctgtgcgctttgtgtggccaacccaaacgcttgttccaaccccgtttggtactccaacttttgccttatgctccaggcacttggccattgtccaacgattgggtctaatcaatggttgggccttttaggaaatgtatccgaacccaacacaatttgataaaacagcaaatccatcgtcggaaatgaacggaattcggtcgaggtaaatgagcagcaaaagagccaaaagcaatttgaaatgataaagcaaagacattcactcttcccttcatttgacagaatgttggccatgcaaatcggcgcggctgcggcggccgcggcgaacgatccgccgcaaagtgaatccggcgggggaagtaatttgcccttaaggttcgtcgttctttgcctgctgccctttgtcctcttaattgattcccatccctgctaaaggcaagaatcgcgtgccaccgtggcaatgttagcgccggccgtgcacataatgcaccaagtgtggcgggggatggcatgggttgcggacggaatcgaagaggaggatgagcccaccaaaagctacgaacacgccgaacaggtggccaccgattggaagagagggcattgatcgatcgatcgctcgatcacctaatcaagcaatttattaaccattcattctttgtgctattctcacccagggcacttcgagatcgtgcagtcaagaggggatcgactcggcacagaaaaggctctccacaattgctgaatcgagcagcagtgcgccggaagaagcgagcagcgaattcgcgtcgggaaatgacataatggtgtgattagctgatcgccaattcggaatcgatgcgcaagtgcctttgacttatctctgatcactttactttttgaccaataaacgaaaattcggagagacttaatgattggtggtcgtcatcctccgaaatatgctgaacaagaaatggtaagccatcgaatccgttaattagcgaatgtctcctccctctcggcgtcaccacccatcccgcttcgtctgctttatcgtcccgtttctttctcacaagtcaataaaaagtgatcagtcctttccttctgatcgaaaatccgccccaggcattttcatcttccaattatgttcccgcgccccctcagttgtcctcctaatcacttctcctcacttagtcctcctaatcacttctttttaattagtcttccgaatcacttcttaattagtctcctaattattatcctcaattattcttcaaaatcacttttctccatcactgtgcctcccttcccaatgctatcactttgcttgtctcctttccttctcctttccctccgcctccttctcatcactcgccgattcgtctcttctcatccgctccgttctctttccgaatttcccgtccctccaactgacgacaattggcaagaaacgaccaaatctccttttgaggagttgcgggagcattttggcaaaataagtggaggaaaatttttgaatctggaggaaaagttggcaaatgccaaagaatatgtgcaccgaatggaatttggggacagaacattcacccacgacgtaagtgaaatttcaaggggaagaaatgccaaattggtgttgcacagaatgaggcggacaaaaggaggcccatttcgatcagtccgtcacagccaaacgtaagtgccgtaatggcaccggtgctttttgaaggtcagtgattgtgcaaagggaagtgccattccctgcccccttcaggcgacattatcctaaacgaacgacaaattgacgccatcctaaggcgccttaaaaaactgcaaaacaaaaatcgcagaaagccatcgcctcaacggacaatgtgccaacacagttcatcctcaaagcgtagcataaatgctgacccggacaccttttggcatcaaatgccaatcaaattccatctgcacgattcgctcggtgtttgcttctttctgttgttttctctaattttcccattttcatcttcagatttgacggccattcaacaaattgcgagtgccattgccttttgggagaacaacacttgcgtcacttttgaacatttggaccgggagccatcggcggcggaagaaaaggaagaggattttgtggacttttttaagggccatgggtcggtcggatttaattttgccactgatggcggattttctctccgactctttcagttgctattcgatgatcggccgttccggggggcggcagggagtgtccattggcagcggatgcgaaagggtgccattggcagtgccaacatttattttccgagagagcattcccaatttcagcttggcattgtggagcatgaaattggccacgtgtggggtgagttgcagtgttaagcaccaaaaaatccaccttatttgtccccccttttaggcctttggcacgaacagtcgcgcccccgacgcgtggaaatatatcaaagtggaaaaggtcgagcacagaagcacaccaattaacactaattagtcacccagcactgattaatacatgttttcaggaatttgttctgccttcctatttgtctgactttcaactccgcgacgatgacgaaattatgacgctcggactgccttatgattacggctcagtgatgtgggtgaatgcgattatctaatggattttatttgccaaagacatttaggcattatggcccaaccgcctttagcacggacggaacaagccaaactctgatcgcaaagtcagtgccattttaacgatttttatgcgactttttaggaatatgctctttcaatcgaccatcggacagaggtccgtttcattctcaatttcgaatgtttaaagtttaaagaatgaattatttagggaccaattcgccttttacgatgtccgtttgtttatttttcgatttccattcgattcgtttcgtattttcccttaattttcaggtgatggccattaataaggcgtattgtgcgggtgaattttccatggcattgattgcttttgccaacccaaagccgttagatcagataaatgtggtgggattgcgcaacttcagcagtcggaccgtccgctttccgtcagcgatccccaaaatcagcacgcgtccccccaggcggcgctctgtctgaacgatggctatcccaacccttcgcgctgttccgagtgcatttgtccgaatggttacggcggaaaacaatgcgaaagggcacaacaagcgcagagtgagtgtagcaaaattaaagggggaagatgaaaagggaatgaattgtgattgttcagatgcgaattgtggcggcgaattgaccgttgggacggacaaatgggcacaattggaatcgcccggtgggtatttagcacggcaactaccctaatgagatggtcggccttcccccgaaaggctattccgaggatggctacgaagtgggccaacagtgcaattgggtcgtccgctcgccccaagggacgcgcattttggtcgaatttgttgacgacttctccatgttttgtggcaacatctgtttggattatgttgagctgaaattggccatggaccaacgtctgacgggggcgaggtgaagcgaagcgaaggcgaagaaaggaaattctgaccattcgacagattttgctgcaacgaacgctttgccggacaaatggtttcggagcacaatcaaatggcgattctcttccgagcccaactttcgcaggacattggtttccgaatgcgtctgagggcgagtcggtttccgatcacttcccaaccaaagtttaaccaattcagcacaacttccag

SEQ ID NO: 8175 - DNA, 1375 bp, Heterodera glycines
tgcaatttcgtcgcctgcccaattcgcccgatgccgcaaaagcattgtttatgacagatttatgtccacactcgaaagcgtcttcagcaccaagtcaaatgtgcacggagaagcttcgtctgatgacacaatgcaaccagccgagctgttgtcccccgttttatgcactgaacggaaaatgcgtacagacggaaaccgaaaattaaaccaattaataaaatgaatggaagttacaattaacacaaattaacactccaacacaaaggcgtctttatttgataagacattgcaaatttgaagaagaaaagaaaatggtaaataaaagtgtaaagagtgaaccaccacatttacataacaatgcttctgctgaatgtaaatgtggggaatatttattacttaagttgtttaattggtttagattatgcgaagaacggagttaaggatcaatcaaattttagctgggaggtagagatttttggaaggcgagtgattatatgaagggaattgggcgagtaagtgagttcttcaaactggcgagatatggccatgagggaatggagaaaatgggcattcagtgagagattagacacggaaaccaatgagtgatcagacacagaaatcggtgactgatcagaaacggtgacaattgaatgatcagaagggaggagagacattctgatgtagaaaaaaaaagatgttgatatcattggcggacaaatgatcagaagggtcaaatgaccaattgaagggtaaattggccgacaaaagatggagtcgatttccaattttagttcgtatttaaatccaaaagctctattttcactgcaaaaggcattggtaaattgactacgccaatggtaagtacttctctctctcttttaatttctctctgcccttacatttccgacaatttcaacttcattttttaatcttcacattattttgttttttaatattttgtgggttatcgctaaaataaacctaaaaatgaaaatctcgaatgtgttgccgaattttaagagaagtactggacattgtttatttattgttagtagggaaagttgggctttgtgaaagttggcaaattctcgaaactgtagccgggccgtccgcagagagtgcagccgatgtaccaaacgtggtaaaagccgggaatggcgaagagcactccgacgacgaggaaaatccatccgtggacatctaaagtggagaaaagcgaaatgagcaagaaaaaagaggagcagacagaacccatgtcgttggggaaaagcattacacaactgccgaacaccaaaaggacggagccaagcaaagccaacgcggcggaaccgagaacgactcggaagttggcacgaaggacacttctgaaagaggg

SEQ ID NO: 8176 - DNA, 1934 bp, Heterodera glycines
tgatcaattggttaagttagctgacttggaattaactagccaactgatcggaaatgctcaatatgtgttgttggatcgatgcggttggttggcaacgaaagtgcgatggccgaagacgacaaaacattcgaattgatcgctccaattcattgactttgccgacatatggtgcccctgctgctggcctcaatgttctccatctgttaagattgaaaaatagaaaaatttgaaattatgaccaaattcgttaattatttttaaatatttgaaaattttgaattttattttttctataaactttgtcaatttcggacaatcaataaactttcattttcaatattttgaaaaaattataattaatcactttattaagcagtaagaattacaacattaagcacgtaataaatagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatgaaataaaaaggaaaaacagacccctaagaatcgaccgaaaatttttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctaattataaaggaggaaaaacttataatatctatgtttagctacaattcaaatggaacagcccaatcaggaaataaagacaaagcgaaacaaggagaagctggaacatgagggttcactttatgttcttcacaaactcagtgacgatggacttcggaagtattggcgatgcgagtttttcggagctaacgacaaatgcaaaggtaaatgcataaaataaaataaaaactatttttcaaattcagggcgccttcacactgacattaatggtaatgtcctcaaaataattggaagccacacatgcgacatgagcgccgcacatgtggagtgtcagcgacgtataacccagctcaagcggcgtgcagttgagacgtgcggagcgccggctacaatccgtgcgcaggtattgcggaacactacaacccccgtgttggctgcttttccgaccaaagctgcgactaaaaaggtcaacgtttgcaaatttttatgccaaaggttggtatttctcgaaattatgaaatgcgcccgtaatttttcaatgcttgttattttttttttgttgttaacacattgataaatatgttatgttattaattttaaacattttttcggaaaaaatcagtagaatctattttggacaaaaacagcttgccgtactaaactgaccctcgtactaaactgaccctcgtactaaaccgacccctcgtactaaaacggccgtactaaactgacccggtccgaaaaataggctctctcaaaattttttaggcgctaaaaataaaagcctaaaaaataggcactaataactcgaaaagtagcttaacaacagcccaaaaaaacatggttttcggggaaccgcccacttcggcgcggccatttcggcgcgggtttttcggcgcgaggttttttcggcgcggacattttcggcgcggccttttcggcgc

SEQ ID NO: 8177 - DNA, 3801 bp, Heterodera glycines
  misc_feature (3751)..(3752): n is a, c, g, or t
tgacctgcagttttagcagaatgggcattttaactgcttcgaaagtgtgcactttgccacggctttcttccgctcgctctatgacttggtggtggggcccggagaaaagcaatgggcgcgaagttgttggccccactttccacggggatgaagtgtgttgacttggcaattgtcaaattattatttgtaataatttggttccgatagttttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggtcacatttcgtcgtacattttctttggcattagcattatttcgattcgatagattattattattttttctgtttaggccgagtttgaggcattgacgccttatggctatctcacagtcactttgttcttttctatgcttgggcttactattctgtacgcttcgtttgttaggacttacggtattcagttataggtactttgactcttatttatattttttgaacagtgacaaaattcaatgaccgattgcctgacactttcgatgatgaatataaagtttgttttgaagttttaagtaattttcaaagcaaacaaaagtattttaggaaagtcaggccgagcgccgtgtggtactggaaagggtaagaaaattgcgatgccatttgagaattattcgcaaaaaaatttagggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcgtaaatttcttattcagtttttacgattgataaagttgggtttcagtttttaattgttgttaattttttgtaattaaaaaaatgttttttattcgtataaaatactgccatttgctctttttttaataattctttttagctttccaagttaagccccttaacttttatttgtcatcgtcaccagtccaattaaaatctcgtccttatgcctgcttcgcactcgaacaaagaaggggctcacaatcagtcatccgaaggcgcacggcgccatttgcaacttccgtcgcctccacccgatgattttcaggtcatttggaaagcaaacatttgaattcattgatcagtcaaagagttcgatttgttcacaggttagtcgtcgggttgtgcttttgtcatcggacgaagaggacgaagacagcgacgaatctccgtcaaaggtggacaactcatatttagtctaagtgtgccacttttttttataacaaatagccttttttagccgtccagttcagcagcagcaccaagggagaaccgtggcagggcaattttattgtccgaggaggaggaagagccgcagggggaggagacggaatggttggggaagaagagtgccgccagtgctggcccatcaaatacggaaaggaaacgcgaaaaaaaggtgaccgaccgtaaggcgggagtaattttgaaattaaaaacaaataaattaaagaagcccgaagcccatgggatgctgaagtcgttgaagctgaaggcgaagaagttgagggagaagcagaagaaacggcggagaaaggatcggatgcgaagtgacgaagaggagggcgaggcgatggactcggacgggtccaacgacggagacgtcgatatgcgcgcagacagttacgacagtgaggacagcgatgttagtgcacacattgtgttggggaaacattttcaaagcatatagcaatgattacgccatttttcaaacaggcgaacgaacaaatttccgcccgtcaattgaaattgatgcgcgaattggagcagaaatgtgtggaatttctgaatgagtctgatgtgacagaactgaacgcttgcgagaaattcaacgacaaattcgttgcttttgtgctcgccaatcgcccattcgaaaacttcagagatttggtgatttgtagcaatttggaattcaaatcataattaaatttttggtttaatcactttagaaatccaagcttaccgtcgcaccgggaagaaaggctggcgcgggagcatttgttcgtttgttggacaactatttggaatggttggagaacagaggcattttggataaagtgttggacgactgtcgcaagcacagcaaagtgatcgaaaaggcgctgaacgaaagcgaaggaagtgcgccggtggagagaccagccggactgaacccgaagtgaacgacggattcgaatggatttaacccattttttacaaataaaaacaatttgttttttgcagttgttctcttcatccctaccaacaaattggtctgaattggcttattttgatgagtcggcttgggatgaatgccattctggctgacgaaatggtttgtgcatgttcaatttaaaaacaacacattgtgtgacttttgcttgttagggtctcggcaaaaccatacaagtcatcgccttccttgcctgggccaagagtcaacaagaggttgagcctcgtctgcgcggaccgcatctgattgttgtgccttcgtcgaccatcgaaaattggtttgaaaaatcaactattctcattttgttacctattgagcttaaaggatgcaagaaattgcccattgggccccctctctgcgcgtgctcacttattacggttcaattgatgaacgaatgcaattgcgtcacagtgcttggcggcattcggtgcgtttatttcttattggatcaacattttgggtgttcgaatggagcattattggttgactgttaatatttgatttaggtcgatgtgatcctctccacttacaacatggtcatctcgcggccagaggaccgaaaatttttcaaaaaattttccctcaattacgtcatctatgacgaggggtgagtttattgacaaaagagcagttcgtttccctccccacgaattagtttttcgcgtatttttacagtttcatttaaaaaaatattgtttgatttttcaaaacatttctcaatttcggattgtgtgatagggagggggagcggggtaaatgaaagttgttaattgagttgaatggtttttcttatcgccagacatatgcttcggaattgtgctacgcagcggtacacaaatctgatgaaagtgcgcgggaagcgcaaaattctagtgaccggaacgcctcttcagaacaatctcgttgagttgatctcactgatgtactttaccatgcgacaactgttcgacagagtacgttttgtagagaatcaacaaatattatttgtgtgaccctttttccttaatattattcccaattcttcagtattgtgatgacattacgtcattacttcaaatgttcgccatgcgtgccaaggttttgatggaaaaatcgcaaaacaaaggacgtaatgccaaaaaaccatcaaaaaatgagtccaaaaacgaggatgggggagaggaagaaatgccagaagagctcgacaaagacaatggactgtatgaaaagcacaaaattggacaagcgaaaagcattctccaaccatttattctccgacgcttaaagacagaggtgttcaagtattatattttaattacttgttgatttttcaaatgtttcctttaataattattgctttttcctttaaaggnntttggtcagtttgccggccaagcacgaacacatcgaattctgcgaactg

SEQ ID NO: 8178 - DNA, 1209 bp, Heterodera glycines
taatttatgtaaacccgtgatttttagtctttccccacacccccttgtacacaaacccacattttctaagtgcttttcttgtgaaaaatttttgaacacgctcaattttatctatatctttttttaaattagggttccaaactttggtggcatattctacttgaggtcgtacaaaagttttataggctgctgttagagtttttatttccctgcttttcaacactctcaaaatttggaaaattctaagatatgcgtttcgtataattttgctaatatgttctgaaaaattaagtttcgagtcaattataattcccaagtcacgtacactttccgattctgaaatcttttttgagttaataaaatattcttttttcttgttatttttccctaaataaagaacaaaacatttttcagttgaaatttctaacccatttatttttgaccatttttccaaagcctcaatcgctttatccaactgatttgaatggtcatcgttttcatgggcataatataatttaacatcgtcggcatacatttttatgccaactgatgatgctttatttgaaataaaggacggcagatcatttataaaaattaaaaagagtaatggccctaagacacttccctggggcactcccgaaaatattttgaaactttctgacaattcatcgccgattttaaccttaaaactccgattttttaaaaagttagttaaaaaattataaatttttccttcaattccaatctttttgattttttgaagtaataaatcaattggaacagaatcaaacgccttgacaaaatcaatatagattatgtcaatttgttgattctattgtatagaattatatatatcgtccatcgtttttaatatttgagttgtagtcgatctattttttaagaatccaaattgttctttatcaaagaatcttgtactgttcagaaattctaaaattttactactcaaaattcgttcaaaaactctacagacagtgctggttacattttttggaaatgcgggatttgcgggattgcgggttaatcccgcgggatcccgtcccgcaagaattttgagttccatcccgcagcgggatccgcaaatttgactttttgtgcgggatttttgcggatttcattgattttttgaaaattataaaagacagaatgcccaaataaagtgtttaatttgctttataaaatataattaaa

SEQ ID NO: 8179 - DNA, 4233 bp, Heterodera glycines
gggaacataccgaagagagccacagaacgcgccgggagagatgtagaaagacaatttaagcatatcaacatatctagagttccatccaaaccaaaacaaacacactaccgatacaaatcctcaaattttaaaagagcccgatataaaagaatggtttgacaaaatagacggcagcagaaagatagacaataaattctgaaattgaacatcctcattggctaatctctctctttttgtggtcctttttcagcttcagatacttctttattttcaatatccttacgtttaaaatgttcaaccagtgccccgttaagtctattcactagagcccggcgcgggacgggatcccgcgcgggattttgcgggatcccagtccgcaatcccgcattttttggaaaatgcggggatttgcgggattgcgggattaatcacgcgggatcccgtcccgcaaagaattttgagttccaatcccgcagcgggatccgcaaatttgactttttgtgcgggattttgcgggatttcattgcttttttgaaaattataaaagacagaatgccaaataaagtgtttaatttgctttataaaatataattaaatattccagtaaaaaaataaagatatatatttttttaaatggcaatttagtgttcaatattttcttatgttttaaaattttcaggaacttctaaagcccaccgaagaagtctctttacattattgtaaagaaacactctccgcccgaattccgctcgctcgaactttggtctccactttggaacgagttgatctttcagtgacaattgatggcgaaatcaaaataattaacgaagttgagcaaatgcgtacaaggctgattgaggcggttaaaaagcgttttttacaaaaagaaaataggtatatacttaaaatactattatattttaaattaaacatttagactttgtatgttgagtacttttctctaccctcgcttcaaggatcgtttttccgacgaaagtgacatattttttgcgcgcgtttcacgttttttgaaggacgaaggagcagaagaaaatgacattttggaaaatttggaggatgaagtgaattcgactcgaatttcgccaccagccaagcgcgcttgttccattgtggagataatgcagaacatagccagttgtaccaaaaaaggttgtaccaaaattgttattttgattaaaaaaaattttagctacatcatctcaaaataagtgcatgtcggaagagattctcacatacaaagaggacatttgtgtttccatgaatgttgatccgttgcagtggtggaacagcaatgaaagaaaatttcctaaactttcaaagatttcgagtcgttatttgacaccaccatggacaagcatttccagtgaacagctttttagtgtggcaagagacgtatatgactaccgtcggtcaaatatctctccagaaacggccgaaatgttgatctttttgcacaattctattcctgatgtgaatttctcatattaatttctatgttcatcagtttgtttttaaaacggcacattcatttattttttgaagaattttttattaatacaatattttttcgaaattcaaaaatcccgaaatcccgcgcgggatcccgcaaattttaaatgcgggatttgcgggattaatcccgcgggatcccgtcccgcaaaaaattttgagttccaatcccgcagcgggatccgcaaatttgaaatttccggtctctaatatctaccatttatagacagttcattttctattgtatttctggggtttaaccaggtctcattgatgatgaacattgatggatcatacttatgtgctatatgttctaaatcagatattttatttgaaattgatcgggcatttattaataggcaggaaacccagggatttttatctaagtattttccatttttatggtttggtttgctcgtgtaacattattgagttctgagtggtcgaagagggtgcggagttttcaaagtaataatggagaggtcaacgacacatatttaaacatattttcactttggttcatggcataggccttacggcgaagctcataaagcaaattgagttcaggccgggtgagatcccgcctgaccgagacattttttggaaattgaatgaattttgcgagggttttgcgaaaatttttaaggaaaatgtctcggtttttttttgtccacaaatgggaccttgacaattcggttattgcccgaaggcaattgtaattttggatgtcggtggatctcttcaaaaatcacctcgtccatcagtccacattcggtagcgaccttacgcacaagttcaacggcatcgatttgttctggtactttctccaacactgctctcttcgattttgcgataatctcctccgagtccaacacggcattgttgaccagcaggggtggggcgcgcacagaaaaatcccgcggtcgcggatcgcgcatcgcggattccatttgccgcggtcgcggatcgcggatcgcgcaaaaaaaatcccgcggtcgcggatcgcgcatcgcggattcaatttgccgcggtcgcggatcgcggatcgcgcaaaaaatgccgcggatcgcacatttgtaaaagcataattagaaaattcccatattatcaataatcaaaattgtaaaggataatattatgatgaagaaaaataagccgttcgagattttcatgcgagagactttttcggaggtcattcaaaataaatcctgcgcagctgaacaggcgttccgactcaacacttcccggcggcgcactatgatactttctcataagccgtcccaaccatcgttttcagattcatttgtctccctttcgttcaaaaagaccaatttcggttgagaattgttgtgtttctcaattttttccttctttttacgtaaagcttcgtccttttgcttgtagtgttcagggtgtttcaattttaaatgacgttccaaatccgatgttcgttttttcggccctgtgtcaactttatagttgcatgtcttacatttggcataagaagaattgtgaattttgtcaaaataaaaccaaatagagtctttttcgttggtcatttggtctaaattacaaagaggaaaattgtctataaaatgaacgatgaatgtataaatattttctgattgcatattccatttaaatgcgcgagaaaattggaatttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcggatcgcgcaaaaaaaacgccgcgaatcgcggtcgcgtcccagccctgttgaccagttgggtgaccattccgatgcaattgaaacttcacaacaaattagagatgaagcatatgaaattacggaaccgcaaagggaagcggcacaaattgtcagggataaagcattggcaaaagcgaaccgacaaagggacgcggcatacgaaagcgcacaacgcgtgcgagacgaagcctatacaaaagcggaacggctaaaagaggaggctcacggattaaagatcaagcataggcaaatgcgaaatgatgaggacgaatgcgagacgagtgagagacgaagcacgctgcggaccgaatgagagacgcggcctatgccaatggggactatgaccgcgacgtagcgtatgcgaatgcggaacagcaaagggaccgctcagtggcacatggcatccgaaacggagcaagagctaccgcaagtcagcggagagacgtggccaccagcgcactgaattgtacagaaacgcgaaccagcaaatggagacggccaatgcgaatgcgcaacgcgtccgtgaactggaatatgcaaaggcagaacagatgaggcaacaggctcaacgcatgaaagaaataggttgtgatattttcctgatagaagaatgaaaagttggtaaattatttagacgttattgatagattttgttgataaatattttaccagcaaatgattttgctataaaattcaagatattatgagggttttttattttattattaaatttgaaaaagattctaaacctatttaggtcatttttctgccattttgtgccaaaaatgacactttacgaagattttttttccaaaaaataacca

SEQ ID NO: 8180 - DNA, 1928 bp, Heterodera glycines
ccccccccccctccccctagggcatgattgttttgtgtgaatagcagccagcataccatgtgcccatgccaagctgcttctcaaagcaattttgttcattcattgctctccgccatcagcagcagaggtgaagccgccgtttgcatcgcccggaggcacccaaattaactccccgccgccccccccccccctccggctgtgcttctttttccaccaatttttagccgcacttcgccctaggcatgaaaattggaggtaaactgtcaaattgggcaaatccgacacaaaggcacaaggtattgtggctttgtgttaacgacgctttttgtcggacggcctccgccagcgggtccaaccgcaaattttggctaatttgcgtcgctaaaacgtcctttcatttgcaatatgttcagcagccattgacagcagcaacagcttctccttcaatctattttttacatcatttaaaatagaaaaaaatatttaaaatacaatttaaaatatgaaaaacaaatcataattaaaaattctatcaaataaataaataaattagaaaagatttatgaattaactaattaatttttgttcctttttgaatattcgttatgaataataccaaaaaagaatttattattacatctaaaattgaattgaaaccaaaaattccaaaataatttatcatcatatcactaggcttttggcaaaaaattggaacatttagtgtcaatgccggattttaattgtctcccattgccccaccaggcactgctcaaatacatcgaaaaatgatcccaaaaatcgcactttcttctctcatttcaacatcttacactcttttcctcaaatgcctagacatctgtcaaatgtaaaaaatttaaaaaataataattaacgcatttgccccccccttaccccgggggtcggttggtccgtcggcggatggtcgactttcccccgtccccggcactttacccccgccccctccctcccctcgggggcacttccccaccacttttgcggccattcgtcgtcccctccggcggggaggggggaaagctttgtgatgtctccaacattcttttcaccctttgagcagttaccggcccactcaagcgaaagaatggtggataagaaaagaaaaaaaggagatgggaagcagcagcaaagggtgagcgggttggcttttcattctccgccaatccgtccgatagaggtgtcggtcgattgagtccggcttcaaaccgtggaatgcccgaataagggcggaagtccctaaatgttatcataaatctgaatggaaattctgataacaacatttgggctgctttttatggtcacctgtttagacgctaataaacaatgttttgagactgagttgtccccctcatgcattcgtttgtcccccgaggcgcaaaaaaaatcgtgcaaaaaaatgacgggggaaggatgaaaagcggacgctaagcaaggaccagcagcacagggacccctcccccccaaggggaggcaaatttatgcgacaaccaccggtgcgtgtgccgtgccattttcgtcctcccccccccccccacccactcgcggcttctaagaggttccaccaccgtttatatacaattccttccttccatgaaaggggggaattgcctttttttgatgccgtgcccccggaaattttcaatttggtagtgccacattttggagggtggtttcacgaatatgtcgccgatttttgatgcatagaatgccagaaaagggaaaattattttgtcatttgtttttgaatgtgccaataattaaatcctttcccggcagccattgaaaaaatgcatcatttgggattaatcatttttgttacattttattcattccttgtgtttctgtgaaaatcccccgtaataattcaccgattaagcaccaatttttcatac

SEQ ID NO: 8181 - DNA, 2824 bp, Heterodera glycines
  misc_feature (2779)..(2779): n is a, c, g, or t
  misc_feature (2791)..(2792): n is a, c, g, or t
ttaataaatttttgcagattaaaaattgtttgactacgaatggatatttatctgaagaagaaatgcgcaaaaaaggacaaataatgggcgaattgacaaaaattattaaagaatgggtaagaggaaaattgggaatagagatagaaaattcaaatttacgaatcccgcgcgggattgtaaatcaaaactttttgcagtacgatatcccactggataatcccgcaagtcccgatgttaaaatttgcgggaatcagcgcgggattgtgagcttattgaaatttgaaaaaatatcgatttcaactaaaaattcttcaaaataataataataaacatgaccaattttgtcaaggtttttgctaaaataagtacaaaagaggtaaaagctatgaagtttcctaaaagatttttaataacatttcttctaggttaaccttttttcttctttatccatttaatttctcatcacgcctctttcaaaaaatttctggttggggacggaatggcgataattcttagcagatttcgtcaaaaaatacaagggattagccctgaaaaattcccaaaaaatcttgcaaatcccgtattttccaaaaataccgggattgcggaccgcaaaagttccgcgcgggattacgactggcgccggtctctaatagtgaatatttttaaaaatcaatttgtttagtgcgccgatgccattatacaatttgccaaattggtattgggcaatgaaaagatggaaccaatttgcattttgtctgaacaatttgacaggaatttaattgttggcgaattaaattgtgaaatgtacgaaaggcaaaaatgcacggattcatcactgtattgcatcatttgcaaggttaaattagttgaaatttggaaaatttgagactgtaaaaaggcgtttgataaattaactggccaaaacacttggattttcggcaaattttcagaaaaaaacttccattaccagggccagatctcactctaagatatcgatgagctcgtttctgaatgtcgtcgctattctgcaaaaaactcaaaattgttagggacagagacgctttgactatgactggcaaataaaacacacaaaaatttatttgtaacaatatgatgacaaatttacggaataattcagaaattctgtcgatcctttgttatatctaggaaatcattaaatatgacttttctcgagcaataagaattaataaattaattattgtgtttattccataattagtaattaaatatttgtaagcattccgctgtgaaatcactgacaaatgcaaattcgtcggcacttccaaagttgaaattcttttttatggacgtgtcaatcgaaatgaaatttatttttgtaccaaattacaaattgtcaattccaaaagaacagaacaacttgagaaattatgaaaaattcgccaattattttgctgaaaacattgagaaattggcatttaatgacaatttcgatgataaaatcaataagtatgaaatagacctactggaagactttttagaaaaaccgacttttcgcagttaaattaacaaactttaaaattatatttttcaaataatttgcagataaatttgaaatggacaaagtgttggaggataaaaagcaattagagaaaatcaaagaaaaagcattaaaagagagacaaaatttggaagaacagaaagcaatgctaatgacattgtcaagtgagaattaattaattaatgacgaaaaataaaattatttttcagagaattttatgaatgaaagaatttttgaaattttatcatcagagcaaaaattgtacaaaaattattctgagaaaaaactgttggaagatgaaaaaaacaaccaaaaactgcgcattgtgctctcttttttggatctttggaccaaaagtagcaattaaaaacaaataatttaaaaaatatttaaaaatttagataattttatatatgggccagaaattggctatttgaacacaccgatgttattgataatggtgtcaaaagtgtttttgttctttccggaagcatcagtgccttttttgatagagaaatttttcttaatttattcaaaatggtaaaagtaaaccaaaaaattcattataaaaaaatgcaaaattaaggaaatggccaattcccgtccaattagtccaaattgagcatcagagaagtgccgagtttctggtctggagcccaggacgagaatggtttatgaaaaaacaattcggacccggcaaaatttccgaaacgatggccatgccaatcatttcgccattgttcccggaacaaaacgaagcttatcggattaatttgtcaacggcaaaagtgattcaaaatgagctgaaattaggtacagaggcctaatttattaaataaaaaagcgattttagcatttcttcaaataagaaacatgaacgaaacgcgacaaataattgatccaattctcggcaataaaaaattcacagaaaaggtcaataaataaaaataaaataatataaaataatagaggcagcagaatacgagaattacagcagaagcggatttcatgatttaaatgctttttttgcctaatggtccttgtgccaagtttagccttgcttgttcaaaatattttatttaaaaatttgggtttttcggacaataatcaaagttatttatttttttaaaacttctgaaagaaacccattcttattccgacctctaaaagtttaaataattaagtatgaacattttgtcacttttgtttgcgctggaaccaaatttgacgtcgaanagtttgccattnntgtcggaaacgattggggcatgaattgctgca

SEQ ID NO: 8182 - DNA, 3173 bp, Heterodera glycines
  misc_feature (2765)..(2765): n is a, c, g, or t
  misc_feature (3071)..(3071): n is a, c, g, or t
tgaaagattgcgtacagtatggtaaacacagtaataccttctctggtcaaacgatgttgccgccccgttggcactgtaaaatccattgcgaacaccgtaagcacaaaagggggcgttgtgccaaggatgcaaattgcgtacagttgcattcgttcgcgcgaataattaattgtccaatgacggagaaaatgatggtggtaccacccgaagctgatcgttttcttgctgattttgttgatgaggtgtatcatgttgatgaccatttacagatacagtagcagttgtacggccaaacactgtcaaatttgacggataaggtcaaataaaaaacttgttcattcttagccaatttatcttttttttgcctccaaactgatatttctagagattaacctggattcaaacccaggtttttttgatcgagagattatagtaaaaccatttcctggtttcgaatattccttttcaaattcataattcgaaactttttctgtctttcgatttccaatacctttcagcacttttttgacaattagccaaataaaacaaattgcgtataatgcggttggaatgtatgaagtcgttgtgagatttattaagttgactgcatcaattaatttaaaatgcaaattgttctccttaataggcgtcataaaaatgtattccaaataaataaataattatataaattgttttttatacctttattatagctggaggatatatggagactaatgtgtaaatgcatgaataaatacgcaaattcggcttccaattgacgaccactgaaaagacaatgccacaaaaccagcacatggcaaggcacagtctcgtaaagctattaacaaattgctttggtatttaagggacaaaggcactaattaggcaacccacaccgtatggtaaagagatggcaatagaaaattggggccattattgcgatgatcctatttaatgctaacaaattataagcaacagcaaccgccatggcacaaatttggtacataatggcatccaaatcaagcggcaccgcaattcggtggccgacaaaatggcccacatagagctccaaagtccaaaacataatcaaaatgtgcatgatattctgaaaaaataaacaattaaatataaatgcaaaaaaaaaaaacaataaaaatctaagagtttgtaaaataacataaaaaattattggaaataaatgaaaaataaatttaaaaataattatagtagaattttgtatcaatttatcattttattcattattattgaaattaatatttgttttgtttattacaatgttaagaaggatgcaaaatgcagtccgcttttttgcgagttttgccgtggccggcagaacaagcaaatgcggcaacaatccaagcaaatgtaagccaagataaaagccggcttggaaatgttgggcagtcgaagaattcggatgggcacattttgccgcaatttgtgtcaggagaatttcgttggaataattcatttaattataaataataattgctttaattctgctaattttaacaattagttatttgagtgataattagggctccaatttttagattttttacttattttttgtcctgagttccctatggcctgaaacgcacgaaaaacatgttttttcggttgttgttaagctagttttctagtattagcaactattttctagttttttatttttaacgccaaaaaacctaaaaattttattttcaactactttggcgtttgcccaaaattattaacaaaatgcaataaaaacgaaaatacactccctaagaaaacggcccaaaaaatttcagaaaaatacaccctaagaatagcccgaaaatttcaaaaatgcacaccaaagaaacgaagaatttctcaaaaattcatgtccaaaattttttatttattttcttgacaagaatttttgtttttaaaaattatttatctcaatacgggtttggcttaattttttgctttttggataaatttttacgattttacaccagtaaatttgaaagttattagcaactattttccattttttgcacctatttggagttttttagaacctaaaaactaactattttgacagtttttaaaaataatgtttttaaattttgaaaaacgaagtttcctgagccttaaagtatgacaaaaaatcgataatttctccagataactctctcgagcacttcaaatggcgacgaacaattgtttggtgtattttaagaacaaatgaatgtgcaacatgccttaggctcaccaattagtagtaataagggaatttaattattttttttgagagtcagcttacaatgagcccgaaataagtgagtccagaggcaactacttccttatcttaatgaaaattgcccaagaaaaacgcaaaattaatacaaaattaattaaataattatttttttaaataaaattaaatccaaagagcctccttacataattacatttttaagtcttggagcaaaattaacttaaattaaaaagaaacgattctgtaaaaactaattttctcatggatccgatgtgctcgcgctggcgtgtgtcgtcggccttcgtttccttctccgtcttgatgttgttttgcgggttcttttcgtttttgttgttgcgctgtttgttgttcggtttctccccgtcccggtttggctctcttcggtggtctctctggtttggtggttggttttggggtcggttttttttgtgggttttgcggtcttttttgtttttcgctttttcgttttttnctttgcctgttttttctgtcgccgggttgcctggcgtttgctcgtgtctctggtttttgcgtctttgtttctttctgccctttttgctgttggtggtccctgggtcctttcgctttttttgcgccttcttggtcttctcgttcgtcgtgtgtgccttgtgcgcccggcgttttttcgttgctgcctctcttcgccgtgcgctcctttttgcgggtctgtgtcgtttcggcgccgccgtttcggcgcccgcccttgtttttggcctgttgctttttttgttgtcgttccgttctctccgtcttggtntcgttcgtgcgctgttcgtgttaaaagctctttctgtgcggttgcttcgcgcttcgtcgcttaataaaaaagttctaactgaaaattgcaaaaaagtcaaaa

SEQ ID NO: 8183 - DNA, 940 bp, Heterodera glycines
gtgtcaggagattttcgttggaataattcatttaattataaataataattgctctaattctgctaattttaccaattagttatttgagtgataattagggctccaatttttagattttttacttattttttgtcctgagttccctatggcctgaaacgcacgaaaaccatgttttttcggttgttgttaagctagttttctagtattagcaactattttctagttttttatttttaacgccaaaaacctaaaaattttattttcaactactttggcgtttgcccaaaattattaacaaaatgcaataaaaacgaaaatacactccctaagaaaacggcccaaaaaatttcagaaaaatacaccctaagaatagcccgaaaatttcaaaaatgcacaccaaagaaacgaagaatttctcaaaaattcatgtccaaaattttttatttattttctagacaagaatttttgtttttaaaaattatttatctcaatacgggtttggcttaattttttgctatttggataaatttttacgattttacaccagtaaatttgagagttattagcaactattttccattttttgcacctatttggagttttttagaacctaaaaactaactattttgacagtttttaaaaataatgtttttaaattttgaaaaacgaagtttcctgagccttaaagtatgacaaaaaaatcgataatttctccacataactctctcgagcacttcaaatcagggttgttccgggttacccgatacccgaaacccgacccgatgattttgggtcgggtttcgggtcgaaataagcactggtaagaaaggggtctgggtgaaaattaggtggataaggaaattgagaattttttttgaaacgattgtgttcaatggaatagaaaattttgtattcgtttttgttcattattatccctttt

SEQ ID NO: 8184 - DNA, 3003 bp, Heterodera glycines
  misc_feature (130)..(130): n is a, c, g, or t
taaacatatgaccatgactgtaattgctatataatatatacttttaccgcaaaaaaaaacttttcattagcacgatttattcggagataaactcattcatttccatttcattcacaaacaggtcagaatntaaaagctgttattaaattttgtctattatttattagctaatgttatacataatttacccatgtttttaaactatttatttaacgaaattttcccgccaaaatgttactatccagtcaccgattatttttaatcacactaatttttcatcactctttctccatttttgacattttttcaagaaaacaacaattttatttatccagaattttagcaattataattctttatttttcaatttcagcaaaacaaaaaattttccattatttattttgttggacaaaataatgcacgaaattttaatagtttcaccaatttttcatccaaatcccactggcaatatcctatgcgatgatcatttttgatttaatatgcaacctaaatttttgttcatatcaactaattttaaaataatccttcgcttcgacttttaattagtgtataatatagttagcacatctatcatgttaaagcattttctttataaaaatttatttccaaaaaatatttttcaactattcgttttgcatttattcgcgcactctcttcgattttaaaggacacttttcattaccgaaaataaataagagttttcccaaaataaaaatcatctcgaaattttcgtaatataaaatcgtgaacaaaggataaaatattaaaaccaaaaaattttcgcacactttcatagtcctttatttcccgcactaataaattttcgaagatcaaaagagaaccaaggggtttattccgatcgtttttcttaagttttttcaattcataatttcgtgttttaaaaattgttgcgttcacaaatcgataatttccgttgatatcgattagttgggggggacacaaaaataaacggctgaacactcgcgcagtggtgctaagcgtacccacccaagaataccattaggctggggctttagagttgccgctgtccctttacaatttaatcgttttttcgagttttaacaattactctttttctctaattctctcctctctcctatagtgaatgcgcatctctctgcccaggggggggcccagatttttatactaatactactcatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgattttcgcccacctgtttgggtaaattatgcctgacagtccaaccatccacccgaccccatcgaacaccaacttctttggcaagtgcactttgaatttgtttgttttatttccaacaaagccaggcgtgttgctcggcaaaattacaaagaaagagtttgtcatttgatcaacaagtataaattcttcaaaatgagatcgttcttatatcgtggtgtggcatctcggttcactttcccccatctttgatccagcggaaactctttgccatcgtcgtcgtcgtcgttgccggttcatccttctttatgtgcttcatgatcagatcggtgcagtcaaagttcagctttgcacagtcttggcaaaacgattgggtgaactcaaggcgttgctgctcgccattctgattgatgagtttgaatcggctgttcccctgccggaaattgtcatcacgacactctttgcagatgaacgtgaacactccgtacttaagaaattttactattttttcaaattaatattagccaaaacctttgggcgggccaatttccaaaatatggtcgggtactcaaacacattggtcggttgttttttgggcgattcatctactaaaatttggctaattcaaagaaatttgcagaaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgttgtctccaattgtgatgacgtcatcatcattttgaggggaaaaattttcccgtttcgactcatccatttctttaaatttaaaaaaaatttgaaattattataaaaaactcaaaaaatgattacttttgttctcaaacaccaattgatcattgatttttctcggggccattacgattaaaaaatagtttatgattataattgttaaaagcataaaatgaacctgcgaaaaaaaacacgtaattattgattgatagtgagaggggttttagcgcgcagcgacctccagacgggctgtcccttttaatcgataggccacgcccatccacaaacacatagacgagagtgtagtggttagagaaagatacaaagggcgccaattcaaacacacagtgaaacccaagccaatttattgattttttacagattatggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattcagtttcggtctaacacacatgcgttcaggggttaaagtccaccagtatttctacataaagcaccggatccgcctactgtaccctcagctgaagtgcattgttgagtaccacaaacagggccactgcaaatactatcccttgggtataaaattttgtcaggaaaaaaatccataatcattttcagagttgttg

SEQ ID NO: 8185 - DNA, 2562 bp, Heterodera glycines
ccaaagtttttaaccccaacaagccagacgcagggaagcagccgatcacccaggaccaataagaaagcggctaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccatcgccaagcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggtgcgagtgccctgtacgcggcggtgaagaagaagcacccaaagttgaagcgtaccgagtttgaagactttttgcagaggaacaccacctacacgctgttcaagccaaagagggagaagttccgacgcctacgcactgtgcctgcgggtttcatgaccggtaagttgtactggggcttatttcgcacaattcagggttcagatgttcaggctgacttggccgatttccaagccctttcgcgcaagaacagcggctaccgttacttgctgttggctgtggatgtgttgtcgaggcgaatgttcggcgcgcccgtaaagagtaagcgcccagtggacatgaaaaaggcgtttgaggagctatttgagcaaatgccaagggtgccggacacactgtacaccgatcgcgggctggagtttgtggcaaaaccgttgaaggagttttacacggagaagggcattcaaaagtttgagaccagttcaaagaaaaaggccgccgtggcggagcgtgccatccgcaccctaaagactcggctgtacaaatatttttccgccaacaacacatcggtgtgggtggatgtgctgccaaagtttttgagtgccatcaacaactcggtgtgccgcgcgaccggacttagacccaacgaaatcagcgacaccaatgcgagggaggtgtggaagagggtgtacggcgaagggctcgcacaattggacaagacaccaaagatcagagccggggaaacggtcagaattcccaagcctaagcacattttcgaaaagggtactgtaatacacacattttccgatcaatttattttaatttttaaggctatatccccaattactctgatcacgtgtacaccgtggatgaggcccgctcaaccaacccccagcactatttgctcaaagactattatggcacaaagttgaagagaaaattttatttgcccgaattaacaaaagtacaagtggatgaaaacacaatgtatcgaattgaaaagaaatacaaagaacgagtgagagatggtaaaagagaaatgttggtgaaattcattggatttccggaaaaatattgggtcacaaatgaagaaataaatgaataaaaatattacaaatttaatgaaaattaaaaaataaaaacaattatggcataatgtcggggtcgttcagctcctcttctgtgaacatgttcacattgaggtctgggttgaacagacaggtacaagcgccagggcagttccacttacaccactcttcgtcgctgtacccaaagggcaccaccttcaagccgtgatccctgaccacccccttattcacggtcgggttgaactgcttgaccaaggggacggtgaaaatctctcccttcttggtgatccgaaagttcttcgttgggtagttaaggcggacgttgttgtccggctgtcccagcttgttctgcaccatgtccttcatcttctcgaaagttatgcgctcgcaggcatccgagtccagggtgatgccgcgcaccttcagcttgtactcgtcctcccccgttgcgttgttgtgcagccacaatccgtacgccttgggtccggctaaacaaacattccatttattttgtttaatgtttaatcaatcttaccacaaataaactccataatcgtgtgattcgggtactcgtcagcgagttccccgagctgctcaccacccggaagcgggtcccccagccgcgtcaggtagtcgtagaagatgctgtcagtgtcctaattataaaaaattatttcctattttcattttatttccagagttttaccatgtagagaatgcgggtgtcgtagcgctctacaccaggagcagggccatacacctttttcaacgattccagcagatggattcgcgcagcagaggtggtccatagggcaatggccacctgagaaaggcaaataaatttcaaaatttaaaaattttttcttacgttgctcgtgctgtgttccaccacatgctcatccttggccttgtagcagaccatccaaaacttttccgtcagctgatcgatgctgctgacctcaatcttcgagtcgttcagcagtttggccagctaagaatggcactcgacgatttcggttttggtgagccgatt

SEQ ID NO: 8186 - DNA, 2632 bp, Heterodera glycines
ttattatttttaccagccattaaaattttcctataggctcctgtgaaaacatcggattacacaactttccttattaataaaaaaaatgtccttgttttgaaataatcattaatatttataccaattacatactattttctcatttttgcaccattttgtgcgtttttagtactgaaaagccaaacattttgcattttttttaccaatcatacgattttttgtttctcagctttcaatggagcgaagtgtgaattcgaaccctttcaaaagtgcagaagatgcgccatcattagcctcaacgagccaaaacaatttgctggaagcgcaagtcaaagagcaggccgcacaaattcaaaaactgacggaagttttaaatgaactacagcaaaaagtgaatgttggcaaagaggaagggcagcagagcacacaacaacctcaaacagtagcagcatcggtggaacaacggtgatgcgacatttgcggcgctgacatttgcggcgctgacacttgcggcgcagacagttgcggcgctcagtcaaagcgacacttgcggcgcagacatttgcggcgtgacacttgcggcgccgacacttccggcgacgacacttgcggcgccgacacttgcggcgcccagtcaaaaggacatttgcggcggcgcaaaattcaacgaccccaaaaatatttcaacaatttatttccattaaaaacattgataatgactctctcagtcccattcttcaaagcctttcatccctaggcgatattgcaacgcatgaatgtgattaattatatcagcttggtttttgttttccttatggtcaaaatcgatgactaatcgtcggatcgcttcatcatttctcaaatatttttttaagcgtggcctttcagcaattccacgagttgggtcaatttcgtaaggtctcagacggttttgttggtgttattcctcatttttgatggcgataatgaaccttattgaaattattttattacagtacccatttatactttgaaaatgctgggtggggcgaagtgaaacgttttctgaagctgttatgccacctaagaaattaattattaataaaaatgaataagataagctttagtcaaataaagattaacaaatttaagaccccaaaaaaaccaaaaataaataagttgttttttgaaaaaagtaaacaattcagaaaataaaaaatgaaaatatataaaaagacccaatatttttggggtcgttgaattttgcgccgccgcaaatgtccttttgactgggcgccgcaagtgtcggcgccgcaagtgtccttttgactgggcgccgcaagtgtcggcgccgcaagtgtcgcgccgcaagtgtcggcgccgcaaatgtcctcgccgcaagtgtctgcgccgcaagtgtcgctttgactgggcgccgcaaatgtctgcgccgcaagtgtcagcgccgcaaatgtcggccaatcatcaccagcagaagaagacacgtgccgaagagaaagaagaagaagccgaacaaatggtcaaagcaacgcacgaggggaaatcagcaaacaatcgacgaaaaatgcaacaaattcaaattggaaaattatttcatcattcgacggcacgaaatttattttattttaattttgacaatttcttaggattaaataaatgtgatttgcttttgacttcatattgacaaatgaatgcgatttttgccatcccttctctcccattttagagtcacatttgaagttgtcatttcacaattgtccattgttagcattaattagggtgtgatgcgcttgaattgagtctgtcggttgccgagtaaccaaaataaaacctttaattgttaatttggcggacggtcaaagcaaaggcgccaacagatgaagccttacattggcacgacgaacacaaaaaaactgactaaaaatgagggggaaattggagacggaaagagcgaaggaacagaaaagtcagaagggggaaaagtattagagaatgatgagaaggaaaagcaatgaaatgagagagattgtgtgtgcccttctcaagttcatatttggtaaaagaaaagggaggtaatgccattcccccggggggggggggggagaaggggccgaacgaaccaacgcccgggggggagtcaacgcaatgcatgcaaatgaatgctttgttggctaattggtaattgaaatgcctgccaaactctcttcatgcccccccccccctctgccacctcatttgtcagaggagaattgccaagcaggtgttaattgctcgccttgccatttttgcctttcattattaattaataatcattttcattaattcgatcgattgctttttgttaaattcgttctgtccattttataggcgaaatgagctcaacttttctaattcttagacttttaattgtccacttccatttttacttttggaggaaaggacattgtgagaagaggggtcaatgggaaatggaaaaggggagggaaaagggagtggtggtgtctgaagaggttttgagagcattgcggggataccgcaaaaaatgagcctacaattaatgattcggcctttaaattcccttaatataacctattaaatgatcaattaaagttttaattgcccctaatgactg

SEQ ID NO: 8187 - DNA, 2777 bp, Heterodera glycines
cggattgattatcggtgccatttttacgccaggtgagcgcaggccaatccacggtcaatatcattggccaattggctatgtttagcatggcgacaggtcaagtcgaacctccaacagggacagctgaaccaactgcccccgttggacatgggactgttcgccttcgcatgccaacgggacaattcggggtaccaaggagtgacaacgtacgacaacaccaactacaacagtcagtacggtgggtatggcatcggcaactacggtaatggcaacaatcagttgcaacagcaacaacaacagcagcagtatccgcagcaacagcagcagggaatgtcagtgccaagaaaaataatttaaaccatttttggctcgtttcagctacacaacggggtatcccgcttttggccaacaaagtgccaacaacggcttcggccaggccggctacaatggcttaatgggacaacaacaaatggcacagaatggacagtacggcgcgagtggaacgggcgcgacaatgaacaccgccacaggcacacgctacgtggacatgtgcatggactggtggaacgtacgacgggccgatggcgaggcgtaaccgcagccccctccctcccaaaaaaaaaaaagattttagggatttcttgtcccatacataccgggattgggcttcggttaacccctggcaggtagcagggaaaaggcacccattggcctcgtttcagaatcagcccgtgtgggagaaggcggtcgtttgccttatgctaattgccttggcatccgccgctttgtccttggtttgggacttgctcactttctgcgcctgcttctgtcccggctccatcatgaagccgttgccgggcttggcaagcaccgcttttgtcgctcttctgatcgctgtcatcgtttattacgtcaacaaccaatcgtccatcggttggcttattttttcatttgcgtttttcttccccaagtcaatttcacacgatttttcttccttttttgtcgcaccattaaaaaaggacaaacttattttttcgagtaaaaaagggtcgacataataggaaagtgccgtcatttatgggaaaaatgaaaatggcatcccaaaagaatggaaaatcggtcctttaaattgccaatgttttgactttttgcttttcatttatttgttctttcccaaaaagacattatgcgcgcgacgtcgcaactgcagcaattggacaaccaaagcaacgtcagctacagtttttacttggcggtgggcgccaccgtagcctcactgataaatatcgtagtcggcactttgactctgtttttggcggacaaatgtttatgagaaggaaacagacatacaaaagaaacaaacaaacaaacaattgttgccatgtttccccattaaaatttcattccgtgtgatcagttatatttttaaatttatttaccgattgaaattttaaaaaattttaatttttcgaaaagggggcgaagtaccgtcggtagttttttatccatattttaagattagccattgaatatattccgtggaaataaaatttcaatttattgtcatttatttaaatttaaatgtgttatatggaaaaacaaaaaaataacaacaaaaattgagtgaattaagaagttaaagcaaatggcaaaatgatgaataaacgcgaagtgtttgttggaagtgattgattaagaaggcattggagagagttgggaaaagggagagaccgtaaaaacagcaaaacttgtcaaaaatgtaactttaaaatgaaattaagtcagttaagtattaattaattaattaattaagcccttctgtgtcatttcgtcgtttccgcttttctctgttttttcagtcgccatttgccatttcgctgccgccgctgagcactttgccgactttgagcagcaaacggaccattttcccttcactctcttcactccacagcaaagcgaactcaaaaacatttttgactatttccaatcttattttgtttttataattaggcattatcgcgtcgaaaaatgaaaatttcgacccaaaattatcgatttcaagaattttaggtaaaactcattaatattgcttgttttttaaagtccggagagcgccgaagtgcaacgaaatgggaactgttctctgacaacttttctcttaaatctttcgctcttttccccctcaaactttttggcataacaaataataaatttgacaaataaaattgccaactcacttcgttcgacgacacctgcgaacagcgaatgttcttgcaattggtgcgcacaaagtcaagaaggtcggcttgttcaggaaaagtgtgccggaagagattgccatccgaataattatcagacaaataattgtgcaatttggagagctgaaaagggaattgttgcgaaagtgcgcaaattgggcactttcggacttacggtggtgcttttgtgcacgtgcagaaatgtgctgacccccgccgagtacaaataagcgtcgtatttggtcatctgtccacaaatgcgtgccaatgttttccgtcgtttgtttttcctttccctttttttgccccccccccccaaaatgccacctcatttttccgctttccgttcgccgttggccccccattcgccgatgctccgctgagtttgtcccattcgtttggctcttcgtcctcactgctcccctgcttttgctgggatttgctcgtcattttcccctcttactttttcccccttttaccattttccccgtcccttttctcttttcttctttttgctcc

SEQ ID NO: 8188 - DNA, 6916 bp, Heterodera glycines
ctttttatggcattttgtgattagttcactttttacgaagatttttttccaaaaaaatgacaatttggaggttttttacatatttcataactattttagcatttttatgcatattttatttacataattcgcaaattttcttacataaaaaaggaagccctagtaattacataattctcttttccctttgaacgccgccgttcgatcaatggccacggcttatcgaatgaatgaatggccacagttgtacttttttaaggttgaattcaaagcaaaatttcgacgaatcaatttatagtcgtgcaattagtgggaatgacaattttttgggcacactttttgtgctttggtctttgtaccggtgacactttgcctgtttttctccatactttgtcaattccatccatttcatttcacacctccctaaacattcaattaatccgtaaaatcgtctattaaaatgaggggcaacatcagcagcagaacgccatacaatcactgccttggtatgcacttaaatatgaatattagccattgggattttaggctatgaaatgtatcaatgtaaaaatgaaaaacaaattactcgttaaaaattaaaaaaatgtttctcttcaatttgaaactttaacctgcctcgattattgtacacatacagtactgcttttgctgattcgcaagcactgaaaagcttttatttgttgacatgtcgaaacaaagcctgaggctgagccgaaaatgcaaacatatgccgccggcattttagagggtatttttggcacttagaaaataggaaattgaaatttttttgcaatatgttttcaaataaattgtaaaaaattaccactccatggaatactaacttacaattagcatattatggtgattgcttcgactgcgttcctctaataggcagcctcgaacaatacaaattcaaattattttaaacatttgtaaaatatttaagtcgataaaattaagaaatatgtttctttattaaaaacaaaaaaatgccaaaaatttacacacagaaaggaggaaagattgtttttaagctcttctgaacacctttcttatcgttttgactttgggtgttcttggcgggcaaaggcagcttaataataattgaaacattaaatatataatttaaacaaaaaatgtttttactattcgccgtcctttccgttcagtccgggtgggcccggaatgccgggttggccacgattgcccggcgtcccggactcgcccatcggtccgactggcccaggcaggccgggccgcccttccgtggccggctctccggtgggtccttgcggccctgccggtccgacatggccaggattcccacgaggacctggctaaatttgaaaaatctattaagataaataatgttcccgcgttacgtgtccaatgccgcccgactcgcacgactgtcccggcagcccgggcagtccgacatggccaagtgggcccggttggccggggtcgcccggaggcccaaacggaccaggctaacaatttatattggttatggcatgccacattcgctccctcattacataggcttcgatgccgagtgttccgggcggtcccgccagtccgtccggcccttgcggcccggacggtcctctcgagcccgcagtgccgggcggcccggctggacagggcgcacaatgggtggaatgcgcatgaaaatagttgaatagttcgcttccggaaatgccaggccgtcccggctcgcctgggaggccgggctcaccggcgaggccgcgatgccccggcggaccgggcgggcccattgggcagcgaatgggtgcaaaatgcggtgggggaggagggattcccccagccaaatggtgattgaaatttggagaagaatatctgaaaaaaatatgaaaagattattctttattattaaatgtttaattgaatattattttttaatcgagaattttaccaattttaaaaacaaaaatttttatcgcatattgttttttaattagtagtaatttgttaaaatttcaatgtaattcaaatataatacaatatatttttgttataataatctatttaaaagagtttatcacttttatttaaacaattaattttaatgttcaattcctctagcaaatcaacctgttgttgttgttgttgttgttgttgttgttgttgttgttgttgttgttgttgttgttgttgttgttgttgttgttgttgttgttgttgttgttgttgttgcccatttgctgttgttgttgaccgcttccctggtaataattcatcgaattttgaccgcagcaatttgtccagcgacgaccacggacaaagcgcggaattgtaagccgaatattctccttaaatatctaattaattattacgaagattattttatgggttttttttggttgccttaatttgctgcattttggtccaactttcattagcatacgcattgaattcccaaattccattctcaatttgttcttgaagtaaactgagttccttaacactttttttttaatttactaaattgattaattaaatttacttgaaaaagaatgccaattatggctaatgacgcgacggtgaaaatggcaccaaaaatggtaaaaaacaaaaagaaattattctctttcattttaatttaactaatttttattgccattttatacactctcaaaatgtaattttcggaagtaattatataattgggaaattattaaaaggcataagccatgtctgctctataaaaagaagatcattccgtacaaagttgaaacaggaacgcgcaaatacacagaataattacacaacactcatgcaaagtgaaaccgcgccgcgcagagacatttaggcaaatagattattaaataaattaaatagagcaaaattaataaataaattaaaataaaatataccaattcttggattaagttatataaaacttgtattcgaccgtttttcatttgattgagcactattttattatgtctatgtccacaagcaagttgattctttcctttggtggaatagtaaattaattaccaagtaattacataattaactttattgctgacaccatttctttccctttgtttctcatttattcgccttttctttcactttttctttttttatatatttttatttgaataaataactttattattctaacattcttttttttgttttttttccattcttcttttcttcatccctctgctttttctgttccgtctttcttcagctgtcccactcgccaaatgggtcacaatatggcaacaaatcgcgcagagaacagccaaagcggcaacaaaactgtaaaaaaaaacccatttatttaatgttgatagcaattaaaggtggggttttagcattctcaagataataattaaagagaataattatgcttttttcttagtgtggaaattgcagtaaattattggtcagaatacggcgacatgacaattatcaattatcagtgggatgccaaaagtccaaaatgggagtttaaaaatgagtataaaaaagtgggaatgtaatttttgattgaaatcgaagagtttcagtgttgcctattgcttccgaaagagaatttgaaatttttgaattggtttaaaaatacggtagaaccattaactcaaatcatccaatccaaatttcatgccatgcttcttccctccccgccgttggttaagcaattcccacccgcatcatctcagtcatcgatggggcccggtaaagctgcttgtcgtcaatgtcatccgctgccgatgccattgcgttttcttcgccggcacgcccaatttgggacggtcgcccaaaaaacacttcgccaaatgatttccaccatgatttgtgcggcattggttgtgtgacagtggccgatttggtcgtcgtcacatttgcccggcgttctcccgtccgattgtcggcgctttcatctgctgacaaaggatcattttttaatcaaaattgctttttaaaaccatttttaagagtagaattttcaagcacaatgaaacagtgtcgagagtctcgagatttcttttcaacgcatagcgataatttttaaaactcaaaatttaaacatttcgtctaatttctcaccgtcattgggccctctcgccccgtcgtgattgtcctcattcatctgctgttgttccccatcattggcattatgggcgccccgctccgtcgccgacgcgtcccttttccggcgacgcatgccgcaagtgatttcccacgcggcagcgaacgactgaccgccgggcgggcacaatttcataatgccattgtcgggacgacgaacaaatgcttcgacgtcggcggaagagagcagaacaaccgcacaaacagcagcaacaacaacgggacggagcagtacatggaaggaggaagaaaatggacaaattgatgagtttgttcgccgcatttcactgcttgaatttgatgatttttgttaatttggaaaatgagtttcatgaatagagatttgcacaaaaaggaagtaagggttactgtaagcaacattatggcaacaacacagaagagatgcatccatttttcacttggacacaagaatggcacaaattaaagtccatgtcaaaatgttttatggcacaaacatttcgggaaaggatttatgttagggagcggcaaattgtgtgattcaaagtgcatgagtgacaacagcacaaacacaatatgtcggaatcgggggttccttccggtgccgcccgacgtccgccagcgaaagcggcagtgacggcacgaacagaaattactcatcagaagcagcacaaaccggcgggggggagaggaaaaaacgacgaaatgagtgaatgggcaaaaaccaatctaagagtgaagggattacatccaattccccaacccatttccaacgcattttgccagctaatacattaagcatatttaaaatgggagggggacggaggagtcacgaatttcttggcatattatggggaagtgaatgatgagagaaggcaaaatccaagcaaagaaaaactattggaaacagattaaagagaaggacaactctcattaatttaaagaaagtaagatattttcagctaattattaaaaatctttgagtttttgattactagggttgtaaattatatggattaacatattttttctgcgcatatgctatgaagaaaggggctcaaattttttgatttggtgaaggtttttagtccatataaatccatattttgggtgttttcgggaataaatccatatttcgtcatttttgcgtttttggtccatattttggccattttttggaaattttcacaagaaaaatgcaaaatagcgaaaaatacacccctaaagatcaactttttggaattttttaaaaattacatccccaaaaatacgaaaagtttgagttttcgtcgtcattttggcatttttaataaatattttcgccattttttttgcgaacatttctttttttaatgagaattttattcgaaattttgccaaacttggaggtatttttgatacaacgaacaacaataaaaaaaattgcatttttaagttttaaatcaattttttggttgtttattgtactttaaaagtttattaagcaaatattaaatatacacaccttttttgggattttggaggatttacaacatatattttggcattttttagtccatattttggtccatatttggccgtttttgggctttttagtccatatttcgggcttttttagtccatattttatgtccatatttagcgttttttagtccatataatttacaaccctattgattacacaattagctaattcttctctttcatattgattgcattggcaaaatgtaacaggtcgaaaaaattactaaaattttgtaaaaatgttctatgaaacgttttacgtactcataattaaaattataataatttacaatttgaaaaataatttgtggtccatttcaaattgcgtgttaaagaacgtataatttttttgaaattgctatgcttttatttaattgctttcggaaaaatgtaaaattcgaagacagcgccagacagaagagaaagaagagaagagaagaaaacaatggcataacaagaaaagggggaaaaagggaagtaaattcacggagacaattttaatcattttttaatgaaaaatataataataattaaatttttgttattgagaaaataaaaggaataatcaattaaggaaatcaaaatgaaacttaacggagaaacaaaaaaagagaagaaaaataaagactttaaacagaaatttatttgacacattagtgaactgttgcagttcgaaatgggcgacatttttgtggaaagccgcagccgtaggaaattaattaaaagtgttaaatgtccacgcgagaagagattaaaagctgcgtcaaatttcagcagggcactaccaatttatacgcaaacaaaatgagtaataacacttattaagccatggatggcggcggcacgtcatactttttgggtttatggccaaatgaaaaatgcccatttaagtaactgaatgagtcggaggttcctttcattacattaggccctatcctaaagaaaccaatctttggcaaggtctgcgccagtagctttgttaattgtgccaaattacaatcgccttgtcttcatcattcatgtgccattctttggggtccgctttggcttacgccccactcctcctccccggagggcattcgccgccgcgcgggcggtggtgccaccctccgctgctgatggcaatgcttcttcctctgctaatgccaaagggggaagttggtgagcaagtgccggtgccattgctggtttttgctgtgccatttgcactttttctatgccgcttctccgccctcaaataatcctcgtcaacagaatgacg

SEQ ID NO: 8189 - DNA, 3142 bp, Heterodera glycines
aggggtttatttttcgatttttttgaatttttaatggaattcttcaggaaaaaacgctaaaaaaggcagcaaatcgctaaaactaatctttgtggtttttatagaatcaaggagcaaacacatgtttttaggctgcctttttcaattattttctcaacttatacaccattgatagagcttcaatatagctctacaattttactcagaggtgatctttcgctttttctattgataaaaatggtttattgttttttttgggaaaagataaaaaaattcaaaaaaactgaaaccgaaaccgaaacggtataccgaaaatttttcttcggttttttcgatttcggttttttaaccgaaaccgttcgaccgagaattttttgagtttttcggttttttcggtttttaaccgaaaccgttcgaccgaccctcttgtccggtctctactaaaaacccacaaaaaggccaaaataggtgcgaaaataggtattaaaaattggaaaaatcaagtatatttatgcaaaaaatcttatttaagtcccattcgttattcatttcgcccttacaattgcaagttatcaagaacaaaaattttggaaacgaatttttggggaaaattttcatttcttaggggaatattttctgaaattttggtcaatttttagggtatattttttgaaattttttagatcgattcttggggtgcatttttcgtttttattgcatgtttgctatgaaatttctggaaaaaggccaaaataggtgctaaaactcgaaaaatgccaaaataggtgctattgaccgaaaatccagttttaggtaattttaggtgctaaaaagtcgctctaaatcgaaaattgttcggagaaaatgctatttttgggcttctctcatcataacaaagccgcaaaaaaaataggtaaaaaacctaaaaatcccagctctataaataacccattgaatgtaaaaaaagcaatttttattaaataaatttaacattttcaatttatgttaaatttctgctagataatatagtttttccgggcttggaaaatataaatatatttattttgttcatcttactttgttaatatattttaattggtggaaaagatcaaaaaatatgtaatgaggagtgtcaattactaatgaaccttgttacgtaacaggtggttaacaactaattaagaacaagcaaaaaataaacaaaaccaaagcatttaatataaatgatattaattagttattaagttcgctcagcagcagataattattactaatcgttgcactaagaatgttgattaacatttaacattagtaattataaaacgaccgcgaacaggtgatcaagaaatgattgaatagagaatattttgcatataaaagaccctcaaatttgtctgtaaaaccattcagtttcaaatcgtattttaattccaaaaatcaacaaattcacctcccatttttacaaaatgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaatttaattaaaggttggggccatggcggcggaggccattggggctgaagaaaatggtgggagagataatggaaaatggagaacggaagaagcgataaacgatgaaaacaagaaaaaataatttgtggtagaagaaaaaatgctgaactcttaggtcgaataaagtttcaatgaatttcttattttttactcaaaatcgtcaaaaatttgggctttgcaaaaaacgcaattttaaaattaaatagcaaaaaatgttcttagatacgacctaaaaagctttggtcctttttaagtcggctttttaagtcgctgatttctaataaatccggaaaaattcgaaaattataaaaatatctatccccttattatcaatcattatgatcatcatttttagacaaaagttgttgaatcaaaaggaaattagttcgttaatgagtgtttcaatcattctgatcattactgacagatgcttaaaaggaaatgattcattgaaaataatgagacactctgtgagcaggatcccaattttaataagcagatggatgatcaccagcagaagtaatgtaatgagtcttgagcggtgctatgacgttagtcaaaaaccatcaaatgctgaactcttagttcgaataaagattcactctaattatccaattcaaattgattagtttatttattaaaataattgaattaaattttgtcacaaaagggaataataaaatattattttagttgttatttttcattaaaagtaatttttttttgcgaggtttactaaaaattataaatacaataaaagtatatttttatgatgtgtaataatttaataattattttttcaataattatttattttttggatcaatagcaatcatttactttaatttacaaattattgttttttaaagagcaatttgtagaatatttttgacgaaatttttttgcaaaaattacccacccaaaattgaacggcaattagtaagtgaatgggtgggcaaacaagactaggaatttattaattggtctgtacttatttaaatttcttaatgattgttacgatcatagggtgacgagaaagaatcccattaatttcaattaaaaaatcatattaataaaatagatcggagaattcgaaatgataagcaactctgatcattaccaatcaaatgctaagaaggaaatatgattcattaaacaagatgagatcattttaagagcatgattcctaactcgaaaaaagcagatggatgaccgctagcagcagcagtaatgagccttgagtatgatcataatgataattactctaattagtattatgagaaaccggccaaaacctcgtggtcaatgcttttcactattaaaagatttgcatataaaagctccgctcaatttttcatgtaaagcatatttcaaatcttaaacaaattgatcgaaagactcattaacgaactgtaataagtacagaccaattacttaattaatctcttgtcctttcgcccacccactcacttatt

SEQ ID NO: 8190 - DNA, 1111 bp, Heterodera glycines
ttattcccttttgtgacaaaatttaattcaattattttaataaataaactaatcaatttgaattggataattagagtgaatctttattcgaactaagagttcagcatttgatggtttttgactaacgtcatagcaccgctcaagactcattacattacttctgctggtgatcatccatctgcttattaaaattgggatcctgctcacagagtgtctcattattttcaatgaatcatttccttttaagcatctgtcagtaatgatcagaatgattgaaacactcattaacgaactaatttccttttgattcaacaacttttgtctaaaaatgatgatcataatgattgataataaggggatagatatttttataattttcgaatttttccggatttattagaaatcagcgacttaaaaaggaccaaagctttttaggtcgtatctaagaacattttttgctatttaattttaaaattgcgttttttgcaaagcccaaatttttgacgattttgagtaaaaaataagaaattcattgaaactttattcgacctaagagttcagcattttttcttctaccacaaattattttttcttgtttttcatcgtttatcgcttcttccgttctccattttccattatctctcccaccattttcttcagccccaatggcctccgccgccatggccccaacctttaattaaattaattaaattcaacaattaaaataaaataaaataaaacttacggcgttcacggataatcggcgatgccatgtttggcccaccatccactgagttctcaacagtgccgtgggtcccggccaaaattgccaaagtgatcagaaaaagggcgacgaagaaacggaggggggacattttgtaaaaatgggaggtgaatttgttgatttttggaattaaaatacgatttgaaactgaatggttttacagacaaatttgagggtcttttatatgcaaaatattctctattcaatcatttcttgatcacctgttcgcggtcgttttataattactaatgttaaatgttaatcaacattcttagtgcaacgattagtaataattatctgctgctgagcgaacttaataactaatta

SEQ ID NO: 8191 - DNA, 1089 bp, Heterodera glycines
tatgatgagagaagccaaaaaatagcatttctccgaacaattttcgatttagagcgactttttagcacctaaaattacctaaaactggattttcggtcaaaaattaatagatttcaaaatataatcattttaaaattatttaataaaaaattaaatcattttattttcaatgttaaatataatttttaataaaaaatttaattcgggttctaaattgttcaatttaaattttttaatcttgaaaaaatcataataatttaataaattattttaaattatttaattaattagccgttgcataaatggaatttttataaaaaatttccaacgataaaatttttcaatatttttttctatttttagcacacttcgctttcctgtctactgcgcatgtaataagccgattttgaccgcttcaagagcaacgcttcaccgtttgtttggcaaaaaatggctaactcaatcatccgcttcaaccgtgaccacaacacttggcggtggaacgcataaatcgcctcctggaatgccaaaaacagttgcgctggcggcggttgagaatggcacgcatccgcaacgattgaagcgtggcgacaacaaatcaacgcggcgcggttcaaaacaattatcgcctcaggcaattttcaacaatgactttcttatacgattcgaaaatcaaaactgtgctgactgacatttatgggaaattaagttagattcaaaaaacgggacgtgaattcagttatgccaaacatttttgatcccggtgtcgcaaatagccgtgccgtggaaaaattaaaattttttttgcccattttggcgaaaaagtgttatccccagaattgttaatttatagtttttttggagacggtgaaaaactttttgactcttcaaataaaatctagaaattttcctaaaaaatcgaaatgaatttttctgctagcacaacgatttggctaaaaccatgatcataattaatgattgatgatcggtgataaaaatattttacattatcgaattttttacatatttattagaaatcagcgacttaaatactatttaaattttaaattgcgtcaaagcccaaatttt

SEQ ID NO: 8192 - DNA, 3985 bp, Heterodera glycines
ataaactgagaaatgcgctcaatgttgagaattgtttgccgttaccagcaaattgtggttggcgttgccgatcacaaccaaaacgggaatccgctaaacgtattgaaaatggaacaggaaaattttcactcaaaattccaaactccaaaaaaaagaaatacccctttcacataattattttaaattcactaatatttactattgaatttattttgatggcctttccctcgcccaaccaaattcggtgtgattaaacctctgaaacacataccaatcatatttttacgaagttgacgtaaggcctgcattcgaacattgtgtgcatcttcgccaacaacaaaaagagttgatgggtaagtcaaacaaatttggtcgtcgactgactgaaacaaatcatttgcatcggtggaagattcaaatgaaatgaccaacccccctggagccgcaaggactctctgtgggaaaggcaaagtccaaaatgccggaaacgttggaaactttgctcacggcctgaaagttagaaaaaattgtcgtcaatagcatcaaaagcatcactttgtggttgagccaacaggttgtgccccatcccgcaagaaaaatgtgatcgttttgccgccttttcgctatttctttgaccctctgccgaatcatccgaatgcacatccaagcgcactcctccacactgatgggccggtcgacgttcaagttaagctcaaccttctcgacacagcaaacagcaagcggcaagagattcctgaaagcatttgacccatcggacgattagcttttgcaaagggaaagcgacgaaagagcagtgacctaaatagggtctcgtgggcacggattgtatgttgactcatcttggcattgatttgcggatagacgagcaccaaactcacgtttttgatcggatcgcacttaattacaggtttattttttgaaacagatttttgtttgaacgaatccgagaattaacttcgataaatttggaagacgaactcaacggaggttcgtacagtttttgcgcaatgaattccgaaatggttttgttcgccttttcgagttcggcttcagcggttggagaagaggcaatgtaatcgctgagattgctgccctttaatttgtagttttgtctttgctttttaaaactaaacaaaccgcgtttttaaggaagcgtaacagatttaagtacgaagtcagtcgagtttgactcaaatgctttaacagccaaaaatgaacttgcacaagaagcgcttggccggactgaaatttaacaaaataaaatgtgcactttcatctctgatgaaccaaagcaccctccctctccatcccatcatggacacatcctctcccctgatatgcaaaaacttactttacaataaagccgtaaagactctcgcagacagttggcgtttttcatcgtcaaactgtgaaacattgacgcaccaccagtgactccttgggttgccaagtcaacgagacgctggtcatcgatgaatttgaggaaactgccaagaaattcgcgggcttcaacaccaaggtttttgaaactgaaacatttaaaaatttaatttctcacccctcacgaaaaaccagtttaatacgcccacctttcttctgaataagtccctccatcctcttccttgttgttcaaagccttctttcttccacaaatcattttgcttatcgaaatggcactattttcggctgggtttgtgacgaataattcatcaaaacctccgggggcactaacactgacacaatcgacctccgcttcaccattgttggcatttgaatctgatcgactgaaaacgcattcagataagtgtcagcggagcgataattacccgactaaaatttcgcggtagaaatagtcgccttcgtagaggaaaggcccacgcgatggggaagccaacggattcaaatggcgcagttcggtcattcgtcgaataaattcgagtctttgcatttgtttttcgttccgctccctctccctcttctcttttgccaccgctttcttctctttgatctttttgatcagattgagcctttgcagttgcatttcgttcagttcttttggctttgtttccttttttgctaccactgtttccgctgtttttttggtcatttcaaccccttggaattctttttccttcatttcctttggcttttctctcatttcctttggtttttcgctcctttccctttgcttttccttcacttccttcggtttttcgctcctttcctttggtttcttcttttttttcgcgaccaaagtttcctcctctctctttaccacaacgttttcctccatctttctgactgtcagtcgcacttttttcagcggagtgtaaacaaagtcatccgcgttcattgtcgggcgtcttcgcctttttatatcagccgaatctatcgccagagatggtcgttgcgttttctcaatttgttgccgttgtttttgctgatgtgcgcccggtagcaaattttcgttctgaattttctaaaaagtcctcttaaatgctgaactgtgattgccttacgaatacctcagcaacaggacgatgcgatgccggaacagactttgtctgcccgggtttggatataaccggaattcgatccaaaatttcaatttcattgccactcaatttgatggaataatctcaaaaaagcaccttcaatattactgctttttgtcaacttaacggaccaaatgaatgtgagggagtgtccatttcgtcggggatttccaccaacattggcgattccataagtttgatttcctcctgctcatccgaaaaattgtcaaagtaatggtagtcatcaggaaaatcagcagccgacagaaaatcgttgttctcctcttcgaaagcatcagttgtgaattttatgtgcgcaggaagaaagaaatcctccgtttgcatttgtgaaatttgttcccgtaaaagaacttgcgaaatttcatcaacttcatcttcatccgattcgaaatcccccaagaaaaattccatttctaaaattcaaccaacaaaaactgataaattgtaagaaatgataaaaagatttgcgcggaatcaaaaatattgaagagaaaaacaaatcttcgaatcactccgaaaaataagcaaaaatcgaatatttattataggaatttttaattcataatgtgatgaaaacaacgctaattgtaagagacataaacatatgtatccgatatcaaagtgacttttccttacaactgacaatgagtaagtgagatcaacaggagaataatgcacaatcgttatttttgtcaatgagaatggacgaataaatgtcattttttaggttcgactcgaatgagtcggggaatgcgggaccctgaaggagtattgacataatcgaatgcgtattttgagcggaagggagtgaggcaagacggagcagcaaaagtacgagtactcaacgaattttccttggcacagaaagcatcggtgacggaggcattgcttttaccacgagagaaggacagagcagtacgaacacctttttcataaccgatttgttgagtgccccactcaattcgctgattggaggacaaagtgccagacagaaaagcagtgtcatgggcaccggcccaattctgaaattatgggaaaattgctattatttaatcaatgccccggccattaaaaataaatcccggaaaaccgaatctgataacaaattgcataactattatacttgtggacaaataaaaaaatatataaatttccggagattttggagataatgagaacaggatacttttccattatgcggccacaccccaaaattttaaagcgccagttttgtgcaaaaaaattatttaggaggcataaaagccgcaattttagctaaaatgtcatcgaatgtatcgtcatcgtcctttaaagcaccgcaaaaaatatttaggaggcataaaagcgggaatttgagctaaaatgtcatcgaatggatcgtcgtcgcc

SEQ ID NO: 8193 - DNA, 2203 bp, Heterodera glycines
gcagcaaaagtacgagtactcaacgaattttcctggcacagaaaagcatcggtgacggaggcattgctttaccacgagaaaaggacagagcagtacgaacacctttttcataaccgatttgttgagtgccgcactcaattcgctgattggaggacaaagtgccagacagaaaagcagtgtcatgggcaccggcccaattctgaaattatgggaaaattactattatttaatcaaaatgccccggccattaaaaataaatcccggaggttttgggggaggaggaaaccgaatgaccgaatctgataacaaattgcataactattatacttgtggcaaaaaacaccaaatttacaatgcttttttggacaaaaaatattcttattttagccaatacttcggccattctaaaaaaatatataaatttccggagattttggagataatgagaacagaattaacaaaactaatataaatttcaaaaacaattttttaaattgtagacaaaatcataaatgacgcgtacaaagtttatttaccgatgtttgatcagcatccttttttgttgcaattggatcatccggagttgagttgaatgttaggttatgccgagacttgggctcatctcgcttttttgccgagtcagcaaagagtcgtgaagagggattcgcattggcaaggagctcaatccgatcctgaatagaattttgaaaactttaacgatgaaaaacacttttttggcgaaaacaataaattcggtgcatttggaaagtcagccattgccttctcacggttttcagcaatctgcaaataacaaaattatttgaaaaagaaacattaaacgaccttggccattttgttcgtgtctttggccaattcaggcgaaatgaaacagcctaaggccttttctccagtgcatttcataatggcacccaatgcagcaaaggatgagtccctcacttcggaatcggcatcaaagccatgctaaaaggccgaaaattaggctaaaaagtttgaaaaaatgtgactttgctcagaattgccaccaaatccttgagcaaacccttgggaatttcgttggccggaagggtacggaaaacgcggtaaatgaacaaatccgtctgtgatttctgactcggattctgtttggaggacagagcctcgagcacggccttgcataggtggtcgaaactctataaaaaacaaattattttttaaacattcatttcgattggattatccatttttacggtatatgttgcgatgccatcgatgcactcgacgagcgcatctctgagcaactgtttcttctccttgaacttggtgaagatcaccgggacaaccaacgacacgtaaggagtgaatttggaacgcaatcccttggcgaaaaacatcacgcatttggtggcacttgcggcgacaatgatatttgcatcatttgccataatctaaaatacaaaatgtggtaattttagaaatcttttccaagtttcccatttcatatcactttgttttgtaaatttcttcaagtgataattttcgctaattggtttacaaaaataatcttttccagcggggtctaactaacaaaagattaagttcaagcgaaaaaccgatcgctcatccttacaataagatgatgagatatatgattagagatttttttgaaaaattttcataaaaaattttcgagtcttaaggataatgcattaaatgcgttttattagtagcttattgtacaaaaatcaaattaaaataagtatccaaatatttttattttaactgataaacggtgttattttcgtttattttcaatttcgttgatttttacaaaaacaaaacaccgcgaagaacaaaaaaaaattgtcacaaaaattcattttttaaatctacgcgttacccaataacaaaaatttttgcggcagaagtttcggcagcaacctttttaaaaactttgcaattttaatgcattttgttaagaaaaagtgaataaaatttttaaaaattgccagatttttctagaaaatttaaattttcttggggggggggggtcccaccaaggatgggccaaattggaaaataaaatgcgaaacgcgaatttgcaaaataaaaaatgcgaaatgaaaataatgcgaaacccaaaattttctacattttttttaatagcaaaaatctaaagcaaaaatccttttttttgaaaattttt

SEQ ID NO: 8194 - DNA, 3909 bp, Heterodera glycines
  misc_feature (17)..(18): n is a, c, g, or t
  misc_feature (3756)..(3756): n is a, c, g, or t
  misc_feature (3837)..(3837): n is a, c, g, or t
  misc_feature (3844)..(3844): n is a, c, g, or t
  misc_feature (3863)..(3863): n is a, c, g, or t
  misc_feature (3894)..(3894): n is a, c, g, or t
  misc_feature (3896)..(3897): n is a, c, g, or t
taaaagctaattaatannttttactttttatttaggtacatttttcaatttttaaattgcaataaatgtgcaatttttacttttgttatcttgaaattatatttatttactattaacaataatctcaaaaaatcaaaaatagtgggcctttttaaatggagttttttaaaatccaaaaattaaaggaaaattaaatgactttataacgtaaaaatattcaaatagaaagttataaatgctaaaatctttataagaaataatttataaatggatatatataaaagtgatcagaattgggttggatttccccaatttcagtcaaaatcccgataattgataaattaaaagcatcatttaatcttgatgaaaatgaatttatttctccgatttaatggccgctccgatgaattccgccaaaaacagctgaccatttgtgttgtttacattgttcacgtattcggtgttgctgctttcttcgttcaaatggtcccatttttcgttcacttcgtcacattttttgccgagtttaaagcgtcgcgaaactttcgcctcccatttcgcattcctttagaaagcaaattcaaattttgcccaaacattttgccaagaaaattgaataaaaaaaaccaacagattgcaaatttgccaggcaaaacactgcaatgtgcttccaattttgacaacttcagcagtaatactgggatggattgaagaagtctgaacaattttttgttagaaatttattatgaaaaatgaaattcagccccaaatttttgaaaggattcaataaaacttataattttatctctttttaataaacccacaacaaaaatcaaaaagaaaatcaaaaaagaaaaactaagaaaatcatatttatattttaaaatttattcctaaaagggaaattttttaataaactcataaagaataacaaatacgtttatttttattaaaaccttattttattatttatattaaaaaattttactgcaatttttttgagcccatcttttgggatttcatatatccatttaaattataacccctcttaatggtgtaacgctatgttcatcgaaacaataaaaccacatgtaaaatttaaaaaacatcctctattcattagaataacattttttaatatataatttttccatgtattattaataaccttttaccatagtctttggctttgacgctaccgtattcgttgttgctgtggtgctggtgctggtggggatcactttctttggctcgggacgcaaatttttgttcccaaattcgacattcatctggccaaaactgcagctgcaaataacatccggcatgctggtattctttcgaacttgggcactaattgcagaacattcagtttcattagcctctttagcacatccccacacgattcgtataagattatctcataaaaataacgtttaaattaattatcttattttttatcttaaaattggaacaggttttgagaaggatcaaaagttaaaaagattttcccggcggtacaaatcggcaccgccgtatctccccagttcactaaatgtttttgaaacgcggaaaaaattttccaatttgatagaattaacaaatttcattaaaaaaaagttttagtgctgagcctggaaattcctttagtagagtgcctcaggcatgaatgaaattatttttgaataaaaattctcaattcccaaaattatttggggcctcggaaaaattgattcctgatacaaaagatcattagccgcttaattacatacacgcaaaacttaactttcacacagaccgccttatagcaaaattcataaccatcaaaacagtactgaacagatgtttttccatttcttttctcatcgagcgatcctccaacgcatttcagtcctgatttatgaattaatttaaataaaaatatactttcttatcacacgttttacgtatctaattatcatatcactactctttttgtatgacatttagccataagcttagagctttcaaattgtagctaatccgccaaaaatatttaaaaaatatattttctcgacccaaaaattgtcaaaataaataactcgaaaatattaattttgaatattttggaattttgtaaaagtaaattatgaattgaatgaaataattatataagtaataatattaataatttcactttttccgctttgaggaggaagagcaattttcgaatttgaccagtcgactcccgtctcaccacgaaagcattcacatgaaacattggcagacccaacgaccgtttgcattacgtttgcccttaggatacattcatcgctccaaaccgattgagcacagccccaataaaggaacacatttcccggctgatcccctgtaaaatggaaaaaatttccaaaataaaaactgtattttaaatgtatctacaacgaaatgttgaaaaaagattattcgggctcggtattttgggtctcgggttttcagtctctgtctcgagtctcgggaaatttttggtctcgaacagttgggtacctcagaaatgtgcttatgatcccgagagcgagataaaaatgaaaaaaataattaattaaccaattattgccaaaagtgattgatttatagaatatcacagcaaaggaaaaatgcaataaatttaattttaataataattaaattttgtcattgtacatgctgagcaggtggccgcaaaacacagctccttatcaggtaagcattttccatttttcacaatagtgtattcctggtttggcaaactttctgctcttccttgtttgcagaacaatcctttttattgaaaacacatcaaaatttaattaattatagcaattaaaaattaccgaaacaaaactgcaaaagcccgaataaaaagaagaaaaaaacgaacactgtatttgccttcatttggttttcaatttcaattgaatgccaagattggcagtctaaaaaggttttgtaaagcaaccagaaaattgaaaagtttttttcattaaaagggatttaacggacgattcatttttaaattctcattaatcaccctttactaaaatttggattggtgtggtgtgattagaaccaaaaatttgataaaaattattatttttctttgttattttagttctaattcataaaagcgaccaaatgagattactaatgaatgctagtcaacatcagtgaaatatttttctggacataaaatgatcaatggtgactgtttgttcactttgtgtgttcattaacataaattcatctgatttttccaatgggtgaaataaaaaggcaaaaaaaaaaatatatatatattatatatatttatttttaatacaagtataattgaattgaattgaatgaataaatgaatgaataagtggcaaaaaaaaaattttcgagtcttgaattccggagaacaaaaacaaatctctctttactcattaaactctttttttactcattgctagggttggttttttgcgcatatgctacttagactaaaaaaaaaaatttggtttggttaagatttttggtccatatattgaaaaaaatgaaaaaaaaagaagcgaaaaaacacccctaaggatcggtctggaaatttttaaaaaatacactccccaaaaaaacacaaaaatttgcgtgttttcgttatttggctttatcgatttttttttttgaaatttttggcaaatttggagacatgttgttcccaaaatgctcatagcttcaaaatcgtattcggtttaaaattcttanaattcataacttacttcattgtggatcaattataaatgcgaaagctataaaagagaaaatatacagaattatactttttantaggttntctatatttaaaaagaaantagaaaattcaatttttttatgtttataacngnncttagaaaaaaa

SEQ ID NO: 8195 - DNA, 3048 bp, Heterodera glycines
ttcgatatgtattttgtcaaatatgccaagattggtcttccatgtgagtatttaaatttaaaaaaaacaatttgtcaccatgaaaataattaaagaagaaaacgtcaaacggtatcgaactcacgacagaaagtaatgtcaatgtgatgcactaacctctacaccacattacaaatgtcaaaaattgagcaaattttctttatttaataaaaatttggcaaatggttaaaaaattcaaatttcgtctaacttttttgcattttctcccacgaaaatgccattcttaggggtgtatatttaaccccgaccccgatcggggttaagggtcggggttcggggttgtcggggtatgaagcgtcgggggtcggggttttttccccgaaaatggccaaaaatgtcggggttcgggggcggggtcggggacgcaaccctaaccataaggacagctccaattttcaataaagattcagtcctcccgtttgacgttggaccaactgcttgaaaagaatgtcggaatgccaacttctgccgcagtttcgtcccttcaaaacaatgcctcctcttcctccgctccgtccccccgcgtgtccaatggcactaccggtgagtgtttctttatgaattgttcgaccctttgcaaatcctaaaacttttaaattacccgacaattcgtttttatgtgtttttcgttcgcttcgcaacaatagccaaccgcagcactgttcacaatcagtggcacaaaatgtgaagaattggaaaggaatgccacggcatggccagcaaatgaacgggcaacaaaacgaagcgcacttagtggccacggaacaattggccgacctcgcaaagaaaagtgcgtattttcagggggagtgactcttttaagggcattgtcttagatttataacaattaggcatttcatagcggaggcttctgtttatctgatgaatccatgccataaatatgcaaggagtgtttctattctcttccccatagtgtaaaagaagtctaattgtaagcttgttaactttttaaaaatttcacgcggtgccttttccaactgccggtccattttcaacaattttgcaaattatctcgaaaaaaaatatcaaacgaaggcgtaatgttttacgaaatacggataccctttctttgccacccaaacatttactcttcttttcagcgctcatcctttttcgggatgccaacgaatcgttcagcgaccaaaatgccgtctccgattggctccgccgttccttcgatttgcctgctaattcgatttgcgaactctcctccccctcattggtcactaactcccaagtctttttcattgttttcgacgaaattgggacagccgaaaggattttggaaatgagcaaatccgaggagagggctcagaaaagtgagacaaagcgcaacgcaaaaaggggcatggaaaaaacgcaaaaaaaaaataaaataaaaaataaccgaaaatttctaaatgaattttcaacaattccattctttcagttttttaattttaaaatgttacttaaaagaatacttaaaaaattatttttgaactttaaattcggttaattaaaaataaaatccttacaattaggtgtcccaacctctaatgtgttttctcttttcagcttttctgacttcagccaccgaatttttgcagtcgaattcccctggcaaatttacggacgccgccttttccgatgaaaatgcctggcgaaatttggcagcggcggtgggtgaaaacgaataaaaaacgaatgcatttgagaacttttctcaaattctgaccatttttatgagatggacaaagagccccggggtgcccaaagcaaaatctaatggaaaagagaattgaaacatcgaaaaatgaaccgacccaccccaagccgaaacaatcattcgccaaccgaaatttccccgggacatttcgcctggtgaatttcgatgcatctgaatttcgagttaatcctccgaatgccttttttgttggtttcccttccctctgatgccccgccctccctcagatggtccccgcctacaataatttgatggccgctgcttcctctcaacttcatcaccaaatacccaattccaatttaacagtcgccgcagtgagaaacaaagcgaaaacggaagggaattccgaagcggaccaaacggcaattcagacgataatgagccaaattgacaagataatccgacagggcaacactctttaattgtttattttcgttttgcttttcattttcggcgtataaaatttcacgaaaaataatatttgaattcaacaaaagtgaacgttatttgttgaaaatgtccaattttgacgttttattaaatttgaaaaaatcagggagattgtggtccggcggtgccaatgcgaccgcctgagagaattttcgcaaattgggcggaattggttaagaaagttgtcctaaatgtttcataaattacccgattctcacaaaaggtgtatctatctcacccgcaattcccccccccctcccttttgtcccctttccccccataaaatcaaattaaacaaagttcgagtgattgtcgccaattgatcgattcaatggcgaatatgcgatgttttcgttcatccgttgaccagttttcttctcgtctttaaactttttcatttcatcataggttttttgtcattagtaatcattcgttaattgcatattcaaataataataataactaacaaaacgccgcaaattcaaaaataaaaattcggcgatgaaaatgcaatatcagacttcgtgctttggcaattccagcgtttggcctgtaaacagcaaagaggtaaactcaaaatttatcggatctgttaaagcttcagatcctattttaaatcctttaattaagcatatttaaaccgccaattttttcaaaatttttctcacaccataaaaatgaatctttcagcacccgttttcccatttggcgagacctcccccgtcctctctcccccgccctctctcctctctcccccgctctctctcccctctttctctctctctttcaga

SEQ ID NO: 8196 - DNA, 1024 bp, Heterodera glycines
gattcctcaaattgtatggaattgcaaagccctttcaatacaaagaaatggtcacgatggaaaggtaatttgtaggaaatggcaattagcaactttaattaccaattagttgccaagttataccaattaattgccataaatgaccaattgccgtctcctcccctccacaggtgcgtcatgttcatcaaattgaggttgccccccctctccctctctctttgccattcccccctctcctctccctcctccaagttgggtgtgcttcgcactaattatgctggccacgatgggtttcactttcctcgtcaaaattgagtttctggccaattggacgggctgtaaggttgagaattgcctttcctggatgtatcgagtgcgcaacattttcacaattcttctctatttctcaactctcttttgctttgttgttacgggtgagaagggaactacgcattttgaagtgcttttggaataaatgttcacatttggcacagttgtgctgataaagaaagccaagcaaaggtcgggcacacttcgggcggggacactcaattcggagcagcagcagcggtgcttcagaagacgctaccaatttcccctggtcaaagtgagcagaacgaaaatggaaaaacagtccgaagggggggggggagaagggcacgaaatgccgaaaacaaaacgaaaagttcagtgcatgtctaagccaaaattcagggaccgaccgaccattgctcccaaaatccaaacacaatccaaacaaaaattcttttacaatcaaaagtccaaacagcgaagaaaattcacaaacattttaaaaattgaccaaaacgagcgaatatcaaatctgccaagcgaagtgaccagaggaagaaaagtcggcagcggaaaacaatcgataatgaaaaaggcgggagattcaaaattgagaacgaaaggacaaaaataaatgagagagaatacaattaaataattaattaattaagtcaaaaattggaaataaaacaatttaacaatcttatcacat

SEQ ID NO: 8197 - DNA, 1937 bp, Heterodera glycines
attgagtcccaagattaagtaacgaagaattttttgagattgagtcccgtgattggaatgccggagaagaattgagtcccagtgattgggatgcatatgaattaggtcacagtgattggaatgtcgtataattgagtacaggtgattggactgccggagaattgagtcccagattaaatacagggaatgagtcccagttattagaatgctggagaattgagtccctgtgatttgtgccgtaaaattgcagaaattgagtcccaagattaagtgttgaagaatttttgagattgagtcccaagattaagtaacgaagaattttttgagattgagtcccgtgattggaatgccggagaagaattgagtcccagtgattgggatgcatatgaattaggtcacagtgattggaatgtcgtataattgagtacaggtgattggactgccggagaattgagtcccagattaaatacagggaatgagtcccagttattagaatgctggagaattgagtccttgtgatttgtgccgtaaaattgcagaaattgagtcccaagattaagtgttgaagaatttttgagattgagtcccgtgattggaatgccggaaaagaatttagttccagtgactgggataccgaagaatccgtgagatgagtcccacgatggaagggataattgagtcccaataattgggattccgaagaagtggggagaatgagtcccagttattagaatgccgaagaattgagtccctgtgattttgtgccgtaaattgccgaaattgagtcccaagattaagtgcgaaggtttttagaatgagtcccagtcattgggatgccggaaaagaattgagtcccaatgataactaaattccaataagtaattttaggaaataactatagtaatgatagagcacaaattcaatatcgttcaaaaaattcagagtcgtctctaaaggtttaaaatcgatgagaaaactacgtttaggttaggcgcatgcttgcaatttttaataagcaagtccttttctaatttcaacagggactgaatagtccgataaaaatttaaaaatgcatttttttgggacaatttctttcaattctgaatgtctaaaacgattttgagttttggaccaattattaatgtttcattaggtttttctttgttacctattgtgccacaaataggctgctttatctatttttctttttaaatttagacaatatggtttctgcaaaagttgtaaatattcactgtaacaaatcggtaatgctttcggagataaattctatcgggtttgacatggattacaccctggcgggtgaaacatttaaaaccagttttttccgaggaaaatcaaaaattaattttccacttattcaggctatttatcaccaaacacggaagaactcatcttcaaattatgcattgactatctgctgaaacataaagggttttggattgaagcaatatttttgtgtaatttttttttaggtatccgcaaaaaattgattctttggtgtacaatagcaagtttgctattcgcggcctttggtacgacaaaaaaagagcgaatggtgttgaaggtgcaaaacagtggcaacattctcagagcaacgcatggcggaaaattcttgacttggttttttgtttatttgagaatgaatttgtgcaaccaaaacttcttttaggaaaaaaattgctcaattgtatcccagaaacattgtcaaattgaaccgagaagtgaaagtgatgaacactttctacgacttgcccgaaaccgatctgttgtcccaacttgttcatctcttcgacaaagactttggagtgtaagtaattgaaacattgtgccgacaaattttactattatttatataaaaataaaaaatcactttaaattggatgaatttttggacttaggttttcatttctaagtaa

SEQ ID NO: 8198 - DNA, 4155 bp, Heterodera glycines
  misc_feature (4133)..(4133): n is a, c, g, or t
taatctgttcttttttaggacgttcaagctgccatgaaacatgtgcactgtggtgatggagcaatgaaggctcaaattttgctcaatccgaaccaatacgtggaaaaggagactcgaattggcactttgttggaacgaattcgacgttcagggaaaaagtgttttttgctgaccaacagtgcgtacgcgtatacgaaggttcgttgagggataggatcaatttctgcattttctgtcgggtacgccccattcacctcccaatattttaatccacgagaaaaccaaaaaataaaaaaaagacaaaaattttctaataataaatgaaaatttttggccaaattcgtattacgacaattttctgtacataaactttcggaattggaaaaggaaactgggcgacagcacggtttttttaattaaaacttcttttatagtgtctgaatgtaataaatttgaaacgatttaactaactctgatttgttctttactagcttgcaaaattaaacaattggttctaaacagttaagcgaataaaacacttaaaacctgatttttttgtattacaaatctcatagtgctagcgaatgatgataaattgtttcatttggacaaattgaaaggagttttacacaaaaaaccgggttgtcgctcagttggccatcgctcagttgttcacccacagtgtggaaccgatcctgttcaaaatattatgttgacttatccaacccaatttaagggaattatgcgatttttactgggcaatgactggtcatcgttcttcgaccttgtgattgttgacgcggaaaaacctttgtggtttactggtgatgctgacttcaggacggtagtacgaaaacaatggttccatggtttataaccatctcattttttaggttaacacgcaaacgggcgaaactgaaacggtcccggacaatatttattcaggaggttcgttttgcaatgaatggtctccacttcctgggctgaaaattgccaaaaatagaaattgggtgaaattatttgattactatcaacgcacacaagttaagcgacaaaatcgcgtttcatttgaactgaaattttgaattctgttcaatgtctccaaaatgcacaagaaaccgatttttataacctttaaaatttaaaagaatttctaaaaggtggagtaccatcggtatatttacaaaatttccaacaattctttgtataatcaatgaattgcaaccataataggggcttggaaaattttaaaaattaacttcttttccatattccaacaggttcctgcggaggattacgcggtttgctttttgatgctcagtcggaaaatacgaagaatgttctctacattggggaccacatttacggcgatattttgcgttcgaaggtctggggaggggaagaggagggagtggtgtactccatttcttccacgccgttttccatttcctaccccccagtcagtcgtttaccccgaaaaaattcttaatttttctaaaaaattgtaatttttacaagaaaaattcaaaaaaaggcattgaacattatttaatgataatttttattgaaaaaattgtaattcagattataccttgtaaaatagtgaaatttttcaaaaaatttttttaactatttttttaaaatttttgttctttagaaaacaaaagggtggcatacatttttggtggttccggagctcaaccacgaaggggctgtgtggactcgaaacaaaaaactgctcttggaaaagaaacgattggagaacgccttggagaatttgtacaggtttggaattgggagcatttccccgccactctctgaaattaataaattatgcaatggcatagtttttctttttgatttttactttctagaattgggcaggcttgaagttcaaaaaaataaataaaaataaacaatttttgtagagggttcagttcctcctgggtcattacttttcgaattttttaacattgtaacgaaattttcaaaaatttgaatttttaataagaaaatttcgcggataaaaatttgacaatttttcagcgtttttttaaattttatgaaagataaagggaggggggggcgttaggcaggcacggtccaagaatttcggcttatgcggggtaccccccccccccctcggacgacgatctttttttgatttatcaattactattttttcaaaaacaaatttgggtatggaggggtcttgagagtggttgtgacaggacctgctcagatcccggagtggaggggaaactaggacgacttatcaattttttttgttcatgatgtatatttgcatctctgtcagaaacgccgaagaagatgtggtgccgcccggtgttcaggctctgtgtgatcaaatacaggcaagtgctgttggtgttttattgtaaaaatgtttcaccagtggcaccctttcgataccgcctgaatttaatatataaccttttaaaaagttgattttcctttttgattgaattttaacatttttttgcaggatgtttcgaaagcaatggaccaggcctatggcaattacggctcacttttccgaaccggcacgcgtaaaacctttttttcataccaggtgtgtgttattgtggcatttacattttttgttgctctttgtgcaaataatatttattttgcgaaaatttctcattttcgcagggcgacttaaaagaaatttgaaaatacaatatattttaaattccaattcatttgcagcttgaaaattatgccgacttgtatggaagttcgtgctttcatcttctcgactaccacccctcatatcatttccgcgccaaattcaaattgatgccgcacgagtcgccggtggaccaaagcgaagcggacaatcagcagggccaagtggaggatcagcatggccaagcggcggacggtcagtcaacactctcgaaaaatcatataaaaaaaattgtctcaaccgcaaagcttttgtactttattcccagcctcggaagaccctacctagcccctcctttcgtcaaaattttttttgacccagcgaaatttttttttgaaattttgcggccgaattatgcttgctaaccagggaagggcgcgaactgtaagtcgagaaatgcagttgtgttatataccattggatagggaatggtcgacttatattgtagatttcttaatttatacctccatatgaagaaatcaaaagttatgtggccacagaaatgaaacattttagtgcctgaggcatttccggttttattgattttttattaattccccatccttgtacttgatttaacctaggacctccaaaattcaaatttgaccagcttagccacgaattttgctcattttcttcacttgtgcaccagtggtggggggatgatcctccgctttctccttggttatttttgcggaaaacaatattagggttttcatgtgcgctggtctcgaaatttcgttcaatttatagctccgccgaaactccctaaaatttgtattttttcacaaaataatggagtcccattctacacgagttcctgaatttttttgaaatttcttaaaccattttttttctttcaggtcctccatttgaagtgccgaatgttagtcccaatcagagtagtagtgaggacgaggaggagcagaatacggataattgatcttttaaaatcaatactctttccatgttaattgatctccaaaaatttattatttcattacaaatttattggattttgggattgaagcattagaaaataaaggccattcattaaatacattcacttaaattggaaattcaccatacgacccccataagttttgttgaagattttcaaaaactattgttaaatgagaactcttttttaatcttttaaacgaacctcaaaaaccaatatttatttttaataaaagaaaaattatctcgacgaatatggtaccaatcgatagctctcgatgagacagatcgctctaggggtgggggaagttgatccgacaagtataaaccggtttttgaaccgattcaaaacacaaaaagtgaagaaaattcggcagttttaattaattaatttattttttaatggacatttcagtaccaacgaaaaaggataaactaaattaggtaaattttcgcaaanagggacatacgaagacggagca

SEQ ID NO: 8199 - DNA, 1406 bp, Heterodera glycines
tgagaatgtcgtaaattttcttgttcatcttaatgtgctttaacttttttattttagggttccaagggtcgcttcgacgtcattccgccgcacggaccttcggcccaatatcggaagatcacgaaagctggcccaatctcatcaacggagaatcgctcattgtcagtgctaaactctgaaaaaagtttcgaaggcctttccccatcagttgacaaaaaatctaatacataattcgttaatttcacttagtttttatcattaattatgtatatacagtcctctaatactactcaaaaatttattatttattaggttcgttttcttcttaaaagtttttggctcttatgcagtttaatcctcataaaaattggtcgaaatgggtgccgaaaacgtgatcagcgactcagaaaaccaccataacttcattttcactttttaaaacaaaaaaaaattctaaaaaatttatgggtgttaaactgcataagagtcgagttttttttattattcactaaaattacatcgagatgctttgaaaccatcgcataaaaatcgagaaatcctttggttcattcgtcttcctccccaaacgaaagaagtcgtctgttctgctccttctgctgctgtcccggtttctcttctcttttggctcgtttctccttctcctcctcctctttgcttccttctttcccacttccattttccgtcttccttttctcgggcttccgaaacataatttttccttccattattttgcgctctgaaaatattgtaattttcgaaatttttcgaatccaacgataaatcctcaattagcacccacccctctaattaaacccctcccccttctctcactgtcttcctcctcgtttcccttctcaatctctttctgcagttcttccgccgacagatccgttctcgggtccaacaccaccacttggggtctttcctcttctcgcatctttcggatgtcatccgtcggattgtccgccccctcctcctcctcctcgtcatcacttttggcaaacttcaatcacgttttaattttaaaatacatttttagaagaccttatcctcgacggtccattctttgtatccgagtttgtttttgaattgtgccaaaaacggagggtcactgccctgctggtacgaaatggccttcctttctttataagacgaagtctttttgttttttcccttgccattcatttcgcactgaaaaagcggacgaaatgaaagagaaaattggaaaaggaagcgaaaaaaaagagaaacaaacaaaaagtgaattaattaatttagtaatttttggcataatgtttggagttgacccaattttagttttttaaaattgaaaactccgtttccttaaattatgtacaacctccttaaacaaagaccccctttga

SEQ ID NO: 8200 - DNA, 991 bp, Heterodera glycines
ccttttcagcggtctttgagtcataaaattctctgagcatttcgtacaatgcgtccatcaaagcaatctgataaaaaatcactgagcttaaaaaccataattttttgcatcgattaacttttcaactcaccaaacgattgtcgcccaaaagtcgcaccattccccgcttggacaatttggacaacactttccgctgcactcgcatcgccagagaggacgaagcattggccgttgttttctgtccgctcgccgtggcgccgcacttcgaattctgagggaatgcgaacgaagaagcttcagaatcggacgaagccatttgatttaattaacctaaaagcataaaaaaagaaaataaatgcaaaggaaagaaaaaggagggaattgcgaagaaaggctgggccaaaatgagttgcgaaatgcaaatgaactggtaaaatgggatggtcattggtcattttggtcgtccatccgtccgtccgttaccattcattcattcgttcgcatttcgttcggttcatttccatccttccccccccccccccctccatcgatcggacgaaggggggagggattctcatcatacataaaacccttctttccatcagcagcagcagcaacagatgattctaattttgatcgacacgacaacttttgcattttcattttgcactgcgccaattgaccaattaatggagaaggaatgtgacggagagagagagagagagaaaagggcaaagaaaaaggggaaaagtggacggaggcgccaaatgtgtgaccactgttcacattcactcactcatctttgtcattgtccttttttagcattgagaacaaaagtggcggtgacagttgccgctgttggcggaggaaaagggaaggaaagcgaatgaatgaaaaattgaattcaaattaaaaaacaattaatattatttggcactgtgtgcagatttgaattcatttaaaaatgtaatgcgaatttgcttcgcccctt

SEQ ID NO: 8201 - DNA, 2857 bp, Heterodera glycines
gaatttgcttcgccccttttgaacggacaaaatctttcattttaaaggatcccccccccccccccctccccgagatgctgggtaatgaacgccttcgtcgggaatggaatttcggtcgggagtaaacaaaaattttgagtaattaaaatggattaatttttggttttttatctatgcaaatattatgaattaaatcgcatctttgctcttttattctccgtaaattgtcatttttccatttttctcggccattaattttcgaattcgacttcgctgtagacaaattgttataatgattgaagtcacctttcaaaaaaaaaaaattcttaaaataattaaaatacattaatatcgtttccttaccgtaacggtggctccgaaacttacagcgacaacggcgagcatttcgaagctgccgatgcgttgagagtccaagtgggcattgagcggactgtactcggcccgtttgatggacaacacgcgaacaaaagggtcgtcataaggggggggggggtaattagtgaattagaatttctttttctgcttttggccccctctttttcagtccaatgtccgattcccttttgtcctcgtctttcgcttggtcctgttattcctcgttctccttttacctgttgtccctcctcttccgtgctccatccttgccgtgctttctccgtttccccgactttcgcccatttgcggcccttccgcgtcttcaccttcccttggctttggcacaaccgtcaaatccgcgctcaaatccgtctccattcggcccatcactgctccaaatgcgtcgtcttcttcgatttgcgcgtcccttccggcgcgacttcgatttgtctcagaaagcacttcgaagagcagcaactgatcggcgattcgctcgtcactcgcccccgtcccattggcatttgccagcagaggactgtccttgtagggaggttcacctctcctcaattagcaaaagcaaaataaaattgaaaaattgaaagagggacgcacccaaaaagggaaggatggaatgggccaccgggggacggacgagcggacaaaggcggacgacggcccaacggcgagggagggcccagaggcaattcattactttcggaagatttgcggaaattgcggttgagtccgggcggacgcgggagagggaggcgagaaaagtgttgcgagtgctctttgggcctaaaactggaagaaactcagttccaaaataggacagaaagtccttcccatgccaatgcttttggcatttatccatcggacgacctttgggctggggaagtgttgtgtctgtcgcactgaggcggagagattccttcgcaaccgccgtcttcgcggaagcacaactgaacggtgcaggtgaagaacagttggacacgatcggcgtaacggaactgaagggacggagcggaaatggacgagggacggaatgaaaagggacggaagagtaccacgtgggcatgcgaatgggcggcaaatgccttttcgtcgtactgaatgtcggccagcaaagattggtcggtgacgcagctgaacaaggacaacgggacgagaacatggacggaccgacggagaccctcccaagagagaatcggccgagtcagtcccgaattcttgagacaagccaaaccacggggtcccaacgattttcaactccccctccccagcagaagtgcgctttcctcccactgctgtcacagaccctttgtcatccaccaaatcgaagcgattgccacgtccgtcgtccacaaagcacgagtgaatgagcactccgtacaaccatccggccaccgggtcgcactgccaaacatgcgtcaccggctcgccaattgacgcgtacttcagaaagggtccgtcgatgccgtgtcgtaaatggtaattgcactggggaagggcgaactgacgctccaccaccgaagttgaaagggggctaaaggagggacaaacggaatagaaacaggggaaaagcaacgcaattggcaaatgctttccctcacctaacgtccattgaagcatcaattgcacggactgcttctgtgaaaaagcagcgaatgttgaaggcacggtcaatgccagtcaaaaagacgggatggaaggagatgaccaaagtgaaggagtaggagacgccgcgggggttaagctgaatgatgggggagaacggagccaaattggccgtggcaaatggcaaaaatgccatccacgcaccgatcgctgcctgcgcatgttgcactgtccaaatcggagactgaattcagcgcctccgcctccgcccaaatcgccggccgcgcctccctccgccccgttggcgtagctgcgcacacattccggatgctccgactcgtcctccacgtaaagccgacctcgaaatggcttttccgtacgggtccaaaccttaaacagaaagacaatccttggccaaattgcacctgtgcgatcaccgacactgatcgattccacgccgcagtccacccgaggctcggccaaaacgctatttgccaatggaggcggtggaaagtcaccacaaatggccaacccgaaaaaggcgaacaaaaaaaggacgaaggacggagagggaacgaacagaaggaaaaggcacattggcaagcaaatggtgacggaggacgacaacagccatttatatcggagaagcgaaggcacgcagagggaggaataagccaaaagagcggacggaggaggaaaagccaagggaagggggggggggaattgccggagaaaagcagctgagggaagggactgtaaaatactcccccagtgtggatcagcagtcagaggagggctaacaccattgtccacccatcacaaccccaacggcaatgccattaac

SEQ ID NO: 8202 - DNA, 1859 bp, Heterodera glycines
  misc_feature (1821)..(1821): n is a, c, g, or t
  misc_feature (1854)..(1855): n is a, c, g, or t
ccccccccccccccccccccccctttttacggggaaaaaaatcccatccggccgggttttccccccccccccccccccccgatcggctgttgatcactttatgtttgtttgctgctgctttccctttcctaactggaaatgaactactgactgcttcagcccccccccaaatgaaattactttttattggcaaataattgagggatttgtggttgagtgtccaccaaccaaaatagttgcccaaacgatgcgaaagatattaaagtctttttattcaaacaaaataattaataaaaacgaaatttacaaaaattagtggcatttaatcaaaaatcatagagcaattattgttcttattttaactttcacacattggccacctcttcagaagagtcacttttgctgctcaaaaaagtgttggttggcttgcgctgaaagtgcagcaaatgggggaatttcgtgcttaagagttggtgcaaaatgccagtgccattttcgctgagttcgtagactttttcgcataaaggcagcacctgcagcggcaagaataagacaaaacgaatggtgaagaaataattagaaaaggccaaagtgaggaaagagcaaagaatggcacaaaagaaaagagtgcctgggaaacgatgaatcgacttgtgcagtggtgcaccaccgatttgtgcatgccggcagtgagatgtgccaattgttccgtccaaattgaatgcatcagcgaatcggacaattggtggaggtggggagaagtgttcagaagggcgaggtcacggcctgtccaaagtgagcattttaaagtgccaagaagaagcgaaacgcactgagttggagggcggtgcgggcaaaaagacagccactttgggccaaattcaacgcgcatcggtaggcaccgggagagaggggggaagcagacgaggagggggaagagggacgacaaatggcctaaaggtggaaaatggctcaaagggaggaccaatgagcaaataagggacaaatagacatggtgctaccaataagcagaggtgattaattaatagcaaaagaacaattggaacgcacccactcaatttgcagacctatgtcggacatttcttcgaggaatcttatcagattttgatcagttccgagtgaaaagggcgtccaacgttcttcctgcattatttgacaacaaaatgtgaattaatttcgatgtctctccgaccgaatttctgagtcgaattgagtcgagaatattgccgaaattagcttccaaggcatttttgagtgagggcgccgccaatctattgacttcgaagctcaagtccaggccgatcgggacgagttgggcacatttgctcatcaaaatacgccaagtgtgcctaatgaagtgacaaatgatggcatttgtcgcaaagggtcgcgggggtaatacgtgagaacggccattgtgggagcaacttcgatgacatggcgacggatgagcgagaggaggacactcaactcacgcgaactccaagtcagcacttggcaaagttggtcgcggtgcggagaaagctcctggcaaacctaaataagaggagaagcggcaaaataaaaagcgacggtggcggagaatgcctccaaaatgtcgttgacaaaaaggccggacacttggcgaacgtacgacaacggctcctcactgatggtcaactctcgagcagccgccctcagcgcgacacttcggcaccgcaaataaagttcaaccgcgtaaacggtgcggccaagcgcaatgagttgttggatgggttgggagagagtacggggggagctcaaaagatgagccgggccctntttgatgtcctcagtaagcccagttcagactcnntaga

SEQ ID NO: 8203 - DNA, 3452 bp, Heterodera glycines
  misc_feature (33)..(33): n is a, c, g, or t
atcactttttgccattttcaccattattatttntctgtaactaaaaattcacgccctgatcttagccaaaagcaaatagtgtaaattttcttcctcctcatcacactgccatttttcttgccatttatcagtcaatgattatttttatgccctctcccctctctcgagtctttcgtttaccattaattagttaatcactattacatcactcacaaatcagtgatgacgtaaaatcatttttatttattatatttttgtctacaacttgatattccatggcttcttttagtgttgatcaattagtgaatgagtactcatcaatcctatctttcatgtttaatagtggcgacatttttatgggtcatgttttaattttttataaatttgacaatcttctaatatgtaataaagtgcttctctaatgagtcatcattatgttcaaaacattcgattaatttgtaaattctctgatttactttaatgatgaccattttacaatttgagtcttttttgtttttgtttttttgctcttttcgaccgaccattttccattttcgcttatgaacaatttataataaaattttagccatttaaatatttttcttttaatttattttcttaattggttttagcattcgccgtccgctgaattcggcggcttagtggcacacgaaaatggcaaaaacagcagaattctatgatgataatgataacagcaaatctagcaaaggcaatgcccaattgaagagtgatcatcccacgcaacaagcaaatgggacaatggcagcaacaaagggcacggagtcaaaaggtgccgatgagaaaggtgggcaaatacggcactgatcaaatactggcacgggaaaataagtctcagcttgtcatattttatatgtttatagtacctaactcaaaaaggtcatgtggtgaattagctacgaagatttaagtctgatcagctctcttttattgagctatggatttattcaaaagcatcccgcccctctccttcctgaaacccgaaaaaaatttttttgaaattttcaaattttttatattctttaaaattcaattttcccccacggagccagtcggcactgccccggcttttcttttcgtctaaaaatatcataaaaaatttcgtatcgtcgacaagcaaaaaaggtcatcaacagggcgcggcgaaagtggctctcttgccgaaacgttgagagtctggctcggccatctgatcaatttaatcatttttattattttttccaaatctgttaatttatgttttgatatatttaagcagtgaattattttttatttttttttgttccaaattcctattttatttctccatcccatcgccctctttagctccgcttcatcccaactcatccgacgactctaatgcctccccttccgttggtgggtcgtccatttccgactttgtcgcgcagcttccgcccgcccctccgcttctcgtgcacattgcggtcccttttttgctaattgccgctacgtttgtcggtctgttcaactgcgctgtcgcgttcggcctgtactttgttttccgagctgttgcttcggactttggacgaagtgcattgtatacattacccagggatttcaagtgggtgctattgctgggcaaagagtcgagaatgaagcaaattagttcccggggataattattaatcactttcaagtagtctttgacctttccaagaaaattagatcaacacaaaatacgggtccagggaggcgagttggtcaattctttatggcaaaatttgatagctgtaaattgaatgattgaatcatttcttgtgcttgacatgatcgaggtttactgatcggaaagctttaaagtggcctttcgctcagcaaatattatcaatttgtacattttttaaatttaatgaaactttttcgacccgtctgccaataggcgataattttgcaatttttaaacgaaattataagaacattgatatattgtcaatttaatttttttcattccctgcttacgttttgcatttgcttttgatcatccatcctcagagtgttttcacttttcattttcaaattaattttttctgttattggcaacccttgctgtgtcaaactgaccactttttctctccaacaggggcacctttctgttcttccaactcaaatggctgttgtggcgcgcattccgcagcggtgcaccaatccatgcccactttttgcgcacagtgcgccgtcacccgaacaaacagtgcgtggtcgaggtggagagcggtcgatcgctgacatttgcccaattcaacgcgcatgccaacgcgtacgcgcatctcttcagcaaagtgagaagaacgcgtggggtgggaaataatggcacgaaaaataataaggaaatctgataagctaatgataagaaaaagcatgagagagaaatagcattacaaattaatttgcttaattggcacaaaactttttaattccattattcttaaactatacaaaacatgtaaaaaaatataagaatttctagaagttccgcatagcttttttattttttgattgcccttataaaatggaatttcacttataaaagccgttggtatttgttattttaacggatcgcgattctttgtaaaaaaacttctggaaaatagcgttcccaaaaaataactgcgaaaaaatgggcagtgagaaaattttctgggcaacttttctttacaaaacttttcgtttggaataactttatttaatttatttttctttttcagtctctcaattttggtgagggtgatgtgttggcattgtacatggagaatggcatcaacttcttcgctgcatggcttggactgagcaaattgggcatcgtcacggcatggatcaacaacaatttgaagggcgacccgttaggccattcaatccgggtggagaatttttttttcaattttattttatttttttggataattttaattacaggtagctgattgcaaggctgttttgacaacgcccattttgcttccaggcaaattttcatttaattttaaattaattatttgtattttttgaacttcctttttattgtcaccaacaacagatcttactatacatagtccaacactcttttttatttctattaataatcagatcattcctaatctttctacatctatacactctattagtcatattttaacatctactaaacttatttttaattcgattctataaatatgaattgctataaaatatccccggattcaggatcagtcactcagcaaaccccataaaatagtgtttttatgactttaaataacaaaaaaatttcgaaaaaagggggtggacaaactgaactattacctaatcgcctcctcccaattcgtttaatgtacatatgtataaaggtatgatatgatatgtagtacacaactcattgttcgcacttttacaattcatag

SEQ ID NO: 8204 - DNA, 2323 bp, Heterodera glycines
ttaccatcttcttttactgctgtttttcacatggtcgtcgttatttggccaggtcaaatgaccatggtaaatgacctggtcaaataaccaccttctttgactacggcccctgattgtgagctgccgattcggcaccgtctgcccttaacttttctttaaatttcgccctaaatttaagccatatttttttggcttttagcatagaaaatccagatctggttaatttgtcaggtgaaaaaatagtcttgaattctcctcgttcattctgtaaatcctcagccttacttccccttttatcaggcattctttgctacatttacaccagcggaacaaccgggtaaattttttccttctttttttttgtaaaatctgtaaattttgatttctttttaagtgcaccaaaggcggcaattatacggcactatcgctattatttgatgtccattggctgtggcaatgcctttggcattgttccgtcggatagagtaagtaccctttgagttttaattaaatttaattattttgcttacagctttatttgacactgccaatgtaccatacggcgggcggcattcttggcacatcacaagttgtcttcaaaggttagctaatgctaattgattttgattatatggaatttatttattcatttaattatgctatggatgcataagtataaataaatctttattatcctttaaggttgtacggcatgtattcgtacaaaattttctgcaagcaatttctggaagggtaatttgttctactctttttgttaaacgaaaatataaaataaaaaccgaattgttttaaaattaaacgataaaataaaatgaaaaatcgaattctttttataataaatttatataataattattatttatattttttctcttaaataaatttctttactccccccccccctcagattgtattcgctttgaatgcacagtgagccaatacattggcgaaatttgtcgatatttgttggctcaaccgccgtctccaatcgatcggaaacatcccatccgggtgagttataaaatttattaataaaaatgaaatttcattaaaaaaataatgattgtaacgaaaaattattatttttttttgttttgacacaaaatctcataagaatttcattcgtcaattaataaaacctttttgtcattttggcttctcaccggcaatggccttcgtccacaaatttggcgtgcttttgtgcaacgttttggcattgcaaaaattggcgaattttatggtatttataaacaatctatttgtttcatttgtggttcggttggttgtctctttgtttcttttaaaatgatttttgcaagttcaattccttttgatgcaacggcaatgaagtaaaaataaccctattttgtgaattgctaatcaatgtgcagtaaatcgattagtctttctgagccgaagcaattttttatttttaatctaaaaaattttcttgcaattttttccaggaattgcttttactttaaataaaaaattatttttgccaaataaatgtttcattaaaaacaaaaatatttcatcagagtaaattaataattttttctaaaggcagcaccgaaggcaattccaaccttttgaatcttgacaatcggccgggctcgtgcggcttcatccccatttacaactcattgcacggcttcttcccgctgctcttgctcaaggtggacccgaagacgggccaactgatgcgcgacaagcgcggcttctgcatcaaatccgtgccgggcgaaaccggcgaattggtgccaatattattattaaacattttcatttatacatacataaatttctgatataatctgcgcttcattaagataaatcccccatgcatccttatgcagttagaaaaaaaaattttctgcgctttttgaaaaatttcatactatgaaatttaaaaatattttttcagtgggaaatgatgcgaggagaaatgattcgggtacgggggggggggggggacggggacggggacgggaacctagtgtaccctcttttttaaaattgtatgattgattttcccaacacaaaaaaaaacaaaattaatatttaattaagttgttgagggagtaaaagttttttttgttttttatataattaactctttaacaattcgcctcaggtcggtgccatccgcaacgacccattgctccgttttgaaggctatgtgaacgagggcgacacgcagaagaaactaattaggaattgtcaatctgctggtgaccaagtgttctccaccggcgatgtgctccactgggaccacctcggatacctttactttaaggct

SEQ ID NO: 8205 - DNA, 2106 bp, Heterodera glycines
atttttggtcaatgcccaaatgaatgaatgatttattctcccaaggtttgttggattttccttggctttgttccgccattttctgctcatttctcaacacattttgggtttttctccgccctctgacccaaccgaagaaccaaaattatatatttaattgcttccttttacatttgaaggtccgccgggggaggaaaaaagagaatttgtccaatgccaatgccaatgcctttcttttttctttttttcctccgttcgttcggccaatgcaatggcccagcgggacactttttggcagttgcgaaaagcgaaacattcgaattgaaactcgcgcgggcttaaaatttaaattctcatttaaatagcgaaaatcggaaaatgtcgtaaaaaaaatgtgagttcaatcatcgccataattcaccataatcatcaccatcctcatcatcgtctcatcctcactttcttcctctttttggccatttccttttggcgttccgttgcgccgatttcctcccaatattttcggcaccgccgatttgtgcctcccccccccctccgccaccggcgccgcccatttaatgcgggccaaacaaaagtgggggaggagggtattttatatttatttgtttgttcccatacaaagttgtggtggaaattggcccttctcaagctcatcgtcgtccgctcgaaagtgcctctcggccctttcggcttcacgatgaccctcgaagggttctttcatcggcgccgccgcgagctcatccctttggcttgccccccccccccctttttcccggagagttccccccccccctcgggggacccttcgccaccccaattcgccattttcaaataccgaaattcaatatttgccgacaaattacctactccccccttttttttttgtttttggcacaacgcaatttggcaaatgactgtgcggcaaattcgtttaaaaatggtgcacaaagtccaaattaattgattattcattagctgcttttcattcggttattattgtcaaattaaattttgtgccataaaaatcaaacactttgcctttccgtggatggatttccgcatttcggcactgtttttgtttcaacagcgttaattaatgccattttggcctttttgcttaattaatgcaattattcctcccttttttgtccctttccttcgcttttgcacttatgtgcgcctttctcttctcttttccattggctgtgctgtgcctttcctcgcaaattgttgaagacaaacagacagaaatttcatcgatggcaaaattgacgaattttgcgaggttaaggcatctgagaaaaaacgacgacaatacaatgccaagaatttcgtccgtttcaccgccgggttcccagctgagcacaggcggttcgccgccggaggagaaaatgatgcggaaacgcttctattatgagctgttaatggaagcggaggaggatgaagaagaagctgcgcaattgagcgcgcatttgaggagaaaacggcgacggacgactcaggcccaccccggcgggcacttgggcatggacagcggcagcttccggtcagtgccaattctgggcaattaaatgtgcgagagagagacgcgttacggtgcgatgatcggaaggattattgggttcaacattggaacatttatcccaacactaattgggaatggcattttcccgaggcgtcaattctttgcttttgaagttcccttcggcgcaaagaaatgccggtgacgtaccgactgcacgacgatttgttgcgatattatcggaagggcacgcggccggtgacccatcccagcaaaatcatttccgtgtccatgtccgtgttcctctaccaaatcatcaagctggacgcggtcaaaaacaccatctcattgtcgggcagtttcgaattggtgggccttttcactttttgtccatcggtgcacaaaaagaagggcgggacaaattttgacggagggggaggggacaacgtctttcatctcactctaatcgtctgatctctcgcttttctacaccctctctctgtccctctctctttttctctcattgactcgcccgggttgattttataaatggtaatttgttt

SEQ ID NO: 8206 - DNA, 2098 bp, Heterodera glycines
cgccggtttcaccgtcagaaagcccacttcgttgtgctcttcccatccgtccaaagtgcgtgccgtcacacttcaaccacaaaaattgatcggatgagttggagcagttcgactcgacctgatgttcagcggtggtcggtcgaaagaaggcacttcggccaattggacgtccaaaatctgagcagagcgagccaatttgatctgcattgcttccggagcaggacaaaactccgccgccgaaactccgccaaaaaaaaaattttaaaaaattttcaatttagaaaaatctcttagaaaaatttttcttagaaaatcgaagaaaaaatgttcaaaaaaatttcaagcgattttttcaaaatttaatataaattactaagttttttcaaaaatttaaaaaaaaccgctggaaatttttttgaaagtatttttttcttcgaattctctaagaaaaaaattttcaagatttctaatgaaaattttttgctctggcggagttatgtctcggcggaatttgggcggtggagtcttagggtgcaccgcattgcttcactgtttgtgccattcttacctcaatgtacggcccgcgcgacagcggtgccgggaatcggtccgagtgccgtccaattgtttgggtctgccaccgtccgacaaaccaggccaacggctccaacattggcgggagcggaaccggaaggccttggcaaatcgtttagccaaatttgaatcaaaatttgacttttttgtcccgctgctctctgacagattccgcaagtgaacggacaattgtccaagaagaaagcggagaagggacgcgtccaaacgcagcggccctcctgaagccatcggtcgcacgaattataaatgtcctttttaaggggttaaggggggggaagagagtgagagggacgacgccggagggtaaagacgaaagaagcgaacctggcaaggccctgaaagggattcagaatcagataatcatgggatcataagcaaaaagtaatccggcaactctcgaaactaattaaaaggatccgccccccgctggtgccattcgctttataatgataattgcccgtcccaatggatcgcccttctcaggtcaagaatgtgccagaattgaatgtaggcgacactcactttggcactctgtgcccatccgtccgcttgcgcattggcaccgcgcaccgtgcggaaacggcacgcatttccccgccgggccgcagccgacgctgcttttgtcggcattgcattggtcaatcccttcagggaatcggaatttaaatggcaaaaaatgaaaaagtgcacgtgttttggagcggaggaactgagtggcggaaacgaatgacaacaaaagggaaaagagaaaggccaaccgaaaagtgccaataaaagggcggcaaaacggggggaaaggcgggggacaccgccgcaacatttttgggtccgtttgagctgacaaataaatgggcaaaattctgtggtggtgtaatttttggggggagaaacgacgaaactgagaagggagggaggaagaaccccttaacttaactccttcttcttcctcttcttcgtttccacttttttttttcactttcgatgggtcggaggagcgaaaagaaaaaaaaggaagaaaaggccctggggcgaagaaacgaaaggaaaatacggagaaaaaaggcgtaaaaggcaattgggcccaattaattaaatgcgtcggagaaaaacggacggagaaaaacaaaagccaaattggaaaaagtaataattaattaattgatcaagcaaaagggcgtgcgttggccttccttcaactgctttggtcaccaaattctgtcattttcagtattggcaagacgaatttctccagtgggacccggacacttacgacggcgccaccgaaattttcttgggtttgtttttgtcgagagtgactctcggcctttgactaattgccttttttgaccttagggccaatttttccttttcagcctcaactgacatttggatccccgaattttcgttgtattattctgtaaattttaacgacgcggtcaaatagcagtcgaacaatgatgtccgagtcaattacaccggtgag

SEQ ID NO: 8207 - DNA, 2912 bp, Heterodera glycines
  misc_feature (2893)..(2893): n is a, c, g, or t
ctttgaatgtgagttgttgatgtgacaatggcacatcaaatgaatgaaaaaatttaagatatttgaaatggaaaggtttgaccaggaaaagtcaaataaaagcgactgatcagttcacttctctgatcagacatccgatcagtgatcgatcactcataaaattgtaattgctaagactctgaaaacaccctcccacttaccactgatcactgatcgctccttcgccgccctttcccttggccaatttcccgtccttttcagccaacgctgcactcttttgcttggctcctgggcccattcaaatgactctatcaaatactcactgttttccaagaatctgtccttgatagacttctacgacaaccaagaatggcaacttgacctggtccgtccaacgcaatttggcattttgtctcttttaaatttggacattggccaagccattttaattgggccattgcttttttatttatttttcctttggcactctctcccctccttttgcttaaggctcaaagtcacatcacttcggatggctttctgtacgactatttagaccccccgctgttctgggaaatggtcgtcattgacttggtggtgggacggcaaagcttttactatgtgagttaatagcagtgccacgacatggctaattagttaattaattgtttgattaattaattaattggtttgttgttttaccacttaaggtgttcaacttggtcattcccagtgccatcataagtcagttttgtttttttgcttgccagcaccgtaccccaacccccatcaaatatacggtattggccccttttcagcgcttgtcgccgtcatcggtttccacacgccgagcacaagtggaaaaatgaggttgagagggcaaaagccgacctttaacggtcctttttgttaagagacgccaaattccgacttggcataatgacactgatgaggcgagtgaatgccacggcacccaattcaaacgaattgtcaaatgtttagcatgtccatgattttgttggccatcgtcgaagacatgcccaagttcagcatctccagcagtcgcaaggggcgtggctcattttccggcattcccctgatcggtcagtcgttttgattactcgtccatctgattctacaatcttttctctcacttttcctctgtcttcccatcaatctgtatctctcatacgctgttttctctcttcattctcctgtctgatcactcattttcctgttcaccgactgtattttccctaccgatcgttcctgaagatcagtcacctttgttgtcttcccctttctccgatatctcgcatttctatcccctcctcctccctctgagcactcattctgttctgctgatcagagtcctctattgcctccgctgatcagactctttccctcccccttttttgtacaggcctttactactttatgctgttggccatcgtcggcatgtccaccgtcacaacgtgtgacttttttctccccgccctctttctctgatcattcatttcccttttcagttcggtatgttcccaattcggtcgttccgtggtcatttcccctgtcagatgttcgtctacgtggaacggaatgtgcgcattcaccaccacgtgcccttttatttgcgttggatgattgcaattgagcggcgcaaacggaggataaggcgggcgataattggacaattaagccaggggattaatggaaattagagcaaattaatggcaaataccattgacattgcttaccgtttacatcgctttagcatggggtacagcttccgcttctccaaagccaaacggaccagagaaacacagcgccaacagaagcacaacggaggggaggacggagcaggcgaaatggtcagtaagtgggcttctcaaattcagtgcttctcctctttcctttcattggacaaaaactttccttttttttgccattctttttctcttttcccctcttttttggctatgcttttccccccttttctccccatttccctgcttttcctgcccattttccacttaggacactttgctgacttcgacccccgcgacaacggcgtgcggtcggcgtgccagccgaatgggcagcgcattgtgcggccatttgaacggatttgcgggcatcggaggctctgacagcaatttgttgcgctgcgtttcgccaacgccgtccgagcggcagcgaaacgccgaagccgaaaaaacgacggcgacgacaacgaaagtggtggcgaaaagtttgttgaggctaatgccacgaaggagtggggacggacggaaacggacgagcggaagtgcaaaaagcacgcgggagcaaaaggaggtcgaagaggtcggcgcagaggggggggggggtaattaagtaattaagggctaattgaaagggcaatgccctaattaggtaatgcataataatcatcgaaaaggcaaaaacgaaaccccaaaaatagaaactttctccgcctaatagcagcactattgtgccagtattttgtgtgccaaatattagcagaataaataaaaatttgaaaattgtcaatcaattggaaattgctttcccaatatctgctggatttgggttgtcatttggggtgcaccccaaaatctcgccgcctaaagttaaaagaagcattccgctaaaaaatcgctttgttcgcttcctagtccttttcgattgagtcaatggcaactcgtaaaacgcaactcgtttcaataaaaatttaaaaaaataaagcctaagcctaggcccaagtaagcctatgattaggcctaagcctaaagcttcatcctaagcttatgtacgaattgcctttttacgagttgccgggttatggattttttgggagagattttgggcggcagagattttgtcccatccncctgccattcgtcattcgt

SEQ ID NO: 8208 - DNA, 3770 bp, Heterodera glycines
tgaaatgtacaagtgaaatacgcgttaagaactttgtggtggaattagttggagctaaattctgccggcgtttatgtgccggtggcagtcaaagggacggacgacggcactttggcgagttgcggcaccggcggagtatacaggtgcaacattttgaggcttatttccatttgaatttgcagacttcggcacggtcaacaacgtcgaattcgcctgcacttgaaaagcacgggacaatcggccgacttcgcccagggcactttgcccattcgcttttcagaaattcattcggtcggttgcctaatttagtattttttaatttttaattgctatttttaataggtttcaattggttcgccaattgttgtggacgaacgcgaggcacttactttggacagttaccaagaaacggacttggcacgaattcggggccaatggaacgaattgctgcagcgaagggccaattatctgcaggggcaaatccaatcggtggagagaaacgaaacaattttaattggtcattcattcatttattaattacccttttttgagttgtcttccaaaacgaaaagtgaattcgaaggcgaatgtgaagaacattctctgcttcaaattggatggaattggtgagaaacaataaaacaaagtcaattagagagtccttattttaataacttttcaggtggaggaaagaaatgccattttcctcccttcgcccggcattcccggcgcacccatcgaatggcacgcgtaattcgaacgttcgaaaatttttactaaatggggggcaaaacataggtcgacaagcgaagaaaacgcttcatctgctgttggcttcgaaaggcattgtccgctcatttttctgcagggtaattaaaaggaaataattaatattgagtaatgagtaattaggtgaagaatcggacgaaaattgcaaccaaaatgtgatcgcaggactggcaaatgttctgccaatggaacggattgatgattgccaattggaaatgcctttattggagaagcgaatcgaagaggtggcgaggagcgggagggatgggcactgatcaatgatcatcgatcgattgatcaattgtgattggaaagtctatcgattttgactggaccgaatatctctctaaaattgagattctttagaatttcttggagtgcagctgtccatgggacaggtaagaatattaaacccatttgaccgaataagaggttcactctctcttatttcctctttttcgtctctccctttctctctctctccttcccctcccctcctccttcctccttatccctgcccctttttttcctctgtccctttctctctctccctccttctccttccccttcccctcccctcctccttcctccttatctctgcccctttttttcctctctccctttctctctttctcttcccctctctctctctctcttatctcctctttttcctttctctctctcttatttcctctttttcctctctctctctctctctctctttctcttcccctctctcctcttttctcattctctctcttcagttctttgctcgactgtccggcactgaacagaaactcacggccaactgaatgcgtttttctgattttaaaggtgttttttctgaaaatgttttttcttttttattatattttttagtttttattttccatttctcaccctttccacgctgaaattgtccttcgcaaacgcatttgcttgtgcattggcgaaacaaactcaaatttcgcagttggttcctcaatttggccatgggccaaaaaacaggtaaaaacaaatgttttcgatttattttaatggaaaatgatgactttaggaaatattaacaggcacgggtctttttgtggatatcgtcgcgtgcattcccaaagtacaaaaacaaatttaaaactatcaaatttctcccaattttcagtgttccgttggctttgagcgtcgcgaagagttggccaaattggctgttcaggttaatgccattgatgttatacgaattgatcaaatattcgcattcttagcatgccaccaacagcagtgatcagatggaagacggcgatttgtctttggtttcgttcggttcgtcggctttgcccggggcgctggccgattattcgccacgggacgaagccaaaagcaattacctaagcgaatacgtctccaaaacgatcagtgcggtggaatggctgatcaaagtgagtcgcccaatgatcgtccaattaatgccaattctttgcccattttattctcaaattttcatttttcagctcgaccgactcaggtgggaaaagctgtgcaaagtgccaaaattggtcggatttgcgatttgtttaggcaggaggaggcgatcagaagggcgatggccaaactaagcgcggaaagggcaccaaaggcggaaattgagggatgccgggcatcggacgggcgaatgacacgaacgatttcgctgccgacatcggtgggtgtgcaatgtttgttggttgtgccattgttggcatgccaaatgcattggccctttaaccctcgacaacattcagtttctgccacccctccatttgtccaacttcaatctgatctcttctaagcaaatttcgcctgaccatgttcagcaaggcgatggccaaaaatcaatcggtgccattcgccccttggcttacggcatttcgccaacagcaaaaccaatcgccacccctggcgatggccccctcacaaatggtcaaaagcagtcaaagtcatacggatgggttctgccagttgctccaccatcagtcacgtcccccgtgcgcttcgtccagcagttcggcttcatcttcgggctacgcgtccatgggtttgtgagaaagaatgccaatgcgaaaacattctgattttgaaatttctctcacttcctccgctcgatttggccccaatatttcctctttttaccccccccccccccttctccgccattgtcccccttttctctttaaccactctaattactctaattgtcctcaattcccattaacgctcttctcctctccgtccatgccatgtcattcgctctttctccccatttctctctctctccctcttacagtctctcctcccaccgccgtttcttctgccaatcgctccttttccgactttcgccaaattcgtccgaattcactgaatttgacaacaccacaaaaaatgatacgaccacaaaaaatgatacgaaagacaatttcgatgtcatttgtttcaccaacggacactttcgctgaacaaattgaatatgcgcagagcgaaattgccaccaccaccgccaattctccggcggcgacggcaccgcacaattcgagtcggtcatttgtcggtccatttgatcactttcggtcatttgtcagtcccccatttgatcagttcttttattttactttaatattatcaattgctcaccccctttatattttttgttttgttttgtgtttttttctatttttgtgtcatttattttcattgatttcaatgccatttcggtgtttttttattgcgtgccattcaaataaatattcgtccccctccctcccttttttgttcattttttatttttccattttttcttttcaaaatttctcttttccctccgcatagaattccttttctgtttgcacattttccttttcttcttcctccagggttttttgtcctgtgatttttgtttgtctgtttgttttagaaagtgtaatttccccttttgatgttttatttaaatattttta

SEQ ID NO: 8209 - DNA, 971 bp, Heterodera glycines
tcgaataaaaatcgatattttgaatttttcaattatgattttttgttcaaatttagattaggaaatcggaattgatcaaaataattgaaggattcgtgatcgggggccccaaaaaccccagagaataaatttttatgactatcacaaaaaaaattttgcaaaacaaaagggtccccccttttgaaaaaattttcaaaaacggccacttttacagtagcgccaaaatttttctttcaaaatccatcggttattttggcaaagaattcaccgtattctcttcggattattttatgactctccgcgacagtaccttccgttttgagttaatcaacagattgccaagagtaatttgcatattttgccatggttcactgtttccatttgcattgccatgggctgccgtatttattaaagtgcctttggcttttgttgtgccgtgccttccccgcccccggggcggatggctttcattttggatggattttgagacattcgctgtgattgaattttgaatgagtcgagtgactgactaacagctgtaaacttacagccgaccaaaatgccatagtcgacggccattggtcacacggcactttcgccgactcttgaaattttacagcgaattaaaacgagttattaccttttcataaaaataatttgctgataaaagcgacagcgaattgcgccgattgactactcaatcaatcaatgtttatttttctattcgatcaatcaatacttttccaatcgatatttacttgcctacccgatcaatcaatatgcgtctttcggtcgttttgtccccatttccgtccctccctttcccatcattaaaattccatttttgtttggttcactcattcaccatttcttttctttttatgctcatttgtcataagagaaagagagagagagagagagtcttaaatgattttttacacatttaggaaatttcgacaaaacggaaatga

SEQ ID NO: 8210 - DNA, 779 bp, Heterodera glycines
gggggcggggggggggaccgacgttccggctcgtcgtcccccctttttttttgcaggatttctcttccattttcagcaacattttctctctttccctccctcttcacttctcttcttcctttctttactctctcctcttcctctctcttccttcttcctttcttctcttcttgtagtgattagagatttgaggaagtgacgaaaacagagacaaaattcacacgcgaattgaaataattttttggtcagtaatgacgtcataaaattggccatgaattggcccaaataaaaagcgatggattggcaaagacaattaattggtcgatcgatagggcgcttttcgcttcgcgtcacaacgccaaaatggcgtaacaaaatttgaaaaagcgcatgatcaaacatcgatagggaatacattcgtagaaaagtcatactcaaagtgatacaataaagggaccgacccattggcacaaaggggcgaatggggggagggaaaggcatcattagcagtggaaactaatcaattaggcttaattaggtcctctcttttggatgagacccaaaagcggctcaatttcggtgtttggtccaacttcattttgaggggacgaaattgactttgttgctaagggcaaattggccacaaaattgaaataccatcaaaatggtgctgcacatgtgctgttgtgtcagtcgggtcgctttagcggattggcgaagcgaaaagttttaacaaatcgccaatttattgccaatttagcagggctatggaagatcaa

SEQ ID NO: 8211 - DNA, 930 bp, Heterodera glycines
  misc_feature (14)..(14): n is a, c, g, or t
  misc_feature (917)..(917): n is a, c, g, or t
tcgtttcgatctanttttgtctaacactggggtttgacccatagtgtaaccggtccgcccaaagtcccctaccccccttattccgctattctcaccttttcagtcgctccttcaataaagctaattacctaattaagctttttctttttgctttagttctgtacacaattcaattccgaaagttctttaaccatttttgcacctcaattctgcgaaaacactttttgatgacgcagaatgcttcagctggaattgcttcggaattggttttgaatagaaatgcttcaagatttatttcggtagcgcagcgaacactcctttctctttactaacgtctcttttcatctgtttcagtcactgctcaaaattccaaccgttaaaatccgcgacacaaaatcagtcgagcacaaagttgctgaaatttcaaggacaggttacgacaaactcattgtgagtcttacaattagtcagcttttctttgtaacgagctaaatttaggtaatctcagattttgactacactttgagtcgctatcacagaaatggcgaacattgcaagacaacgcatggaatatttagtggagtttgcgttaacgaaaagaatttggagttttatgagaaggcgcatgttttggaaacaaagtaaataaaaatgaaaattttatatttcttataaaattatgtttttttaaattaaggtataaacccattgagttctgtccaacaatgccaatgtgcgacaaaatgtttgtttatctgcctttttcattctgttaaaattttttgtttacttgtttcaaatgcggaattttcatttagtcctttcatggaattgtggtggaaggaatctcatcgactgattgttcaggttcttgcttttataattttttttttgttgtaatatgtagtaataaaatnttcgggggggggg

SEQ ID NO: 8212 - DNA, 1452 bp, Heterodera glycines
ttcggttcgtaattcgagaattcatcttctttaatttttaattcttattttttgcaaatgttttgttttgagtgaccgttgcattgaattcctcaactttctcgacctccaaagagtccctctgattatgtttagtgctggcattggttgttattttttgccagatttttacattctccaattttaaggtgatatcattgagtttgtgttcgaagcagcggatggtcaaaagccgacaatggccaatgtgcaccttatctccaatatgatgcaatttgatgaaaacgaagtgtgcatcggctttagagaaccgctcatccacactttcaacaagaaccaaactgtgatcaaacaggaggcgcccttcttccacaaattggcggaccgtaacgcagtgctgctattgggagacagtttgggaggtgggtgaacgaatagatgagcaggtcaacgctgggtaatagtgccgatgggaccccccccccccacctttttcgaaaaatgacttttttgattacggattgtattagggattttaagggtcggagaatccaatacaatctttgtaccagagccgcaaataggaatgaatttatagattcgtttattgtacaaaaaatcaatggatatttgtttaataggctgaatctctgataaaattcccttttactagtaaatgtttttcctttttaaattcaagatgttcgaatggatgttggtgttgaaaatgagtcggtggtactcaaaatcggatttgtaagtgctcattcaccgccacaacttttcatcccttttcttcgattagctcaactttgattccgacaatttgctcgaacggtatttggacgactatgacattgtgcttgttgatgaccaaactatggacgttccattattcattttggaacacatcaaacataaatcagcccattgaatttatcaacaaaacaatagccattttgttgttttcacagtctttggttttgactattagcacggattatttgccaaaatttctgtctatagtgaatgtttcttctgtttatcctttttattgtaaaatataaaatacattttatgtccttttgtctctttgcattttgtgttatttccatttgctaatttactcttaaaaatttttatcaaatttttatcgctcgcttttaatcattttgtgtagtaattatttgtaggcctttgcgatgaaagtcatcaacgagtttggctatcgtcaagatgcccgaacacccagccaaatccgcaacattgactatcaaatgggagtttactcacatgcagacggctccgcttacattgagcagggcgagacgaaggtgggcggtcaaaaagttttatttagtttgtatgaattttctgtcgattgaccattttttcatgttttgctttttcctccattcgctacatttcccctctgctgaaggatctttgtgc

SEQ ID NO: 8213 - DNA, 3474 bp, Heterodera glycines
  misc_feature (9)..(9): n is a, c, g, or t
acggattgntattagggattttaagggtcggagaatccaatacaatctttgtaccagagccgcaaatagggatgaatttatagattcgtttattgtacaaaaaatcaatggatatttgtttaataggctgaatctctgataaaattcccttttaaatgtttttcctttttaaattcaagatgttcgaatggatgttggtgttgaaaatgagtcggtggtactcaaaatcggatttgtaagtgctcattcaccgccacaacttttcatcccttttcttcgattagctcaactttgattccgacaatttgctcgaacggtatttggacgactatgacattgtgcttgttgatgaccaaactatggacgttccattattcattttggaacacatcaaacataaatcagcccattgaatttatcaacaaaacaatagccattttgttgttttcacagtctttggttttgactattagcacggattatttgccaaaatttctgtctatagtgaatgtttcttctgtttatcctttttattgtaaaatataaaatacattttatgtccttttgtctctttgcattttgtgttatttccatttgctaatttactcttaaaaatttttatcaaatttttatcgctcgcttttaatcattttgtgtagtaattatttgtaggcctttgcgatgaaagtcatcaacgagtttggctatcgtcaagatgcccgaacacccagccaaatccgcaacattgtctatcaaatgggagtttactcacacgcggacggctccgcttacattgagcaaggcgagacgaaggtgggcggtcaaagttttttttaagtttgtatgaattttctgtcgattggccattttttaatgttttgctttttccttcattcgctacatttcccctctgctgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacacatttatatcctcgaagtcaaattgatatattcttcgaactccttgaggcaataatttgctttttacattttgatgctttattttttaattttaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggtgagtaaatcaggagactttataatgagaagttggggggggggggacatggcgaggggagggaaaagaggaaaattaagcgaatgactaattgtaagcactgaaatcatgtcatatgtttaggaggtaaagacgaaattgttcttatggacatgaaaaacctactccacaaaaatcatttgccgtctttgttacaaatgggcgtcaatgcgtgtgcccaagtacacatttgtctggagacagctgtttttagagtaaattataagcacatttgagggttgtttatccattttaattgcagcatgtcgaagcatcgcatcggaaaaacacagaaagtggaaaacaaaattcgcttttgaacagaattgttgaaggtcgctaatcacagatttaatttgttggattaataaattcatatttttgcattgaaatatatttgtttttaatcgatttccatttgtcttttatttttccaattcattttatgtattctttcttaaaaagttcatcactagttgatgctgttaattcctcggagtgtgcgttgtttttatggcggtttgttggatgtttcgtcactaaatgtggggaatgccacgcggatggaattgttacgaatgtaatttgctgaagccataaaaattaatttgttttgcttggaaagtacaaagttccttttagcgctttttccacgccattcgccgtttcccattgttttttgtcggtttcgtccgtccgctgccttcaaacatttgaaaagcgtcagcaaagccaaattgagagggaagcgtccgaactttccaaattcattgactccctatgcaatccgaacgcatttaagaggcgtcctgatgcactctttgctcccgtctgcgctttcatatttcttatggtacaatcagttccatttagaaacgcattggaggaatggatgtcgcggctgtcagctttttggattcgttgaatctaaccgaggaaaacatttcgaaggaggccatctcgcgattcagcaaagaggtcgcttttttaaaaaatttctcgactgatttgcagtttttttaaaattttttcattttcttttctcatacgaaattttcaatcatttttaggtttacaaaatgtccgctattcaactttctcagctgttgaaagcgactagcaaccgcaaaattgagcaccccgtgttgatcaaccacatttgcaccgcactgaaagagtaaaaattcatttaaaacattcaaagaaaatcccccactaagtcaagaacgaatctcgtaatattaatatgttcaatgtgcccaattgaatcattttgggattgctactagtacaatataaaatgtgattgtgagagactttggatattgtctcaatgtctttcaaaaatgccctcctaaaatccgttcctccattcagccgtcctttgcctccgtctctccgccacatttgtcaaattgctttttacttgtccaaacattcgttcctcgataagccgcttctcaacagaatcaaagaggattttttggtttatgtccgaaatgaaatcatctcgaaaacatctttttcacacattgtgatcgccttcggtcttcccttttttctttctttttttattttcaaatttcagctttttttcgtctgactgatcgacatttttggcaacaaataatccaaatcatcgaaacactggcgaatcgccctgaatagtgggtttaataattgtttgtttcaatcatcgctttaaaaagaaaaggccaaaattctatctttcatacttttttaatttaataagaatttcgtatgctatgatttggacgatccaatgttttgattgttaggaaagcaaaaaaatatttggtcatttttatttcaaaatctattaagaaaccaaatcaaaatttatccggcggcgcctttctgcaccaccgagcgcatttccaacaaaaatttaaatagttcataaattgcttgtttttacgcttgcgttgccccctcccttcctctgttatgttcttttctttagttcaactgctctgattgaatgcgttaattcgttggctgtggtaaatgttcatccgaaa

SEQ ID NO: 8214 - DNA, 820 bp, Heterodera glycines
  misc_feature (792)..(792): n is a, c, g, or t
  misc_feature (816)..(816): n is a, c, g, or t
cccccccccccccccccgctgatttacgcctcgcccccgcccattgtccgaccttgacaaggaatgccctcctctttcagtccttctcgttggtccgtgacattaaacgtggtgagcaaaagcatcacccattgttggaacgctttgaactgatgcttcgcttggtggttccgctcaattcccacagcactccccaggaatggtcagttccgccgatttttatttaaattgaactctatcaaaatttaggcataaaactggcgcttttctggaaggccgttgctttgtggacacggcacaacgccaactcatccctttgagagatgtcaacggaaatgcaaatgtccgtgaagttgcagtgattcttcttatggacagacacttcacccaacgcattggtccctccgagaagggccccgaccgaccgaccggcatcaatcagatgtgggaacatggcggactaagtcgggactggtgactctgtcccgttttcttccaggaacattcgtcatttaaaattggctgggatccatccgattgtattcaccgaacggcacttccgcaaactcggcgacgatgaacgatctcaaataaaatttattcgagagaagatcctttccttatcggaggaatttcacaccaacgaatggacggaagagaataacagttaaagtatgggcttaacttacgaattgtattcttggcaattattgatttgtttgtgtgatttattcccaaaaaataggaattctttttggaaattcattttttaaatgtgctgtctttttccancgggttggtaccgattctcacaanagat

SEQ ID NO: 8215 - DNA, 2107 bp, Heterodera glycines
atatatttttgtcacttactctatgacatttatctgaatagtcgtcagagtaagtggttctcgcccttctgatgacttttttattttttatgaataaacaatacagtaaaatggcacaattaactcaattataaactcattttctggcgactctcttctagcgctaattagtccttagttatatttttagcattaattagtcttaattatacacttttgtctcgagcttccggcccacaattcttcgagagggttaagcccttgaaaaaatttttaatcccccgtaattacgaccttgtttgatttttctcatttcatttttaaaggtatcaataatttcaaaattttccataaactcggttaatttttgtacatttttaggaattagccgttctctttatctaagcccacctacccaattgtttttttttattaattttcgcaaattaatttttaattatataattgatgtcgagaatttaattaacttttcccaaatatgttcacattcacaatccttcctagttcaacaaacacttcacgacttttacttgtttgttctattctctttctctccctgctcttttccttttcattcatatccattttaattgatcaaaccaattaattcattaattattgctaattatccccacccctctccatttttcctcaaatttctcccattacgcattcatttggagatttggaaatgcattttcaaacagaacacacaacatattcattttatgtttttatttcatatgtgtattgactgtgaatttgaatgattaaatacaaaaaaaattgaagtaaaaaaataataaatttgtcggaaattaaaaaaaattaatttgcttgaaaatccattaaattttaaaatcacccatgaattttaatcattaagtatcggatttgaatagaattcatggttatttagcctttttcaaaaattgaatctttaataaattctcaaaaatttgaaactatttttgagaattttaagtccaaataaataacagtcagtaaattcgttccataaaatccaagtttagtgggtggaacaaatatccttgattaaatcactttctgagacccctgatcgaattgttatttcacgagtcagtaaattttaaatgaaaattttgttaaattatggattttaactagataattttcacatttgaaagagttttgaagattttctatggttttaaacggtacttcaactaatttactgtaaaccaaagactaaaaatttaaagaaaaagcaaatgtttgggggctaaacattgctgttgtcaatcatttggctatactgaaaagtgatctataaagcaaattgatcatttgtgcttctcgacaagcaaaaaaaaagtggggaatggggacttcgagactggcagtgactggcggtggtacactctcgacgaacaagcggatttttacagatttgtcagtcagataaagcccaggaggagagagagagattaagcctttttcaaaacattcgaactttctcccaaaaatatggcccatttttcgtttctgaaaagtgagaaatttagctatatgtatgtaattaaattttgtttagatttttgtcaattttattaaaaaatgtttcctggaacttttattaaatttaaccctttctataattaataaaatcgcaccaaattttacaggcaaaatatatttaaaaaaaaaattacttttggtcgatcacttttaatgccgatcaatcgcttttgatttaagttcactgacacacattttttttatctgaccgcttttccttgaacaattttcgatcactaaccaaccattattgattgatcgcatttccactaatcagtcgtcacatttgattaaagttcaatcattcatttattgatcagaccgattctccttgattaaattttcgatcgccaacaaaccaaatattgattgatcgcatttccactaatcagtcgtcacatttgattaaagttcaatcattcatttattgatcagaccgattctccttgattaaattttcgatcgccaacaaaccaaatattgattgatcgcattccactaatcagtcgtcacatttgattaaagt

SEQ ID NO: 8216 - DNA, 2087 bp, Heterodera glycines
gctctctcatctgtttcctctgcttctttgtatcctcctattttctctcatccccctcttttctcttcctttcctcaatatctctctttgtctgttgtctctctcaattcatatgcacatatcaaccgctctttttctcttcttatactggttctttctctttacatatatatatactcatgtctctctctattcgtttatctttttcccttttcttcctgcttctcattatccttttaatctctttacgtctgtctccaactttccctctttcctttcttccttcctctctccactttctttttttctcctttctcactcccctcttttcctctactctttcccacttttctttttttccccaactctctccgtctcactctctctctctctctctccccattttatatcaattaacataaaatatttacagaagcaaaaagctaaccaactataaagctttttctgtctagcagtcaattagttacacatatgtctctatgcctcctcctttcccccactattttgtttcaattaaaaaaacgctctctctctctgccagcgaatgcttttggttgccatttgtgcgaaatgtgcctcgggggatgtcggctaaattttttaaaaattcaattcaaaaatgtttgtttggattccttttcattttcatcccttaatttattcaataattttccattcaattatatttctattaatttttattttaaaacatccaaaattaatggaaaatttttccattttatttttattatttaaaaaaaaatcaatttaaaaaaagaaattcagagggcgaagcggcttggtttgaattttgccctattattaagcggtgatattttcgtctttttgggggggggggggtgggtcagtgccgggtttttgtcctgtttttgcaagtgtcgggttttttttttaaattttttgctgggctgtcccaattttttaaacttaattttaaaattggtaaattttttcagaaattttcaagaaatccgttttttttttgcgtgttgatcaaatttttaaaataaatttaataaaatatttttcaaacaaataattaagcttcctaaacaaaacatttgttttttcttctcccttcaattcaaactcattaaaattgattctttttgctgtcaatcaaatttcattttgtcacccacctaataggttaactttttatcaaattgtttaaattacatttggttcacttaaatttaattgccctcttaattgatgtttccgtttctttaaaattttttcgaaaaaataaaaaataaatttcaattattttttggcagttttcctttattaaatgtattatttgtactgctcgaaatgcctcagccctcagctccaccactgagcgaactgattcagcttcaaacagtcaatcaccacaataaggcagctccaacggcggaagtctgaattatttctgtactaaaacaattttggtttcaattttcaattttaattatatatttttttaattttagatgaagcacaattaccatgatggcacttccaatgcgtacgcgtcatcccctgtgccgacaattagcacatgttcagcaccaccaccaccaccaccaccggcggtgccaatgtcgtacatgaacccgaaacagcataaacattatcaatgttatcagcagcaacaggaaccacttatgggtacaaaaaaaaataaatatttaaaattaaaaatgcactaaaatttttgtgcccaaattgtttcttgcttttcaagacaggctcaaacataagaaatgcccttgttttcaaggatgcccttgaaaaacgtagcattttttggccaaagctcgacacagattttggaaattaaaaaatgatttactgtattaaattaaagatggctacggttatgccgtcccagtggtgccaatgccaaacaatgatcataacaatatgaggagcttttgtgccgcattatgtcgttgccatttgaaaaatgtgagcatgttctgcattgcattcgtggaattttgcatttctggtcagttccagaaagcattcattcattgatcagaagtgaagctgat

SEQ ID NO: 8217 - DNA, 854 bp, Heterodera glycines
  misc_feature (160)..(160): n is a, c, g, or t
cagtgaccagtttggttggcattgttgccgcaaaaattggcacaccgacgccatggcacgtggccaatttggtgctttcgttggtctccattttgttgtgcattggttgcgcaataatctcgcacaggtgccagccgggaaaacagctcgttcccccccncccccctccgcccaatctttttaaaatttcaaacagaaatttttcattaaaaaattttagaaaaaaatttaaataaatattttaaaaatttttctggcgattttcaaaaaattttatgatgaaattacttcaaaaaattttaacactgaaaatttttttgtttattttttcttaatttttttttaatcgtcgccaaatatgtacttaattctgcatccttgatccatgtcaagggcgtccttggaaatttgcgtcttacttactctagcatcttaactgcctgtacaccaaataccgatgtcttagacttctcccaacccataatttcaaaaaaatgtgccataatttgcaggaactggcaattgaccggcctttacaaaggcattcataatccaatctcgcgccgtgaccgttactattgcttgattggtgaatatgacatggaccggatgaagcacagtcaaaagcagcacaaagcgtatttcaatgaggcagggtttttattgcgatgttaaaattgaaaaaaagagatttctgatcaaattgtttcaaaatttttctaatcactttgtcagggtttttggggtattaaatttaaaaaagaaacttttgatctaattctttccaaatttttctaatgtctaatcactttagcaggctttttgggaattgaaaataataaaataaagacatt

SEQ ID NO: 8218 - DNA, 3253 bp, Heterodera glycines
aaataaagaagaagaaaaatagaagaaaacaaaccctttttaagtgaaattctatttttcattaaaaaccagaaaaaaaaatttcaagtaatttcattaaaaaagcttttttttattattaaaaaaaaatatttctcaaaattataaagggtagagaaagtgatgaaggttagttgaataattaaatgttcaaaaataaaaatgaaaatttttaatcatttcacaatagaggtaaaaaatcaaatttttaattatacaaataaaaaactctaatgacaaaaaatattcacttttccaatttttattttgcgattttgcacccttttaaaaaattaaaaagtgaattttaaaatgaaaaagaataattaaatattttcatttaaattattatgcaatgaaagaaaatcaaagcaaaattattaacaatgaagcaaatactaaatgtattgaaatttcgacaacatcgcccgaaaaggaaagaaaagaaagagggaagaactggaacatgtaatataatttcaataaacgaaaaataataatttattaaacataattaatgattaattatttagcaagaaaataatattttgtagaacaattaataaacttttataaggaaatcaaattaaatgagatgagaaataaattggatgggcatcagagcatgtaataaaatgcaaatatttaataaattaattacacaaaaaaataaaaattgtaaattaaaaaaaataaaatgcactcactaaaagaggttaccaaaaaaagaagagtggtgtggacaaggaaaagaatgttattatttctataattaaacgaaaaaatgataattttattcaaacttaataatcagcatataaaagttcaactggtcagaaagccatgaaattatgctgtaaaaaagaaataaatattctaacaattaaaaatgtaatttattttcaatttttgtaacaataattaaatgaatattgaatttttgttgagatttatagattcaaatcaaagaattaaaaaaagtatcgtcataaaaattaagagttattggaaatgatgaatttaaaattgaaattttattatttttaattaaattaaaattcagacaaaaaaataataagtgagcaaacattaatttttttaaaagtttttaaattttttgaaaaaatcaactctaaaaactcattataagtgctgttatttttaatttataatattaaattaaaaataattcgcaatagaaatatatttattagaaatatttacgaaaatgtgttcctaaaatgattcactttttgtttttactcaagttcaaaacaaaaaaatttgtaaatgacaaaaaaataacaaaataataactatttctaataatacaaacacaaataaaaaaaattaaatttaaaaatgataaaaagtttaaataaatattaaaaatgcataaatacaaacgaaaaaaaacaataatattaattattcattttgcaaaaaaaatatttcaacaaaaaattaagcttaatcaatgcgcatcagttacaaaaataaaaataaaacttattatattatatgaataataataaaaactaaagcaaatcactacaataatttaagcaaatttaatagccttaaataataaaataaactgaaaaagattcccgtataaaaatatttgattatattacgaaaaaatggattataattactaaaaaatattataaaattaaaaagagaaaaacttttatcaaatttctcgccctttgagaacaaaaacagtgttgcgggggacatgaaacattctcaaataaaagagaaaaaatgcagcgaaaaattgtttatacaaaaatttaaaaacaaaaagttgatttaatggttaattatcataaatagggttataagttgtatgcttttgcatattttttctgcgcatatgctatgaagaaaggggctcaaaaatagcatttctgcgttaaaattttttgatttggtgaaggtttttagtgcatataaaagcatattttgggggtttcgagaataaatgcatatttggccatttttgcgtttttgagagcatatttcggtcatttttggcattttttaaaaagttaaaagccaattttgacagtttttaaggcatattttagtgcatatttgggcatttttagggtttttagggcatatttgggggatttttagtgcatattttatgcgcatattttgcatttttttagtgcatacaacttataaccctaatcataaataataaaataattaggtaatagaataatttttaaatcaaaaagaaatattttactcaattcaaataaaataattatttatatgacctttttaaattaatttgtacataattaaaatattaacatttataaataaaacttattattagtgatgtaaattctatgtaaattcttaattttttttcatggatttccccatggtctaattagtaggaaaaacattttctttttttgttgtagaaaaggtagcactataaagttgaagttgaattagtgctaataaaaacttgctggcgttatgtctttgtcaaataaaaaaacagcaaaaaatgatgattttttcatttatattatttttccattttttcttcaataaacagaattttgcaccttttttgccaccttttaagcctaataattaacaaatagcacgacaatttaaagagttgcaaaatgaccgcctctttgcaacaaattcgagcccaacccggctggacggtttggacttttaacttacaaattctcattgttttcattagggttgcgaccccgacatcggggttggaaaattaggggttcggggtgaaaattccccgactaaatttgttggggttggctggagaaatttaaaaatgtcgggggctttcataaaaagtcggaaataggaaaaagaaaaagttcctgaacacaaaagtcataaaaactcaaaatcgggggcattggaaacgaaaatcataaaatgtttatttataaaaggagtaattatggctaaatgctgcaattttcaggcggacaaatgcaaagagcaaattgaggtggccaagagcgagaatcggacattccaacgccaaacgctgcaggcgcatctggtccatttgctgaacaaagagcacaaattcaacgaggccatccaattgggtacggacggacgtacgaaaaaccgaaatggatgcaaaatcatttttttggggattaaacaatttttcatcgaaattcccatttaa

SEQ ID NO: 8219 - DNA, 2319 bp, Heterodera glycines
tttttcccgccataagagcttagcctttgtacaactaaagtgcaatagaggcaaaaaagtctcttaattttgataagaatgtgttgacaaacgaaaaaaaattcaaaatttttgtctgttttgtaaactcaaaaaccccgtttatttttttttcttaatttgtttattttgtccattttcagctgctcaacttgtgcgcgagctgaagaaggtggacgacaaggatttgctggtcgatgtgcaattggaggagagcattgtgcgtttttgtgcccttccgttggttaatccttcgccctgaaatttagacaatcctaaataaaagttccatttccgagtccaccggtgaagcaccacctgagtaaatttttgaaaaaatttcactaattccaatgaatttggtgttaatgtctccaaatttttaatgatttacccaatttcttgtcccaatgccatggggatgactgtgaaatcgctttctttcaaattcatttatttgttggcttttcagggcttttaccatctgtccaactacacaaaggcacgtgccgagttggtcaggtggacaatgcaattcgttttttttttgcatcacaattttcagcgcacggactatcgccaacaccaaatacactccgcccgccatgcaggtactgaactgactgacaaagggcgaacggagtcaaccgcctgtttttttttgctcaaaatcatattcccaatgaacatttaggggtcaaatttttaaaaataatagtggatttatttcttccgttgttgtctattggctacaacttcaaaaaatgccattttctctgcgcttttaaatttttcattctcacagtgcctaaacaggtcaaccgcaatctcttgacacaataatttcaatgagtaatttaattggtaaattttttccaaagattcatttatgttggtcagacgattgaatgttcgagtccgtaaattgcgggacacaaccccccccccccggtcaaaattaatattttggtcccccttttcatttcgctcgttccttgtcctaatgtttgttccacttcattcgtccttccccccccccctccctctcccattttttgttggtcttttaaattacaattccccaaaaggcccgtctcgacctccaatcgggcattttgcacgcggccgacgaccgcgacttcaagacggcctactcctacttcttcgaggcgttccaggcgttcgactcggtcaatgagtcggcgctcgcgcagcaggcgctgaagtacatgttgctgagcaaggcaagcgaaggcggcagcaaagaaatgattcaaaaagaaattcccaaaaagtttaggttttaaattcacaaatcgattttctttaatcgaataaattcgggcgagcggagagcgaattttcaataataatggggaagggtactacttttttttaaactattttgaattgcaggtgatgttggaccagtcggacgaagtgcactccatcatgacgggcaaaacggcacaaaaatatgccaaaacggagacggaggcaatgcacgccatcgcagaggcggccaaaaagcggtcactggccgagttcaacgaagtgtgcaatggggcgggggaaaaggcaatttagtgggaatttggccaacttttggattcttttctttgtaaacatttctcgaccggcgtttctcatcactcaaaaagggcggacacgaattccacaattttttcttcccaaaattttggtgaaaaaaccatccaatgaaaaaaaatgattcataatgttgctcaaaagtaaccaattttttttaattcttgatatcatttgataaacctaaatgttctctgttggtctgtcaaatttcaaagtttcgtcaattttctactggaaatgtatggcgagaagaactgaaacttaacgaaaattttgtaaatttacaaagctaatagtgagcatttagacttatcgaatttgattgtttttgatttcctaacgccaatttttggctgattgtgagatttgttttttatttgccaaaattttatcttcaaaactttgattttctctcccttttctctacaattgcaaaatgtgtcctttttctttgtccaaggccttcgacaagtacaaggacgtgctgggccaagacccggtggtgaagcagcacttcggcatcattcaggacacaatgttcgagaaggagctgtcccggctcatccagccctactcgtgtgtgcaggtggagtgccacgggggagagaaacggcaccaattgggaggaaatgttggcattttcaggtggaacacatcgccaaatgtgtg

SEQ ID NO: 8220 - DNA, 978 bp, Heterodera glycines
atcatgacgggcaaaacggcacaaaaatatgccaaacggagacggaggcaatgcacgccatcgcagaggcgccaagaagcggtcactggccgagttcaacgaagtgtgcaatggatgaaatgggaaaagcctctcgttacgctcgaaccaacggactgacacaaaagggggcagctcatttccccccgaaatttttttttactttactaacttagaatttttcaagaaaaatcttattgttagaaagttttttcataaaaaaaattctatgaaaacaaatttcgagaaattttcagcgattttttagaaaattttttcaaaaatcagtaattcaccgtaaaaatttcttgagaatttttttccttagaatttttcttttgaaaaactttctaattgtaggatttttttcttgaaaattttttaataactttgctcaagaataaccaaatttcaaaaatcttgattcgaatttgataatttttgagtaacatcctaacgctaaaaaactttttcgagatgaccgaggggctaatgaaatgcaccgtcgattttgtcttcctcaaattgcacaaatgtgtcctttttctttgtccaaggccttcgacaagtacaaggacgtgctgggccaagacccggtggtgaagcagcacttcggcatcattcaggacacaatgttcgagaaggagctgtcccggctcatccagccctactcgtgtgtgcaggtggagtgccacgggggagagaaacggcaccaattgggaggacattttggcattttcaggtggaacacatcgccaaatgtgtgggcctcgaccgggagagggttgagcgacggctcagccaaatgctgctggacaagaagttctcgggtattcttttcggcgggcacttttacaataattggtgctgggctctagggacggtcccaggatttcggattgggggggttacctccccccgggcgactacctttttttt

SEQ ID NO: 8221 - DNA, 2424 bp, Heterodera glycines
  misc_feature (2296)..(2296): n is a, c, g, or t
aattacgtttgccaatttcaatgccaaattcccttttccattttattaatgtatatccagcaatgcccaactcttccgcaaattgtttctgttttccatttttggacattcttccaaaaatcatcaattcgttcaataaattcttgctttttctgtttataaaatttattttcataaacaaattcaaattctttgttccatttataaattttcggtcgacaaattcccaatttttcggctattttttgttcaattttattccgaacttttctctctaatttccgtcttttaataattccttcttttattgcatgaaatttatgaataatttcaagtttttgctgatcattgtatttgtcaatctgaacattgcgatttgaatgtgccaaatttaaatcattttgatcatttgggtgacagtttgcattttgctcagtttcccatccttggccaaatatttcagcaaaaatgggcagaagttttccattcttttcacaaaaattattaactgataaagttttgtttaatgaattgattatgaataataacataaaatttaatttataaaattccattttcttaagaatattataattttttctttattattttcttatataaatttgctgaattttctttcaaataattcatcaattttcattcataataaaatcaataaaaaagattttgattaatatttttatgcagatttgataatttttattaatgcaaaaaaataattggtgaagattttaaattttcaataaaaataactacttggagcggaattaattcatcagaaaattatgaaattttatttcctttaaaatttaaacgaaatttttttatggcataaatttttagctcttcgattccaatttcagtaattgcataatattgtttaaataagaggtttggcttaactgtgagaattgcgtcttctcgactcaaatattagaacaaaaagtccaaaatatttcggcaatctttgtcatatttttcaaatttctctcttattttgttgcattgccaattcttcgcataaaacacacaatgcaaaggtatgcctcatatttttccattgaatattcaataattatggtttcatgattccttttcataaatgcaattagcattttgtcgtcaaactaattaaaattcttttttttctagttacgggcctgcccctaaattatcctgcatttttttaattaactcctagaaattggaaatttttgctgcccaattttcgtgcttttttgtcgtttttgtaattttttatgtcttttttcatatttttcgtgcctattttaggtgcttatttgaaacattttcgtgcctaaaagttcgggccctagttcatacttaacaaatctaaagagtgtttgctaggtaaattattcgttttcgcgtccgccaattcaagtccaaattttccgatttgactaataaacgactgattccaaagatcactcaatattacaaaatccctgaattttcgaaaaatatcacttcggcttcctcaaaacacataattatgccaaatgatagcgaacatttaaaatcgaaaaacaaagcaaaaaataaataaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatggcattcagtttggcaaaatgcgcatcaattctttgctgtgcagttttgctcgctgttatcatttgtttttccaacaaaaatttgtacaacatttgtataaatgcgatgattttaccgtataaacacagtaatttttcatgcaaaaatattaaaattaaataaaaaattattattatattatttatgaatgaatttttgtaacatgtttttcatttactattttaggactaaagcacagtttggcgatgtgcccaataaaataggagtcgaaagatcgccataatacgaatggtaggccggttttcgggatcgggttatggggatggtatgttggcatttggggtccgactaaaaagtcgagggtttcggggtgccaacacttatccaatgcttataaaattgcctctgtttctatattttccaactaacaaataagtttttttggctttgatttatttaattcttagttttttgtttaatatatttattttatagtcaattatttctgtgttcatttacttgtttaacatttctngtccgaacacagctctgagcaaatatttccaattctgaggaaattttggccaattaattgctcaagcaatttataagtgaattagaggtcatttgcattaaaagggcgagtaatttctagcggatttt

SEQ ID NO: 8222 - DNA, 2189 bp, Heterodera glycines
ccaaagatcactcaatattacaaaatccctgaattttcgaaaaatatcacttcggcttcctcaaaacacataattatgccaaatgatagcgaacatttaaaatcgaaaaacaaagcaaaaaataaataaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatggcattcattttggcaaaatgcgcatcaattctttgctgtgcagttttgctcgctgttatcatttgtttttccaacaaaaatttgtacaacatttgtataaatgcgatgattttaccgtataaacacagtaatttttcatgcaaaaatattaaaattaaataaaaaattattatattatttatgaatgaatttttgtaacatgtttttcatttactattttaggactaaagcacagtttggcgatgtgcccaataaaataggagtcgaaagatcgccataatacgaatggtaggccggttttcgggatcgggttatggggatggtatgttgtcattcggggtccgactaaaaagtcgagggtttcggggtgccaacacttatccaatgcttataaaattgcctctgtttctatattttccaactaacaaataagtttttttggctttgatttatttaattcttagttttttgtttatatatttgttttatagtcaattatttctgtgttcatttacttgtttaacacttctgttccgaacacagctctgagcaaaatatttccaattctgaggaaatttttggccaattaattgctcaaagcaattataaagtgaaattaggaggtcatttgcatcagaagacggagtaatttctagcggattttctgttgtgaaaaaattttgcaaatttttttcaattccgtccaattttccttctaattttgagtcaatttccagcaaaatttcctgtaaatctttgatcaattcattgttcggcgtgtcaatttttgatcaaatttaatttcgtaaatttctaaattgtgaatttatacatttaaaaattattttgtattaatacctttatttgcaccatcaacagatttgaaacaattaaccgaagtaacacttttaagaaaatgaaaaagaaataaaattttataaaaataaatttcatcattttacgaggcgttggataaatttgtattatttttttttcaaaaaggctaaaataataatgaaaaaaatttattatatgaaaaaagtaatagacatcaattattatatttattattttgataatcaattattgatttgggatgaatggagagaaaaataataaaacattcattgattttcacattatacgttattaggactggatttttaggcataaaaaatcgcgaaaaaggaggcagaaaaaaatcgtaaataagcattaaataggcaaaaaaatttttattaacgcttcttaggtagtaaaacacgtaaaaacttaatcaaaacacttaatcttggttatatttcaattgtaaattaaatttttaaatattttatgagtttagttcgaatacggacaaattttaaatcaaaaacttttcaacaaaaaacaataattattatatcgatcaatttttgagaaaattttttaattcttaggggtgtatttttgaattttcgcgggtcatttcttaggggtgtatgttttctttttattgcatttttattattgtttattcaaaaatcctgaaaataggcaaaaatagggattgtaaaagtcatcatagacaccccaaaccaagcggaaatttaatgctgtaaattgaattcagctgtcataaataattctcacggttcattcaaaaaataatgcaaattaattaaagaaaaaggtgaaaattgggaaacccaaaaatattacaaaaatgaaaattaaatagacaaattaagaaactttaagacaatatgcactcttcatcttaactcttcagtttaaactgtagccaatttgtccgattatttgcgccaagatcattctatctttttttctgttttaaatcttaatatttcaaattttcaatcactctaaatttatattttttcatatcaatca

SEQ ID NO: 8223 - DNA, 1356 bp, Heterodera glycines
agttccttaattagcccataattgggtcaattaagggaaattttaaattgtgactctctggaaatgaaatgaaataagaccccaagattttctttttgttgtcaaaagagtagtcattaaattcattcttcaaaaaagtattaccgagttcgcggcattggaacaagattcgccggcatttggagagccggtgacactcgaggagttggtggcattggaagatgggtcggcagcattgggagaagcgacggcacccgaaggagattcggcattttccggcgtcttctgtccattggaatttggggaagagttcggcgtgggagaggttatgttcggtggttcggtctcctgctcaatctgaagtttgaggaaatataaaaaaaatttgattttaaaatttgtttaaacttgccgaggtcaaaacgtcgtaaagatgcagcattaattcgtcccaattgtacagaggaccgtaaaatgtaacaatggcggcgtcccattgctgaaaaaagtttagtgttgttaatgataggaattccattttaagttattagaatagcacagacttacaacttggggtagctgataaaacacaaatccacatccaaagtattgttcaatccgagcagttctttcctgcgtgaaatgaccgcggaccaattcacgctgaaattttgtggttaaaattaaggtggggtttagaaatcctgcgaaaacttgtcacaattccgaagtcccggccccaaaaaatcaaaaattcattttcgaaaaaacataaaccgaaaaattgagaccggtaaaaaaaatttccgggaacgggatcggcgggagttcaaaattttccgggacgggagtcccgtacgggaatccgtaaaaatcccgctcccgttaaaatcccgtccatttttaacgggagtcccgggcgggagcgggagtaattcgaaaatttaattaaaaacacaaaaatatttttaatgcacaaatttgaaggacaattaatttattaattaaaaatatatagaaaaatttagtaaggagaaatttgaaatgaaaaaatcttatttttgggtcgaaaatcagaatttttttttcaaattgcttaaataaattcgacttcctttattatatttaacagattttcgataaaaatcattatttttacaaactcaattcttaccagtgcagtttactccagttttttgggtaaaaatttccgggagcgggatcgggagttcaaaattttccgggacgggagtccctaacgggaatcccgtaaaaatcccgttcaccgaaaaaagcgggagtcgggagcgggactcccgtaaaatcccgcggaagtcctgatcccgccggtctcta

SEQ ID NO: 8224 - DNA, 5161 bp, Heterodera glycines
atcatataattttttgtcatttcgttttaattgcttaaatcccttcaaatttaatccttttttttctgtttgagtgtacggcgcggacggagaacaacagcggcattttcttcccgattttcacccaattcacaaattttgtattgggtcaaatactttttggtgattcctcctaaatccaaattcatccgttaatccgtcgcttttctgaccaaagtccgttttcccaatggttttgcgtgtgatgtacgtgatcgaactgttggagacggaggagggcggcattgagctggtcgacccctcctggtgtaagcgattggcacaaataatggcggggctttcagtcgctgcgctcgccggcgacgacgagcggacgctgtcactgtcgcaggcaccgccgtgcgacgaaacgccgcggcacgggagacgaacgacgcccggcaccggcagtaccacgccgggcaaaacatagccaaacaattcaaaacatttcaaaattaaattgcttttaaatttgaacagcaataatttgccaggtcccgaagagggcccaccgcgcaagaaggtcaaatcgccgccggtcatctcccccaccggctcttccacgagtctttacagtggcggaagttcgtccatcgaatggacaacgaccggcacatcgttggaaatgcaggggacgagggtaaaaggaaggggagaaaagcataggaaaagcaatggcgaaaatgcaaaacaatttatataaaaaaatcctaaaaatttaataatttttaaaaataatattttggataaatgattagttttattttaataatatgttttagtaaattgatttgatttatcttttcatttgatttaattaatgaatttccattcttttatcctttaggtgacgcgcactcagtacggcttccgcactttgcaggagtcttccgccaaaatgtgccttaaagtgaccggctatcccttgcccgacatctcatggtaattaaaaataaattaatataaatatataattaaataagaaattaatgggcacaggtacaaagatgacgtacagctgaagaacgacgagcggcacactttttactcggacgaagaaggctttttcgcgctgaccatcgacccggtgcaggtgtgcagcaggggccaatcacaattacgaacgacaaacgacaaatttggcatttgtctccgaatttgtcattacgacaaaaattatgtcgtttatcgtcactttttttaaggattaatcaacatttctcaggaaaatgcaaaaaaaaaaaatggcaaaatggcaaaagagcctttctaggggtttttgggtatgtagattccgaatttaacagttattttgctctaattctaatcatgaacttaaattcaaaaaacccgaataaatggatgaaaaatcatagataaaaaaaatagaaatgaaaatctgagatcggattcatgatcagcgaactaatttaccactagaaacatgtttttaatattaaataaaaatttttgggtcaaaataatttggtgcatttttgggacacttctcagacgacaaatttgaggggcggtgttgagcgccccccaaatatttggcgtttgtcgttggtttcaatcataattacgaacgacaaacgacaaattttttaattgtgattggagataacgacaaacgacgtatattacgacagatttggcgtttatcgtttatcttttgtcgttcgtaattgtgattggcccgaggggaagagaaaggcacaaattaaacaggaaagaaatgccaaaattggatggcatttcgactgagttggacatcgcttaaatttcgattttcagactgaggacaccggacggtactcatgtgtggccacaaatgagtacggccaagcaagcacttccgctttctttcgagtgctcaaaggtgagcaacggcattttgagcaacgaatgtggagaaaaaatagcggcaattttaattataattgtaaaatttttaagttgaaaaggaatctgccggtccgtcctttgtcaaatcgttggcggaacggcgcaactgcaaagagggcgaagtgatcagcttcgagtgtgaggtgaacgagcaaaaagagaatataaattaataaaataaaatcaatgtgtcattttgacaaagcaatgactcataaaaaatcaataaataataacaaatcgattattgaataattgattgatcaacaatattaattgatcaggtggatggctggcccgagcccgagttggtttggctggtggacgaccagccgttgcgtccatcgcacgacttccgcatccaatacgacgggcaaatcgccaaactggaaattcgcgacgcacaaccggacgacagcggcacgtacacggtgaatatcgactttatcaattagagataattgaatagaattagaatttacagtatcttttcatttaggtgcgtatcaccaacgaatatggtaattcggtgtcgcggaccattcttacggtggcacccgacccagacaaaaattatgtgccgccagaatttcaggcaagtcattgagtgaaaaggccagtcagtcttaatataggaaatatatgcattagcaaagttttcccttaggcggtgatcgaagacgtggactgtaacgagggggatactgtaaagttcaaagctgtgttgactggggacccggtgccggaagtgatttggtacatcaacggagtgccattgaccgaatcggaaaaggtgggccaaccgcagaaaatgtaaaagcatttgaaaatggccccgatcaggttcgcttcatcaacgaggacggtatttgcctgctgaccatcaaagacgtgagccgccatttcgacggcaccgtcacgtgccagggcaaaaaccgtctcggttccggaagttgcgaggcgcggctgcgcgtgcgcgtgccaccgatgccgccgcaattcgacgcccgttggaggaccgcgtaataacggagggcggtgcggtgatgttcgagttggacgtggccggctacccggaggttagagcgaaacagtaaattgaaattaaaatttgtaattacccttcatttttagccgtccgtggaattccgcctgaaagggcgtccgctgacgcacggagcggacggcgtggacatccgcgcagtggacggccattaccgcatgacaattgcgcgctgtctgacggactcatacgacggcgaactgatggcacgcgccaccaacgaagtaacaacagtttaagcgaaatgccattaaaaatggaaactaacaaaacaattccttccactgccattgttccaattcagcacggacaggccgagtcgcgcgcgcgacttacggtggagccggaagaggaggagtcgcgcagtgcgccgacattcatcaaagacatcgaagaccaggcaaggcattttggagagcaaaaggaatttaaaaaccaaaagcataaaaacaattaatattcccacaattttggcatatttaaatttgagtctattggttgaaaatgttttcttttcttgttccatttttctctgatcattcattttatggcattaattaggaactttttccgttttccttccttcgatcactttcctcctatattttcttcttctgatcactttctcacttttaacattccttcaatcacttctcattttcctcttttcttttgtatattttattttgccatttctttggtccaccaccgcttaaagtgaaatgccaataaacttttgcccaaaatatgtccgtccatctgttgtccatccctcgccttttctttttcttttccttttcctttttcttcgctttgctttttattcaccagctaaaaagccgtgccaacagttgtcccccacccgaagaagagatcaaaaaatgagtaaataaaggtggaagataaacataagctgtggggaaaagcggtggccaagccgacgcacggaaaaagcggcggaaacggacaaacgcatggaaacaaacgatcgaatcgatttcattcaacttttattttcagagggccacaaaatcccacttctctgcgggccttttcggcttaagtttaaagatcagttgcatagttaagtgatcagcagatcacaaaatacatgcttcttacgtgttaatctcatttaaaatcccaaattttatttattttttcccttttggcattttccctgcaaaatttaatttcacttccatttttattatttcatcgtttccatttcagacagttaagcaaggccaagaggccacctttgacacggtcgtgcgtggttctccgatgccaagtattagttggtttttgaacggccaaaagttggatgccggcattactcctggcgttgtgtccattttggcggatggtgccgaacacaaaattgtgctcgactcggccaaatgttccggcaccgtattgtgcaggtgacacgaaaaattgagcacaaaaggcaaagcaggaacagaatgagtgtggaaatgacagaacggattcaaaatttagaatattttattttctctttaccaaatttaccgtacccaatgtcacagatacagtaccgtacatcggcataaattttcgggattcattttggaggaaagtcactcaaaaacttcaaaaacttaaaagatatttgaagtttttatcaaattatattttaattgaaattcactaattcattcaatttgttttcgtagagctgaaaatcaaatcggccgtttcgagactaagggccgactcattgttttgccatcggagaagcagaagaaagcgcctattttccgccagccgttgacggacaaaacgcaaatcgaaggggccaccgttgtttttgaagtgaccgtagaagcggagccgcccccgacgttccggtggactctgaacggcacggaactgagagcggacgcggctgggggaagggtaagtgacaaattggcattttgactagcattaattatcccatcagcaggtccgtgtgcgtgagtttgagggcagttccaaattggagttggaccaatgcaatttggcggacggcggagtgatcgaatgcaccgcgtccaacgcggagggcaacgcggtgactaacgcacgtttcaatgtccagcgaaagtcaaagcgcctgtgttagacgtaaagccgcgcaca

SEQ ID NO: 8225 - DNA, 1155 bp, Heterodera glycines
attttcgattgtatacgtcatacttgtatatgcttctttaacaacagtgtcgtcattattcactacattttttctttttattttttggcgtttcgtctccgtctgctaatgcacattggcgttgtgcacaacgttttttccacaattttcgcgcggtctggcaaatctttgcacgggtcgtctgcccgttttcgcgattcctccatcagaaggtcgatctgtgaggaaagtccatggtttaataatgcaaaacagttttgattttgtaaaaaactaagggataaagcaaaaataaagcctcttcttcttattctaagcgcatttaccggtcacgcttattattcattaccgcaatgtttgtgaacagtttgttctcctggacggacaccactttgtatgtgcctttgattgtgttcaggccgtccaacggcattcgcttcaccgccgagtcgagcaaacgttgccggcactcttcgctaaaaataattgcgtcaattatgaatatcaattaaccaaatcactgactttccgattgtgtttgttgtgtcgttgacacctttggccagttcaaggcttgtgtagaagcccaactcaggcgcactcagctctcttttacgctcgtccgggtagccaacactcagaattcttcaattaaataacatataacgaaaatataacgcaacagaacccgcatttaatccgaaatctgtccgggtatccgtctcggaaatccgggtcctgaccctggctttttcaagatttcgagttcgaattattattattattttaaatagccaataaattataaatatgtcttacttatatttaaagataattaagctaccaattaaacataaaggctaaatttgactaatttttaagcccatgtggttttttgactttggaattataaagttgcaaaaattaaaagtgataaaaagcttttgtcattctttgcgaatttacctgttgaacatgtcaacatcttcgtcaccccatccccagaacagattggagtagccgttgacccgctgatattgttccggggtgaagccggacacttcgccaaagttgttgtccggaagaggacttaattaataattataaaatgcaattaattatttcgtttaataagattttggatttgtttttaaa

SEQ ID NO: 8226 - DNA, 5343 bp, Heterodera glycines
  misc_feature (60)..(60): n is a, c, g, or t
  misc_feature (125)..(125): n is a, c, g, or t
  misc_feature (4912)..(4912): n is a, c, g, or t
tgaattttaaattatttttccaattttcatatttttaggggtaagtttctctattattanaataaatatatgattaataaaataaattacgcgtaattattctcgtcaaaacgtcggaaaaagtngggttggatggtccttgaagcagcggtacaaattgtgatcatgttcaggcaccaaatctacgtcgtgaagaatgatgcagtcccatttgcccgaatttgttatttcgacaaaaccggctaaataatttattgaaattttcaataatttaatagaaaaatttcagcaaaattactatgtttttatttttcggattcttatcaacaaaaaaaaaaaaatattgctgaatctatttaatctctgcgtttaatttcccgagaaaaattataaatcaatccaatttttattttattttttaaataaaataattaatcttttatttatattttatactgttgcacaccgttaatcagtttagctttgttgaacttgtccacccgctttccaacgggaaacgcctgttccaccacaaaaatacggaaatgagcttgctgacgctgtaagaacgggatcagattggccagcagacctcgcaaatgctcggctcgattcctgaaagtatcacataattttaattttttaaatattataccgtgtttcttctattatagcctcctccctcaattaaaccactcctctgggaggcttagaaaagaccccctctggggctctattagaagaaatacggtagcttttttgttttttaattattttttgttttgggatggttttggcgctgacttatatccgaaaaatccgcaaaaaagaaaggttttgtaccggtttgctaattttttcgtctttttccatttgtagcgtttaacgaacatttcatcgtgctgtatgtcgtactgtacctgtacggtatcatgatggccactttttgctgtgcaatgcatgtgcgcggcttccactccccgcctttggccatttcgggatgttcacgttcagtgtcggccagcatttgcatctttttgtcgggcaattggcgcccgattaatgtgggcggaacttcagggcataacggaagaggttcagcgacagaaaatggacaaattaaaagtgccaaaataatgacaaaatggtcaacaaacattctgaaaatgggaattcatttgttgtaagataataaaataaaataaatacaaataaataaatcgaaggaaataaatcattcggagacatctcatcacgggcactactcatcacacaatttgattctttattttaatgatcaaaaattctattaaaattattgctgtttttctaatcacctgggaatttagaataaattaaatttcataataataaaaaaattgaattaggttatcaactattttacattgactactattttacttaaatacttgggaattaatttactacagtttaatattaaaataatgtaaattgcaatgagattttttcgaaccgttcaagggtaattaatcagtttttattttatcagtagcatcgccaacttaccgaaaaaataataattttgctggtgtaatcgtaccaaaaacaaaaccaccatcatgttactaataaaaaattcactatttaatcaagttaataattaaatgataaaaaatttcagtttgttttgacttaacaaaaaaaaaagtttctctctagcaattcgcgaactttcaattaaagataattagtaactcttcttcatgttaatgatgttcaccaaatgaaaattaattagttaactaattaagggaaatctatgtaataaaagtgttcaaaatattatgcaccaataaatggtgaccaccaataatattgtgcttcggaaaatattccaaatggatgattttcacaacgcatacatacatttgtgtgtggtggtgttgtgcagcagtagtggaagaaagtaaagaaggacgaagatgggaattgggaggaagaggagggaatgggcggggggtgattaattaattagctaattactttcactaattaattagaataatgatgattgtggtggtgctggtgatggtatgatgtggtggtatgaaaagcttgattctctctgctttcgctgttctgtccgttcttccgtctcagcagcaacagcatcagcaggtggttgctccccaggcgaaccgcgacggtcggcggacagtgcgcgggcgggggcggttttatgtgcccaaattcagcattgtttctctcccacactgtcataattcgtcgcgtcgtcgtcttgcgcaaaaagtcggtcaaggatgatgaagcaaaatgataaataataaataaaacgtaccacaacacaacccaaaggatgcaggcagagcaattaattaattaattaattagtgaattattattattattacaacgcaaaataagttgtattagtattattattcgtattatttacaatgttatttttagaaatttaaatttgtaagaatataaaataaacaaaaaacctgtccaattcatttgttttttattttgaacatttacataaaaattaaatggataaattggatttattccttttaacgtgcagcttttaaagcagagttcaaacctcaaaactaaacataaaacaataatttgaaattgaattcattttaaaagtaaattcctatgtgattagaaaaacagcaattcaattaaactcaacaaacttataatgtgtaatttatcagaaaaaaaattttataaataaaaattattaaattctttagccggctttgtcgagataacaattctggaaaatgggaattcattattcttcatgacgttgacttggtgccggaacatgaccacaatttgtaccgctgcttcattttcccacgttttgacgaggaaaaaaaaactaaaaatcgaaaaagaattaagaaattttttaaatacaacattaaaattccaaaaaaagattgaataggctccaagtttttcactagcggttggatttttcctggtaaaaaaacttgaaacttcaaaaaaacacagatgaatacatttgaatatcatttaccaaaaaagctgggctctaatgcactttatgagtccaatcgagttttatgagtccaatcagaatatatgagtccaatcaaatatttatgagtcctatgacaatttatgagtccaatgattttttaataaaagtttgagtccaatttttatttttcaaactgtcagcctaaaattgaaatacacaatgtaaagccacaattatagtggatattggtatcgaatttcttccagaatattttggaaaattttttcatttccatggaaccgacggaacatatactgataaagataggttggtaacaaacatgtcagagttagttccgtgcaagcgtcgcaatccatttttgagtgctctccatgtcgcctcaatgccttgagtgtgcactcttgggtcattgggatcaacgaagtacatccgatgatttacccaacgatggtcgtattgctgttgcatgttatttatccctccataagcagcccatccgtcacttattataattgagttagcttcaatgttatcagctattataggcaggagagtgtcggcatctctacgctgtacgttgaagaatctaactttgttagtgcccctttctaatagaccaaaaacccaatcgtaggctctatttatcattctccccctgttatattttgctctaaaaaatttgctttcatcgatttccacaacaaggccttgaccactcagccgctcttctgcttgctgtctttctgcccacacttggcaaagatctctataaaagttataaaaatctatgatcgtatgcattgaatgttagtttcacgcatgacagtttctaggttactactagggtgactagcccagaaatagccaattcgcaaaattttgtggaaagaaagatgagataaagaaaagaaggacccaaaacggacagaaaagcggctggcagtttcactgtcagggtcatccctgcggcatttattacagcgccactaaatttttttattaaattcatttatgcgttaaatttcaattaccgtataccgttattttttggtttttcgaattacggtagtcaaaataagcgatgcaacttccattaagcgtttcaggtgattggtaattattgggagagattacggtaattggtgcgaccaggaaaatgaagaaaaaaagcatttttatttaaatgtaacttttgtcaaaagaaacatgctttaaataagcaaaaactcttcgtattttaatcgcttagtgtaaacaaacgactttattttcttgtcagttccaatttttaaaacattttttaacataacgtgagatcgccaacttcagttttatctaaagaacaaacacaatgtcttctagcgcatgcgcaaacaaagtgaacttttttatttattcatcttattgtggaatgaaaaaatctcctaagttgaataaaattgtaaaatgtactttattcacaaattttagctgacccacaaaatgtccagcccacgaaatgtccaagtctcgaatttgagttttttattattcagatgggcctaaggttaggcaaggggtaatataaagggtatattcgtattcagcgactccgaaaaccctaaaaatcctaaattagactcattttgtttttataaattttgaaaaattttggacatttcgtggcttggacactttgtggtggcgcccaaatttttgatcggactcataaactctgactggacttacaaaaaaatgattggactcataaagggtcattggactcataaatatttgattggactcaaaaactctgattggactcataaaactcgattggactcataaaactcgattggaactcataaagtgcattagagnccgatttttcagagtaccaatcatcaaacatggatcagcgcttgtaccattttaatgactggcattatttacttaattgttggcattttaataatggccaaatcggcaggttagaaattttctaatcacaaaaaacaattcataatttaatgtttttaggtatgccaactgctgatcagaggaatcgccgtgtgttccgatcacttttttggatcatcgccgtgaatattggtggtattgtattcatacaatatgtaccgcactgatcagcccactgatcaaatcaccgatcaccacttggtttttcctatttgcttagaatggcacaaaataatgagaaaaaatacttatatgtaaaaaaaatcgggtactgaagtgtccacttcttttaattaaattttcaagattttttctagagttgagcgggaccg

SEQ ID NO: 8227 - DNA, 5402 bp, Heterodera glycines
aagaccctttcactgaccacccccttgtacaggtatgggttgggatttaaattggtggaggttcgattagcgaaatcgcattttttaaaaaatctaaaatttactaaagtaagaaatttgaaacttaaaagggttttacaatgaaattctgagtttctcatttgctaataaaagcacataaacaaaaaagtaaaagcaaaatttccacctttggttttgttagtctctcatggcaattgtctattttccttagtcattgttcgaatagcccccccccccccccccttaggccgtttccttcaaatggccaccgttttgcggtcgtccgctgaactctccgtcgagtcgattgtcgctttgttcaattgttacgtccattcggtaaatttttcactttgcgtttttcctatcgctcattcctctccattttgtttttctcttcagattttcacatttttttgctcggattttgatgcacagcaacaacagcaaatgttcggcaccaatttcgtcacttttcgcctccgccaatttgtgcaatcaatcgaaaagaaaatgaatggcccgggggcgacagagggtgggcaagacagtgtggaaaatgcggaggtgacagacacacagaaacaaaccaattattacaaatatggcacatgccaacgttttagctttcgttgttttgccgtcggtcgtcgctttgccacgcgttggacagaaacgactcggacaaattgtttttgctcgtcgaaagaattgttggcgttgagtcagtgtatgttttcctttctgttcttttgatttttatgcatcaaaatttggatgctttccgcagtgtttttctcgccaaacaaatggaattgcttcggcctttcctcgaggcgcttttgccaaaaagcggcggaggcagcgacagcaatttgtccttggactccttctatcgtgtttgtttgatttaaacgtttatactagagctcgattggacctggacccactcctgggtttttcctggacctggttttttgctcaagtccaacattgaatccaggtccaggcccattttatgccacaaatttgtttttcccccatatgcattttaccccattttcagtcccttgcggcggtgttcgatttgggcgacgcttcgtttggctgtgtggcggccaaaattatactctttcagtcaattctgaagcaaatttcggcgaccgattggacaaccggggaaatccattcgcaacattcgccttatgtggacacaattgtccaagtgaatggggaaaacagaggggggtgggggtgaatattggcaaaaaagcaaaggaaaaaatggccaaaataacaattgtcagccttttccataaggtgttttactggtgttcctttttaggaatgttcgcaattcaaacaaaagttcgtccgccttttcccctacgttcacatttccgacgaattgtacgccgccatttggtccatgcttttgctgtgcattttccgtattttggtccaggggtacgcggacgcccaatttgtttcagtggcaccattgacaaaaacgtaattttttaggtacgccgacgtaaaaaagtgcagcattgagggaagagcactgcaactgttggatgtcgagcaattatgtggggaattggaggagatcaccggactgaggcaatttcacaatcatccctttattttagtgtaaattcccgaaattaggcctcttccccaccgaccgttcgtcgaaaatttcgtcaaagcattttatttgccgtttggagagcttcaaaattggatggtgaatcatacagtgagtggagaaaaaatagggattttaattgggattcttaacaaattcaaggagtacagcctaagccaaacgagcgcaattttaaatgcagcggctggggcggcggcgaacagctcgtcctccgtcgcgacgaactccagaaaagcgaccatgtcgcgcatcatggccaatctgttggacgcgagcggaattggggaaggcggcaactctcttttccaatgaataattccaatttattgtttaatttcacatcatttcaatccctttcatcttcgcatttaataagtcacgcaaaagaacactcacattttgtaattctaacaaatcccagttttgtttgtatatattgaatgttgttaattgtgataaaaaaaggcttaaatttaaatttgtcgaatggttgtattagtcgaaattgcctcacaaaaacaaacatatattcgaacgaaagaatcaaccaacaattatttatgggataaatgagcatcaaataaattgttacggtcggtccaaataagtttcgttgctttgacccgctttcgccgtccgttcattttcgcttcaaattattattgcgtttcgcctaaaaaacggttcagagaatataagaaaacaaaatatggctaatcaccgtcatgttcagcgccaagcgaccaacggccttgaaaaaggccggcgccaacacattgtgcaacagcgcgtgcacccgtccgtcgatgaacacttgggcatggcggaaatggccgctgtagcgtgaatatgtccaaatgccaagcgcgacaaaaatcagcgtgaggaagagggagaaaatggaggcgatggtgtcgaggccgagcagttggaaaaatagttgacctgaaaaatgggcatttcaccgaattcaggcccaatcagtggaggagtgaatgtaaacttatgggccttcggaataccaattttaaatatttcattaatctacgagaattaattttggacataaacaactgcgcagggaaagcaaaacgaacagcagtaaagggcaatcatcgaagcgacgagcacggcgggcgtacgcacaagatgtacagtttttgagttgtttgcatgctcaaacgattcaaatgcctcctgaaagtcacagaaagcgaattaacaaaaatagcgcaaattttagcagtttaatatttcaatggaaaaatttgaaagcccaccgtgatgtcctgcttcaatttttgtgcgaattgcttcgccaactcgggaccgcccattttcttcgccgttttgaagatgcgcatcgcctgttccttgcaccgctcgtgctctgctcgcagttccgcgccgctcataaagggcgagtcgccaccgcacgactgaatttgtttgagttcgaataagtgggaagggggggggggggagttgtgtgaatttattgcatggaacccatgaacccaatgtcatgtcaaaaataattggctttttcggtatgatttgccctcaacaatcattcaaatgctacaaaaaaactcacttcttccatctccctcatatacaccgcctttgcgctctccacggcctcgtaatgattggtcttagcggtgacctaaaaaaaacaaaagcaattggcagtcataaggagggaaagcattaattagccttttcactaatcactcgggtcaataacaacacaggaatgaatgttctttccacttacatcgtaaatggtttgcggattgggcatttcagccttgctgaacacctcgaaataagcctgaaatttgaacttaaatattttaattgacgcgaaaaagggcacatttatgtagccggcaagctctcggcaagtgatgggctgaccgccaatttgtttgacgaccaaattgttggggtagaacacatagttcgcaagtgaacggagctgtgccttgaagtcggggtcgatttctaaagggaaaaccgaaatgctttgaattcagtggacaaacaaaaagataaaacaataaacaaactgtcaagtttgcctcggtagtgcaggtttgtggcaacttcgcggccggggtgaggcagcaaaaagcagcgaatgttgtcgaaagacgagcgaatgtgaaggcgcagctgctgatgttccgggtgttgacggcgcgtaacctggcaaaaacaaatacatttaacaaatcaatggataagccgagaataaatgggggcacaggaattgattttacgaagaatcctagctaatggaaaatattttaaattttgagatggaatggaagaatataagaaaatcttcaatttatgcatgagattcatgatacattcatctgattgagtaccttcaatcgtttgtcaagaatgcgttggccaccgattgagccgtactccgcgtcatcaggcacactccagtcacggacaaggaacaaaagcgactgaaattgatgagagaaagggtcaaccaacaaaaaagagcattgcctggaacggtttgctgttgttgtcctcgtccagcgccagtcgggcgtactctgtgaacagttgcaagtgctgcagatcgttctcctggatgttcttgttgatgttgaaaatctgggaaccaaatgaatggaaaaacggatggaattccttaaattttattcaaaaattcttttcagtttaaaacctgaacagaggaaaccatcgtggacaacgcgaaaacggtggagcactttttgaccgtcgtatccatgtcgaaaatgccttgtgtgtccatgaggaggacaacaacctgaaaaatcatcataataaagacagaccaatgaatttctagggaattaaattggggcgtgaattgttccgccaaatctaacccctcctgccaaaacctgctctccgttgcggtcttcgagtaggaaaggctctggccaaatcagaattccgttggtgtcccggtcgtcgccgcctcgccaactgaatccccccaacgtcgattccatttccaaccaatctactgttctgtcagcaacaggtgctgagtgccaacgcaaataacgcagaaaaaagtttaaaataaacgattttccggtgcggtaggcgcccgccacgctgactacacacacctaaaaggaaaacatagtaaccacatttatatggcaaaaaaccaaacaaaaacgaatatgacattcatttggcctgttccgaatcccagccaaatttgagattgtatttatcgagttatccgtaaatagatattttcggcatttgttccaagtttaagaagtgaaattcggaatagggctaaaataaatgctatgtttgtgtttagccatatagttttcacctttttaatgattttttgccgaaaaatagagctcatcgacattttaccaaaatttgtaaaaaaaagttgggataaattattaatgaaaaaattccattaagtcagagtcactttaattgaaaaatattttggacctttttgtcagcgtagcgcgggtcgtccaatatgcgcttaatcgcttccgaattgatgacaaattcgttgaccaggagttcctcttctctttgctgattctcatcatctgagcccacaacgtcttcattaggcggaacagtgacagttgccggctcaattatttgaatgggtgca

SEQ ID NO: 8228 - DNA, 1494 bp, Heterodera glycines
aatgcttgtgctcaccgactgtggctgagcagttgcttcttgaaagtggtgatcagctgaacacgttgcgtggggttcagcgagtacacggagaactgaacagaacacaaaaataaaggggatggtagcagttttttttattttggacctcgaaatgccatatgtttatggaaatgaaaagttaaattttgaattcccattgggaggaccttttccaaatgttcaacaagttcgggatgttgttgtgcaaaaatgaacccgtcgtcctcatagcagtgcatttggccgcgcatttggcgccggcactttgtgtagaagccggcggtgagcagcaaaagtcggaccacttcgctcaggtccaaatagtcgcggctcaactcccacacactggcacctgaccttgttttttaagaaataacaacggcaatgtttttagaaatttttcgttttaaaaaacaatttttgagacccaaatcgcttataattttctgatttccaatttcttaagtgcttcacaattatgtatttgatgacaattggttaatataatttgtcgagaaaaaaaaatctgtttggggattttgtgaaaaatttaccaagaaataaaaaactatgctaacaaaccgtgcaatttgaattggcgctggcattcgcgattgatctgccgaatgcgctcgccatgcatcggatggtcaaagtccttcaacgcctcgttgccaacatggtcaggattggtcagatcggctgaaaacattttggtcattcaaaatatttatttattaatccaaatcttgcattaccaaaatattgaacacacacaaaaattagggagtctaaaataaggaatggaataatcacccgcatttccgtcgtcctgtatgatgcactctctcaatgtgttcagcagcgtgtccaacagacggtagaagcgcgaattttcgttgatttggcgtgaaactgtgaaaaaaatgcatattactaacataaatatgtcatgcaatttctgtttctttggcccatctaccggtgaaaaagttcccgaattttaaaaatatgtttggccaactttttgaaaattgaaaaataacgatttaaaaaacacacccaaagcggtcgcaatttggggcacactgaacgcggcagagacgggcatccgctggtcgtccatgatcagcagcggggcgaacgagtggcagaagctggagatggccaggatgtcccagtagtgttcccggggcacccaatcgggccaacacaacgctttgaagtcgggaaaaggctaaaatatgtggaaaaagatccataaaaagcagacgcacaagtcagcccaagggcatagccaggggtgggggggggggttgaaatgggtaaatttcttgaaattttaagcaattcaaaaatcacacccaaatttgtaaaaaatgggtcacaaggcaaaaaaaaagaaggtctttttttggcgaaaacactataacttcctgtaaaccccccccc

SEQ ID NO: 8229 - DNA, 2122 bp, Heterodera glycines
tttttggcgaaaacactataacttcctgtaaacccccccccctaattcggaaattaaaaaaaatacacccataaaaatcaaattttgaattcagcccaacgcccccctcccgaagccaagtgtttgactgcgccgttgagtcagccacatttccagttcggcaacgcttttcaaggtatttaaaagtcaaaatttggcactatttttcggcgtgccccggttggtctccgcctctcccaccccatcgtcttccctcacttttaggtcctcgcacaacaaatcgtcacggggcttccgccactcggccaacgcctcgcgctccctccgctgccgctccaactgccgcttccgttccgtctccttcgccgcttggatggcctcgcgcagtgcgccgatgtgcgcttcatggagcagtcgacgcgactgccgccacctgcggcagaagagcaaaagttaagaaaagagcacaaaacgaattgaaaaaaaactgggaggccctacagtgtaacaagaggctaatagaattaaaaaataagaaaattccaaaatatttttttcgcgggctctgtcatccatatattgcgcaaaaagtcgtcacttaagttctggaccgattttaggacaagcccaaaaattgtattgaaaaattgagcaaaaatggatcaaaaaccaaaaaaaccctaagtttaggcaacttccaagtgggaggccaacgctttggcccacctgtccatctgttcaacgccggccttttccgcttgacgaaacaacggctccaactgttgctgttgctcgtggatttgctaaaaaagattaggcattttttctaaacaattgcactcgaatcaaagttcggaaaaacgggacatttgatcctggaaatatggaagcaattccctgattctgataatcccattattaaaatgcggagggcaaatgccacggtctgacaaataatcgaaaaaagggtggcaatttgcgtcgtccgtctcaccctttttttgcgggccgcctcctccgccgccgccgctttgctggcgccggtcggcgaaagggtcgcctttttgcacttcgccgtctcctcccttttcttccgcctcttctaaacgggggaaaatatttaataaaatacgggtttcatccagactagaaagaggggaccgattttggggtttcaatgcccaaatttggtggctcataatgagcatttgaggtaccatggaaagaatccatcggtttaggacgcaacaaaattaattacccatttaattaaaatgatttgaagcaaaaaaaatcaattgaatttgcttagaaaacagaacctaccaggcaacatggccaagaaaaggtgtaaaatacagaggaatgtaaatttaagcgtaaaaccaacgattgcatcggtttcggactgcaaagcctcgtcatatgtcaggccagtccgtcccgtcactgaacagcgccaacagctcgaattcagctgaatcatccgctcaaaatagtcactgaaattgggaaatgctcaaaaaactaatcgaaatgcaaaaactttcaaccaaatcctcatttttctttgtaccaaaatttcaaaaaattaatttggtgcccaattcccgtaacatcaaagtcaaaatttcattttaataagtaaatctatgccaacaaaaaaaaaggtttgtactcgtagtccaggaacacttcgttggtggaggacagatagaacacttccgtgttcgggagcagtccgtcgggaatgggcctaattcgttggaattctttgttcagcgtggttggcatttgtcagttaaaagttaagccaaacatttgtagagatttgctgaaaatttaattatgaaaaaaggaattaaaattgcaaactaaaagtccaattcaaggcaatcattaagaattggtgtcccgacgaaaaaatttttaaaaatttgtcgggtattttttctaggcttaaaaaaagcgctgatcacgaatctgagctcagattttgaaaatcattgatttttatctaagattttttgtcaactacttgatttttttcgatttttaaagttatttttttaaaagtttagcaatgaatttgggttaaaaaatactctgatcatgaatctaa

SEQ ID NO: 8230 - DNA, 1117 bp, Heterodera glycines
cgaaaaaaccaccacccgtttggtggaaaaactttctttgcacccatctcagttctaactcttgctaattttcttacaaaatttgcgtatggtaaaagtctatatttttgtctcttcgtgagcgggaagtacccctttaatatattataactaatttcaattaataatccaatttgctcactagtagcctctttaaatatttgttgtctctttttaaaagatattgtttttgtccaattcaatatgcacagcttccgatggaaaacgactcgtttaccaagaaagtttgcatgtgtggttaagtggtttttggaagatagtaaagggaaaggggcggaggttcgagtccgcctcattgacattaaatttccaaaaaaaattttgatcctaggaattttgattccctgtacacaccgtttcaaaaaacgagatgtgtgccaataaatagagagtgcagagaaaaaaacatctctcattttggcgtactatttatttatctctgttattagagaaaaacggaatttacttcgccacatataactttttttctactcatacaatttacaccaaattttgcatatcgatagagaaaaagaaaattaacaaaatttcagtgatttggttaagaatttcggcctagaacattgctaaattgttaatttagattttcgaacgctcttatcttttttctaaatcgttaaatcgcttaacatttgcttagaaaaagcttctccccatcaagggctttcgaatgatgtcaagattgtacaatatggttggcaaaaacctttaaaaataattcccaaaattcgtaattttttaatattttggacaaaaataaataaaaatattcatgtagcacatcggactcgaacctccaccccttgtccctttacaatcttacaaaaaccacttcgccacacatgcaaatcttttttttttttttattcagaagaaataaaatatccaacgaaggggtgaccacttacacgttagattttagtaaattaatatcaagtccaaggagctcttttacagactgaatttttgtttaactcaatcaatttatttatacgttatttgaaactgtcaacagatggagcatctgttatatctt

SEQ ID NO: 8231 - DNA, 4905 bp, Heterodera glycines
ttctttcttttttaccatccatgatcggtcttcaatttttaatgaaatccttgagaaagttcaagtgattccttttatataattttcggaaaatttgctcaacaatcatttgaagcattgaacgtgtgtctcatgcttacaataaggccgtccacatacactcgcattcaaattgacaaatgctttcctccgaccgatcacttctttctgtgtgcgttcccccctcttttcacattccctccattctgctgctgctgctgcttctgtctttcctctccctccgccgtttgaaggattgatacgtttaagcatcttccaaaccgtcccttggggggtcgtctaattcgacgcgatgattgatgatgcgattttgcgagtagaaaaagggtgggcttggttctgtccgtcgtactgattgattgtcccgggctgtccgtctgtcagccaattcctttctttagttggaaagggcggtaatgcctttgaggaaaagtaaagggaaaattacggggcaaaagggggggggagtgattgagcaaataaagccattcagagggagtaaacaaatccaaagcaattagcaaaaaaaaggaaacggaagtcgcgccggggaattcaaagaaataaattcaatttccatttgggccattgcgtcgcttcttttgttgtttttttcacttttatttttactaatcaacagcagcttgcacttgtttatttcttattaattggtagatgcatgtaatcattatccggaagctgcgtatttaagcgccgcactctttcttttctttctctccctctctctctctccctctctctcttctctctctctctctcttctctctctctctctcttctctctctctctctgcctccctctctctcttctctctctctctcttctctctctctctcttttctctctctctctctattctctctctctcttttctctctctctctcttttctctctctctctcttatctctctctctctattctctctctctctcttttctctctctctctcttttctctcctctctcttttctctctctctctcttttctctctctctctcttttctctctctctctctctcttttctctcttttctctctctctctcttttctctctctctctcttttctctctctctcttttctctctctctctctcttttctctcttttctctctctcttttctctctctctctctcttttctctcttcccttctcatttcccttttctgcacctgtcatttccaaccatcccaagcaaataaacaaaatgttttttaaaaatgggcctttattttaattttgtttttttccccaattttttcccagacctatcaaaaagtttgtggtgaagtggttttttctgtcacagtgccaaatccgtcactttcaattcgatgccacactcattgcgtgccaaaatgccatcttccaattccaatgccattttcaggggaattgggcaaaagatggaataatccgccgagaattttaccgttaataaactctgagaaaaatgtatgtaaaaacatgttgtgcactttgtgattattcttatttgtccgccgtgggaattttactatgccccgggggttaatttgctgtacattcattttcacagcaaaagtgccatttaatttacagtcgcccagtaaatttgcattctttaggcacatttccagggatgcaattagcatttggtggggtcgtcctttgtccccccgcccccggaggaaagtggagcattagttggcattaaaagtggtcacccaatggaactttccactcatttatcatgccaaatgatggaaaatgatgacgaaatgccatttgaaagcgacgaaatggccaaaaaagggcaataaaagcgaaaatgagtgtattcactgataaggaatgctaattctgaacagtttatggtaatgcaagtgattgagtgactttcttttggtcctttcgattttgcctttggcaatttcccccatttccctcattttggcacttttttcatttttcttaaatattttttattgctaaattgatgtaagccttttcagtcttggccaaagattgctgtgccgaatgtccaaatcatatgccaaagtgtctttggcaaatgcccccccgccctttgagtgtgccaaactcccccccccctttttgctattgttttggtttttcctccgtcgagtgccatcatttggcacacattcggctctctgtagaagatggcgatgcttttccctttcggtcttattttttctttttttgttttgtttaatatccgtccatttcccccgccggggaaaagcgaccgacggaaagggaaaagcgacgcatcccccgggggaattaagcgataaaataataatgataatgagttcataatggtgggatgacagaagagaagagaacgacggacaaatgggcaaaagaaaatggtaggacaaacggtgaaagagcatttcaaaccatttccaaatggtttcaaatcatttaaattgccaatcgctttttcccattgtgaaaattgggcgggaattgaataataatttgaaaataacggaacaataagcaattaattcattccttaatagcaatagttgtccccacctcatgtaaagaattttacacacaaagaatgtttaattgctttaaattgaggaaataaattttcctaggaaatgtcaaaggtaaaaagagagttaatttccttttccaggcttttgtctgtttaattgcccaaattccttttgaattttgcttcctccatctttctttttgtgttcgccctgtgccatttgccccctttcattttattttactccaatttttgtcaatttaagtgccatttttttccgtctttccctccccccaaatttcgtgcaatggcgcgtaaaatctgatcatttttgcgtctcaaattatccaagatggaccttctgctgattctctgctgtttgggcggctcccctttcatcgatttcgaaagtgccacccgaaatcctccgccggcgccgtttgaccaccaatgggaccccaccgattgggtggccaccgatctgtcaggtgaaaaggggcaaagtccgcccaatcggtcggtcactcattcagttgatcagcgattgatttggcatcccgatcaatcaaatttcggctttttattccaacttatgtttttccccacctttcttcccaggctctcttctgaatgcctcgctcagttcctctctgatcacttcctttccccaacttcgtcttctgatccctgccgatttgcctcctcaactttcgctcgagcagtgcgacctttggaatttgacatttgcatcaaaggcggacgaaaatgtgttcagacgaagtcgggggaagctcaagtgcaggtgaagcgaaggacgaaaaacgaacgaaagatggcaaaaggaaaagcatttaaaattaggaaaattagtgccgactttaatgctaatcattaattgaacattttcctctctctccctcttcgtctctctctcactcttttttttctgcttctcccctccgctttgatcttttctttcccatctctccccttcccgcttctcttacgcccgtttgacttggcccacgtctcaacaagagtaagctttcacattctttgccaaatcttgcggctgtcatctgtgctttatccttccttatttctcgcttctctctctctctctcgctttcgctcgctctctttgttttccctttctctcacccgctctctttctgtgcccgtctctcaatgcttggccaatcgcctcgggcattacactcaacgcatttcatcactttatttcccggacttcaacttcgtatgaaaagcattcccaaagagtcgcactttggaatttgttgtcacttttactttgttttgaaccctttacaaattcaatcaaaattaatattttatttttaaatataatttttattgccatttccccctttttccccattttaaatgccaatgccattcctcaatttccttttttttgcttcctcaggtgccctcccggcttttccggctccgtctgtcagtatccgccgctttcctccgacccatttgtctcgcgccttccgtccatggcaccgtccaatgcttccgctgcgtcccccgcggcattgcctttgtttttcaccgccggcgcctccgctgcgatggcattggaatcgcagcagcaacaaaaggcggcggcacattctgtggtcggaatttctcgcaacgaaaactccttcgcgctttacctgctcatttttctgctgctcgccgttgcaatttcctcactttttgcggtaattttaattgccattggcaatgaattaattggtgccgagcctatcgagtcgacaattcccccccccccctcctccccatggtttgttaccgttcttctgctgctgttttctcatacctttttttgccctctgttttttacctttctttttgtcctccgcccccatttcttcaaatttcgctcatttcacccccccccaaagtaccaaaagctctccttccattcaaaattccagttattactactggattgactatccatcactcttccagagtgatttggactaaaatcttctatttgttcatagctgtacatagtataatgtcccgcttatgaacaaaataaccacttacagtcattctatttgtttgacactttgagttatttctggcattataaaaagcctaaagagtgtgtgagattgatgtattgcaatcacattttgtctaataatgtattccttcaagtgcatttaatttcgccaagataattaccataatttgtctatcacacataacagaattgtgctcccgtttaacctctgttacacccagatatgttca

SEQ ID NO: 8232 - DNA, 2391 bp, Heterodera glycines
gaattagatgggaaatgtagtccctttgaccttgtccccgctttttcagcaacaaaattcgtatgcctcggccacctcttcaacggcaccggcaaatggcaccggcggcgccctttggttggactcgcgccgtccgctgatcccttcggtcagcgaatgtgtgcagcaacagcgccgcggcgtccctctgccgccttcgtccgcgcctccccggcagtgctcgccgcccccctcctatcggtcgctgaacaacagtttggaacgcctgtcggagcacaccaaaatgtgatgagcgtcgaacagaaaagtgaaatgtcacgacaattttaattatgccaacgacgatcatttgaaacattgccctgtacatctcatcatttgaagttgtaaaacggaaaagcacaaccaaaattaaagtggaaattcatttcaattgccaaaccgagggattggacattgcgtaacaatgggggcatcgcaattctcagaaatccgatgaaggcaaagtcaattaattaattgcaagcaaatcagctgatttcgctgatttgtcatgcttttccgtgcaattattcttccattttcctgtctctagtcatttcccacttttctcactttttatcattttatttttttgtatatgtaaatttatgtttaatttgttatcgaatttcttattttttaaaatcaattatcccatttttattcatttatttatattaaatttaaaattaaaattctataaatccttgtattttcgattggccaagtaattttaagaaagatttgggcaattaattaacaaatgaggcaatatgacaagaattcaccattaaattttaggatatattcggagaaacaagacgggaattactatcgcagttttgtaactaattttcgcttaataaatcaatttggaccataaaaaataaactcaaaaaatggatttattagtttgttctaatttgagtccgggattgagaattaactgagatggatgttctcatgtacataatgataagtttagcattttgattgaaagcagcagccaaataaaaaaacattacagaaaaggtactgattaatatttttgaatttgcgcacaaattacataacttggcgttatgaatagttatgtttaagcggatccaaagtgattcatcaaagaacattcttggaaataaggatgttttccatctttcaaaagtttatatttcaaggacgagtatgccaaaatatggaggtgattcgtcgagcatttattttcatattttagtttattattttttatcgcgaaaaattgcttggacttaaaaaatggagcaaattatggaacacaacatcgacccgcccgttcaacaggtgttgtgttgttttgtttttgtgtgttccatttctgttattcattgtctctcagatccttcgcactcccttcgccaaattatgcatgaattcggtgttttatccgatgaatttcgcccgcattctcatccaattgggacacgacccgttccctctcagcaggggcaagaaacggattttcttcgggccgccggtgtactttcagccgaacttcttcaaatacagtcagtatttaagaccaattcagttgcttttaccatttttcaatttttagttaaaaatatttggcaatcgcacggatggcccaccgtttacaccggaatcggcgcccatttggcccattccgtcgcgttcgacttgtgctacaaatacactgtgaatgtaagtgcatttcggttttgttataaaattgtttgtcttttttagcaattggacgaattttaccctgaattgggcggcagaatggacgaggaggacaagcagaagatggaaaacccgcgcgagttgggcactcatcagttgattcgggtcagagtccgccaggccatccgcgacacggtttcccattgcatttcgacggccattgtccaaccattttgggtacttttttgctttttctttccatccaattttttctgtcaggtgattatggtccgtcaaattgcgcagcacattggcaacgacaccaaatacgcgccaattgccctcctccaaccgttgcgtctcatcggtgacgaggagggaccctccggccttttctccggcctcattccccaattgattggcgtggtcttcttcgtttggggctctgctgttttgagcattgtcgttgaagaagtcatcaaatactcggtcagaaatgatggaattcgtcgtttgggggagaggaaaaaaccatcggataacgaaaaatcggcggacggtcatcaaaaatggtggcattaggtcaggagaaggaccaggacttggatgaccagcactagtaagggtacttcaccaatctccggtcgctgtccaaaatggtggact

SEQ ID NO: 8233 - DNA, 964 bp, Heterodera glycines
atattaaaataattttttttttaaatgccagttatacctttttaacaaaactttttataattaattgtaatacctaattgttatttatctatatattgacttttttttcttttatatgccatagacatgaaattttgaaatgaagttatttagttttttggatatgcattattataatttaaaataattaattcagaataaattttaatcgttaaattatcatggtgtcagaattctgttagtttggttttaggatattttttttttcatttcaaatattatctgacatatgacttgagctttgttcaaatattattttaattatttttttattatcaagccttagtttttttaaattatacgtctctataaatattccttagactattatttttatactttatttttggttgtttaatcttcttgcttaattatttataaaatgcattttcttatttttcggttttaaaatttgaataaatattatatttatatattttgaaaaatcgcgcgagtaatttattagtgatgctcgagaccaaaaatttcccgagactcgagactcgagaccgagactcgaccccgagaccgagactcgatcccgagactcgagaccgagacccaaaaccccgagaccgagcccaaaaaaacccgagacccgagactttttaaaaaatttttcttacacacttaaaaatcgaaaaaaatcaatcttttgagtttttttctcaaaaatttttgttttttttccttatttaagctaccatacatttttccttttcatatgattgacttttttacaccattttttgtggtgctctttttcaaaaaaatgtttcgggaacaggggtccggcggtgccgataggcgccgccgggaaaattttttaaaattttactgcaacttggtaacggattttgtccaaaaaatgaccaaattttgcgtctttgagctacttttttaa

SEQ ID NO: 8234 - DNA, 2295 bp, Heterodera glycines
ccgccggagaagaattttgaaatttttagtgcactttgttaatagatttagtccaaaaatgacatttttacgattttaattgttaaaattgtgtttgaactcccatcgaaaaaacattaattttgaaaaatgagaagaaaaaataatacttggaggggaactgatccaaagcaaaaatgaagacatgaccaagaacacaacccactgagccacgcacactattcacctttcttttatttgatattttaatatctaaacttttttaattttatgtgctatttttcattaaaagaaattaatacagattaatcattttaatgtttggaaaattagtctaaatatttaaaagtattccattaatttgccataatttgaaaaaatctttgttcacaactttatgatcatattacgcgaattttgtcaatattttattagttttttgcaattttatgtcaaatttcgcgatttttggtacatttttctcttttattttttacacgtttctatggccgataactcagtgcgttcttatcatttctcattgttttttcccaaaactcataataactgtttttttaataattatttagttgtttttcattccaaaaattcgcatgcgattttcatagccttgcgcgcctttatattgataaaataaaatttaacatggacaaaaatgaaaattaagccaatgtacataaattattatgcaatagaaatattagtaaaaaatatttgaataatgaatacaaaatatttttaaaaatatattaagttcagctccaaattttacttttaaaagaaatagaatgttaaaatttttaatttttgtcaaatattatttcatcgtaactgatatattctgttttaaaactagctaatgtaacgccgcttctcgctcaaagcattcttcttaaaacaattgttaaatctaataatgttttttaatttctaatttgaaggtcttaggttttagatttatatttatttattttataaagcttaattgtcagtattcagaatatcagttaaaatttttggttaatatttttctccaattaaaaagtccgcagcattaatatttaataattccccaattgttatataataaataaatgaaaattttaaatttagtcctatttattattaagaagctttaattcattttaaattaaaaaaaattatatacaatttcaatctattaacatgatcatcaagtggtaaataaattaaaaattataaaaaggaacatttatgttattgaattacaatataaaaaaattatttttattgatttcaatattacaatagaatgtgatatgtttttcctctttctgcgcttcttcgctccgggctccatgccgaggacttccgtttcaaagttcagcaaccacttggtgaaggtagccagtgggtcctcgacgaccttgcggcattccacgtccgtgtgccagaactcaaacggagaccaggcataagttcggaatcggccgcagagagcgcaggcccgctccagctcctggtcccaaatgcccttctcaatgcagcgggtgcatgtcacatgggcgaagcagaagttgacctttgtttttttttttaaattgtgtttgaattcaaaaaaataattacctggtgcttgaaccgcatgagttgcgggtcgggcttgaaatccgtagtgcactcaaagtcaaagaagacgaagcgcttctccttcttgactttaggccggtatggtatgtagcagtctcgcggggcatggaagccgagacaaattttgcagaatttttgaccgcaaacatgctctttttgttggtgatgctaaagagaaaattaataaaataaaaaaattttattttataataacccgaatttggtaaatcacgccacagtcgacgcatttcttcgagcttttacaaattgattttcccacaatttcatgttcgttgtcacgcttgaccctgtagtttgtacatttggcatggtgttcatagcattcacgacttttaaatgtctaaacaaaaaaattctttgaaacgaaactcaaataactttactttattgcaccccaagcaggtctcaaaaaagttgtcattgccttggacgcagtttcctcgaaaggcagacccaacacgcaggcagttgtggcatttccatttgcattttgctgtgtgttgcgtttgttgatgaaatggcatctcacactgtaacatatttatttaattacagtataaaatatattattatagatactccaaaacaatagttgcgggcactgaacagttttacaacattttt

SEQ ID NO: 8235 - DNA, 5978 bp, Heterodera glycines
gccggcgttcgcgttcatcattttgtaatgacataataaaatgttggggatattatgtgaacattaatctctatcgcttagcaaacccgtgagagcatttccgatatcccctcactttcctttgatttaataatggctttgttgtacattttacaacaagggctcagtgatcaatcgatcggaatgttcgcgtgttgtgtatttagcagggatggcattccgaggcctaaaaaattttccgggaatcggattccaaatcccctaaattttcggaaatcggaattccgtgccatccctggtatttagcatgaagcttttgcataaatttttttaatggaaaacggagaccagaagagcttttgaaaggagaagtacatagcaattcataacaaaatttaatgcgtgatacaattttttggctctatcgcacttttttaggcttccaatcgaattttaggcatccaatcaatgaccaacctcagtttcttaggccataacttttttctttcttggtcaatgcctacattcttggtttcaaaccaaagcttaaagtcccgaaaacataaatttaaaaaaagaaagcaaaaaatatatttattaggtttcaaaatttttggcaatttttttatgagtaacaaggttaaaggagagggagggggctggggcgtgtttgagtatcgatcaattctttttcgcaatgcgaaaacccaatttttagcccttcttcgtttctctccattttccatctttcaaaagacaaacaattcattaaaagctcttcttcagcagtcgctttggccaaaaaaaagagataaaacaattccatcaatataattaaaatgaatggaatcactgctggggattatggtgcgattggcggcacatatttttggttagagtcagcaagcagcttattttggagcaaattaaaaaagcttaacccgattttctattatttttttttgataaagatttgtttcctaaactttgtctgtgacatgcgaaaacaatttttagaaacaattttttcatcaaataaaaaattcaagaaaccaactttgtattttattaccaaaactctatataaaagccaggaagaaaactgtttgcttgctttggaatggccgaacaaatgacaaattaattaaaatttgcgttttttaattaattgttagtaattactaatcagtagggcgtccaaaaatatggatataaaatcgcgaaatatggccataaaatatggacaacgaatcgcaaaatatggacataaaattgcaatatggacataaatttttccaaatttaggctataatttctcaaaatttcttcaaattcgctaaatgcaaagtaaaacttaaatgcaacaacccaatcttttaaaaattcatggttcactccagcaaaaattatcagcaaaacgtactgcggcacacttgacaacatcgcctctctcaacaattccatcgaaacgacaacagtttcttgacggcgcggcgcaattggacatcacagcactgctaaccagcactgaagtgtcagagccagtccgtgcagtcattctccaactggacgcacttctcaagctcgcggtggacatggttcatgagacgtcgatccaggacactcgcgcggtactggaggaggaccggcgagaacattcggtcgttctgatgggcgttccggaatcggacagtggcctttcctctacacggcgcgcgattgctgaccaacagcaggtgttagacattctggacgtttgcgaaatcgaggcaatgccgaccaaggtttaccggatgggccaaagaaaggaaggaggtccccgacttctcaaagtggaaatgccaacccgaaagattacacaaacatttctccgcaataaaacccgtcttaaaaactccaaatttcaagctgtctccgtccgtccatctctctcccctgaacaactcaaggagcggcataatttgatcaattgttgcaagacagcccgcgcccaatttcctaatctcaatttcattgtttatgctggacatgtcattccccaaaacgatgtctctgtttttcgtgatgaccctggtaattattcctgtttttgccataaatccaattcataaaatcttgcgggaaccacccacactgaaatttcaaaaaattttacaaacgtaaattctggtaccgcaagatttttcaaaagtcctcataaggttaataaatatatacaaggtgctttagttaatataaggtctatctataacaaatgcgaacaattagaaacaatttttgaatccttaaatttagactttatctgttttactgaaacctggggtaaaaatgaaaaccaatttccttttcattcaaattttcttcaaaatcataccatttcttacactaacagattgaataagcgtggaggaggcatagcttttgtcgctaaaaaagatatacagttttttgtaaagttttctgaaacaaaatttgggtgtgaaatactaatattgcaatttcaaaattacaattcactaaatttgattcttatttatcgacctccttctactaatttaaaaaataccaaaaatctttttaaattccttgacctttacatttcggaaaactgttgtatacttggggattttaaccttggaactaaagatttaactataaaaaataaaaaacctttccctttaagtaattttggtaatttattttgtgatttctttaataaatataatttgacatcctgcattaatgaacccactagggagcaatcctttctagatttaatcctttcaacaaaaactgacttaataaatgcggtagaagtaaaaggtggacttttagatacaaatcatctaacaattctttttgatttttgtgttttaaagcaaaatgcaaacaagaaacaaattgttcttaggaaatacactaaaactaatacctttctattcgatgcatatttatcctcatttctccctcaactactacaaaaattttatacagttgaggataaatatgctattttctttagttctgttcgaagaaatcttgaaattaatattcctgaaactattttatctgttaagtccgccaaaaacttttacccaccgcatttattggcttcaattagggaaaaagcacgtctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaaaccagtagaggatccaccagttattcagtataatactttgtttgtttcagactcaacttctaaagcggaaatttttgcaaaaattttttctgaaaactactgtaaataattattctcttgattttgatacttctttttcttctccaacaataaacgacgttgaatttaatattatttctgttggtaaagttcttaaaactttacctaacagaaataacacatcaccggacggtattacctttagactgttaaaaaattgttctctttcgtttactccttttgttactgaaattttcagactctcccttgatacaggaaagcttcccactatatggaaacaatcgattattatccccttgcataaacaaggggaaaaaagtaaccctatgaactataggcctattgccttaacttgttctttatgcaaaattatggaaaaatttattgtttggactatttccgattttcttttaaagaacaatttattctctgaacatcaatttggatttataaagggcagatcaaccacgacacaactaatttcaacccttgaaaattggtatgatggtatttataaaaataagaatatcgattgtgtctatatagattttaggaaagcatttgatgttatcccccataatttacttttatataaggttcatagaatcggtattaggggtaaaatcttaaactggatatctgactttctttcaaaccgtacctttagggttcgggttgataatactctctcttctgagtataaaatgagctctggcgttccccagggttctgttcttgggcctcttttgtttctgatatatattaatgatttacctgaattaattcctaaacctaaaattatatgcggatgatgtcaaattatattccgtacataaaacaaaaaatgatagaattgctatgcaccatgctttaaatattctctctgattggtctaagaaatggtatattaaaatttccatcaataaaacttttattatttactttggaaagaataaccccagggaacaatataaaattaatgataatgcaatttgtgaagttgaaactattcgtgacttagggattcttattgacaataaatttactttttccgaacacataagcaaaattacccgtaacgcctactaccgtatgcgtttacttttccgtgttattaaatcaaagaaaatttcagtttggaaaaatatttatgttagttatattcgtccacttctagaatattcccctgaatcttggaatccacaactaaaatcgcatattatcaaaattgaaaaatgtcaaaaatattttactcgaatcgctttcagaaaatgttgtcttccatatattccctatgaccaacggctccaattttttaaattagctactcttgaaaaacgaagaaaaatttttgacctcctaactacttataaaattctacatggttttacacatttggacccaaattctctgtttaaaagaactaacctaaatactcgaaataagtcatttttccggttaaatgttaaattacaatctaaaaaatcttccaaatcttttgttaacagatcagtcaaggcctggaatgcccttgataaaacgttaatgtctagctctttaaacacctttaaaaaattattagaattgactcttgattctgaaagcaccaatgtataaagaattattaacttttgaggcattttattgactttgacctcgattttattttcatataaatttttcgttattgtttatcttaacctgtgatctcacttgatatttattcacttactctgtgactattttactgtgatcagtcatcagagtaagtggttcccgcccttctgatggcaattttttctttatcgataaataagtaaaattttaacgcatttttgagttgtaaaattttattgttatacatagaatagaagaatttgtttttttagttttgtctttggattcttagttcttacaatttgagaaatgtctgcgagaccaaaggtttttttcgatgttatggttggcggaaaatcgacaggttataaactcggacaacaaatcgccctcattctctgttcaaaataggtttaggtcgaattgtgatggaattgtttagtgacatcgttccgaagactgccgaaaattttagggctctgtgtactggcgagaaagggatgggcaaaagtggtaattaaaaagtcttgaccgtgaccgttatggattttactttaggcaaaccgttgcactacaaagggtcgaagttccaccgcgtcattccgagtttcatgcttcaggtataaagttgtggcacttccgcgaaaaggaatccattaacggactccgttttcacattttagggtggcgattttactcgaggcaatgggaccggcggcgagtcgatctatggcaattgtttccccgacgagaatttcaaagagaagcataccgtcccgggactattggtaacgtttctggcaatttaaggaatggaacactcgtagcccatgggccaaaaaagcgtcatttttcaacttatttttaaattcagtcgatggccaatgtcggacccaacactcacggctcgcagtttttcatcagcacagtgaaaacagaggatgtacgacaggcgtatttagccattttcgagattcatgattaacacaaattaatctagcga

SEQ ID NO: 8236 - DNA, 2530 bp, Heterodera glycines
atacctttaatagaaaaacagaagatgcatttaaatactcctaagtgcatttcaaaataaaataaataattgtttaaacttttaattattttcattttaaagtttttaaatttcttctccattgttttttttaccaatgcaccgcaactccgtcaatggtctgttcaccgcctggtgttccgtaaaactgaaaaataaaattttttttaattaatttaattattttcaaattgcataaacaaaaaagtaattttttatttatttttattgtataaattgagaaaaacaaataattaatattaattaattttttcaggcaaaattgagcaaaaataatatttttttatcgaattttgttaataaaatagcgattgaaaaataaaaaatatttttaatttttattattttttaaattaaaatgcatataacaaatttaaaaattaatttttattaaaagtacataaattaaaaacattttacaattttaattcaattatttttttaaagaaattgagcaaaaaaataatctttttatcgaaatatttttaaaaatttcgagtgaaaaattttattaaaatatttttaattaatttaattattatttttaattaaaattgcataaaatccaatttttaatttattattattattttatttatttattattatttgaatttgtgccctcctctcaccgtttccgcctgctcataaacattgctccgctggtcgtcgtgtgccattattttcacattttttgaggccaccgattttttcagctcgggcccgagaagggtggcggcgaattgacttcaaatttgacaatttaatttaatttcacaaggcaattaatttcaaaaaaattgttgaatttctttttcatgcaaagattttttaattttaattaataattcatgaaaatttaattttacaatttagctaataatttttaatgaatttaatgcttatgttttattaaaaagtttttttaatttaaaaaagttatttaatttttaatttaatttattttaattttgtattttttctacttaagtaagtttttgtaataacattatatttaaaatattagtgttgattataaatatgctcatatccttcattaaaactatttttttaattatcattagaaattaaatgatttttaaattaatttattatttttttttattttatttattctccattttcgccaccgttgtgttgttgcagacaaatacatcgcttgccaactccaaaagggcaaaagtccggcacctaaaattagaattaattaattaattatttagcaatttaaatttttgaattttttgcccaccgggctcattttcaattgtcagtgcccaaaaggtgagattttgtttcgcatattcttcaaaaaatctgcaaatttatttggttatataccaacaaaataaaataattaattaatttttaagtggcaaattaacgaattaattattgcctaattaactaattaattagtaaccgtcgaaaatattgggcataagtggcataatatggcccattgacggggcccttcatccatccccagccaaccattctgcccgtgtttttcatccatgccggcgccgacctgtccaatttggggagggaggggagggaagggctgaagggtttaatttttcaaaaattcttaaattttagggcgaaggggagggttaggttttcaaaaattgcaaatttcaagcattttttgtccttatttgtcgaagggttcggaattagcagtgcatttaaaaaatatataatttgaaaatggggggagggtggagagtttttttattgtaaattttttttgaaaattttttttttcgtttttttcgctaccatggcgacgcaaacagttgaagctcatcatttccaaccaactttttggctttcaaaatgtgtggtatctgaaaaattattttgagagtgaggaggtccatttttttcatttttttgaaattttccgttttttttaattttccgaatttttttgccttaagttcaaagtcctccttggccagcgcaaaagtagtcaaattaaaatcgtctgttttgtccaagtaagaataagcatgggtggaaaaatcacagctcgcaattggcacacggccaactgtgtaacggatgcctgaaagtggggaaaaagcgattggaaattgcgccaaatttgggatttgaccgaaaaattgggttgatcggatcaggaggagctcatattcactgatcagacaactgggactgaaatgagtatgaccaaaaatgggactgagctggccgggatcagcaaggcaaaattaattcctcgtcgtgatcagctaacaaataatgatcggaacgccccactattacatgggcaggccaattgaaatggccaagagcagtcatagagaaacttgccgactcgagaccgagaatttatcgcccgagacttctcagctcgagaatcaagattctacactcactgatcaagatcaattcgcggattggttggagactgatccga

SEQ ID NO: 8237 - DNA, 1157 bp, Heterodera glycines
tctctcactctctccccctctcactcactctctctctccctctctctctccctctttcactcactctcgctctctctctctctcactctctcacgcactctctctctctctcactctctctctccctctctctctctctctaaccctctctctctctccccctctcactcactctctctctctccctctctctctccctctctcactcactctcgctctctctctctctcactcactctcgctctctctctctctgtctctctctcttctctctgtctctctcttctctctctctctcactttctctctccctctctaaccctctctctctctcattctctctcactcactcgctctctctgtctctctctccctctcactctctctctccctctctctctccctctctcactcactcgctctctctgtctctctcttctctctctctctcactctctctctccctctctatcactctctcactcactcgctctctctctcactcactcgctctctctgtctctctctccctctcactgtctctctctctccctctctctctcaccaatgtccttgtcaaagtacgctttgagcagtgcgtcgcgcgtccgctcgtccaacgcgttcaggctgatgccggtcgagtcggtgaacgcgccgccaaagccgaaaatgcgctgacgcttctccgccgcgttgacactgacctcaagcaaaccggcgcaagaattggcggcatctttttagaattggcaaaagaaatggacaaagtgacaaaggcattcgacaaattatccaatggatggacaaaatgtcgactaattcttcaatgtgacaaactgctcaaaatagtggacaaaatgtgcaatgaatgtggataaaatacatatttgactaatcctcaaagggatagttaagtgtcgacattctggtgaatttcggccgtcaacccgaatattatgccaatgtttttgtttaccgtccggcgccaattcaaatcgtgccaaacgcttctccgccaaatcgctgacaaaatacaccaatttgtcctcggcatcgccaaaagtgcccaaaggttcgggcgaatcacaataatcggatgtgcaaacacagacaaaagaatcatgatcaaatctgagagagattttgtaatagaa

SEQ ID NO: 8238 - DNA, 1333 bp, Heterodera glycines
atttaaattaaattaaaattaaatttgtgaaattttactgtagtaaaaattttataataaaataaataattattgaatgatttggaaaatggatggaaaattgcccaatattaattataaggcacgttgtgatcattcaaacttttttgatttttgggaccatttgacgatttgacggtcaccagatagggaaagggggcgggaaggtaattaattagttaatgaggataattaacaattagcaaattttctgtccaaaaataaatgacaggcacaatagtaatattgaaaggtggataaccgaaaaatctttggtgtttttacttgttttctttttttgttttaaaaattctaagaattttttgggaaaaaattaatttaaaaaaatggtttttcaaaatttaaatatacacattcatttttagcgcttaatataaaaatcactctgttcttattgtacaaaattttgtagctttaaatggatgacaaaaaatgaataattatgaatgaatcaatgacaaaaattttggacgccgaaaaggcggcggcgtaccaaaaaaaagcgaattcaaaaaatgtaatcaatcgctgatttttaaagcaaaaaaaaaaaaacatttatttttactggttgtaaaaataattgtcatatttgataaaggcataatgaaagtgaagccaaaaatttaaaaattaatgcgattttttcacattttagaaaagaattttaaatcaattcaattttaaatttttcaacaacatttgataggtgagaaggccggataatccattaagcactttaaaatttggtgcttaaaattgaataaacaaaagtgcggcgatgggagagagagagaagcaaagagagggaagggaaaccttaaaatatttttaatgagttccattcatttgaattttaaatgatgtcattaattaaaattagagcccggaattttgagaaattcagggcccggacttcccagatggacccgggattaggattcccgggctaaaagccagtttgaacgggatccctgatccagtttgaatcttttaagaccccgtaccatgggttccgattcccatattttacccggaacccgggtctccaagatggaccccggaaaggattattaccggactaaaagcccagttttaaccggattccaagggtctgctcgacttttcaagacccggaccctggtttccgattgcaaatttttcgcggagcggctttctgagatgggccccggacaggatcccggactaaaagtattatactttgacatagcaccgtaaaaaaaatttgaattaaaatttttaataaaatctt

SEQ ID NO: 8239 - DNA, 935 bp, Heterodera glycines
caaacggaaaagtaaaacaccgaatggctcactttttcagttttaagaggtaaatgccataaaagcagggtagccagattaaaattttcaaaagcctcattttgggtcgaaaagcctcatttttacaaaatttattctaaacacgtttaaaatgttcaaatgttatatttttgattgtccatgatcaatttgagcatttttttgttagaaataagcattttttgggattctgaaattttcaatgcgatttgttaacagattttgtccgaaaaatgaccacattttgcgattttgagcaaatttttgcttgtaaattaaggatttttacggtccggcggtgccgataggcgccgccgggggaaaaattaagaatttttagcatatttttagcatattttcattaagaaattctttattttgcggtttttctcaaaaaaccacaaaaagcctcattttgaaaatttagcctcattgacctatcaaaaaaccacaaaacgaggctaaagcctcagatctggctaccctgcataaaagccggatttttatttttaagcttcccacaacaaacacggaacagaataatgaaacaaatttataaaattggccaaaacaattcagaaattttttatcacatgcaataaaaatgattaatttttattcaaatggtttgtattttacgccggcatgtattttttcaatatattttttttgtttccgctgattattttcctcattttttttttacattttcacaacccttttcccaaaaaacttttggcgaccaaggggggtccggtgccgggaaaatttttttgggatttttaatggattttcggaaaattttgaatatttttttctaatgccgatttccaaggacctccttggaaaaaggacaccttcaattttccaagaccagaaggccaaatccaaggacg

SEQ ID NO: 8240 - DNA, 4153 bp, Heterodera glycines
  misc_feature (68)..(68): n is a, c, g, or t
aaaaagatgcaaaaattaaattgaaaatgccaaagaatcgcaaaatgtttttccttttcccatgcatntactgtaattaaaaaacattattgtattttaacaaaacaatgttctgttgtgaattcaatttgcatccaaaaaaaagaaacctcgcaaagcgcggattaaaatgctcgatttgctgtactttttacgctgaggaaaatcgaaacttaaaaaaagaaaaacgaagaattaacgacggaattcgaaaagatctaaaaagcaccttaacagactctcacaatttgttttggtgatttcatttggcacgagcattttattagttgtaaagagcaattggattatcacaaaaaagggctgaaattgttgagaattaacagataaataaaacatgaaatagaataatctgcaaaatattttcataaaatggacacttttcgttttccggagggtcctgaccctgtccgagtactttttttcgtttgaaaaatgtataaatgtatccggaccgattaggggtccgggaacatttttttctgtaaaccggaaacccaatatgtgacttaatttcaatactgatcataacgctcaaaagacaataagtgtgtgaaaatgaactattgcatatttaatgcttttctgattttaaactttataaaggagcatgatatgtattccagtaacattttgagatatgattaggtcttattccaccatgtgtgaaaaattataaatcatatgaaattgctttttaattaatttattcttgcaattaataatccaatgtttaaaaaacaacaaaataaataaatgcaataacttaacaaaataaattaaggagtggcaaaacaataaaatcttaaggtaaacaaccgcgcaataaaaagaaaaaggaaaatatcgccaaaggaataacaaagtaaaaataggtaattgttggtaagtttgatgagccctgctgatcagaaaatcagaattttgggtaaattaaattttccaaaatttagtggagagagaaataggagaaaaaaagtttggttgcggctttatttgcgtgcaaaagccaagtccatttcagaggtatcacctgcgatttgacggtttgagaactctggaaaaactaataattaattattggttttactcattaacgtttcttacattaaacataggtattacagtactactaattgacctctatggttttgttttgaaaatagccaatcaaaatgaaagccctttaaacattttttaacccatttttgcgaccggtaaatgcggacgatccaatgttcgctggtgtacgcctcttccaaatggagcaaattgaagtttttgttgccaatttctgcatgccggacgcgatcgtaaccggtggcacggcccttttaagtaattaagagaaccaatttttagttgcttaaattctaatgctttactaagcttaaattctaatgctttactaaaagttgtcaataaatcaaaaaaccccaaatattcctaaaaattaaaacaaaaactataaatattgcatttttcgtagcatactttttagttataaaaaatatacggctcagttaattaagtattattgaaggctgtaaagaacgtacatgttcagtgtacacagtgccgaagcgatgatagcacaatttgtacattaaacagttgagcattgtagaggaactattaaaaaggtcgccttaattcataagttttagcattggctaacccctccttgtcaatgcgaaactctccattctttgtgtagtaatcattttcgtgaatgtgtcgcccctccggcgtcgaaccgccgattcggaccatccacaggaatttgttgatgtcgaaaaaggggggatttgtgattatatataaaagcagggaaacaaatcccaaatactaatttgcgggattccgcgtggaatcgttcccgcgtcgatctctaatatgtacttgtacgctcactaaccgtcagatgaatagccggtgactcctccaaaaatgaccagcacatagtcgacgtccaattcgtgcattatttcgtatgcatgcgattcattcgatgccatcgcttgtcctacacgcgaaatgtgtgtgttgttccacgtattgttgtccacgattgtctgattgtgaaaacaacaagcaattaaacagctgatgagcatcactaaaccgttcggttggccattgccgaaatttggtagccataatcccaccaggacatcactttcgcatcctgagcaaataaacggtggcgcttttaaggtaaaagaaatatttggttgtcttacatcgggcgtgtttttacgtaaccagtaataagcctcgcggaaatcgtcgaaaattatgcgtccgccatcgcccgaacgcgcggaaaggacaatggaaggactgctgtacgcctcagaagtgacctaaaaaggggacaaaaattgcagaaacaggcaaatttgcaacccaagtgctgtggtacacaaaactgatcagacaaattgacatggccagcgtaaccgccaatgaaatctaatgtaaaaaaaagcatcggctgagtctttgttccctccgcttcacctcctgtttgtaggggtaattctcatccccccgatggtaccgtgccgccccgctcccgccgcttttccctcctccgcccgcttttcctcctttctccgccgcattttcagtgcctgccgacttcccctttgacttttcagcgccgaacaaatcgacattcacaacgtaattcccaagtgttgaagagacagcgatgccgccgagaatacacctgaaaaaagacaaacttgtggagtattaaattatccgacatgacagttaaagctcacatgattggagcgagaacgagcatcaaacggaccataaccccagcaaaataaatggaagtcaatccatagagaatgatgaaaatattttgatctgtgagttttttgaagcaaaaataaaggccagctgaaaagggaattaaaatggaaactgctgggaaaataagtactaatattgtaccaggaaaagtgaagaccaaaaattgaaggtcaaaataaaaggaactccacgcggtgggctgatgctccgagacggaagcaatgatcggaatgttattcttggcataggatgggtccaaaagggaatagaaacggcccgtccatggcgcaatctctggaagaatggacaaatgaaagcacatggaaaagacatggaaattcactgtgaagaaacgtcgccaaaatgagtgctaaaaaggcggcaccgccaaaaacgagcagaacggagcggaggagcagctgaaaacggtcggcagtcattttggaacgcatccattgggcaagtgcgacgatttggcaaagtccaaacacaccaaaggcctacaaatccaagcaaatttgatggaaatggaaaagaatgaatgcccaaaccaacccccatgtgttcagaagttgagacgggttgaaagccgacaaacggaatttgcatggacaaaattgtgcccaaagagtaaaccttgcaaattgaaaaaacattttggaacatttttaattttttataccgtcgaataagcgacgtaaattcgatgagagaagcgcccggtgcaaattaaagtcaaaaaaagaaagggttaaaagggaaaaatcaaataattaaaagcaattaccaacacatggagagggatcagattgatcagaaagacgtagccaccccaactgagtaagaaaatgaaaaatattggttgttgtttgtgagtcattttatggtttggacctggacaccatgtaaaaataagagagcgcacaaagcacagaattgaaaatggagcccgatttgacggatttgatccaaaaataataggtgagcagcatgcaaaagatggcaatgccctgaaatagaatagaaaatcaaacaaaacttgccgtaatgtttaaatcccgaaaaaaaaacaacttcgttgtcgtatgaaccggcgacagaacgcgaaatgtaaccggggacaattgctgaaaagagaaaggccaaacagtgcaaagggtagtgaaacaactgaccaattaaagcagcagcgataagaccggccccttcgctctaaaggaaaaaataatgttgaaaagggcaaacacatcatattttgatattttcg

SEQ ID NO: 8241 - DNA, 1990 bp, Heterodera glycines
  misc_feature (1971)..(1971): n is a, c, g, or t
aattgctgactccctggcgaatacctggattggttttgctcgttataatttttttcaaaaaaacgactatctcttttttcggggtaatacgaaataatgccaaaataaatggacgtccttggaaaaaataattgctgactccctaacgaatacctggattggttttgctcgttataattttttttcaaaaaacgactatctcttttttcggggtaatacgaaataatgccaaaataaatggacgtccttggaaaaaataattgctgactccctaacgaatacctggattggttttgctcgttataattttttttcaaaaaacgactaactcttttttcggggtaatacgaaataatgccaaaataaatggacgtccttggaaaaaataattgctgactccctacgccgaaaaaacgcacaaaaacggtgaaggaactgaagaggggagccaaaaagacgcaaacttcgcgaatatcgacggtgacattgagcaggttgaggaagcgatggatgaacatgctggtcagcataagccctaacaaaaagtaagaaaaaaattcaagaaagaaaaaccgggataaattgtgccgccaatgatacgacccaaaggataccacgcaaatgctaaatttccaatgttaatttggcgaccattaactttgaatggtgcgttaccgtcgaaccaattgtggaagttgtagtagccctcttcagtaaggtatttggtggttcggtagttaaaatacgggtcgaattcatgctgaaaacgaggaaagagaccgtttgtttaatttctattaaaaaaaactgtcaaaagtacttactatgacagattcaaagcgaatgacggcaaaaagtctgacgagaaaagaaacaatggccgaaagcgaaaggacaaccaatttcagaagggtttccttctgtttgtgagagagagccaaaaaatcgaagagagggacggcggagacggacgacgaagacgatattacggtcatatcagggaaacgatttgcagaaattcaatacaaaaaaaaataaaattcctttaatattttttgaaaaatcaccaatttttaaacaactggttttttcaattgaattaggagtcactttctcaacttttgtttgcttattattagggcgtgtaattatatggaaatccatatttttttcctggactattggaggcctgaaacgcacgaaaaacatgtttttagcttggtttgaagcttctaggatgtatttctatatccattttttccatattttgcgatttatgtccatatttccatattttggcatttttatccatattttatgtccatattttagcatttttttaaaaaacctctattagaacggcccctatcagctaaattgggatttttgacccgaaagaccggaaaatttttcagaaaaaactttttttgtcaaaattttatcgaaactataccaaaattttgagatataccctaaatttggaaaaatttatgtccatattttgcaattttatgtccatattttgagattttagcaattttatgtccatattttgcgatttgttgtccatattttatggccatatttcgtgattttatatccatataattacacgccctacttattatgtatcttggattgaaataagaattttaaacaaatttagtgtctaggaacaaatgtcaggaaaaaccacggattgacattaaggtaacatggataaaaaaggtaatcgccgcgttcgcctgttcaaacccctcccgccaggacagcccttcccagcagagcatcacccccagcacgtccaaattacacggtgttcataaagcttttgcatgtcaatatgaatgaaatatattaaaagtaatcgggtattactattatatagaactttccaaatattcaataataatggagtgctaaaatattaagacccaaattgaaaatttacaattaatgaattccaatgantatattgtatcttcaaaga

SEQ ID NO: 8242 - DNA, 2182 bp, Heterodera glycines
tcatttgaagggaatcaaatgtttaattctcgggattggtgtgggaaataatcacagaatgggcaggcacagacgtccaattaattggagttggtcgccttcatacaaaagggtgtcctgttttggccaagggagtcaaaggacgaccagtcggacaacagaagaggaggaagtgggggaggggggggagtatttgttgcaatgtttgcaaagcatttgctgtgatcggagatggtgtttaagaaagacgccattgtcaatgatcaccaatcactcagccaacaaaatcataagttaattagcgattaaatgattctttttaatgaatgaccagttttttccggggtttcgatgtatatacgtataatttttataaacaaattgtgttcagaaatgggtctttgagtaatcttttacacatttctgatgctctgatcagttcaaaatgccgcaccaattcgaaacactactgacacaaaaaattctgctgctgctcacatttgcactctttgctgagctccgtttgcattttttccgcccatttcgcaatttcattttctgctgatggatcgtcgtaaaaatttggcaattctttagtccatagtaaatgcttttcgtcatctttttcgactttatttccccgcgattcaatgatcagttccatcagtcgcaaaagttttgttcgattcatttttaagtcggacaataataacaactgaataaagtgaaaaaagagagcttttggcaatttgaaaccatcggccttatttctcacttcgcattgcttctcgaattcgtcctccgtcatcagttcgcgcacatccgaaatctccgcacggacttccgtcaggcgatgctccagcagtgggaccaaatggcggagattgaacgcgttgatcacgttgtggttgatcgaaatgctttcttcctgaaatcggcattaaatgcaattggcaattttctgttgttcgccgttatctgaccaaattgtgcacttgatgccaccagccggaaggcacgaaaacaatttggcccggttcctgcacaaattggaacagttcgtcgtgctgaaattgccccaaacactgccgaatgtcctcagggtacgcgccgttcgcttggcgcacgcggcgttcggcgcccggccgtagcaaataccacaacttccgaccgcaaacattggcagaccaagagaaggaattgagcacgtccgagtggaaaggcgtcctcaaaaaggaaaagccaaaatgtgaaatgaaaatgtaatcatcggcagacagcaccaactccctttggtgccgaaataaacaaaacggtaatcgcccccgaatggattctgctgctgatcagtgactgtccatcgttcgtaattggcccaatcgaatcgtaaaaaggcgggcaattcgtacaaatccgactcttcgggatgagaactgaaaattgcattgttcaattggcattttggagtattctaacttttggaagtgccaatctttaagataggccactttgttctttgtttcattgtcagttggagaaaaaccgaaatattcgtcaataaatgagctaaaaggcatttgagttggacaaatgtccgtgccgatcagaatgggcacagattctgtgcctgaaaaaacaacggccaattatttgcaaaatccatcctttttctttagtaaattccccttcactcagttcgaacgcctttaacaattaaaagtaattaagaccaaccgaatttcgatttgagaaattcgaagtttggtcggcccgtctttcggtcgacccattggcgaagagcacgccaatgagcagaaaaattggagcagagaatgcaggggacatttgcaaggagatgacaaaaaggaaaacaaagctattatgcactaatacaaataccgaacttactgaattagtaccccctctggattaaaaccactattttcgaaataaaaccaccggaggtactaattcagtaagtacggtacacagcaggagaggagtgttaattaattcccccacatttagatccaatgagttattttttaattttagtccgtgacaattacatgagaactttttaacaggttttcacaatgtttcaattaccgaaaaatgaaatcctaatttgatatttggtcgagcggagacaaggacacgcaagacataaaatgaataacaa

SEQ ID NO: 8243 - DNA, 2467 bp, Heterodera glycines
tcgcccgtcgtaaatatcataagaaaatcgcctctttcacccaatggaaaagcacattgccatggtgaagcgaaaactgtgctttgatgccactgcgcccttcactcgacggctcctcaaaatggaaaagttcacggttaaaaatattcaatattttgcacttttaagcaaatcggtgtggagagaataaatgcggaagatttggcactgaaagtgtccctttggaggtcgagtcgcggcgtccgtccgtcgcctccctcttcgtcctcctcctccgcttcattggcagcgcattcgctgggagcaaaagaggaagtgccaatttcaaaccacaaaagaatgccatcgcaacgacccgcgtaatgactgacgaagtgcacctcctgcttcattttggtcagttggccaagcgcggaattggcctcaaacatttggaagaaaaattattatggaggccaaataaaaatacaaaaaatatgtaaatataacaaaggaaagcgcacatctgtgccaaattccattctaagcagttccactgggtcagataacgaatcataaggcaaagtccgactctccaactcttgaaaatgtgtgacgcggtagtcgcccatcggagagagatccgccccacaatatgtgtgccgccgttcctctgccgacgggagaagtgtacttcgcgcgtgaagagtatccgaactaaccaaacaaccctgaggggaaaggggcgctttagggaaatgcaatttaagcaatgcaaaaatgaaagagtcgtataaaaatgaaaagcaaataaccgcagtgaatttttcaactttaaattgctgtaaaacacaccttcaacaaaattagagaggggattagcaatgcgccaggcgaacggaggcgtaactcaatgatagaggcgaaatagtcatctcttagggcaccgatggaagaaaagggccaaaaaagaatggcaccgccaggggggcaaattgctgatgaaaaagcattgaaaggattcgttcggctgctcacctttgtccagcgtggtcgccgtcccccgacaaacgtagcgaattgtcgcatgagcggacgcaacgaacggaaagtcaccgggacaatcgtccacggtcaaaagcaaatcggtgcagtccaaaacggatgagtgaggacggagagagcggagggcacgcgagaagaaagtggcgatggaagggtcattcatggccaaaaggtcgagcgaagaaggcgcacgcaaaagttcacgcggaggggagggccaaagggagctgaaaaagcaaaagagtgaattcaaaatgagtgaaaaaaataattaaaatcatggcgtaattgaatgccaattaataaacgagtgacccaccatttgctgctgtgtttgggctgaacatgcaaagtgtggtccctgacaaacacttcgaaatgaagcgaatcgccggcattgacgtaaaggggcggataaaaggggaaaagcgcctgttgccagcaaaaccctacagaaaaagaagaaaacattaatgggaaaagaaaggaaaaggcaacaaaaaaccaccattttaaaaacaacgaaccttctgctggcgaagtgcaaatttcaaagccatcgaaaaggtcgagtctgaaagaattttgatctcattattagatatttctattgaaggtcaatgggaatacctaaaccaaacgcaaacactcgaggccaacccagtggaattggccgtgagaatcacttcggtcaccaaattgtcttaaacattggattcgccaacgtaaacattcaaatgtaattaagagttttcgatacatacttgatacgatttgtttgagttgatggacattcgaaaaatcaactaaaagtccctcgattggctcagaaagcaaccgataggcttcggactccgccgattgttcgggcgctgtaagagacggaagttcgttcaaaaacgcgcaaaggtacggagacggcggcaaaataagcgaatgtttctaaaggaaaatagcagattaatttcacaggattatgccatataatgaatgatctaagattagaaaattaacttctctagtaattaattatgtggtaccaaaatatgggggagaaacgtaaggggtaacaaattgtaataagaatgacaggctaacatcatgtttcgctttgtttcttgtgattcggttaaattttggtttttaaaattgacaataaccttcgagcttcaccaaatgatgttctaacatcaaaaaagggtcatttgaacttcttaaatttgacgggaccccttcgacaaatccagtacaaaacctcctttgttttgcaggtttacaatcatactcagtgtcagtttttagtggagggaatgggtgagggtgaacctccttcttcggcattcgtttgtttggtccggaatttctctccccttcaaaattcacttctcgctgctgctgctcctcgcggatgtaacaggaattg

SEQ ID NO: 8244 - DNA, 2021 bp, Heterodera glycines
tcatcacgagcgaattcaatagcacggctgaataattcgacagagcgcaaaagtttacctcaagcaaccattaattagttgataaaaagtgtaaaggttgggggtgggggagatttacggattttgtattaaaattttgagaattttagagttgtgggtaattttcctgaacctcgatcaaagaagcattcggcaatggtgctccaaagggacgactcattgggataaattgtttgggcgagttgaattaccttaaaaggaaaaagatataaaccattccaaaaagtaattttccgtttttacctgatcaactcgagaatcatcgtattcattgcgcaaatatgcacgtaacgcacccaaaaattcgtctttaaatttgcgccttccgatgccactttcggcgggagagggaacaaccggaatcattttcaagaccttcaaaaattgactaattttaggaattaaaattgaaagaaaacacaccgcaacataattgagcacagcctcagcaaattcgcgctttttaaagtgatacctataaaaacaaaaatttttttcaccaatgtttaaatctgccaaatgctaattataagcattttcttgggacttaacgtaacaaaaacattttcaaatgaaatttctacgctgttagaattttaatctttctcgcctagcattcgaaatggagaattgcaatgtgaccgaagttgtcagtgcaccaccgccaactcgacgaacaaagccttgctggggttgcaactcgcgaaaatttgcatccaatgccgcaacaacagcagcagggactcgcaaattattattgttgtcttcattaacattttcgaattgaggttcattgtttggaagcatttgaaggaatttaatgctataagtatgaagaaaagattaattcattgaattgttaagcgatgttttggtaatactgccgatggttgccccattttttgaagtttttattattttcaaatcatgaaaatatgcttccaagcgttttaatggtcgctgctcaagaattcggcatccatttcggtctatttcgaaccctgtgcccgaatttgaacaaaaagtcgaattcaaaaatctcaaaattcacatgttcgaatttgtgcagaatgaaaaacattatgaagtaaattagatatgtatgttttctctgttaatagagaaaaataaatagtacgataaaatgagagatgttttttttcttcactctctatttgttggttctctctcattttatgagaaggcgtgtcaattcaagtgccctttgtatattattaactttaacttctctttcttctcattagttggtacaggatttatttcgtaatacataatacgtgatcaaatgtattccttatgtcatttcattaattcagacaatttatctttagttcgtttttcccataaagaaattcagacagaaaattatttaacttattccttaaaccaaaaaagcatggttcgtcgtggtggtcgttcttcttcaccaaaagctagcgctccggttcgaagtgtgaaaagcacttctcctgctcgttcggccgttccgtctcgtcctgctggtactcaaccaacttccggtgcaacggcaccgcagcagaaagggcctgggctgctcggacaaatggctgcaactgctggaggagtggcgattggttcggcaatggtaaaagaataggtctaatttgatatatccacttattttagggtcatgccatcggtaatatgttctctgggggtaatgctcaagaagtcgctgctcagcaagatgttcctgccaattcggacaactttgaaaccaccaagcagtactcacagccctgtgagattgagtggcgccagtttcttgagtggtaatacttgtacatggatctattttatggatttcacattatttttcagttctcagaaccagagcgaaggtagcatctcccagggattcaacgacctcttcaattgtggagaagctcgctttggccgttagaccttgaaggaaggaa

SEQ ID NO: 8245 - DNA, 926 bp, Heterodera glycines
  misc_feature (9)..(9): n is a, c, g, or t
aaaaaaaanttgatccaaaaaaaaactaaataatattttccccattatttctccctcaattaaaattaagttggcatggtgaaatcaatagaaaacagcctgagattaaaatcaaagaataatattttaaagactattcgtcgatttgaacatttagaaaaaaatacataaaaaataactcgtttcttcatccaaacttttctttggttcatgttctgaggtataattttgactgcttagtttaaagaaaaatttcactgtctacaattattggactttattaaaatctctaagatattctgccattcatgcttgacggaatgtccgaagaccttgattttaaacactcgaatgggcaactgccaatattacactctgttaaaaaattataagttcaagtttttaagtacttcttatgatccatttaagtggaggtctaagcctctaccaaactgagcggacttggcacatttttaaatgggcacatcgtttttattcggtaaaattggaaacaaagaaaaaaacctaggtgatttcaagagaaaaaaaatctgtagaaaattaatatgggagatagtaacgcagtatttgctagaaaacccttttggatcattgcttgaggcaagtctctgttaagtgtatggggccttttgacggaatgcccaaaggctacaattttgaatgtccatttcagaaatcggcatagctacattttgaattataaaaaatttttttcgtattatactcatcattattggaactcatatttttaaaatcatgactggatcctccatagatcgattgagagacgaaaattcttgaaatacaaaatttctttcgacgaattttacccgtaaaaaaattatttggcctagcactattatgactttacttcaaaaacttcagcatttaaaaatatcttgaaa

SEQ ID NO: 8246 - DNA, 4506 bp, Heterodera glycines
  misc_feature (4423)..(4423): n is a, c, g, or t
atgccaacccgaataataatgatcaaataatacttatacattcgaaccaattctcagagaaaatgctacagcatactctacgggattttttttaaagtattgaatcaaaatgaagccatccgattaatccattcatttgttaaaaaattatcatggcagtttcaagtaagggatgaccaacttttcctctattaataattctgggccaaaatctttttggcatgtaaaatattatgtaattcatacattttaaaaaaaaattgatccaaaaaactaaataatattttccccattatttctccctcaattaaaattaagttggcatggtgaaatcaatagaaaacagcctgagattaaaatcaaagaataatattttaaagactattcgtcgatttgaacatttagaaaaaaaaatacagaaaaaaaagaactccaaaattcataaaatacgagactttgggaaacaaaattcggagatatcattttgactgcttagtttaaagaaaaatttcactgtctacaattattggactttattaaaatctctaagatattctgccattcatgcttgacggaatgtccgaagaccttgattttaaacacttgaatgggcaactgccaatattacactctgttaaaaaattataagttcaagtttttaagtacttctcatgatccatttaaggggaggtctaagcctctaactgtatcaaaatgcgaaaaaaaacaacttaagcaataccaaaataatccgttgaaaaaaaaaattttgtttttatttgactaaacccggaaactttgccaaactgagcggacttggcacatttttaaatgggcacatcgtttttattcggtaaaattggaaacaaaggaaaaaaacctaggtgatttcaagagaaaaaaaaatctgtagaaaattaatatgagatagtaacgcagtatttgctagaaaacccttttggatcattgctctgaggcaagtctctgttaagtgtatgaactgggcccatttaaaaaatatattgaaaattttagatgcttttaaaatatgaattaatcagcaaggtttatatttttgtgttaattcgaacagtgaaattgtttcaattaattaaaattattccaatattagtttgttttatccaaattcttcaatcggtttaaattccgttctttgcttcaaaaaacatgacggaatgcccaaaggccacaataaaatattggttttctaatgattgttacttcggcaatgttcggttaaaatgagtgatcactaatcagaaacagtgaaggaaattttgttgccgcaagaacgttcacatataatagataaaagctgcttgtctttagatggatgtaatggatttccggtactcggagaatgcactgtgagagaaaaaaaaactttggccgattaagcaatttaaagtgtaaagattaaagtttgtcagcataaaataaaacaacaaaataaatttaattaaaaatcaacaaaatgatactcagcaattaggtaattaaagcatatcgaagatttttatttgatctgacggattatcttggattgatttacaaattttaattttggcctcttacttgacggtactcccaaaggagttcaatattaaacttttttttttgctgacaaaaaaaggaatacagaaaattcttatttcttagcaaatattcgaagagagcgagcagaataaataaatttcttataaaatggtcacggcgaatggggcagagcaaatagaaacgaattttggcgcaataaaaaagactcctgcttttgggcgcaacattagacttgccgtttggcgcaaaatatgtaaattggcctattatttttagcgcaaaatgaatttgacaatttttttaataaaattcagtcttcccattttgggagcaataagaatgtgatgatcttcccattttggggcaaaataatagaattgtcgttttggcgcggcgcttgacttgcctttctggcgcaattagttctggcgcaaaaataattttttttttttttttgtaattaaaaatagacttcccatttttggggcaaaaatatcttcaaattggttcgaaattggccatttaattttttttgatccgaacatgactgatctcccgaaggagcggtgcacctcattccattctcgttccccaacacgcgcaaatcccactcgtcctcctggggatggattgccggcggcgtgccagcaaccatccggtgctaccagtgaaggtgctgatgtccagcccagaatatgaggaagggaacgagtgagaacgaggattggatttggggggaaaaaggaataagccaaaatccgggccctggataaatggcctccccaaattggtaatcccttgggcgcccactagatcgaatacgcgtgcggggatgggcgaggagtaaaatataagataaatattggccaatcacataaaataataattccgccgcgctttgctctcggctctcgctcgccgattaactgctcacccaactgactccttatcgagagaatgctcccgattaaatagttggacttatggaacggaaaatggaatggaagagagcgtggatatgtgcttgggaaagagataaaacggatgtgattaattgcgctttacactatttaaatgaatttcaaacttagccccgtatttacaattgttagaagaagcataaaagcagacagtttcttggcaagttgaaaggttgctggaaaaacgcacaaatgtgggattattccggccaaatgtaaaccaaagaaaatggcagccattaaattttgcgaagaatccgttggttggtcacatttgtcagaagattgatccattatttagactgttttgaaaatgggattttatctgagagtaattgttcaaatagttacaagactaagattaacaaatgcttcttaattaaccacaaaagtttttgtaatttattaaacaccgaaaaattgttcatttatcttttattgactaatgcttttgataatgataccaataataaaggattttgctcgattattaacagggattctttttttatgtaagaaaaatcgcgaaatatgtataaaaaatgctaaaatatatatgaaatatgtactaaaacctccaaatatgtactaaaatatgtaaataaaaatttttaaatggtgatttttttggaaaaaaattctttataagggtgaaataggcacaaaatgccataaaaataggattagaatcactttttagtattttaaattaatttttaatatctcattttttgaaaaaatcgattttttagaattttttagtttttcgcaaaaaaattctataaattctcaaaaatcctcaaaatatttaaaaaaagaaaatatgaacaaaaaattgcgaaatatgtatgaaaattccaaaatatgtataaaaatatgtacatatgtaatatgtagaaaaatccgaaaatatgtaaaaatatgtaaataaaagtcccaacttttgttcgcaaacacaaaaaagaaagtgtttttcctactaattttacattaaaaaaatgatccctggtaattacagtaaataaatagggtgccttttcgtttcttgttttggtcagaatttctgatgatcgaaataattgtatttttaattaaaaaattttagttagaaattatttttattttcttgatctcattgataacactaagtgttttctactagcctacaaagttttaaacttagattaactattctaaattttttgaggatttttgaggcttttggggaaacatcgtcagaatctgttaaattttatgattaattttgataaattggcataatgtttgacaatcatttaataatttgggtttttaaagagcgtcaaaatgaattctcacccaaaaaattttgtttaatttttcatgaaaaccagaaaataaccaatttttccgaaaattcacaaaattaagaatttttgcaatgaaaatcagcttaaaatatagtcaaaattcttaatttttccccggcggcgcctagcaaaaatgcgaaatgaaaaaaagcgaaatgcgaaacgccaaaaaatgcgaaattttttcaaaaattttacaaataatcaaaatcatagatttactctgaacaaaggaataattgcagaaattggcgttcaaatatgagcatgccaaaataataataaactgaagcattcgttttaaaaatttagttttttaaatatattcattcattcttaggtgtggaactttcgcatttcgcgccaaaaagcgaaatgcgaaatgcgaaacgccaaaaaatgcgaataatgcgaaaggcgaaatgcgaaaagcgaaacctcggcccatccctgctgcctatcggcggcaccgccggaccccttattccccaaaagttttttggaaaaagcgccgcnaaaaaatcaacttcgatttttcaggctcagaattttcacaaatgcttatttcaaacaaaaaatgctcaaattgatcatggaca

SEQ ID NO: 8247 - DNA, 3294 bp, Heterodera glycines
  misc_feature (3279)..(3279): n is a, c, g, or t
tattgaataaattatgaatttaaatcaggagattatcctctcttattatggaagagataaataaaagggcaggatatgatagtcgagttaatatacaattaacgggcaaaaggaaaaatactattaaaaaatgagaagcatgcttaatttttagtcttcaaaatttgatggcttcctagagacgatgattagtaaaaaataaaagaaaccatactattttaaataatatggtctcaatttaatcattaaataagaaaaacgttatcatatacaaaaacataatgcaaatgcataataaatgaaaaaacgacggcaaaactctccaactcaaaatgatgaagacgagattctcgttcgtctagaacgactcgaaaaattgctccaggggtctgggaatcctacccttatcccaatcatcgaacggcttgaaaaattggaaaaattggtggaacggctcgtagagggtgagaatcgatatggacatcgatttggtgacccccaccacacccctacttcggcccccacccctaagaacggcaatgttcaatggggtcaaccgccgcctttctctggcacgggcgccgtttctcagatgatcaccgaggcgatcatcaactccgaacagctgaaggaaaagtccactcgggcagtcatcgaaaaaatgccggaggcgatggacggacgggcattggtggaacaaattgcagaagaatgcggcatcaaagacaaactttcgccggacattcaccgccacccaaggacaccacctgagagcggggcaaaaagggaccgaattttgaaggtgccgtttttggataaatatcacgtgacaaattcctttacaattttcgtaatgcactgaaaaaatttcctaattttccacaattcatcaaagttcgcagggatatgacccaaagcgaactcaaaattttgtactccctgcggcaacaagcctatcaggccaatattgccgcaggtgagtacaaatattttgtggcagatttggagatcaaatctttgaaaaacccccgcccgctcagaactcgctagggatacgcgagcaaaccaaacaaaaaaattaggaataagggagaaaaaaatccctgtgtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaatttatttcggaccaaagcgattctgaaaatatcatatattgtggggattttaacatcccaaatattttatgggatgaaaataaggtaattcaaagaaatgaccctgtgtcaaatttattgattgagtttattgaccaaaaacaattgaaacaacatgtaaaggaaccgacaagagaaaagctattttagatttagtaattactagtgaatcagaaataattaatgatttaatagtacttgaaaatttttcaacttccgatcacaaaatggtcggattcaaaataaagggaaaatttagtcgtaataatcacagagtttatagaagagattttaaaaatattaattttgcaaaattaaatctagcgatacttgaaaatcgaattgatttagcaataaactcagtatacaccgttgaacaaaaatatcaagaattcttaaataaagtaatgaaattatatgatacgtttatacccaacagatctctaaaatcgataataaaacaatcatatcctcaaaaaataaaagatttattttcagagaaattacggttacataagcttgtaaaaaagtttcccgataaaagtgagattattttaaattacaaaataatttcaagggaaatgaaaaaacaattgaaccaatttagaaatgaaaaagagtcaaaaattatttcccaagggcaaaactcagttaacaaatttattcgaaataaattatcaaaaaattatgaaattcctactttaattgatagtgctggaaatatgtattccagtaatgagcaaaaatgcaaagtattagcagaaacatttcaaaaatcatttttagaaaattcaattgttaatggtccacaaactcagtcaacacagaataagaccaagctttttgacattgaattgaacgctggcataatttggaacatattaagaagacttccccggcgtaattccacttcacctgataatatcccttatattttattaaaaaattgcgcagatccaatcacaaaaatattagcagatatatttaggctaattttggattccggtcaaattccggaaatatggcgaacatcattagttgtaccaattttcaaaaaggcgaaaaaactgatccattaaattacaggccggtgtcattaaccagcactatctgcagagttttcgaacgaattttgagtatcaaaattttagaatttctgaatagtatagaattttttgataaagaacaatttgggtttctaaaaaataggtcgactacaacccaaatattaaaaacaatggacgatatatataattctttacaaaaaaatcaacaaattgacattatttatattgattttgtcaaggcgtttaattctgtttccgttgatttattacttataaaaatcaaaaagataggaattgaaggaaaaatttataattttttaaataattttttaaaaaatcgaagttttaaagttaaaatcagagaagaattgtcagaaagtttcaaaatattttcgggagtgccccagggaagtgtcttagggccattactctttttaatttttataaatgatctgccgtcctttattgcaaatgaaaaggcatcagttggcataaaaatgtatgccgatgatgttaaattatattatgcccacgaaaatgatgaccattcgaatcagttggatagacctcaattagaatacgctaccgaagtgtggaacccaaatttaaaaaaagacattgacaaaattgaacgggttcaaaaatttttcacaagaaaagcacttagaaaatgtggttttgtgtacaaaaaatatgngggaaagactaaaaa

SEQ ID NO: 8248 - DNA, 3238 bp, Heterodera glycines
ttgcatatttatgcgcttattttggcaaatattcgtgcatatttttgacagccctgataattaattatatatttgttggttaaataaaataaagcgagaaaatgaaatgaataattaactctggaaaaacccctggaatcgaaattgagaactggaacccaaaaccctctaaattccaaaattaaaaatacctaataatgtatttattttaattaattttagaaacaacatgataatacaattaactcataaatttaattatttaaaataaaattaaactttctgacattgaactaaacgctggcataatttggaatatattaagaaagctccccaggcgaaattccacttcaccggataatgttccttacattttattaaaaattgtgcagaaccaattacaaaatttttagcagatatatttaggctaattttggattccggacaaattccggaaatatggcgaacatcattagttgtaccaatttacaaaaaggcgaaaaaactgatccattaaattacaggccggtgtcattaaccagcactgtctgtagagtttttgaacgaattttgagtagcaaaattttagaatttctgaacagtatagaattttttgataaagaacaatttgggtttttaaaaaatagatcgactacaacccaaatattaaaaacgatggacgatatatataattctctacaaaagaatcaacaaattgacataatctatattgattttgtcaaggcgtttgattctgttccaattgatttattacttcaaaaaatcaaaaaaattggaattgaaggaaaaattcaaaattttttaactaactttttaaaaaatcggagttttaaagttaaaattggcgaagaattgccagaaagtttcaaaatattttcaggagtgctccagggaagtgtcttagggccattactctttttaatttttataaatgatctgccgtcctttattgcaaatgaagcatcatcagttggcataaaaatgtataccgatgatgttaaattatattatgcccatgaaaatgatgataaaacaaatcatttagataaagcaattgaagctttggaaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcaggacatattaacaaaattgtacgaaacgcttatcttagagttttccagattttaagagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacaaaaaatataaggaaagactaaaaatcactgatttacacaaattagaagaaagaagaaaaatcaatgatttaacaacagcttttaaaattataaaagggttcaccagcctagaggctgaaaaaagtttctttttctcggaaaggcccaggaggcctttacttttgcgagtaaagcgccacacggccaaaactcaaaataattttttcaatagaatagtaaaaaactggaataatcttccagtggtagcggtgcaaattaataaggcaaaggaattcaggggtttactaaaagcaatgagttctgagtaggattttccattttgccatatttacactatatttttatcacctgtgaatttttaacatttgattgatttatttttaatcatttttttattacgatattcattttttatttttttttttgaccaactttatttgttgttttctttttggcaccatataagagcactcatgtgcctttggtttgctcgataaataaataaataaataaaggggctgaaaaatagtttttcaacattaaaattttttgtttgattgaagatttttaagtccatataaatccatattttgtgggatttcgggaataaatccatatttcgccatttttgcattttgagagcatatttcagacattttttgaacatttggtcaagaaaaatccaaaaagcgaaaaatacacccttaaggatcaaagttctgttattttttttaaaaatactccacaaaaaaagagaatttttcaaattttggaagttttttcgtttttttcattttccaaaattttttcgagcatttttagtacatattttattagagatcggattttccgaatctgccgggccgggccgggctgagattttcgaaaacgaccgctttcctggtccggtctctcaaaaacgggtcaaaccgggtttttctaaaaattactggctccggttacctggcccagtaaaaagcggtactgggcccggtccggtctgatcactatatattatgtccatatttgggtattttttagtccatataatttccagccctactgatcactagtgatcggtgtttggtcgattttgcatttttagctctccgaaaatgtgaggaccaccaagcaaatgctggtgccgctgcttttccatctgatcaatctttgcttcggcaccgctgtgatcacaattgcgttttaccggcccttcgccaacaaattctgttacgatttctttggcgaattaacttgggccacagtgtctgtctccaattttttgatcgaactcacaatgatactgtaggggatgaatattatttctttttgggttaatgcaataattttgggtcgtttagtacgggcccttttttagcaataaatttttgcttttcaaatcaaatccaataatcttggtagcattcgccagccgtaggcgtgctgaaatagactgcttatgtttgcggagcagcaccgacgaacagatgcgaccagatatatggagagaccgaacccttcgggagcagcttcgctatagactgtactttaagtctgcgtcggatttttgctccccatagtcgtttgagtaccccaaacggacacttgagaaaatagatttttttgttgtcgtggtagtccccccgaaccgatgcgcccagatttatggagagagcgaatccttcgggaggagcttccctatagtctgtactttaggtctgcgttggatttttgctccccataaat

SEQ ID NO: 8249 - DNA, 1526 bp, Heterodera glycines
  misc_feature (61)..(61): n is a, c, g, or t
taaaatgcaacacacacctggagcggagctgattattttagccaaatgataagataatacncgccgttggttgctaaaatgtgttcacaatttcagaaatttgccgttgtccgctcatttgttttgtgttgtgctgccagcgccgaccattcgtctcagcccttcccatcatttcaaattccattattcccgtgattgtccaaaatgatcggcggaatcctggaagatatctggacgagatttatcggtacacatctctcctgatcattttcattctgttcattgttgtagtgatctgatctgacccgccaccaaaataaacctgaaaaaattgttacaaaaacccatcttcgcggggataatggcacctgggggatatggcacttgggggattttattttatttttccatttatttagacttggtggaggacatctctgatcagtacgacgattctgagcaaccaacaatcatccaccacgaaccagcaacaccaacaacaatgtttgacaactatggtccgattgagaagattgttgtggtcggcaccggcctcatgggcagtggcattgcgcaaattgcggtcgagtcgggcgtcaaagtgtgcctggtgggccgtagtcaagagaagtgtgatcagacccggctgaagatcaacacgggagtgcaaaagtcgatcaagaagcgcatggcaaatgaaactgccgaggtaaacgacggcaaacatgaaaatggcatggcaaaaatgatgcaacgagttgaaaattgaaaaatgccactttccataaccaaaatttagtaattgctttcactctttaataagttttaattatcataaatattcctgatcgttttaaaaaagttaaaagtgccaaatgtctccattattcgggttttgaatcggtccaaaaatttcgtttaaacgcttttccgcagagttttttaaattaattctttcgcaatttgaaaattaagagtcaaaacaataagtaaaaaaaaaattagttattctgatcagatgaaccatcgaacatttgttttacttcaggcacaacagcagttggtcgaggcgacaatggaaagccttgagctggtgaccaacttggatgaagcgggcttgtcagatgccgacattgtcattgaggcggtggttgaaaatctgaaggtgaagcagaagctgttcattgaattggaagccaaggtgatcagaggcaatctcgaaagaattttttgatttaaaattaaattaatttaatatttaaatttaattttatttgctaataataagtgtcattcaacaaattcgaaatttataggtcagcgagaagtgtctattggtcaccaacacttcgtcctttctgctcgaggacgtatcgtgcaaaatgggcgccgccaagcgcgagcagttcggcgggttgcatttcttcaacccggtgccggcgatgaagctggtggaggtggtgcgcggcaatggcaccagcgacacgagcgtacgaagtgctggtcaacttttgccaaaagatagg

SEQ ID NO: 8250 - DNA, 4911 bp, Heterodera glycines
  misc_feature (1183)..(1183): n is a, c, g, or t
  misc_feature (1190)..(1190): n is a, c, g, or t
gaattgtacaaaattgttgcatcgtccggcatcaaataagcaatccaccaagaaaaggttgacgtttgtgccgtgatcagcagagaatcgcatgccatcacagcaaaagcaaaatcattgctcttggcattggttttggcacgtaaacattggcgaaaagcaaaaaaaaaaaaattatcattaaataattgataatcaaaaggtttgttaattatttgcctggcgattgaaagataaatccgccaaaaattgcttttcttctcccagcaaaacgacagaaattgaaatgttgtcaaactttttctggaattaaaaattaatgccaattcatattacaaacccttaaatattcaaatccaaattcaattcctttctccgtaaaatctttcaaaacatttagcaacaagttaaacaaataaaataatttaaaaaaattataaataaataaaattacaaaattgttttcttggctggcaaagaccggaaaaagcatttccttttctcgtcctccttctgttccatgatcgtgtgttgtgcatttttggctctccttgtaaattggcttccgtccataaggttttccaatgccgtacaatgcggcaaaacggaactaaaagcgtaaggcacatggactaaagcgggcgcggaaaatcaaagtcaggacatagcatccgcgtcaaaaattgggcaattgaaactttaattgtcaacatttagtaaagtttcggattttaattcaaatatggccactaccccaaaatcagaaaatttagaaataagaaccaaacaaacccctgatgtatagaggccaatatttggcaaggtttttaattttctccatcaacaattgcttttttgacccgacttcaaaactgaattccgatgctcgacatttgtcttgtccacggaaaccctgagatattatactctttttgggatattttttcaaaacttttttttgaaccttctaaaaatttgattcaaaaattcagaataagaatcgtatagaagttttgaatttttattaacttaccaaaagccataaattatgaatacactgaagtctacctcagggttgacgcggctcgtgaaagtcgagtttcggtcttgaggtcgggtcagaaaaaatcaattttttgatggggaaaattgaaaattttgccaaaaaattgggggatgtctntaatttnttatataacaaatccactaaaaattgctcgaaaaattctcattgctctgtcactgctcctccctttggcattgtatgccagtttcagtggtggaaaagatattctacgaaaattttatttccctattattgaatttatcgaattttctttgtcacgacgtgaatttttttggagtggagagaggagcttaatgttggatgaatgtaaaaaagacaattttacattttataatattataaaaaaaattattttatctaaaaaaatttataagcaaaaaaagacatttagaaattattatttaactgcgctttcacaaataaaaattatactttaaatagaaaaacaatttttcaactcaatcaaatttagttaggtaaattattttcccgttttatttcttttcttcgagaaatgtacttcggctttatctgtgcaattttggcattttctctttacatgggcgaaggaatgccaatcaatccgccgccagatgaaaatgactgcgattttactaccgatttggaggttttggcggcatgcaaacaaagatacataaacaggagaagagggctgaatcctgatcaaaatgagccacgcattggcagcaaattggacaagtacaaagaacagttgaaatgtgttaagaccaatgatcataaaaggaagcggaaaattactgacgaagatcgccaagaaaaaatagaactgtataaaaggttgaagtcgaacccgaagcaaaagaatagacgaatgttaggccatttgtccaaattgttgaatgttgagccatcaaaacaaaacgcacaaactgatcagtcatttgagaatgaatctgctggtcaatcatcatcgcaaccatcgacatccgatgcccatcgatcggtttcggaggagcaatcactgtctgatgatgatcaattagtgcctgattattcaacggctgctgctgagaattcgagcaaaaatttgccaaaagaatccaccagtgaaaagcgaaatggatcagaatccaactgatcagatgagtgaacaatatgaagaagatgcgaatgtagatttagtgatactaaattttcacattttcatgagacttgcggtcttttgcatattgtagtaaattttgtgcttccaatgagcctacaaaaatttccaaaaacattttccaaccccctaggaattttttcgaaaatttccccgattttcggtgtattttcggttgtctaggtcaccatgaaggagtgatctgatcaagttggtacaaaagacttatttgatcagcatcaaaagttgtgttagcatgaattatttcagatttttcttaaattcgagattcaaaaagtggtcctaaagatatgaccacccaaaaaataagggtatgtgcgtgcgattggcctggtcgcatgtcggcctaagggaatgaatttatacgcatttagcatcattcgaaagcccattggatactctatctctttgttaaataattttattaattaattttgaaacttttaataaatttctagcactggtcctaaagatatgtatgatattactgtacattttatctccaaaaagtcacgaaaaagtgataaaaaacgccaaaaagtcacataaaaattccaaaaaagcacgaaataaatccaaaaaagtcctggaaaattaggcaaaagtaattaaaaccaaaatcctttttttaaacatttatcgaagaaagtaatttaaaaacgattaattttagcgaaaaaatacatttcaaaagtgttacaccgccagatttttattttatttttcagtaccgccatttcagtcctaatggtataagaaattcagtaacgtctcaaagatagacgacttatttttcagaattttcttcacttaaagtcaaattttgccttagaaagtgtaaaggcatgaaaaaagtcataaaatcccaaaaagtggaaaagtcagaaaaaggcacaaaaaaatgcatgttagaagcttcaaataaagtgttgaccactttttaagtcattttaaggtaatataaagtcagcaaaaaaaagtgacttaaattcccatccctaataattatcaaattttatcccataaattgttaacatttttcttgaatccttaaaaaatgacaaaccaaggatcaactgatcagtaaatctcaataaatcatgaaacttcagcaacagcaatcaaattctctgttgccggctctcattcttttgtttttgtgatccgcaatttcgagaagcgctttttgggtggcagtgtatcaatttgattgtcagcggttgggtttgcggttgatgatgaagcggatgaaattgagtccacccgctgaaatgacgcttttggttggacatgcggcggtgaggcgggcgactgtgagggcaacgatgacgcggagaatgagtgtatccgatttaatgatgcttggttctcggggcttggtttgacaatggcaccgggttctttttgatcatctttggccactggcttagaaagttttgcgtaaggggccgcttcacaagtcgtagtgagcgcaccgatcagcaaataggcaaccaatgccacaacagcaaatcgccgcttcattttaatgtttttttggcaatttgtgatggataatttgagtaatatataatgtttgttattaatgttaacattaaaatggcattttcattgaaattgttttatattgatttttttatgcgaaacgattaatttcgattagaattattgagggatgtctttacaaattatttttgcatgacaaatccatcaaaaaatgctctcaaattctcattgcctgtcacttctctctttggcattatttgacaattttagtggtgggaagcctaaaaagatattcaacgaaaattatattttgctatttattggatttattgaattcttctgtgatgaagtgaatttgttggaggggagggagaagcttaatgtaggctgaatgtaaaaaaggcaattttacgctttattttatgtaaaaaaaattttgataggcaaaaaagatatttagaaattattattaaatttaaataaagtttaataaaacggtattgactccttttttcagatagtcaataagaattaatttaaatatttattttatttaaattaaattaattttattggatttcccaatacttcaattatatttcacacttgattagtgaattttgatcgaacaaatatatttattaatgacgatttgaacgataaaaaatggtgattttgcaatggtttaaatacggcaattttacataggcgggctgacagaaatttaaatgtaaacaatgctgactaataaaaaggcttaaaatcacaaaggttatgaatttggcgaaaaattattttaaacagatgaatcataaaattttaaattttcgtcgctaaggatgaaattagcgacactccggcggccgacaattcactttctgttccctttgaagttgcccttgtagtgattgttcatctcggcaagtccggcggcaattgtgaccaggagaatggacacggcaacattgtagtcgcgaagatgttcggccaaagcctcgacggcatctgctgcggcggtagtcagttcatgggttcgctgccattgtgatgcgcccgttttcccactttcccccattttcgcctgattctgccgtattttgcgaaaaaaggaaggccccttttttcccattttttacccggtttttcctttttt

SEQ ID NO: 8251 - DNA, 3990 bp, Heterodera glycines
  misc_feature (3886)..(3886): n is a, c, g, or t
  misc_feature (3903)..(3904): n is a, c, g, or t
  misc_feature (3918)..(3918): n is a, c, g, or t
  misc_feature (3939)..(3940): n is a, c, g, or t
  misc_feature (3979)..(3980): n is a, c, g, or t
agattcgtaacttcgggaaaagaattggctctaaaggtcggttcagccgggctgttgcgtgaaacagacggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgtgtggcgattctcggaacctccagtggagcctgttaggagttggcctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcgagctgttcatgaacggctcgtggcggcacgcagccgcgcgggccagttagggctggtgccaatgaggcagcgaagaagtctctgaaacgccaaaagcagcgggagaagagagagaaagcggagacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgtgcaaaaggaggggggagcccctccgtctgggaagaaggcgcggcgccattcgtccaacaaaccggaatagatcttgatgatctcagcaattgatcatattgatctctttttccagttgttgcgataaattatcgtgcattatttcttcgattcctccaaagcttaactcttttcctaatacctactcatgtatacgttagtaggcatgttttatgcaggtaaagatagacctggtgcccccgggcgacttgggatgtggatgatggttggcggagagctctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgcgaggagctgttattacattattggttgaacgcttttgggtcgtactgcacagataaatatgagaaaaagttttttacaacatatacctgagctttcaaatcatattgctatgtctgtgcctgcgagaaattaccccaaattgcgctctttagcgcagggttcttccggcacatcaagtcataatgggaagggtgtcgcaatgcaccggtgccccagcgatgattgtgctggtaaagatccccctcagcgggggtctcaaaaagggaatttgaggagtgtgcgatggactcccagcgaggagaaagctgtcttcgagtattggtcacggttggaacagcatgccatgttaaatggtagcgaagcccgggggacctgtgccataactagaagtcagtttctcattcattgggatggcgagagagagtcaagatccttgtcggatggtgtgcccgagtacccaatgaggacggaaagggcatactatgaaagggtccgactcttgcgacaacgcggatggcaatgggattgtgctaatgaatgcttagtaattggccaatgtacagagccgtgccgtaagccaaacgtggtagtgattaaggctgataagagtgtgaagagatcgctggttaggggaaagcttttgtccctgccccatgtaatgggtgaaataaaccaagtgagcgtgcaggttgaggtgcctttgccaagtgtacccgccagcgtgccccaggttgaagaagttgaaagcaaaggtgttactgaaacggaaccgtcgaatagaccttctttggaagggaatgcggcggaagaaggattaaggaaaccggagcgagtaaacgtacctgttcatgggataatcagtgatagtgaacggaaagacctgaaagaccggttttggagcgcctataaaacggccaagaggtctgtgggttttagaccggctctaaaaatcgaaccgagtagggttaaccgtgcccagtgggaagtactggattcctgcgttgttgaggtgctcaaaaagagggaaacctccaatgggtaccgcggttgcgtcctccggcatttgaacgttgcagtttatgcggcgggatacgtgctggcggaaggcaacaaggaaaggaggcaggtgatcagacgccagtcggcggaatggttgcttcgccaaaagtccgaaatcaacaacatccgtagacacatcggttggattaccgatgagttaacacggaggaggacgggaaagaacccaacatccagacagttgagtaattttgcatggttgcaaaggcgataccaggttttgggtaaacccgtaagggaaacccgggacttggaagtccaacgagaaagacttgtaagtcgtcttcgattggctcaggaccgagttaactcttccatggatcgtgaagagcgagctcgtaaacgaatgttacccctgcggagaaagttggaagaacctttgggtgactctaaacttgacccaaagcaggcacgaacattttgggccagcctgattggagagcgaaaggaatttggaaaaatcccggagcttgaaaactgggccgaagaagtgaggagcaaagtcaccgatggacaaggtttcgcaagtgaccatgtggatcaaactgtttggaaaaagatactgggtaaggccaggccactgaaggcgcccggaccagatggaatccccaatttactttggaaacggttaccatccgcaaaccaggcgttatttaagtggttaatggggatcaagcggaaacagctcagtgtccccagttggctcacaaaaggaagggtggtcctcctacccaaaggaggtgacccggtagacccggccaactaccgaccaatcgcttgtttgaacacgcagtatagtgactggtatggtgacggcatgggtatcggaacacctgaccacatactctattttgccgattgaacaacgagcgatggtgtctggcacttgggggtgtacccatgctatggtgattgacagagcaattacgtcttatgcagaggccactggactaccgctttatgtaggctttgtggactttgcgaaggctttcgactcagttagtcaaccgtggatcaggtacgctctaaaggtcgctggagttcacaagcgaatccgatgtcttattggaatccttatgaaatgttggagcgtaaggtatgaagtgttcaagagcgggagagtgttaaggagtgcgcttttggcagttaagaacggagtgttacaaggagacacgttgagcccgctgctcttttgtctctcagtagccgttgtttcttctgcagtaggcagcctctttgattttgaggtcaccatacctggacgaggagtgatgcagcagcagaaccacttngtctatatggatgactnntaagggtttgctcntagtgaagcgtccttgaccanngatgtagtaacattggagcgaaccgcttcagccctcggnngtgaaaatca

SEQ ID NO: 8252 - DNA, 5232 bp, Heterodera glycines
ttttcagagatcggtgaaattgccggcgctaccgaagtgaccgttcgtcaaacgtaccgtctcctcctgcccaaggctttggagctgtttccgcctgactttcgcttcgagacgcccatagatcagttgcccacttcctgaaaaggcgcaatttgggcttttcttttgaatgcgtgtcaattcgttcattttttccgttcattcattgccccgccctccttcccccgcttcgtaattgttaatttgggtattagctgttagtgtgtgctcattctctttgcttatcagtcgccacttcgttcctttgtctatatttatagtaattacaaggaggacgaattttttatcaaaagaagtcctcagcttttcgttcaataaattctcaaatatcaagcccagtttccgctttccccctttgttaatgactgtgttaatggaaacaaattttctttttgtttttttcattttattctttcctatcactttgttcgttgttctttggttggtcaaagggaaaatgccgatctctttttggcaattcggaaaacacacattcttaagacatattgtcatgttcgccttccatctttttaaagttccggctttgttcgcgggcgcaaagttccaacttcttttgccattgatggtggaagtgtctttctttttgctgccattccatatgctcgttcgccttctgccgaagtacgcttttcagcaccccatccgccaattccatgggcagacgtaagggacgccactaaacagggaccttcttgttggtggaaaatcacgtgagtgagtgccaatgggctacgcttgcaaggcccaagagttcgccagaatcgcctttcttggacaacgattaacgctttttcgttagtggttttcccaccgacgccccctcgctgtctccgatggatgaggactgtctgttggttttttgtctctgaacgatgtcttcgtggggctgtgccgttctccaatacatttgcgggggcaaatttatgtacggcagcgctcggaaactcgatgagcaaacaattgtcctttttgggcctttctccggtgatcaatgcctttgtttaaggcggacaatttcaattccctgggcagggaagtgattttggtcactttcggtcggtttttgccctttttttttggatttttcagcttctttagggtaccggatgaatgtctttgggctgctcaatttgaactttcgtttttccgatttgaatccgcaaaatttggccatccatggttccgttatttgtccttccccccccccccctcccccgatcactccctacacagatattgttgctagtcttatttggactcaaaatgaaattgcagtttttggcggtgatcccaaaagagtgacgctggccggccaaagttccggctcagtggccaccaaaattatgcgttttgttgccttttttcggctaacattacttacaattaattggttttgatagcttatgtttcttccacggactaatgttctgttccatcagttagtccccacggagtgagtgagaattcgtttctcttaatggttcatcaatttttatatgaatcaaaccagagttaatgagtctaattttcaaagaagtttggtccaagaattccaactcatcaagaataataagcattcaatgtatgtccaatcaatagataatcaacgacactttggtcaatctgatgagccgttacaggggcaagcacagcgtaatgacgggcaccgtttcaaaggagtttctggacggagcggtgctgctcagcccgagaactggtcgggtcgacaaggtccgcctcgcgctttactgtcgtcgattagtctgtcagttaaactatgaaaacggcgggaaggcattgtccgaatgcgtcaaaggctgttcgctgctgattcttcacggcgaaatgtgccaacctttctttaccaatttgaatacgatgaaattggcactgcttttcaatatgcgccgggaaggtattcgttgtgcttcccgtgtttcacttctctcttacgagggcgggaatgccatagtttctttgatggttcagatttggctctcttcccgaactgagtccacggcatgttcaagaccttgtctatttatttggtcagaataaagggattttcactgaaagtgaccgtcgcctccagcagctctactcgacacttttcgtcaattttgtaatcaacggcactttgaacggaggccccgttcaaaatgcgttgccatttcaaccgaaccgttcaaatttctacactctgcaaattcgaacaatcaaagcgattttgttggagacactgcgtactatcatcaaagggcaggtaaattttggactgagcaaataccaaagtcagttaaataagccaataactggtccatgatcctttttatcaccaaagttgcgggacggcgacatttgctgagggatgagtactgatcgacgatcaaatgaccagcaaatatttgtcggaggatttggacttttttggatctcttctgataggccatcctcgtaaaactgtgtgccaatgtcccttcagttgttgggctttcggcattttcctattggcgatgctgtgcacgctttcttttttcattttccacaaatggaaaaaacaacgaaagtcgaagatgatcaaaaaagaattagcggacataacgcaataaatttttaattactgtaataaaattcactcttccatttaccacataaatttacggtcggggtcgttttcgcgtggccgttttcgcgtggccattttcgcgtggccgttttcgcgtggggtacgttttcgcgtgagtacctgtttaggactgaaattggtcggatttgtgcaaaacatccatgtttcgaatccgaacccgaattcggacaaatttcttgactttttaatttttttatttcttgcggctagtatcttctacaatactttgtcagtttggtcggatgtgcatcaaacggaaaaaataattaaaattttataaaaacacataaatagtgaaatgtccgcatcaattgccttttgctcacatctgatcgtgtcaatgaagcgccaaattgttggatgagtgcagctaaattgccgctgaagtttgcgatggaatgcctcggcgaagttgttggtacgatcagcaccatctaaggtgcgctgatgaacattccattcgtgcgggtggaacagaggcgccgtcattggaacattgaaacgcattcggccatgtagttgtccaaaaacctagaaaaataaaaaaatcataaaattcgccttcggacttaaccaattgaaaacgccgttaagttgtggtggaatttgtgctcgaagaacattaaggccattttgaaggtggtgcacaggcagaaaggccaatgaagtgatcatcttagacttctcggcgaaagcaggatcagtgttgtaagcctaaactactaagaaaaaaatttatcatctgaaaaattcaattgacatgtgtgaggccaaggattctgatctgcctcttcatgttgcggacaaggtgaaaaaaacagtagcggtcactgcatgccggaagcactgtgcggaccgcaccgacaattgccaactcgaagtccatcgaaattgtctgcggcgcgaaattcggccatcgttccaaaagaagctgtaacatgcgcgtataaattgcggcacacttaaatgttaaaagacagtagcaaattggaaatacccaaccatctctcctaaaaagattgaacattgtgataacacaattaactttactttgccaacaacacataaatttggctgaaaagcggtggcgtcaatgaaaacgtgccgtccgcgtaaatgtcactcatctgatgggcccaatccgccgtagaagctcttccaaaaatgagaatccttaataccggttcaatgatcagcatttaatgtataaatgatgtctcaccgttgaggtccattttgtccttgaatttgaaaaacgccggtgtccgccaatagaaattgttcctcgtcaatttcagttcgcttgtaaatacgataggtatttggaatttacaactgctccaaattgagaggttcgactcgcggtgcattttcatcacggcgcaaacgtttgattacctaaaaaagaaaataataacaaaattgtttttggatataaacccaccttttttgtggcgtatttgctcggaaaagctgctaacacaggtgtgcatgtgttttgcagcacttgagcacgaatagtcgcagatgcctcgcacgtctcagcagcacgtcgcttgagtccagttacaagtcgctgacattccacatgcgcagcattcatgtcgcacgaatgaactccgaccaacttctgcacaacgttatttaaatccgtgtgcaaacgccctgaattttaaaagatttgcaaaattaaaaataatatattaacatacccttgcatttgtctgacgggccatgaaactcacatcgccaaaatttcttaagtccatctgcgctcaattggtcgaaaacatagagtgcgccgtcatgttctaacttaaatttgtttcgttttgttttaattttttgctgctggtccatattatataatttaaatagccttaatttagtttataaactcattaaaataaaaactcgttagaaaaaagagtgaaacaaattttggcaaaatataatgtgagttatgaattctcttttatatgcaaccacgcgaaaacggccacgcgaaaacgtaccccacgcgaaaacggccacgcgaaaacgtaccccacgcgaaaacggccctcacgcgaaaacggccacgcgaaaatggccacgcgaaaacggccacgcgaaaacgtcctggcccgcaaaatagggacccacgcgtttcggcgctcgtgtttcggcgctcgcgtttcggcgtccggtgtttcggcgctcccgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaacttcaaaaatttcgacttttcgcaattttcatgcataactgttttgataattgtctaatcgcaaagcaatagcttacaaaaagcttctaaatagattaagctttcgaacgacaccaacaatactggatttggtttacaaagaaaaag

SEQ ID NO: 8253 - DNA, 2228 bp, Heterodera glycines
ctatcataaagtgctttttttttgttgggtcagttttacattgcctatacagtttggctttctctttgatggaggccaataaatgcgttggatatttaggggtcaaatcttttttggtaatttttttcattggaatacactcgtttaaggtttctagcaatgtattattaaaggcgttgtatttttcgttcacactaaaatgctcgttagataaaagcgctaattctagaagaaaccataatattaaaaagagaaacattcgacggaaaaaaccgtcgattgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaaccacgaatttcccctggtgggtccactcgtggcattgaaaaaagaaagcttactaaaaaagtggcaaaaaatttcaccaaatttactcatagaaatgggctgcccttccttccataccaggtctttattcggaaaattaaaatcacccaacacaacacaattacggctatagaatgtttctaaaaatttaaaaagttccttggtttgtctatatgttgtcttgggtggtcgataaacaagcacaaatctaattgattttagtttttgtaattgaaaaaccaagatttcgcaattatattttgtttcagaaaatttaacaaaaaactcaatttctttcttaattaaaacaccgcaaccacccccacgtgttaatttttgagattttctatgacaaaaaacaaagttataattttcgattatccatggactaaagaggattgggtttccctcctttgtccacgtttcagttaacagacaaatttctatgttattatttactaaatttaaagatatttcatcaattttgttgtaaatcgatcttatattaactaagcaggctttaacttcccctattttcggtattgggttattgagtctaacatgtttaaaaccggaaaagctatttctattttgtgagaaatatttattgttcaaaagtgatttggtgaaaagtcaattatttttacgaaaattgggcacctccgaccgcttgacaatgtttccggcgtaaatgatccaatcggcgttgggttcggccttccttcgctctgtgcattctttttgcatcgccctgcgctcctccagttctgccggactgagcgatggtcgaatgttcaggtgttgccacttcccactttgcttgatgtgggcccgttttttgttccattccgccagcagctgcctttggaattttgaggccgggagaatgattttgattaagcgcgggcggtgacctgaaccagcttggtatggaggccccattctatagctagaaatcgggcactcgacgccaagctcgtcgagtacatgcgacaattcgctccggtcggcagccactcgttccgatggtttgtctccggccggctcgggcagtccttgcaccaccacacttcggcgccgctcgtgatcctggatggcctcctccatcattttttgttgacggaagtgttggagttggtggtcttgctcggaaatgacggcctgttgattttgaacttgctgcaaaagtgcaacacaaatttgcagaagttgtttggtgaccgggtcggcactgttgttgtccatttgttgggagattgccgcaagttggtcactaagagcggtgtacgggtagtcagtggtggatttttttgatgcgttgtctgagagaggagaaagatgggaagaaggacgctttccaaacatgacaaatttgaaagaaatgtcacattctttttggcggttcttggactttcaatcgcccttttcatctatgtgtcggccaaaattgacactgttgcgtcggatatgagcgacgagatcattacacttcatgccttgcagtccaaatttaacgagcactacaatgaaatgcttaaatattacaattctcgcattttggctgcccaatcggatttcaattctcgttacgaccggcttcaatcggaatttattcaaattcaatcagaattttggaaaaaatcaaacaagttcacggagcgtatagtcaatttggagttggagttcaagaggtacagtaagttcggctttttgaaaattattacaatttgagtacagtcatgtgctaaagtaaagcaacatattttttat

SEQ ID NO: 8254 - DNA, 1888 bp, Heterodera glycines
  misc_feature (1874)..(1874): n is a, c, g, or t
gccgccaccaccaccatcacaaatggaagatgggctgccgttgccaatgccaccatcaaaagccaaagtcgccgcccgacagaaggccaagacttcatcgacaacaacagcagcaaaagtcgtcgccacccaaaatgcctgctgctcatcatcatcatcaacagcagcaaatgttcctcagccgtcgtcgtcgtcactttccgccgccgaagaattcgctaaacaaaaaaagcggaataagaacaacaaaaacaaattcaacaaaaaacaggcaagctttaataaaaagtttaaatttcatagcatttaaataattaaaaatattaacctttcatagtcttttaaaattattataaaaatggttttaataattatttttaaaaatatcttccaaatttcttttctttttagccgccgcccccatcaatccgcattcctaagggcaaaacgccgaagaaggtccgtccacgccgcccggaacccgaccagccggacgaccaatatgagcttcgggcggtgttggcgaccgccgaagtggtgtccgggggcacgacacatctgtgtctgtatgtggatttccttggtataaaaattttttttgaatttttacactaaaatttctatttaatttcgatttaatttttaaatttcagattatcaagggcaagaggactggtgtttgtcaacgaaaagcgacgccctagaactgacgcacttccacgacattgactcgacaatggactctacgctccatgcaattgtgggccgaccggtggcgccatttctgcaacaacggcttaatgctcgcccactttttcatcaacgtaagaaaaatttttcaaaatttaaaatttttgaaattttttattaattagtgcgtcagcagcagcaaaatggtccgcaagtggtcgagcaacaattgccatttgtgttttcatcttctgtcgatgtcacgccagcgcaaagggcaaaggtggattggtctttctctctctttctctttctctctcacatttcataaagtctgggtgttgatgggcaggccttccctcgtgttggtccccccttcaatgcttatctcggagctgtgaaaggcggtaggcaggccttcctccgtgttggtccccctattgttttttgcttctcatttctctctttctctctcacatttcataaagtctgggtgttgatgggtaggccttccctcgtgttggtccccccttcaatgcttatttcggagctgtgaaaagcggtaggcaggccttcctccgtgttggtccccctattgttttttgcatctcgtttctctatctctctctctctctctctctcacacacatttcctcgtttctgtgttttgataagcctgaccaaaaatatttaaaaattcaggcaaatgcattgtttgaagcgttcaaagtgcgagaaggattgaacgaagagtagaaaaaggaggaaaagtgcggaggaagcagatggcgaacaacaacaaaaaatggcacaaaaattttttaaattttcattttgtatttccaaaaattaaacggaagtgtcacggggtggctgatttaaccatttgtttttttttttaaattttttcactcaattaacttaatttcacacgttttttattaaactttttgaactttacgggtctttattgagataataatgcaaaggttagaaaatgtcgtccaattaaaaaaaaaggtttacataagatgattaggttaatgaattaagtgatcgataataaaaaggattaagtggatggtctcaaacatatactgataaatgttgtgttagtgttaaaaaaaaaagtcaattacaaaaaaatttttttgttttgccaaaattattcgcaattaatttanatatgtactaacac

SEQ ID NO: 8255 - DNA, 1809 bp, Heterodera glycines
cttaccttattcaaaacgttttaaaaaatcgcgatgaaaaaataaggccaaattcggttttgttttgctcacatttcctcccgtcgttgcgcctccttctcatcgtccaccaattgttccaaatcctcctcttcgtctcccctcgtcgtcccctttccccccgccgctcttttcgcccttttcccctccctttggtcctgcaacttccgtttgactctgtccagtcgctcttctcggcttctttcgtccgcttcctccgcctctctttggtctccgctcgtcgtcaattcctccgctttcactgccctctctctgctcaacaactcatcctccaacacatcgtgcgcacttttccctttaaacttctaaagaaattcaaaataaatcttaattttttattaaatatttaactgaatttccgaactaaaaattaattcgcattaaaagagatttagaaaaataaaaagtacaaatattattgtcagctctgaattaccttggtcagatgttcactttgttcgtcctcctcctcaatttcgtctccaaatgacaaaagcgaagtgttccgtttggtcgctgccattgcgacatttgttgcgtttttctcccttttggacctttttctctcatcgtcctttgtcgctttcctcggattaatgtcatcaaatggattcaccaaaactttggcgctcgtaattttatgtgggtaaattggacgctcatttttgtcaacttcgtattcgttaagcttcaaaagattaaaaattgtgtttccgaccacctaaaataaaagtcagtttgttttacattgtaattttggtattgcccaccttcccaaacactgtgtgcttcccgtccaattcggtggctttgtcaagtgtaatgaaaaattgagacccattcaaattcttttcgccagctgtcccgacacgtccacgccggtcaaatttgagtcgctgatgaaattcactctaaaacagacaaaatcgaagtttttgaaaaaagatgtacaaagaaacaagtgtaaaaggccaccttaaacagctctccgctggccgactcgccgccttggcccgtgccggtggggtcccccgtttgaacgatgaagtttttgatgactcggtgaaatagacaaccattataatagccatccaagcagagttgtacaaagttacgacaagcaatgggacactcccttgcccataattcgatgtcaatgtctccgattgttgtttgaagacagacctaaagatatacaacttaaataaaagcatatcacaatcagcaagaaataattaccttcccatttgtcactggttcattgatgtagaaggaagacattgccacaattttttacacaaaataaaaacggtacttgtccagtttacctgatacttttaacatacatttttaaatgccaataaaggtacaattaattatacatgattttttaagcatggaaattttaaaagactttaatattcgtgacttatttactctcctgcaaaaaccagatactgaatttgaagaatggctccgagaatgcaaattactccacagtaaaaaaaatttgcgaatgcgggctcgaaatgaaattgtattacgccaacaaaaaagataagtatcccatatggaagtgcaattctcgaaaaaaccatgatgggcggctgcttctatttatgaaatttcgtgattaaattgaattctgttttaattatgttaaaatgcataaaaaccatgtataattagtacatttataggcatttaaaaatgtatgttaaaagtatcaggtaaattagacaagtaccg

SEQ ID NO: 8256 - DNA, 2186 bp, Heterodera glycines
  misc_feature (2153)..(2153): n is a, c, g, or t
ggtacttgtgcagtttacctgatacttttaacatacatttttaaatgcctatacacggcgattcaattttgggctcccagtgcaaataagtttattatttatttattaatcagaacgccaaaactttgcaaaactttaaattttcttgggattttcccttgtaaaaatggaagagccgatctcgagttaaaaactagacagctaaaaaataaactgtgattcgatagagggggtcaaaatatgggcctatgcaaaattttaagaaaattggtcaataggaaaaatttttttcaaggacaacaaaatcaaatttatttgcaacatttttagcataaaaaaggttttttggacaaaaatctgttaacaaatcgcattaaaaattacaaaatttttcccggcggcgcctatcggctccgccggacccccctcccctcgcccgttcaccaaacaaaaaatttgttaaaaatctgatttttgatcccgaacgcaatgaaatttacgatttaaagaaatttaacaaaatgttcttatttttgaccctggatattcgtcccctattagcgggtcatcacagaaaccgttggacatacggtacttatcctttttgtcatccctctgaattttttttaccttgttccccccatttttgaaaaaaatgaaaattttaaaaagtcgttaaacccagggctcggatcgacaatttttcaaaatcagaacagattttgttttgcgaaactgcctccaaattagttatttttaaaattattcgatcaataatgtattatttttttcgcctccgattgtcgaatttaacgatttttggggaggaaataagcaaatcgtaaatttcagtgcattcgggatcaaaaaataagatttttaacaattttttgcgggtgcagttttttttttttttaccagactctagtgttcggtaattgactaagtctatcgtatggtgcacagttgggctggcgtaattaattaaatttggctttagactcatctatacttttaacccaatcttcccaacatggttgatggacaaattaaaactgcgcaagtgcaagaaaatgcaatgaagcgaggatttgtcaaacaggtcgcagtaggaaaaccatgagaattcgctgataagctcgtgttttatttaggttttgagtggcgattccgttgtgttacagcttccgccttctgtccaaggcgcggctcccacggaattgactgtttacttggccaatgtgtcagcaccacgtttggctaaacggcccactgaaaacactgaggcaactcccgacgaggtgccatcagtttataaaaacaggagcataaaataagacattatggcacttcataaatatgtgtaattgagtaagactattattatttaattcgaaattatgacaattttctaattagtccaaattaccattaaacacagccttatgcctgggaagcacgcgaatttttacgcaaaaaaattgttggccaagctgtgctttttatgcgcgaatttcaagccacttcaggcagagaacatggcaaaatccttctcgggtcatccggcacaagtgataaaaaaaatttgaaaaaggcaatttagtctttttttagacattgaaagtgccgaaaatgtttccgaaagtggcgtttcggctggttggttggaagtccgacccggcaaacaaattgagttggaaataattcttgttttttataccttctttcattcagcgattatggtaagaaactgctcgacctacaggaacaggcaaaatcggctaaaaagggtcgttggtccgaagaagagagtgcaaaacatattcggaacattcaatggaccatcgaagaaccaagggaattggtggccttatactctgggaagcaactggacgcggttgtggagcaggtcagatgggggatggagggaggcgaggacgggtggaactgacggaaggccaacccaacatgccaatgttgatcgagaagtgttttgcaactaattcaggtccgcgatggcacaactttccgcctatttttgttgccgtcctttgaatatataaccgtcgcacttagtggaattaaggtgagaccgatgtgtccgataatagttgaattttggggatgaatttgggcacggtatttgttggtanaattacggctctaatgcactttatgagtccatc

SEQ ID NO: 8257 - DNA, 1510 bp, Heterodera glycines
  misc_feature (672)..(672): n is a, c, g, or t
gtgtccgtttggggtactcaaacaattatggggagcaaaaatccaacgcagaattaaagtacaggctatagggaagctattccggaaggattcggtctccccataaatctgggcgcatcggttcagggggactgcctcgaaaactcaaaaaaaattttttggataaaaattatttaaatgatctgactagataatatttaaaataggttatttctcttcctttcagtatccctgcaaagtttggtgcgctcataaagtgcattagagccaaaattactaggacgaacctattattatgactaactcatatatattttactgtgcctatttgtaaaataataaaaggctcctcgggtcggcagcgatggaaaaccggaagaatttggcgaagacgcaaaactttttgtggaattgcgactgcttcagagagatgttaaagttgtgctggaaacaacggcaaatcaggcactcacagggaactgagaatgaaatcaatttgctggctttagaatttcatcggcactgttctgcacccgcggggaaacatcgccgagtttttgcttaaagaggggttggccaagtgcgtcgactggtcaatggccgttgaaggggcggcgccgaaaaactgagagaagccgaacggtcggtgaaattgcttagggattatattcnatacctaaaaagccattataaactttttaagcatcgcaaaagaaaagcgactccgattatggaagtcgttcaccgggtcctcctcaaccgtaaaaaatgcatttactgccaaaggttgtgcaaattcatttctacacattttaaagccgttaaaaccatcagagtctctctcattttcagtggttgaaattggtctggtcgattctctttctgtgcttaaagacaatggagaggagatgaaagtgtacttctcatctttgcgtgcaccgaggtaacaaattatttcaattatttctcaaagttaattcattttaaagacgcgaaggcaccgatggaacttctggcggcgttcagcgccaattcaggcctctctatgacattccgtttatgtttgaagcccgcgagtttcttcgtcgtcgtcttatcggcaaatcggtccaagtgattttcgactacgtacagccaaagcaggaccaattcccggagaaaacgtgctgtacagtgatgttcaacaaccaaaacgtggccgtcatgctcattgagcgaggctttgcacgagcagtgcgtcacggccgtgacgacgacaatcgatcgccacaatacgacgcattgttcgctgcggaggcacaggcagagaaagacaaaaaaggtcagtgtatggatgggccgaagggaaaagcgattattcccaacccaacctctaacaaatggcaaaaacctcaacaaaaatgaatcgagaaaaagccgatcaagatttgtttccctcaatgcttaggttttacttccagccaattagtaaggaccgttttaggaatttgggctgaaaagtgcacagaaa

SEQ ID NO: 8258 - DNA, 3407 bp, Heterodera glycines
  misc_feature (3367)..(3367): n is a, c, g, or t
ttaattaaggcattgtaatgaggcatttttggtgcgttgggagctaaggaaaaacatgtgacaaaatataaagttcggttaatactaacacaccgtatttattgaattagaccccccccccccccctgaaataaagccctcattttgagagggcctgaaaaatagaggccagtcaggagggggggggggggctttatttcagtaaatacggtatttatacaaaaaaatcaatggataatggacaacgaattgcgcaggaaaggcacttcgacggcggacatttgttcccgattggcggatgggcaacggatcagatggtacgtgttccactccaccaccgattcggcttcttcatcttcgtcctgctttggctgttcaaataatttatttaaaaaaaaacacattgaaaattggcttcaataatatcagtttttcgtggtccggaaaattattgggggctgtcaattgaaaaaggaacaaaatgagaatccaaatcctatcacattttcctaggaagtgagggtggatgacgaataaagcccggatttcctgaaaaattcagggtccggaataatattgcgggaactgcgtgcccggatcggatttcaggcgtttttcaactcctgatcagatcaccaccgcttcatcatcgttcgcctccccctccggcggtggcgccgttgtcgtcgtcgtacttcggcacctcttcccctccggcgctgctgcttccgcttcacttgacttctcctcctcaccgtctgtcattttgtcgtcgtcttcctccgccttcaacacttgggagcgtttgaatgcaaatgccaacacctggccaaacaaattcgggtttaaaaatagggtttgaatacaagcaagggcgagacaggaggggggggggcggctgagggggccaaagcatcggcgtccattcgacccggtccacccccccggaacccaattcagcaacttttttgactttaatttttaacaaattactgaaaaatttcaaaaattttcccagcggcgccctaacacgtttaaaaaaacattattacctccccagttttttcattgttatagcaaaactcgtccagtgagaagcccgggcagtccaagcggacaacaaatgttcgtcgtccatcagcatcgaaggcattgtcaaaatcctggaaaatgtgaaaaaattaattcaatccgaaatttatgggaaaaatttgtatgaattctttcccgaaattacagggaaataaaaagttctgtggccaattttcgggattaaatttagaaaatcgtttttggaaactatttttagaccaagcccatcaaaatttccaaaattttccctggcggcgcctatcggaaccctcattttatcagactttttaaattttactcaaaaattaaaaaaaattggtaatatttagtgaaaagggctaaaaagtctcggattccccccccccctctaatttttttttctagctaggggcctgaaccgattttttcttaaaaatcccttagaattcattcctccacacttctttgaacagtttgagcatttcctccgccgtgtccgcccggtcgagcacaaatttgagacggcattggcgaagatttgccattggttccgccgccgtcgtttgtttctgtgctggaacatttttgcccaaattgacgagccaatgcttcacgtccgcaaaatagtgctaattgtaaaaataagaattttaagaaatttccacccgttttaccatgggaaatacccctggggagacaaaggatggaaaatttttaagaaaattgaaaaaacacaactaaattccaaaacatccctaaattcttggtacagaagaaccatggtttaacaattggcaggccatttttattattaattaatgtattaatttcgctgtgatgaaaaaattattaaattttgtcttgaaaaatttttctagcgtttttttttaaatttttatgcattactaacaataagtttttctcaagaagctttccaaaaattccctgaaataaaatttttttttttcttgaaattttcctatgaaaaatttctgagactgaaaaaacaaacggctccccaatttcgagtatcactaccgaggcctgaatggatcccaaattttttaaattttggctggaattcagaattttttggccatccgattaagtcccgcccgaccatagccaatttatagaaattttatgcacctccaccagcgtgtcgttctcgcagtacacatgcacgtcgtaccgtctgggaaagtcgggctcggccaccaactgaggaaaacgggcaagaaaggtggccaaattgccaccctcggagtagtggaaggcgcccaccaagcgaagaaggcccggcactcgcaaaagggtggccaaattggtggcaaatgtgctttcctgatcgtcttaaaaaaatgtagatgatgaaaaattgtagacctggcaaaaatgccattccttgctaaaaaattagaaaatttcaaatgtttcaacaaaaaaaaactcaaggaaatttatgtaccgtctaagcgcggcataaaattgaactcgataattctgggagaactaactccatccttttttctcaaattttagtaatttttaatggacgctaaattcgtcaaaatgataataaatgagatggaatttgaattataaaccgacccttgaattcgtaggacaggaacaagttcaagcagtacttgcaccgttccttcgacattttctgttgctgttccgccgccaatttgctcagccattgcaccgcctcgtccccaatgccatccatccaattttgcatgccataaatgctaattgagctcacggcgtccgctgagatgggcaaagtgccatcgctgttcaaattgaggcgctaaaatttgcattcgcgtatttcttaacaaaatttaaaaactgaggtaaaattgaaaattaaatttatatatttgactttttcaatttaaatcaccgttttctctccgaaattcgtgcccgagtaaatgcccactgttttcaactgttctttcctctgttgttgttgttgcaattttccatttgcatcgccttcatcaacatcaaccagcttgaattggatgctgtcaactgcctaaagcgacttttttttaattttcaaaaattttaatccgattccaggtttttggtatcccatgatcagttttttagacgtcggctgatatcctaggtttgagctattaaaaagctaacttcgctgtgctttcgtttactcatcgtagcggctgcacgtctggcaattaaaaatttcacaaaatgaaatttattgaaattttaattcaaaacgccacaatttactttaaaaaatatattttanagttaaaggaagggaaacaaaaaatcgtgtgattttcttt

SEQ ID NO: 8259 - DNA, 1718 bp, Heterodera glycines
cggtggttggcacatatcagtggacccaacaaagtaaggctcacaaatgacaaatgggtaaaaatgtcttcattttaataatcctgcgaaaaaaaaacttcatacaaaaatcgattttttcgaaaacttcatcccttttttaggtttccgtgacaaaaagtggcagcagcgatgtaatggaagtgaacacaaaaaacattctgatcgcatccggctctgaagtcacaccatttcctggcattgacattgacgaggaacaggttcattgatgaattttttttaatatttttattttccacctcaaattgattttgaggtcccaaatttccgggtgcgctaataaattttacaaaaaatgttttcagattgtctcctcaaccggagcattggcgttgaaaaaagtgccacaaaaaatggttgtgatcggcgccggtgtcattgggcttgaactggtaaatggcaacattattttcaaatttggcccctcaaaaagatattaaaaaaagttttcttcgttttagggcagtgtttggcaaaggttgggcgccgaagtgaccgccgtcgagtttatgagtgccatcggtggcgtgggcattgacggcgaagtgtccaaacaattccaacgttcattgaccaagcaggtaaatgcctttttaacggaatttcatccaaagcatattggaattttttggtacatttttgcttgaaaatttaaaaaaatggacaaacatgagatttttaactaattttttacactttgtttagggcatcaaatttttgatgaacaccaaagtgttgggtgcgcagcgaacgtccgatggacaggtcaaagtgcaggtggagacggtgaaggacggcaaaaagcaggaggttgggtggggttttttaatgacattttagggccaatttttctattctctactcttggctaaatgtgtattttttgaccaatacatccggatgtactacttcattctccctctcccaccagaatttttttaaaaaaatattctaacagaattattcaagaaaaaagttcttttaaaaaaattttctgcacttttttggaaaaattaattatttacataaaatttaaaaatcgtaaaattttcctcaatttttttccttgaaattttcctttgaaaaatgggtgaaacgacttgctcagattaaatccattgtctctatacgccattctaacattgcccagttgaactgtgacgtgctgctggtgtccattggacggcgaccgtacaccgatgggcttgggctgaacaatgtgcagctgaacacggacgagaagggccgtgtgccggtcaatgaacgcttccaaaccgcggtgccgtctatctatgccatcggcgatgtgatccaaggcccaatgttggcccacaaggcggaggtgagagaggggggggatgactctttttaaatataaaaaattcactcaattttaaaggacgaaggcattttggcggtggagggcattgcgggtgggccggtgcacattgactacaactgtgtgccgtccgttgtgtacacgcatcccgaggtggcatgggtgggccgagcggaggagcagatcaaacaggaggtgaacaaaatgatgggttggagtcggggggtgggtaatcaatcgatcaagggtcaggaaaactgggccggactggtccaaagccttgctttccttaccctacaccgcccccaatagtgtttcc

SEQ ID NO: 8260 - DNA, 2246 bp, Heterodera glycines
  misc_feature (2223)..(2223): n is a, c, g, or t
  misc_feature (2225)..(2225): n is a, c, g, or t
gggtgtcaactacaaagtgggcaaattcccgttcgtcgccaattcgcgtgccaaaaccaacaacgacgtggaaggctttgtgaaggtgatcggcgacaaggacactgatcggctgttgggtgtgcatatcatgggaccggttcgtttgcttcttttaattaaatattgcattcaaaaattttggcgttttgtccctaactccaacaaattttttttttttttttgctcagaatgcgggtgaaatgattgccgaagcgacgcttgcgctggagtacggtgcctcctgtgaggacattgcgcgggtgtgccatccgcatccggtcagttggttttgtttgcgtgtgccttgccgtccagggaagcggcaatatttgatccgaaattgtccttctattttcttttttggtgaagatcgagaagacaaaaaaaatttaattttgaaaattttttggagtggggcggctcgagagagagaaataaagtgcacccaaataaattcccacaatttaacaacttatcttggaccatggaactcttctaacgcttttttgataagtccggcttggcccaatggagcctgccaattcgttttccatttcctacgtccctctcatccattcattctcttgctgttttagaccctttccgaggcgttccgcgaggccaacctggcggcatactgtggcaaggcgatcaacagcatttgatgaatgaataatgcattcgcagcactgttcatgatatatggattgaattgtgacattggcacttttttgtttgttcgcgcactgttttagatgttagagatagcaaagagagagagagtacagaaaatgagacaaataaagaataatttaattttaattaaaaacataatcgttctaaagttctcttttttcttagggaccaaaaatcagttgacttacttgattcctgttgtatgtttgcttaaaatccacataaaaaactgttaacaataagtattttctatttattttaaagtggactaaaaagcaaacaaagtaaaaggtcatcagaaaaaatattgagcgtcttttcaatttcgtaaaaatttggcctctggggggtgggcacgatctttcgtattctgtaaaagcaaatttctgatcccgccctcttgtcaatgtacaatatgattgtaggtgtgtattaattcattttttgtcgcttcccattgccctaccaaacaaatacaaaaataaatgtatgtaatggaaagaaatgtcgacccatattgataaatgttgatatgtcccagggatggcattccgaggccccaaaaaagcatcacaaaattcctgttgccaaataaaattcgcaaaaatgtccattgaatgcaaactcggttgtccggggaacaagctcgtcaaacagttccatcacaatgcgtccaacaggctcaccatcgatgtgaatgtcaaaaaagcagcgccgtctctcggcctttgacaccgattttgaatctagtaggatggtcaatggaaaaaagtaggttgttcgagacattcatttctttacacatcaaagtattttaaattgtgtgcgatttctatcaaggatgagcggatcagcagggggatgagatgcaatgaaatacaagcaataacagtattcaatcatttcaaaacattggattgagacggaatcacaaaaaaaaaaatacattttatcaatgaattcaataaacaaaacaaaaaataaaggaaaatttaacaataataaatcaacaaaaaaatcactcttcatcgtctgctttttcttctactttttctagcaaaaacttcacccaaacagatcgtccatttttaaaaaaagaaatcgctttgttttcgaagtcaaaatggcacttataataaagaaattcgttaatgcccaatctaaaattattgtttgcagtttctcaattactttgacgtaaacatacgttaaagagtccttgtccttttcaaggacatcgcatttaaatcccgtatcttcgaattcacctattttgatgtttaaaccatgcagcctaaatttttagtttaaaaaaggattgttcacgaataaaaaacccactgtccaagggtttcttctggatcaccaaatgcggggttgaactgttttttttttaaattgatccaactgtggtcccaaaattgcacgatttgcattgaaaaaaggtccgcccataacagcatttgaacagcctgtgagaatgtnanaaaatttgtacataaaacaca

SEQ ID NO: 8261 - DNA, 2965 bp, Heterodera glycines
ttttttatctctctttctctgctttctctcttctctctctctggttctctctctcttttcttcttttcgctttcctctccatctcatctctctctctctgtctgttctcttactctctactttatttctctctcactcgccctctctttctttcgttctctctcactctcattctctctcccatttcccttcatctctctctccctctctcttctttctattctttctcattttcattttaaattaatttcaatttttaattttcaaccttaataatatatttatttatttttattttaatgataccatattataaaaattttatttgaaaataccgtacgtatcacttgcgcaggttccaataggctttgtcaatctgaccaatggaaactgttgaaattcaaataaaatgcaattaagaaaatgaaattaatgaaataaataattaatcagtcaaaatcaaccaatcaaaaaaatgaaaaaaaaacattatcaaatgatcagtttatcaaaattgcgaatcaaatacattgaaaaatggattagccaaagaaaaaggcttcgaagccgaccgatactcactcattttttgccctaaaaagggacactttagggtataaaatttaattattttaaatttattttattattttaattaaaaattgtttttttaccaatcatttgatatagtcgttcagctcagggaaggcgaactcttcattggacatgttggcacccttctgcccaatctgagccaagcacgtgtggttgtaagtgccaaaagaaagtctgctgacgatcacttgagtgtcattttgctgctcacaagcccacaaaatgacgatgtgttcagtgcctaagagggcaattaattaatttaattaattttaattgggtaattagtgacccaccgagtgcgcaaccgattgcagaacagaactgttgatccgcagcacattcggacgccacaatagcagcatagcctgacgtttcgtagatcccaactttgcaatgggtccctttaaatttaattttaaaatcatttttaattatttaaatttaattattttttatttttaaattttaaaaattaccgtagcaaatccatggcaaagcgaagaagcagcagatgacagacaatgggagaacaaagttcattttctgcttaatgtttttttggtatgctaaaaagttgattaaaaatgtgaaaatgattttaaaaaatatggaataaaataaataattaaaatgaaaaatgaaatgaaaaatttgaaaattttattgttaaataatgaaaatttaatttccccccccccaaacttatgcattcaattcatccaccactttggcttttcatcttcttcttcttcattaacttctttcactcttcattcactcaccattcaacgcacgaagaagaaatttggtcaaaaaacctttaaataaataaaccataataattttacaaaataaaattatctattaattattaaacaataaatatttaatatttatgcactaaattttatttttcgataattgcttaattaatctcattatgtaccaaattaattttattttccgataattaattaattaatctcattattaccaaatgcgagagttgcgcaggcattgaaaatgttcgcatttgcacgcgtgccgaagccggtcggtattggcatttcgcttatgacaatgtcaactgtttattaataaaacaatcacttggaattaaaaaaaacacattaattaatcatgttaattattttacatttgcatttaattgaataattttttcaaattttttttggttatttcgttttatccattttaattttcagttcattttattattcaattttattcaatattttctctcactgtgactcattttggagaggggcataaacgacggattcagcaaatccacattgtccatgtcgcgccccttgcgcgcaattcggcactggcatttgtggccaaatgccaggtatttgttgagcgtctcgcaatctttgtccaaggcacacccccaaaaggtgaaactttccgtggctgtgaaattatggaaaattcaaacagccaaaaaataaattaaaacaaatttttggttgaatgatacgataaattttgggaattttttaattattaaattcattgttttattgctaccgtatttccgtgagcaatttttggggtcattggcaactcgtatgtttgacaaaacaaagcctaagattaagccctaggctttgcttaaaacataggcttaagccaaaagctaggcctaagcctaagcccttagacctagacctagctaaacaattccaaatttttcctctcattggaatttggcttagaaaatacggtagttcaattaatcagttgcttcttattattttattaatattagaataataaatacaaatagggattaatcaccaatttggcagctgaccgcgtaacagtattctccgccaacgcactccttcacctccgtcttaccgtaaccgttgcctcggaagaatccggtcctgcactgtatgccttccaatttaaaaattgagatatcaaaattcaatttctatcatttttccatccacggaataataccacgtgccattcccacactattatttttctttagcattttccctatcatttttttgtgcccatgtgccatgccatgcaaaaactttggcattttgccgcccacttttgttcaatgccaccgccggaagggtcggaattttgtcgggctcctgcgcctcgggcagtttcacgtgctcattggccatgtctttgccctggtccccaaattggcactcgcagcgctgcttcgtcgagtgcagcgcggtgttggacgcgttcacgaagaattcttcgcagccatttttgtccgcttcctcgctacagccccagctgagcagtgccgtggaggtaaaattttctgaaaattaaa

SEQ ID NO: 8262 - DNA, 3192 bp, Heterodera glycines
  misc_feature (1750)..(1751): n is a, c, g, or t
attcatggcatgtgaatggcacaaatgccaaaatatgagttttaatttttttttttgatttggattcgttttcacacttacgctccatgcaaagcacggaaaagcaatgctgcgcatttggcactttgtcctcacatttcccattcgccgatttttcgcccattttgtgatttgcatgtccaatcttacaggtcaatgcttaattagttgattaattactttaatatttggactaattatgatacgcgagcattgattgatcatggcgatcagcaccagcaaggcaattggcggcaaaagatcaaagggggcgatcattgccatttgaaaaaaaaaaatttgttgaaattaattggattttatctgaaatatttttaaattaatttgacttatttattttcatttttatttggactaataaattgtaaaatgaatgcttttcacatttttgttcgttttccatttggcttttttaatgaatcattcactttccatcccacaaatattctttctgcagccactgttctgatgactaattgaaaatgatcaaaaaaaaaaattttatgataattattcactgggaaaatggacaaataaaaatgatttatgttaattaaatgtgcaaattattttttaattaaataaataaaaaagcaataaaaatgatttggtgccatattaattaattaaaaataattcggtgtcatattaattaatacaatacataataatttagagtgtcatattatttaattaattatcaattgagtgccattaatttcggcttcggtatttttggcacaaatgtatgaatcttaaataattttaattttaagatgttttttgtaaatttaaattttgttattttttgcttttctatccatcttttcgctgtttccaatgccaataacacaatgtaatcaaaaaaaaaattatcaaatattcaaatgatcatttactaatctgaagcaattaagcaaagtgccgttggaatttagaccattttgcacattaaaagtgaaatatgaaattcatggaaattgtgaaaggtaattaattgaaactaattaaaggcatttcaattaattaatttgctttaattaattaacccaattaagtttttcgttgtgttacaaaagtgaattattattcggcaacaaaaattattcatggaaattggcgaaaagatttaaatttgacaaaacattcactgaaaaggcaaatgaagaacaatgtggagaaaatgccaggaaaattcaattttcacttgccaacggaaaagaaattattgaaaatggaaatttattatcagagtaagtgtaattatttaacaatctaaatttataaaaattaggaaaaaatcaacgatttggaaatttttcaaaatatgaaaattaatttaaatttaagtagtgtatttacaatatttcgctgaaaaataacagaaaaatactaattaaggaatgaaaatgttaaatcaaaattattgaaaatattttttgtaatttatttttaaggcaatttttaaatttttaaaaaatataaaaaataggaatgttaaaatgacattcattgttttttacttttaatactgaaaaaattcaataactttgtaattttttgaataataaaattaattaaaatttcaaaattaaatgaacgatttttcattgaaaaaacaacagaaaaaaataattaaagaataaaaaatgttaaacgaaattttttgaaaatatttttcttatttcanncaaagatgtttaaaatgatattcattatttttttataaatttgtcgtcatatcacaaaacttgttctattctttaggaatttgtcagacgaatacatttttcgcgcattgccaattttcgaattaaaatttacaaaatcgaacaaaacaatcataattaacacaggtatttttattattccttgctctcattaaatgccaaaaataatttcacatttaaatttagtctcgccaaaacaaatgaaattgcgctcagaattttttgccgaatcaaagcttggcccatttttagaagaatttgccggcctttggcttttggcggcggacatttggccaaagtttggccaaatgccaacaaaatttgtgtttatggtggcgaatggatgccaattaattcgtgtcgatggcccacctcaaaaatgcgcaactttttatcatttggcatttgaaaagccacgtgccattcgccaacaaatcattaagccactcgtaggaattaattgaattgtttgtttattttttaatgaaaaattatcccaattatggtctcttttaaagatatttctgaattttttcccaaccttcaaagaaatagttttaaacttgattagttattaacggagtttttcattttttttacaagatttttgggtttattttagaagaattattttgtcccattgtataaacattaaaaataaaattaaatttattatttttttaaatcttgaattttttaattcaaattatgtttaatttatacttttcaattagtaataataataatgatcaattttgtattaatatttatatttacacaattagttaaaattacaattattaaatcaattaaaattttgctcagatttccggtggtgcccaaattgacataaagcaaatgccatggacagtttattttatggcaagtttgaccgaatattctgaatacggcagaagatgcactgcttcattaatttcaccaaaattcgttctgttggccgcccattgttttgacaaaatgaaagaatttcagccatttttattgggtaaacaaaattaataattaattaaatgttttgaaataataaaatttggcatttttaaaggatttggctcaaattcgcgagtcttcaagagcccaaattatgacggttttgttgttaaaatgactcgtgtgaccaatttaaatgtgttcatccatccaaaatatacgaaaaatggccttggcttaaacgatttggcattgataaaggcacttaattaattaaaataaataaccaattaattaattaataatagctggaagaatgggtctctcttccgtcaacagtttttcccgtctgtattcattgtgagaagagcacagaaaagttcaaaagtggagaagcatacattgccggatggggactaatggagagtaaaaatgaattagttaataatga

SEQ ID NO: 8263 - DNA, 1379 bp, Heterodera glycines
  misc_feature (1264)..(1264): n is a, c, g, or t
aatgattttatttttgagatgcttgtaccagaattcgccaaaaaagcccattaaatctgatgggccgaagtgccaaattaactgaatgcgcttatttgcaaaatgatggccatcaacgaatttgcgttgagaagaacactattcagacagttaatcaattttattcaattaaaaatcattattttttaaaatttattaattttttaaatatttataaaactttgaatttttgcgaaaaagtaatcaaggacataaaggacatgtgcagggtttgtccttgaatgcttaaattcttttattttcttagggtgatagcggcggtgcgttattgggcagcaacggcacaaattttgtccaaattggcgttgcaagtgtcactttatgtgaccccttatttggcaaaagcaattttaatatttataaaatttaaattagtctaaattaacgaataattttaattaaatttttatgaattttaaattattcaaaattaaagaatttaaatacaaatttgtttatcataaggtttggtgagcatttactctccgctggacggttgttggattgagcgaattactggtgttgaatgtggcacctaattgatcgatctctattaattgcttttaatgccacaaattaattactaattaaaattgtcataaaatatgtgcaaagataattgaaatgaataaaatgatgcaattttgagatggataaaaaagcacaaattaattcgttgtcgccataatcatttaatttaataaatatttaagtatattttaattcatagtcaaatgggatgaagccaaatttaaattttcagaaaatgaactttgaaattcaattacaaatgctgggtaagcgactgatggatgagctgcaaccatgccttatttgtgattagaatcccggacgaggacggctcccgaaaaattggacactaacagaaaataaaataacttatccataaaatttgcatgattatttcatagatcagatagtataataaagcattttcaaaattccaatttttttttgttttttgctttttttggacgccgatttcatcgaaaaaaataattaattttttgcgtgatttttaatagattatttactaataaaaaaataaataactttcggtgattatcgaggacaattcgtcaattagtaaaatgcaaataaattcgaaatgacaataacttgtacaattttgagatggaccaaaaaaaacaacaaaattaattcgtattttcagacaccttanaacattaattttttaatatatttaattcataaattcaaatttgcaacattattgaaaaaaatgcgataaatcttctggagatggcctatcgatgacaaagaaacatttggaatta

SEQ ID NO: 8264 - DNA, 2429 bp, Heterodera glycines
  misc_feature (191)..(191): n is a, c, g, or t
  misc_feature (210)..(210): n is a, c, g, or t
  misc_feature (267)..(268): n is a, c, g, or t
  misc_feature (286)..(286): n is a, c, g, or t
  misc_feature (297)..(299): n is a, c, g, or t
  misc_feature (314)..(314): n is a, c, g, or t
  misc_feature (322)..(322): n is a, c, g, or t
  misc_feature (325)..(325): n is a, c, g, or t
  misc_feature (334)..(334): n is a, c, g, or t
  misc_feature (336)..(336): n is a, c, g, or t
  misc_feature (338)..(339): n is a, c, g, or t
  misc_feature (357)..(357): n is a, c, g, or t
  misc_feature (366)..(367): n is a, c, g, or t
  misc_feature (369)..(370): n is a, c, g, or t
  misc_feature (376)..(376): n is a, c, g, or t
  misc_feature (378)..(380): n is a, c, g, or t
  misc_feature (386)..(387): n is a, c, g, or t
  misc_feature (404)..(404): n is a, c, g, or t
ctcgggagaacgctcctccttcggtccaacagcaatcgccgttttctttttttgtttgaaattcaaaattttactgcaattatgaagagtggcggggataaagcaacagcagctgaacggcaccagtaactatgggcatggcatatttaatgagtacagacagcatttcagcattgtaattaaagagtggnacgttaaaaatttaccccnactaaatttctttttttaaaaataacattaaaaactcacaaaaaacccgaaaaaacnntaatttcccccttttaantacccttactnnnatattccattttctnctcattanttntactaatancntnntttatattttttaaacanacctttcanncnnatattncnnnaaaatnnacaacaaaaaatcactntttaacaaaaaaaaaaagttggtggaattgccatttcattttacaatgatttatttatccctccccccccgtccgatttattcattttcattccttcagttttttgctaactttgaacaacaatttactctggccatatttgtataataattcaccctgtttagttgatttaatttaaaataataatttgctcactcttattttacagttttattagcagcaaaatttaataagttttttggcctatccttccgattaatgcacaaattttcccgccaatttataaactaattaattaatgtctaattgtcaggtattcagctaagaattttaatttacttacggtgttttaatcatttggacgaatggacgcgtgaaacgaattggttaatttttattttattatttaaaatttatttattgcgaaaatgggcatttcatgcaaatgcttttgggttatgcatgccaccgatccgtttaaaattttcttacattcagagggaagtaaatattcagaactttgtgctgtccaattcccatcagcaaaatcttgttgaaagtttaagggtaatttgtcagtaaaaaagacaaattaattccatttttttggggggagggctttatttgcgaaaaatggtcagtgtcccttaaaattatggattctgctttgaggggaggtggtattttttcggttcacgtgtgtcctaccccctgcccctccatggcgaaatatgtaggtgtgcaaaaaatatagaaatcctacaaatccgggccctactaaactaattacaatctcacattctgagaatttatgtaaatttttcgatataataaaaatgcaaaaaattggatttatataatttgattattttattaaggcacagcaatgtctccgttctgtgaattgggtgcgtcggctcgtaaatatgattgatgccgaccgactcgtccacgctgaggcacacgaatttggaggcattcaattgcctgcgcgaaaacttgaggcatttcgccttgttcgaggtgttaaattcaaaatgaaaaatttatttaccaccaattcattataaatatccaattaaacattctttagagttgctcgccgttgtcactgctcatcccaatttaccacagaatattcagcaaactgttggcttgcccatttccgctaacaatcgtgattatgttggtttagcaaattttaaatttgttttttaattaatttttaatattcccccttttggggctcaaatggccccggatggataagcatgaacatttatccttgtccaatgttggattgtttaataaaatttaagtcaaaaattgaaaaattgccatttatggaaaaatttgttaaacttagagattttttcctttaattaaaatattttctgactaatttgtaagtgaaattctcatgttttgcattaataaaagcgtttgaaattaaatcaaattattttatttttaatttacattattacaggttcgtctgtacccgtatgcataaagatcggatcctcggatcacgacccttattacaagggaaaataggatccgaggatcggatccgtagatgaggctcacgatccgtatgcataaagatcacgatccgcgatccatggatcatttttggtgatccgcggctcaggatcattgtgaattggccgcttaccacggtcgacaatttaacggctgttcgctttggtaagaatacattattattaatattcaaatattttttgttttaattgccaaaattggcattaccattaccagtgttaatttcgaaatattctattaaacataaaaaatttgaattgtgtaaattagactcaattttagtgctgagagagcgcactttgcacctgaacggagagtataatcttggccaatagtcggagatacaaaaaagacaaagtgccataaattgatttacgcttacaatttagttgttaatgcgatttatttttaaacaggcctttcgcccagccgtatccagaggggggggggggggggggg

SEQ ID NO: 8265 - DNA, 892 bp, Heterodera glycines
actccagttcagcgaatagcacttcattccatggaatggcacaacatttcagcgaatggcacttcatcttcagttaatggcactttatttcatccaatggcacaatatttcagcgaatggcacaacatttcagatcatggcacctcatcttcagtgaatggcacttcatttcatctaatggcacaacatttcagcgaatggcactttatttcatcaaatggcacaacatttaagcgaatggcacttcattaatcgaatggcacttcatttcagcgaatggcacaacatttcagatcatggcacctcatcttcagtgaatggcacttcatttcatctaatggcacaacatttcagcgaatggcactttatttcatcgaatggcacaacattcagcgaatggcacttcatcttcagcaaatggtacttcattccatccaatggcacaacatttcagcgaatggcacttcatttcagcgaatggtacttcatcttcatcgaatttcacttcatttcatcgaatggcacttcatttcagcgaatggcacaacatttcagatcatggcacctcatcttcagtgaatggcacttcatttcatccaatggcacaacatttcagcgaatggcactttatttcagcgaatggtacttcatcttcatcgaattgcacttcatcttcatcgaatggcacttcattcatcgaatggcactccagttcagcgaatagcacttcattccatggaatggcacaatatttcagcgaatggcacttcatcttcagttaatggcactttatttcatccagatggcacaacattttagatcatggcacctcatcttcagtgaatggcacttcatttcatccaatgggacaacatttcagcgaatggcactt

SEQ ID NO: 8266 - DNA, 1635 bp, Heterodera glycines
aaaacatttgttattgcaaagtaacagatgaaaaaacacatgtttttgggcaaaacatttgttactgcaaaataacaaatgaaaaaacacatgtttggggccaaaacatttgttactgtaaagaaacaaatggttttgcatgtgttttttcattgcttttgtaaagaagtaaatagtttcgcttgtgaaaatgtgttttttcatttgtttatttgcgtaagaaatgaagaataacaaatatatacactaaaccattttttatatacaagcaattgaataaaacacaacgaatttctaaacatgttttcgaaagtaactaatgaataatatgtgagaaataatttgcttatattggcaaactaagagaagaaatgcctattcaatgtttgtctgaacatttgttttggaaggaaacaaatgaaaaacacacccagtttccatccgtccaggccgcaaccctggataccagcgcaaaaggaccagtggaaagcgaacgcccacgcccacccaactgggaagaaaacccagtaccaggcaggactccacggttttcatggatggcccccaggatattcgaaaaagcgtatcaaatatcctataggggtttactaccgcgtcaaccaaatatgcaaatgtttcggcccttcaaagccgtagacacggtttgaatttcaaaaaaatacgagcgggcctcgtcagtacggcactcgtattttattattttttgttgctaagctcaccagtcagcctttggcgtcaccccggattgttgcttttaattttattaaaatttttggttgcaaaaatatttgtttgttaggaaagaactgaaaaacaatttttggggtaaaatattttatgttttcaaaagaaatgaaagaagaaatgtttgggatgataaaatattttatgtttggcaatgaaatgaaaaagaaatgttttgggggagtttaaatattatatatttggaaaggaaatgaaaaaatacaattttttgagatcaaacatttgctactgcaaagtaacaaatgaaaaaacacatgttttgggacaaaaacatttgttattgcaaagtaacagatgaaaaaacacatgttttggggcaaaaacatttgttactgcaaagtaacaaatgaaaaaacacatgtttggggccaaaacatttgttactgcaaagtagcaaattaaaaaacacatgttttgggacaaaaacatttgttactgcaaagtaacaaatgaaaaaacacatgttttggggcaaaaacattcgttactgcaaagtaacaaatgaaaaaacacatgttttggggcaaaaacatccgttactgcaaagtaacaaatgaaaaaacacatgttttggggcaaaaacattcgttactgcaaagtaacaaatgaaaaaacacatgttttggggcaaaaacattcgttactgcaaagtaacaaatgaaaaaacacatgttttgggacaaaaacatttgttattgcaaagtaacagatgaaaaaacacatgtttttgggcaaaacatttgttactgcaaaataacaaatgaaaaaacacatgtttggggccaaaacatttgttactgtaaagaaacaaatggttttgcatgtgttttttcattgcttttgtaaaga

SEQ ID NO: 8267 - DNA, 987 bp, Heterodera glycines
  misc_feature (48)..(50): n is a, c, g, or t
  misc_feature (85)..(85): n is a, c, g, or t
aaatgtattaaaaagcccgtttatacgtgtgtaataaatagtcatcannntggtaaccacatgtcaaaaataatgccgggttctnttatgtaatagaccaaaaaaaatttttaaaatttaaattgatatgaaacaatcccattattccattttatcttttaatataaaatgataatgtaatttaaaataaaatgaaaatatttatgtgattgtcagaatctgatttgtccaccctcagattcccgacatcagatacgcaggaatctgtgtcttcaacgatctcttatgaaaaaaaaattttgacacaaaagaaatcaaaaattaattttaaaaaatttaattttgattttaaactaacaaaaatagattattttattaaaaagatgatctatttttcaatgtcttataatttgtttttgtatatatgatcatttaactgtttaaaatttgtgagataaaataatataatctattaaaaattattcttttgaaattttaaaaaataaatagatagcgattttttgttaactgataaaaaagtatatttttaatttaatatatttgaattatttttaatgattataaatgttgcttaatttataaaattttaaaatatggtgttttgatcagaaatatgttgttggtacgccggtttgtgatttttgacatttaggaccggaattccgattgcggtttttttggccgtcaaaattccgattgtcaattgcacaaaaaagtccttattttttaagactatttaaaaattaaaattttgtacacgaaattttttagacgtttaaaaagcactcattcatttgtctaaacacaaagaaatgaccatcgacatttaaataatgcttactaaatttattcattatttcaaattataccaaaaaacacccaaaaacggggattattatttccattattttttattaccattttaaatgcaaattttttagtgagtctattgataagttcattata

SEQ ID NO: 8268 - DNA, 6147 bp, Heterodera glycines
  misc_feature (1655)..(1655): n is a, c, g, or t
  misc_feature (1830)..(1830): n is a, c, g, or t
cgtttgcctataaatgcccttcggcgttgtgttggtattccattcgtcctcttctccttttcctctcctcctctgctccgattggatttcccacaacaaatccttcctccctttcttcgcctcattttgctcaattcgcaaccttttcccttccccccccccaattttagccatttaattcactcaaaaataaacaatcaaaatgaaaggcttcttcgccctgttcgtcttcgccttcaccctttcggtgttttctgccgcccatttgccgcctttggacattaaccaaatcccggccgaataccgcggtaagcgcaagagaaaaaacaatttggctgggcgattaataataatgataattagcgataatgacgccgttaacgtgcccctctcagaattgatccccgaggaggtgaccaaattctaccacgagctgaccgaggatgacaaaaaggcgctgaaggaagtggcagaacgccacgaggaattccaaacggaagagcaggcaaataaatggacacccccctaattaattagatgaaatgacgcctaattgcccaccccttttaaggcaatggaagcgctgaaggaaaagagtgagaagctgtacaacaaagcggtaatttaaagttggatggacaagtggggggggggaggatttctctgattttgaaattcgcttgggaatgaaaatggcgggggggggtgacggaatgatcttcccaacaaaataattggaaaaaggaaacagggaccgatcattggtgatcagtggcccagaaaaggaaggggtggcggattttaaaataaaatggttgttctacccgcacaatttaaggtcgaactgcgcacccttgtcaaggtcagccacaccaacaactcagcttttgactagcgaaaggacaaaaataaattccccaaaacttacagggaaaaattgaccaattggtgcccgacgcgaaggcattcgttatcggggtaagcaatgggcagcggaactgatcagacagaagccgctatttggtcacagaatcggaaacatttaacgctttgctttcagatgatcgaaaaggcaaagggaatgcgcccgaaggccggcgagaagccgaagcttgaggagctgcgcacggcggccaacgagctgatcgagaagtgagtggggaagggaaggacggaaatgacaattagcggtgcctttgaccggtggacaaaatgccgcttttccctcccaggtacaaagcattgaatgacgaagccaaagagtcgctgaagtccaacttccccaagattacgagcgtcatccaaagtcagttgtgtcaattaaattttcaaagtgcatgggctaatcacttttaattactttcccatataactttccctacgtttcagacgagaaattccaaaccttggccaagagtttgctgaaacaggaggcaccggccgcctaaacggcggcacttaggaaggaacggactgatcactgattaattgatggaccattgcgcttaatcttttgccattattttgtaccaaaaaaacagacagaacagaatttgtgcatattcacatacactgataatataatattataataacttttctcagtcttttgtaaatggctaataaattgaattgccaattgacacgacaattgngggaaaatgggcaaaagttttttgggaaggtatcactgatcagatttgggatcaaagttttacgaattataagggcaaagagcagatgtattggatacttttaccacgtgtaagaatgcacttttaattccgccattttcctctccaaaattcgtttttctccgattaattggcncaattaaattaattaatggggctgctctgttggtgtgaacattttgactacggtatgggagaggacacactttcattacgttgtttctctgttgaagtttattgccctgcctcgtgccaaatgccaactgttgcttctgtcccccccaccatttggccaattctccattattttggctaatttcccgattctttttccgtctccccgctttgataatgccaataaaacggaggcgctggcggaaatcggagaaaacaaaaattttcacaaatttcgcaccaaaataataataaacaaaaaaattaacctaataaaaatagattatctaaattctactaatttgctgtgttttttctcattttttttgcctaattttcaatttttttgtgcctaaatttgatgccgaaatttaaattatatgcaattttaaggaaagcactttcttatcatattgtaattatgctgctgcttctctccattttttcgcttcttcttccggtgtttttgactttttcccccttttcaaatgcttttcccgtcctttcggttcgctttaatttttatttttaaatcggtttaacaaaattattgctgttagcagaaaacaacagaaacagcaacaaattacaatgctaatgacccgtggcgatcattgccccccgagttggacatgggacgagtcaaaggtcagtggtcgtgaatgatcaaccaatcagtttgacactcatcttgtgcttcctttttggcccattctcttggcaaaacttcgcttccaaattagtcttggccatcattagcgattaatcgctgctaatccgtctccccatttgcagaagttgtgccggaagaagcagcggatttcttcgatcagctgacgggccgggacaagcaagtgctgcgcgaagtgttggccaaggcggacacttatcaaagcactggcgaagtgctgcagggtttgttatcatcggcggatgagaagcatttacgagaccgtaaaatgtcaacaaaaacaaatagcacggcatttcgacattgttttttcgacttttttccgacccttttgggccaaatttccatttcccccgtaattttcggtccccctatgtgtaaatcttcttctgtaaagatctgcgaaacggttcttcgacactgtacgacaaggctgtccaagtgagttggagcaaatttatgttgttgagtgtatatctgggcttattgcaaaaaggtggtcacttccgttcgtggcattgtcggcaaactcagtgtgcccgcgcggacattcgtcgacgaagttcggtggactgtttttttgttgtttggggtgtgggatactgtacggaaatgttaactgtagcaatcaaaattattaatgaacatcatcggactgctgtgcaacttaattattgaaatttcctgtttcgctttgttccgatataagcgctttatcactgatataataggttcggttcagtctaagcttatctgatttgctggtccattgagttggtctaccgactgatctgttcagcctaatttggtttgatcagtcagttcatagtttatccgtccgttttctgacccaaactcttttgctagcctatttccgctggtttatttttacaccaaatttctgtccaacttttcgggggcaaaaataggcatttcggggtcgggcagaagccaaacattctaatgtttcctgcccctcctttggcgtttcagtccgtcaaacagttgcgcaatgcccttgggggcggcttctctctgtccaatttgaaggcccaagctcagcaattagtcgcccgttatcgccaattggacgctagcacaaaagaggaactgcgcaatgcttttccaacgattgccttcgttttggacagtgagaaaattgaattggcatttcttaaaattcgcataatggcattggcacttctgctaaacgacggcattttcagacccggtcgtacaaacgatggcatccggactgttcgacattaagacaaaggacgaagggccaatgggagagcgagggagagaaagaaatggggagggcgagagaggagaggagggggatagagacaatgggggaatgacgagagggggagggagaggagaagacggaggaggaagaggaggggaggtagaggacgaagtgggcgagagagcggagcgacggaatgtcgtccaccgacggaagaaccgatcggcggtttccgtagcatcaatggcagcactcgcagcaacaagcgcagcactcgtaacaacaaacggagcaatgtcaacaatgatcaatcagcagagaagaagcaacttgggaaggagggacggatgatcagtgatcagtgaccgatcagtccgtgcgtggcactgatcggcagaagcggcgataataaaatcggtctacctcagttgggcgcgctcggttgggcccagcatgtttttccactataactttctataacttttttctttgtcatccaaatccaacattgttggtatcattagaaagcttaacatgtttagaaaatttttctaagaaattgcttcgcgattagacaattaccaaaaaagttataaaaaagctatagtggaaaaacgtgctggcgcccaaccgtgagcccccaaactgggagggctccgtaataaaattaatgttactacaccgcccccttgtttaaaaaatatttcaatttttttaatcttttaaggagttttcggggtcagagaatccaattccggcagccctttcaaagcccgaattcgaataaaaacgctgccaccaaataaattcagggaaaaacgtattaaagtttagctaacatttccaaattgatacgcagtcatattaatacaataaatatgctagaaacacttaagcaaacgcaaaactctttatgcgctacacttgaaccgatttttattgaataaatttgaattttgttaaatttgaatttttaattttattcgaacccgggttcggggttggaaataggaggaaacaactgtcggaatcggttatctaacccagaaaatcccgctaaaagtaattaaacacggaaaaaagaaatgaaacagcaaatggaatgtaatttttatttgaatttagtacccaaatcccggttcctggctctatcacaataattgtgctatataaataccaaggcataaacaagttgaaaatttaattttggattaatatgggcatacggtactttgtatttgtccgtagggtacccgaagcccccccgtgttattttcataatgaattctccgcccatttcgctaatatctgtgaagatgtcggttttggcttaactttcgtacgtgcaaaacttcttcattagttctgttgcttctctgttcgcccccccccttgactcattcattcatttgcattcatcgccaattttccgctctttgtgctgccatatgccatctcctctttgaatgggttcgcttattagtccctaaaacttgtcaaaaggaagggcggggaccgaagatgacagaagcttttccgaagactttaattccgataacgtttcctttcattttcacctacttttacagctgctgagattgtgccgttcttcttttcagcctttgtgccgatttttccctaatagatttttaaattacctaccgtaaatccgctatttgaaggcccgggccttctattgttcaacccctctataagtcaaatgtgaattgcctattttttgtacctctatttattcattataagtagggctgtgaattttagtgacgaaaaatcccgaaatagttaactaaaatagtgagtaaaaatgccaaaatagtgaagaaatagtgacaaaaagtccgaaatagtgacgaatagtgacaaattttcagccaaaaattgagcaaaaataatttttattcactgattgcagttgcaaatgagtcggactgggatttttaagaccaaaaaacccaaaagttacctaaaaaaattttaaaataaaaaatttttgccaagaaagtaaatttttgagaaaatttttttcatttcatagtttgaaaaattttagcttgattcttaggggtgtattttttggttattgcatttttgttaaggaattttccaaaaaatgtcgaaatagtgaaaaaatagtgacaaaacgccaaaatagtgaattttccaaaatagtgaattttcactattttagtgacgaagctccaaaatagtgatttctagtgaccgatagtgacatcagaattgaaaatttttaatgcagaaatgcgttttttgagctcctttcttcaaatcaatcgagcaaaaaatttagttaaaac

SEQ ID NO: 8269 - DNA, 5552 bp, Heterodera glycines
  misc_feature (121)..(121): n is a, c, g, or t
tgcttatttagtcccgccgggaccgggactggcaaaaccgggaccgggatttctgtttttccaaaacccgggaccgggacctgaaaaaaccgggaaatcccggctcggtcccggtcccggntcccgcccaactctacttaaaaagaccatcattggtagagttgaaaaaaatttttaaaaaaatttgaaaatattaaattttccaattaaattcccttctttacatttatattaatattcatttaacctctaaaatgtcgtaaaaaattttaaaaaaataagtgcgaaaataggcacaaaaattaaacaaaaaattccaaacgttgtctaaagtagagatttttcgccaaaatgcgaaattaatgcttgtaaattaatttctgcttctaaatccagtaaattaaatatttttttatttggaaattatttttatatgagtttttccaataaatttttaatagaacaatttattattttaaacaattaaggcataattataaaaaattaggtgggttgagtgattttcaaaataaattcaacaatttctttgtcacttaaagaagggtctcttggtttctttcttactattgtactttttcttcatcttttttggaatatctatttgctcctgaaaataaaagaataaattcaagaaaagaacataaatttaaattagaaatttatttttgctaatttcaatttcctaatttctttttccacttaatgtggggtgaagaataagagcgcaaaaagagaaagcagattttgtcctacccaaaacttatccaccaaaaggtcaccagtccaaaacgacacttattaaatgctgccgacccaaaacatcataaaatcacaaaaatcaaccaaattgaaaataaaattttattattttgtggataataaattttagaaaacgtgaaatagagcacaaatgccaatcctcattataactgtgaattttaatatattttcttatgataattttaattaaagctctttatcctttcttatttttacatcatttatgaataaaaaaaacaattaaaaggaaaatgccaacagataaaaggggaaaaacaaataaagcacaataattcataggctaacaggaaaataagtaaaattattaaaatttttgtttccatgttagtagggtgcgttgagtgatttttaaaaattcagcaatttctttatcactcaaagacggatttgctttcttcattttcaaataatcattcattttgctcattttctcttcattcgaatatccttaaaaaattaaaaataaataattattaaattaaattaaaatttacttttgccaatttcaatgccaaattcctttttccattttcttaatgttttttcatcaatgcccaactctttcgcaaattgcttctgtgttcctttttttgacattcttttaatctcgtcaattcgttcaataaattccttctttttcttttcataataatttttattattttttaaatattgtccaaattcttttttccatttataaattttctgtcgactaattcccaattttttcgcaattttttgctcagttttaacccaaacttttgccgaatattttccccgtttcttaattccttctctaattgcatgaaatttgtgaataatttcttttttttgttgaaaatctaattgatcgttctgataagttgattcattttgatgaaaatttgcattttgatcagtttcattttcattttcatctcctccaattattatttcattttgccattcttcgccaaatatttcagcaaaagttggtcgacattttttacacagattaactgacaatgttttgtcagttgaattgtttatgattaagaacacaaatataaaaaggagaaaaagcatcactaaaaaaagtataataaataattaattaataagtttttaatatttttaatatatatatttgtattaaaattaagctaatttcttcggaaaataattttttatttcattttaatgaatgtggagaagcattgccaaaaaggcgatcaataagtgaaactgatcatcaatagattttcttaataataaaatattaataaataatattaaaataattaaaagccatgaatttcatcataatttcaaatgccatttcgtaattacgtcccattggatgttttcacacttcatcactagggcttcaatttttatttgctgagctccctatggtctgcaatacacgaaaaacaagttgttgttgttttttggtggttgttaaggtacttttcgagttattagggcctattttctaggttttcctttttagagtctaaagcctaaaaaatttaaatttatataaatcataaaatttttacaattatttgtcagtcacaaaacaatcgccggtgctgggggagggcaacaaatgtaaagttgtgcggcgacacgttttcttcccagaaacatttcagcaggtgttttgctgttcggcaacgaatcatttggcgtagtccggtaacttaccaggaaagtttcgatgatttccttgcttggggctccctcccctttcaattttttaaacgttctcttacacgtgtccacgaaccgttcggcctggccgtttgacattggattatacggcgctgaaaacaggtggttgacaccgttgacggccataaatttggcaaattcgttgctcgtaaattgggtgccattgtcagacactaaaatttccgggatgccatgtcggctgaacaaatatcgaagcttttctattgttgccgctgtcgattttgtggccatttcgaatacctccgggtatttcgaaaaggcatcgacgatgattaaatattccttgccgaaaaatggtccggcatagtcgatgtggactctttgccacggtgcagatggttttggccacggttgaaggttgcttttaactggtgcctttgcttccatttggcacggttggcagttttctaccatctgttggatgtcggcgtccatatttggccaataggcgtaatttctcgccaactgcttcattcttttgattcccgggtgtcccttgtggaatgaatgaagagttttctgccgaagtttttcggggatgacaactcggtcggcgtacatcaggcaatttctcgtgatgcaaagctgttctttgatccgatgaaaaagctttatttcggcactttcgtctcggacgttccttggccaaccattcgtcaaaaattccttgactttttgaatggttttgtcggcttctgcagctgcgacaatttccttaaatttaattggcagtgcttcaattgatccgatcaaaatgtcgtcaatttccgaatctgatcggagagatgcaatcactcggtcttcgtcgctttttccctttgcgatcagccttgaaagcacatcggcttgaccaaaatcattggtgctgatgtactcaatgctaaaatcgtatgcgaggaggatcagcgaccatcggagaagtcggttggcactgcactggcgcactccctttttgcttccgaaaatggcaagaagtggctatggtcggttagcaacgtgaattttcgtccatagatcattttatggaatttttgcacggcgaaaatcagtgccaatccttctttctcgatttgagaatagtttttctcagccggtgttagagctgatgaagcatgtgcaattgcctttattgttccgtctggaaatttgtgggagattaccgctccaatcccgagttcggatgcatctgctgcaaccacgatttcctttgttgggtcgtaatgcgtgagcagaagttcagatgacaaaatttcctttattttgtcaaatgcttgtttgcatttttcactccacttccattcgctgtcctgcttcagcagatcgtctagcggttttcgtacaaaacgcatgtttttgacgaattgctgccagtggcccaccattccgaggtatgaacgcagcgatggcacatctgtgggtgcgggcattttactaattgctgagattttctccgggtccggtctccgtccgtttctgtcgatgatttgtccgagatatttgatctcttctcggaaaaacgaacacttttccaatttgatccggaatccccattcttggaatttttccaaaactttcttcaagtgatcagcgtgctctttgacactttggcttacgatgatcacatcatccaagtaagctgtggcgaattcaaattctgccaagatttggtccattaccgattggaatatggctggcgctgacttcacgccaaaaggaagtcttttaacttcatagttgccacggtgtgttgaaatcgagcagatttttctcgactcatcatccaattcgatttggagatatgcatccctgaggtcgatttgcgaaaaatattttcctccatttaaggttgcgaaaatatcctcaggtagcggcagtgggtgttggtggtcttgaagggcattgttcagaccggttgaatagtctatgcataggcgtgcgcttccgtcggcctttttcaccgccaaaatcggagctgcccattcggtgtattcgacttttccaatcacacccattttctcccatcgctctaattctccatcaatcgcttcttgcgcgttgtatgggactgggcgagcctttctgtagaccggtgcggcgtccgctttcaaagtcagatgcgccttaaatttcatacaacggcctaattcgtttttgaaaatgtcgggaaatgtcgctttgagatggtcgatgtgcgctttgactgtcgaattttgtgacggttttggagcttttgtaaaacctcttgtctcgtctccgactctgcacaaattcactggcgcatcaattttggccttgagttcgttcaggagtccaaaagcgtccatcatttgcacacttagcaaatttagcgatcccctttttgccacataatattcgcttttaatgcaaatattgcggaatttgaaatttgcgactccctttccgacgaatttgacttgtgttccatcgaacatgcatccactttcggtgcatttgcggagtcgggggctgccgatgacttcatgtgatagttcatcgatcacaattatttcagccccgctgtcgagtacgaatttgatgtctttgccatctaccgccacgtcggttttgaaaagcgaagcggagttcactttcatggccgttccaattcgtaaatttccaattttcctttttggaattggcaatttgtttctccgtctccattcctgcaccttgtcgcattggccttccaaatgtccattttgggaacatttttggcactttgctgacttatgcttacactcccagtggctgtgatttgtccaaccacatcgccaacattgttgtgccggagcggatgatgattggccttgcttgttgtttggccttcctcccttttgggttttgtgccactttggcttgactgcatttatgcttcggttggccgcagatgattcaatcagctttgcttcgctgattgtcgtcatgaaattgataaaatgttgaacaatttcatcatacttgacgttatctcc

SEQ ID NO: 8270 - DNA, 2073 bp, Heterodera glycines
ttcagaccggtggagtagtctatacataggcgtgcgcttccgtcggccttttttaccgccaaaatcggagcagcccattcggtgtattcgacttttccaatcacacccattttctcccatcgctccaattctccatcaatcgcttcttgtgcgttgtatgggactgggcgagcctttctgtagaccggtgcggcgtccgctttcaaagtcagatgcgccttaaatttcatacaacggcccaattcgtttttgaaaatgtcgggaaatgtcgttttgagatgttgtgttccatcgaacatgcatccactttcggtgcatttacagcggttttcaaaagtgaacttaagtttccaattttcctttttggaattggcaaattgtttctccgtctccattcctgcactttgtcgcattggccttccaaatgtccatttgggaacatttttggcacttcgctgacttgtgcttacactcccagtggctgtgatttgtccaaccacatcgccaacattgttgtgccggagcggatgataattggccttgcttgttgtttggccttcctcccttttcggttttgtgccactttggcttaactgcatttatgcttcggttggccgcagatgattcaatcagctttgattcgctgattgtcgtcatgaaattgatacaatcttgaacaatgtcatcatacttgacgtcatctccgtctgcgccgagctttgacaaaattcgttgtctcaaagttgcatctttcggcgactttagatctgtcaagagcatcaaaaccttgaattgttcctcctttagtgatgaaaacttgaagtcattcgtcgaagtcggtcacttttgacggcaggcatgatttggaatattcactgaatgccgtttccgacaatttgttcattaatgcctttactttcactgcgtcagttgcgtttggtgccgaacagtccattgcaaaagaaaacctttcgatccattctgaaattcgtcccttttcgtcggtcggttcgaagtccgaaatgtcaggcagcaccggcaccggaacattattgttcggattcggttgattgttttgttgctgctgctgtgcggtgacgagttgactaattgcgtccagcaattgttgaatattggcttgtgccattgtcggtggttatcgatcgcttttcagttgagtgttgaaattggacgatgaaaaccgcgtatagcggaaccgcaacccttttagggtctattggttttttgaagcgttgaaaaccgcacctggcggaacctcacccttttagggtctattggttttttgacgcgatgaaagtcggcggtcgaaatgtggacggtttgttttcgtccacttgaagaccggcggcagaatgttgaaatccaaaaattactctcgcctggagatgtaataaatgaataacaaatgcgctttatgtcgtttgctttttagctgactgcgccaattgttcggtccgagggatttgtttaagtccaattaaatatttatttattggagaaggaaaagaaagtcacaataatttggggaacaaatataaatgcaaaatgaatgaagggaagacaatctaaaggggaatgggagcatatttatgggcgagggaaggaacatgaaatggaacagaaatcgattggcattatgtcatgtcattcaaacttcggcggcagtgccccgaacactaattgtgcagtttaaatgagaacatttacgaatttatttatcagtcagagatattcgaattttttgttgaaaatatttttattatgaaatatttaagttttaaataatttataatttttttgtcctaaaatttattgaatcatttatttacttaaatgtttttttaatagatgtcgaaatgattgacgcagcaaatattttaaatttcttttctgagcacgtgcaaaagaaagaagaaaaaagaaatggggaaacaattgtaattgaggaaattgaagagcagagaaatggcggacaaagcattgataagaaagggaagaaggtgatcattgaaataagcagctcatcagaggaggaagaagaggaagaggaag

SEQ ID NO: 8271 - DNA, 1745 bp, Heterodera glycines
  misc_feature (89)..(89): n is a, c, g, or t
gtgcttcgacgggcaaagagcagcggaaaatatttgcggaggcgaaggcgtaagggcaaagtgagcaaaaacaaataaaaatttaaatntaaaacggacggaataggcgattattttttgaggattgcaacggaaaattcaaaatatttttggcatttcattgccatttgtcagattaatccaacactgtaaacttcttctgctggaggccaaacaagaggagctttgcggtcgtgttctgatgacactttgcaaaatggcctccaccgccaggacgaggcaatacggcgaagaggtaaaagggacaaagggacggacacaggtgccgaaagtcgaaggattaaccccggactccaagaactcgagaaaattgtcgagactcgggaaccgaaacccattctcgaccccgcccaaaaaaaagtcactcattcactcgccggctctgccaaattgtctctttttctctttgtcttccctaaaaagattttgtgtctgtttcttccttcaaattataagtgccattctcttcggcattattttccccattttatttatttgatgaaatttttttcagttcagtttcgttaaatttccaatttctcttcagttggtaagtttttcgcctttttcgcctttttcccttttcctttttttcttctttcttttggtttccttttttctctctctcttttctttctctccctttcctttgggtttctttttttcactattttttctgaatttcacttaatagggctcttcaattcgccgcgatttattgcttcgctattttggtgccggttctgtgcaaggaaatggcaacgaacttttggtcatgggaaaagccgagaaaagtgatcattctgcagccggtgagaatctctgatcaactgatttggccatttgtcctatgagtttggccatttgtcagctcgtcattctgtcccctcggcttcttcgtacgacgaatgcctttttggcactgatctgaggcttttgaaggagatcagtctctatgaaatccaatgcaaattatgcgatgctaaggcagttgatttggtggtcgatctgatcgtgttggacccgtcctacgacattttcttgaaaactgtccaattggccaaggcaatgcttcacggagggaacgaaaaagtggaaaagcaaagcaatcaaaagaaaattaaaagcataaaacaatcactcacaggtccaaatgagcttttacaagcgacttcaggagcgcaaattgtccgctcgtttcttcaaagtgttggttcagaaaatgcaaacggcacagaacagagtgaaaacggacattctctgcgggttggcacggacacggcccggtcagtggagaggagaaacagcgtcaaatgaccaattaattatcactaatcacttctcacccttcaatcccccccccctccattttcagctctgtccgccgttgtaagccgtcgctgtgagtgccctcctccccatttttgcttaaaactcggcttttccattccgtactttcatttcccctcagcttctgctgctgtcactccaatgtctgctccgaatggatttggccatttgtccgttccccgacgctccagcctaaaattggccgagatgagagggacgacggggcaacagaagcaaacggcggaaaggggagaagagacgaagccgttgcagacgacgatgagtgtgcctttgatacagcaggagggagagcaacgggaggaggaggagaggac

SEQ ID NO: 8272 - DNA, 2392 bp, Heterodera glycines
ggggggggggggggggtcagagtccatttccattacgagcggccattttttctaactgaagtttttttttactcttcggaacaatttttttttctccaatgttatttaaaaatttttaacgcccgagagaaaaaaaacagggcttattagcactttgaccaagaaaaatttttttatttttttactgggtgggaaaatgttcgtttcaggatttctgctgggggggggggttcccaccccggcaacgaaacgactttttttcgcaccacttttttgcggcgcttttccaaaaactgccgataggcaccgccgggaaattttttgttttgttttttttaatgcgatttgttaacaaattttatcttaaaaatgacaaaattttgcatatttttagcaaattttcaccaaaaaatgaccaattttatgcttttaagccaaatttttaaagaaaattatagacgaaatggaaaaaattgattttagtcgatcgtagttggaatttttaatggaatttttttaaaaactggcaaaatttttggatttttctacccctctcctcttacgatcgacaattttcctcgcaaatcggtattagtcgatcgtaaaaatttggaaccttgcacaggtatggaatgacgattatttgcctttcccaatggtcagcttcttctcgccattatggagtcgcggcacgactcggaaaatgcggacagagtgttgcgaaacatggcacacattaacgggggcgggaagcagctgctgaaagccattgcacaagcttattgcatgccgaacacgcaaaacttcgaattgtttcgcatgcgacagaaattgctgtgcaacgaacaaagtgggagggagaagaacgacccaaaagcgaaggaggggcacaaaagcggcacattttggcggacaattgccacaaaagtgccatttgtcggtccaaaatttgccgaaaagccccaacagcaaaatcagcaacaaatcgcctctccgttatccaagccgacgaatttggcctttggcactttggccgaccctcgcgaagtgagcagaaaattcaagcacaaaaaattggatttgaaattgtcaggttggacacaacatttatattttggcacaccaattggcacggcatagcgccgaattggatgtaatgctaaggccggagaatgccaaggacgaaaacacacgcgaagcattggcatattatcgaacgcacacgggccaaattgaggtgaaaatgagaaattcagcagcaaaatgagtgacgggccaacctacaatcagtgccactcaaagaataaaaatctttggcaaaatgtctttggtaaatttcaaagatcgttcgagcggaccgcaaaatggagcgcgtcatctttccgattcacaacatttgcgcctatctgacctccgagaccaaagagagtgtattcataaacacggaaaaggacgcgcaggggtcgaaagtgacggactttttcgaacgatggccctccctttacgaggaaatgaaatggcagcgcaaattgcagggtgattagtgccactctgatcagtgatcacccatcattgtctcttccgatcagatcgcctttggctgagtgcatgcacaaagcgtttgcccctgtggggccgaatgggctttttcatggccgttctgatcaatctgatcctcgccgttgcatatcccttcgatcatgaggactcatcagcagctcgtcctcgtatgttgtgatccttttgatcgtttccccacctctgatcacttcctcccgctttagtcgcactttctcccagcaatcccttcctttacatgtcatttgctgccgctctgttccacctctattcgtcctcctcctcctcgtcctcctcttccaactgctggtccctccctcgctcccccccccccactttgtgccaccctttcccctcccctcaggcaatgtcttggcctttccctatcctcccaactcggcattttcgctctgatggttagctccacgctgttgctgatcgccctgctcggtctcctcccctccctctatccccccccccgaaatgaaaatttttaaaaattttccagcaaataatggaaattttttcgaattcccccccccccaaacgaaaatttaataggcaattttcgtaacaaataacactctaatttcaaaaattttcccggcgacgcctatcggcaccgccggacctccactttccactatttttacaagttttgtgccttaaaacggtcaaaattgggtcatttttagtgaaaaagtgcagtttttaatgaaaaaaagttattggttaaatagcaaaaaaaaaaaaaaaaaaggtcttcaggtcgggtccccccccccccggaaaatgtttctagatacgcccctgc

SEQ ID NO: 8273 - DNA, 1646 bp, Heterodera glycines
  misc_feature (88)..(88): n is a, c, g, or t
catcagcagctcgtccgcgtatgttgtgatccttttgatcgtttccccacctctgatcacttcctcccgctttagtcgcactttctcncagcaatcccttcctttacatgtcatttgctgccgctctgttccacctctattcgtcctcctcctcctcgtcctcctcttccaactgctggtccctccctcgctcccccccccccactttgtgccaccctttcccctcccctcaggcaatgtcttggcctttccctatcctcccaactcggcattttcgctctgatggttagctccacgctgttgctgatcgccctgctcggtctcctcccctccctctatcttcttggcattttccaggtcattatcgcaattggtccccaaaaatggttgaatttcttcggttcagttggccaacaaatgtgtccatttggccagttatgccggcaatcggggaattgttgagcgcaattggcacgaccttctgacggactccacaatgctttaccatggcggctatttgctgtgctgtttgttcggtttggtcgtccacccgttcatttacgctcttctcgtaataactaattagttaattaatcattgtccaatttccctcttgtttttcagctgtttgacgtcgtggccagcgaggacactcttcgaaatgtcattcgatcggtgacgcgcaattggcagtccatcattctgaccggcttgctggccctgatcctggtctaccacttctccatcgttggctatttgttcttccaacgcggtgccctccaaaatttgccaattgaatttcttcaatttattccttcagactttcgcttggaagtgcacaaactcagtgcacagcgtgcagaggaggggcaaaagccatgtccaaatgatttgccgtgcgaatttcgttttcattgcgacaaaaaaagtgacggcgaaaaatgcgacggaagggaaaaatggcggagaacggcggaaaaagaaaaggaggaggaggaagaagaagaggagctgaagattccctcctgcgacaccctgctaatgtgcattttgacaacacttaattggggtgaccatttgggaggggggaaaactcattcattaaatggtcgtaaattcattcaaatgagcatttaggtctgagaaatggcggcggaattggcgacgttttgcgcagtgtcggccctcatgtgagtgatgaaaatgaatgttggtcgaaccatttgtaaagcctgaataagcgctaactcctttgaacagggggagggaaaagggatgggacaaaatctcgccgcaaaaaaatccatagcctggcaattcgtacataggcttaggttagaagatttaggggtgcacctcatttccatgagtcactctgctggtcctactgtatctggctggtcccgtcttacggtcggactgctttgcccccccccattgactaattttccgtgcgttttaaaaccgcacattggcaggagccgtatttcatctggcgcattctgtacgacatgactttctacgtggtgctgatcatcatcgtactcaatttgatcttcggcgtgatcattgacactttcggcgatttgcgtgccgagaaaaacgagagggaatttgtgctgcgaaacaattgtttcatctgcgga

SEQ ID NO: 8274 - DNA, 4571 bp, Heterodera glycines
ggttattttacaaaataatttttggaaggttagggaaaaaaaaataaaacccccaacaatggccttttgaaccctttttgaaagacgttattaattcaaattcttaataaaaaattttccggcttaaaaaaggaaaagggatgattaaattctaaagatgcaaaaagcaaaaaagcgtgcaattattttgggttttattaaatttacacagaaatttttaaatccaaaaaaagaatgttcaccgatccctaatgctgttgttgttgttattggcgacggcgaccttgccttgcgctatgccggaaccaaggcattttggacctgaaataataaaatattattctcagtaaaaaatagttgaattaaattaaaataagtataaatttaaaatgaattaaaataatttaaaaataattaaattaaatagaatttaataaggaagtcgcatagtaataaaattggcgaaaattggctcaatcccggggtgaaaatgacaaaatgatcgcattacactctattttattagccattttttgtacgtccaaatggtgaccttctccgttccgatcggtgatcagctgcttggggcgattgctttagcagcattgcctttcgctcccaccgcccctcgcaaaattagcgatcaaataaatgagcaaaatacaaaaaacctttatttgctagcaaagatcccccgtccaaaaaatcaccgaaaaatctattaaatgaatttggaaacaaattaaggaagattttttagcaattccgcccttctctgttgcgatcggtgatcagctgcttgggagcatagctttaacaacattgccgctctcacccctcccaaaatcgtcgatctaatcaatgagcgctcaaagaacatataatttttggtgaatagctgttagaaattaattacgattgcctaaaattcgcccatatcggcacgccggccctccaaaacctattttttcttaaaaaattcgcccaaaatccctaaatttggtcatttttagacaaaatctgtgtaatttatgccaaaggaattgaatcgaggcgaaacattgactaaaggaatgtggagccaacacacattcataaaaattaattttttgtgaattttttggaattaattcaaatcaaacccccgccccagcgggggcggaattttcgtgcccccgtctccgcgactctgacccccgcccccgtgaaaagccacccccgcccacggggtccgaaccctattttaaatgatcgttatatttatataagcctttaattccgtgaagctcgtcttggcaaattggtcgtagacaaaaaattattttgcattggaaatggcaccgacagacgatgctgcggtggaagaacagtagtggaaatatgggggaacatttgcggagtgtttgcgggagacgaaacgccaaaagacgcgctaattcgctgacgaattgcactaaattaaaaaagtattaattaaattatttccatttttgcgaataaaaaatgtataataaaaaagtagggacaattcttacgcgttgacggcaaaataaatgatgggattgaccgccccgttggcaatccacatgaaattcagcgcacattttgccatttttgtgtttggcaaaagccactgaaaatgaaaatcataaaataaaataataaataaaaaacaaaaaaaaggaattaaaagatcacttcagagttgtgccaaaaatagttgagaacggtgcaataaatggtgatgacaaacgcttggatgagcactttcacttcagcaactgtgccggtctggcgcaaaacgagcccattgatccgcttaagaaggaggaacttagcagggaaaggaagtgatcgaaactaatcagaagacggatgatcggtaatgattaaaattattcaagagggaaatgatcggctggattgaaatgaatttaaactgatcagaagaattgaagtgtctaaagataagggattgagaatacaaaagaaagaaagtgatctgaaggaacggcaagtgattggaagcattggaactgatcagaagacggaaagtgatcggtagattagaagacggaacatccatccgaaaagacagaaactgagcaaaatggaaagtgatcggaagggattgaaatagttggtcagaagaaagtaagtgatcggtaacgattaaaattgatgagaaaaggcaaatgatggcaagggattgaactgaatgatcggaagccgttgcaactgatagcagagggaaactgagagtgaaagggaatgaataaatccgagagaaaaagttgatcggtttaccaattaatttaaccaacatcctttaattaaaaataatttcggggataatggtgactaattaatgcattaagaaagtaatgctaattactctccttgatcaactttataattgggccaccttgtagagaattgtgaagaaaattgcggcgtaaatgaggccggccgtcggaatgccgcccaattcgatgatttcctccacaatttgcacccaatggctcagcggccgactgtcgtcgtaagcccacgaaaattggtcgggccaataggcaattgcggcccacggggaggaaagtgccaacgcaaaactaagcgagaccaaagccggcaacagaaaccacagctaaagccaatgggtaattaaatgattaaaaataatcaatacaaaaattttaaatataattacctttaaattgttttacctttatgcaaattggtgagaatagcaaattatccaaccgatcggacgtcaacacaaccaaacgattaattgccaaaataatagtcacaattgtgtaaaatacgtaactcggcgtggcaattgcgccaagcggctgaacaaagcgccaaaaaaatttttaaatttatttatttcttttaaacagcttttaaaatttgtttaaaaaattgcctggcaaatccctaaatggaaagtgtttggagaaattgtgaagaagccggtgacgaaatggacgcacgaaagggcacagtcggcgaagcaaagtgccaacataaacttgtagcagctcaaccggaacagctcattgtccacgatgattatcttgagaaattattttaaaaaataatttatataaattttatttaaggaaaatgcaaaaataaaattaattttataattcgaacccgaatgaccgccaaattgaccaccaaacacagtgctgaaagcacaagaatgcaaattccgaccataacaattattaattcgttcaaaaaaacttccgacaataagcttgacattggcacaaaattaaagtcaacaaaaagggtaatttaataaagcaaaattaaattaatttgctgaaagaacaaattgagttggaagtttagggttttctgtcgtaatgtttcgctaaaattggttaacttttgaaattcaaactaatttacatttcctttttgtgactaaaattttaacttatcgtgaattttaattttccttcccacattttcttgtctcattgactttgcgtgccgtgagaataattaattacacctttcaaatttcaatttgcgttattatgggtttttgctccccataaatgtttgagtaccccaaatagacaattgaaaaaaatgatttttattttttttggttcttcgggcagtccccatgaaccgatgcgcccagatttttggggagatcgaatccttcgggaaaccgccaaatggcaattatgtaaattcgtcattttgtcagaattaaacaaatgagacttggaacaaaaagttcaattttataaaaatgcaaatttttacaaaaagtgaaatgccaaaatgggttctccaaattgatcctccaattttcattcctccatcggccccagtgacgggtccattcccgaaaggagcatccgatcaaacaagtccgtgccgtcttcggcagtggtcgagttcggcacttccgtcgtggtggtcaaaagttcatcggaaagaaaaggataaatttgaaaattagaaaatcaaatgaataattaaattaattaagtgttgcattttacttgtttcctcttcggtcgaattgtttgctgcacttttgttctccgcttcttcttccgtcgcatcccttcggattcgctataattaattaaattttaaaaagcaaacgtttattcgataaaaatatttttaaatatttacattatttccatgggttaaatgcagcggaattagtccgatcagcagaagaagggacacaaaagaagacatagcaaaatgaaaataaatattaataatttaattttactgtttttatttggtatttcaaattttaaaaagattgatttgtttaaacaatttcctaaatttttgacctttggaaaagcatttttaaaattgaaggttcaaaatgcaaaaatcaaaaagtgaaaatgaatgaaatgggccaaaaagacactccaaaagcattcactgctcaaaatcactcaacataagctgcgagttgttttacacaaagaacgaaacgaacaaaacggaggcggaaaggttttgtttgcattattaggaaaagggaaaaaataatcatttaa

SEQ ID NO: 8275 - DNA, 1353 bp, Heterodera glycines
cagtttccaatttcattttttttctaaaccaaaaaaactcgttgttttaatgtattaatttttgtttgtacgcctttctcaaaagcttaaaaatatataatcatcttgccaaaaattaagttctaaccaatctgtacagttttttgtacagtatgccaataaaacattaaaaattatttttttcaacagatttactattaaaaatgtcctcttccccctcaatgccatcaccacacgaactgatcagacaattgatgccgatgagcaatgatctccaaaacagactccagcagcagaacggcacggccattgctcaaatgccgccgaacggattaaatgtttgtttgaataaaaattcgaaaaaacaaaattcaaaaatcaaaaaaaaatttagattttctccgcccctcaaaagccctttctgatgccgccgcctcttctgccgattggcccaatgcaaagtttggcacacctccaatttctcggccttttggccaaggcccaacttttggcacaatgccaaacggcggcacagcaaagcgtgccgggcataaataaggcaaaaataataaaaatcaatttaataaaaatgaaattaacgagctgaaacgcctatataatggaaatgtcatccttttatttttacagctgtgaaaacctaaattaaaatattgctgaaaaatattaaaataattttaataatagaaattgaaatttgctgaaaatatttaaaataatagtttaatcttttaaatcgggaaaaatttaaataatttcaccatccccatatccaatgcaaatttttgttaaaaatatttaatatctttttaaaaaattgggcaatttccaattgaaattattgccttcctattcagctgtgctcttcttctccttacttaccaccgtatatactctttttatatgccagtctccattaatctgccagcctccaattatatacccccttctgaggaggttgaaaaataatataccagtctccatttatctgccaggggggataaatagaattttttaaataatttttttggcacattttccaaaaaaaaaattaaactcaattcaacagtaaaagaaaatgacacatttttgccattttggggtcaattctcagaagttgtttaacagaaatgcaatagaaataatttttttttgacgcgatgacatttttggcgacatgttcaaaaaaatttcaaaaattttccactaaataaatcagctgaaaaataatctcccagtctccattaatctgccggcctccaattatctacccccttctgaggaggttgaaaaataatataccatggcatataaaaagagtatatacggtatata

SEQ ID NO: 8276 - DNA, 3393 bp, Heterodera glycines
tttcgatatttcattttgcagcccttcaagtgcaagtactgtaaccgtaccagcaagtggaaggccgacctgatccggcacgttgcgagtaagtgccgagatttgaatgtttgggaaatcaaatccatactcccgaattcgagactgatcacaagaaccaagtttcagcagagatcttatatttgaaatttgccaattatgaaaatgaatagcaaagggacccatttttggtccgaaaatttttggcttgaagaaccctgttggattacaaaagtttttgaaaataacatcctaggaatattattttagaagagaatgatcccaaattatcttaaaaaacaatgcgccactcttcggcgccaaaattgcggtgcccgatttagctatcctgctaaataccattttatcccaataatttgtttgattcaaaaagtgccaaaaaaaatttcaaaattttcagaaacccacggcattcgtgtggtgtccaagtacagtcggagcaaagcgttggagctggacaagcagcaacagaagcaattgttgatggtggaagaagcggtagaggaggaggaggaggacggcggaagagcttttgattcatcttcgtcatgctgtgacagtgaaacgccgacaaaggacgagaacaacaatcaaaataaggcaaaattttaaattttcaggggccttccgcaaaattttcaattttttaagagcctttccacccataaaaaataaatcaaacccaggcctaggcctttaaaatacaaatgttttttatgtaacgaaaatgtcgctaaaaatttcaattttcccgagcagcttccgccttttgccgccaggccacaaatgttttaatttaggctaatttctccgtttctctgccgggccactaattatttttaattagacttaattgttttttttgccgttgcttttccgttattccaattaaaaagcaggaaagttttatgtatcatttttgggcaagaattctgtttataaatctgaaaaatgcaatttttcattagacggcgccaaatttttgaaatattaaaaaatatatggatgagttggatcataccgtttttttaataatttaaaatccttttaagtctggcgatgcgtctactctgctgaactcgcaggagcgcaaggcacagcgactgttgtccagcatggcacgcaacaagcagctggtgcaacgccaacaacagaagcggcgaattgatgcgatagtggagagcggcgatgaactcgctggtgatcagcgaccggtgattgacaactcgcaacactctgccgaactcgctgatcttttgtcgctgaaacgagagactgaactcgctgatcacctgtcgctgggcttgcagcacaatgccgaactcgccgatcagctgtctctgaacagagaggcagaagtcgctgataagctgtcgctgggttcccactattctcctgcactcgctgatcaattgtcgctgggcccccagcacactgccgaactcgctaatcaaatgtcgctgaagagagaggcaaaagtcgctgatcagttgccgctgggtcctcagcacactgccgaactcgctgatcagccgctgtcgttcccgaactcgcacgcttctgctttcgctgctggctcagtcgctgaagcgtcgaaactggcacactcgctacatcagcaacagcagcagcgtttgcagttggacgcgtcacttgcactgcttcagcagctgctgaatattttgccgccggtggcaccgccgccgccgccacccaatggcacagaacagtcgcgggacggcaccgctgggagcatttttcggcctaaaatggcatgaaaaattgacgaatataaagatattgaacacccatatttgtctggcatttcttttttgtattgtcgcgatgcgacgaattttctgtccttttaacgtgacattgtagggccatgccgggatgaatgtttaaaaaattgaaaagatgaaaatttaaactaatttttaaaatttatggtttttaaatcgaaaaattgtcaaaaattttttattgggctgtaattttgccttaacaagtcggcatttatagagtttttttttcgggggagagaaaatcgtgccgggtttttaggctttgctaggcttaacaaattttcgcttgattaattaaaatttaataaacattttggccaaaatatattatgtaaaaaagacataaatttagctagattttaatttattcatgagaaaaatagctcaaaatgtgagcacttatgataaatatgcggtttaaatgatttttatgtttttaacagtgaaaccccgactaaaaaggttgctgagtttttttttgtcgagtttttgaaaaacccgaatttttgaaggggtttttgagaaagttgacaggttttttgccgaaatcatctgctgctggacttttgaatatgatctattacaatgtcatttagtgatcagaaatttgacctctgctttattttcatttcagtaaaactttatttatatataaaaaaactaatttggcttattgcgtttagaaaaatcaaattaattaattaaaggccgtctcatttaaaagatttactgaaatacttttggaatccaactagactttaggtaaatcggagatgctgtttccgaatctgccgtcagatttgtcatgggattgcaaaaatctctgattttgtcaaccttttatttttagttttttccataactttttttttactttaattatattgagttaaaattagcattaatttgattgatatcgctattctgcatcgaatgataccaaatacataattttatatgttttaaaaaattagtggtttactttttttatgggatgctaatgatttcacatttaaaaaaattgttattagaaaaagtctcatgaaaatgaattatttttatcattcttaatagccccaaaattgcaatttaaaaaaaaaatttgcgaaaaatccacattaaaaaattctaaataaattttaaataattctcaaaatttcagccatccgattgccttaattaatgcccttttaaataatctttttgctgcaatttgtcctttaaaagtcaaaatttcatttttctaaaagctttctctccagagaaaaataatccgttattttcttttataattattattgctgggatataataaaattagctgccaacaaaaagtgcactcacaatggcaatctgtttgtgcgttttttttgaaaaaaggaatttctggcattttgtcgcgccgtcaaaatcactcgtgcgcatttgaatggtttagtccacaattaaacacatgttttggtttgtgccattcccagaatgtaaagcacaattcggagatcattgttggcacattttcattact

SEQ ID NO: 8277 - DNA, 2414 bp, Heterodera glycines
  misc_feature (90)..(90): n is a, c, g, or t
agcagtagcgggcgaagatgacatcgaagtcggcgaaattcggagcatcgggtcggtgtttgggtttgatggggcagcttttttttacanaatttgacaggaacatttaaaaactatttaaatattaatattccatcctataacctcttcacattgaatgatttagtgactctgtgtccggtggcgcaatttctgtggattccaatttgtatgcgaaattttgggagcttcagaagttttttgcaaatccaaatttgctctttgaatacaatgcgttcaaagattttcataaggtatttaatttaaatgcaattgcataaatatttcggagcttttccatttgctatgtttagactttgtccgacgttttggccattttttcagccaataaattggagagagtgcagcaaaaacgaaacaattcaccaacggtccatcagataaaggcaagtttttggaggcacatatgcgcaaaaaagcaaagcaatttccaatttggagtgataaaccgattttgtcaaaaaagggcattttgaaaattcggagacaaatttgcgccgatagggctaaataagtcgtttcaaactgttttgttccgtgttaaaaaattatatttgggacaaatcgtccgaatttgcttcatgttttgaaagcgaggaacaaataatttgtttcacatttcgttcatctgattcattagcactttagtttttcatgacaaagaacgggaatggcttgtacatttttgcattttgatgtgataattaatgtgtttatggtgttcaatggctcgtccggtgccccaaaacaatgcaaaattcactgagtctcggaacgacttatattttgtatcgaaatgacgcttaatggaatgtgcacccataccgacagggactgtcagcaattcttggaaaatagttaatgaactgcgttaatagaaatcagttttttgtttccttttacagaattaattggaacttttgatccctttctttcatatattttgtctcagaaacactcaatttttaacttttttagacagaatttccgcagaatggtggcgatgtgcacgtaaaaatggaaattgacagcgaggagcaggcgggcgaacaactgcaatttttcgccaaatatttgacaagtcaaaaagtgagcggtgggagaatgccattcttttcactcgacgcattaggaaaattaaacctctgtctttttgagttttgaaattaggaaaacaatttctgtcttacaattaacatgaagctaatggctccgtctttgggcaactgtttgggtttttatgttgtttctttcagttgttccctttgcaattggccgactcgcagttccgtcgctattttttactccaatatttgatcattgccaattaccttctgctcaaagtcaaactgaaagagtgcgtgtttttaggcataatcaaaaaataaatattgtgaaagtataattttttcataattttgcatttttcaaattaagtacctcacaatttcagcactttcacgctcaccacgctccaggaagaagaggtgcgcgagctgaccgacaaatgttttgcacttttgcgtgagacccatcccaacgggtcgctgttcgccgatgcggtgaaggtacaccggttttcactaaaactatataattttgaaaaatttacaaattcaacatcgtaaaaaataagaaactgaaaaacgaaatagaacttcgtaaaaatttttgttgaaattttaacatgttgtcgattattaatattatcttattttttgagccgttgtatttttttaaatttcagaaagtgctcagccgtgaacgcctttggtccacctggaagaatgagggttgccctgatctgatcacgcccctgctgaacgcacaaaccatcgaaaaatacgcagcatttaaacggtaattggacttattgagcaaagaaaatagagactgaatgaaatgaaaatgcaaacaatttttgatacaaaaattaatttttttttaatagaaatattttatttattctttcaacattttttcaatttttttcatacttaatgaaaaaaatacattcattaaatttgaataaaaatcttcaaagaatttttaaatcaaaatcttactccttttttaaatttatcgcaccattctttgcctctgtttgcagaaaggcggtggcccaatgcgtcgctggccaattggaccttggcaacaaagaaatgacgcgcttgtggaacattcagccgaacaatttgctggcctgccggtcacagaagcgcaactgcacgcccgaccttgtccagtttctgagcgacgcgcttgacgagttggacccggaacagcaggtggacgagcagtaccaaagcgtcaacgacgagaagtaccagtggatgggcagccgctttttgctg

SEQ ID NO: 8278 - DNA, 1284 bp, Heterodera glycines
aaaaaattatatgacaaattataacgaaatagacctatcatctcaagattattttgaattctttaaatttattttttagcctcgattttgttcctagtttaatccatgttttacgatttgaagtttaagagctccaatgttcaagagtccaacagagtgccgaccgtggccaatgcttccgctgtttccacttcaactgcatctttcctcaagaagacaattaaactgactgcggaaaatttaccggttaacaattgatggacaaaatgaaattgagaaaaagaagaaaatatttttgtttttttcttgaaaatttatgcttttgaaaataattcaaaattagaatttgttttttaccaaaacttttctgacaacatttttcaaaatagcaaattctgagagtttttagtccaatcttttaaattagattttttaaaattaggttttgcgctttggtgcttttaggcgtttaaaaacttaaaagaaatgtatagtgttttaaaacttacctattttttatttgaaaaattttatttcccaatttctctttcagttattaaaagaacgcgcagagcaaattcaattggcaacaaagaaaattgaagaagcggcaaagaaaagcgaagaaacaacgaagaaaattgaagaaacaatgaagaaaattgaggattcagaggccgaacggaagagagagcacagcgccaacggagagaaaagtgagaagcgagagagcgaaacaaaaagcaaaaagagagaaagagaaaaagagagcgaaaacgaaaagccaaagaaaggcgaaaacgcgcggaagagagagtcgagaaagagagagttcaagaaaatccaaagttgaacacaaacaaacaaacacaccaatgtcatcgtaattgcattcattcctcaagtaaaatatgtatgtccacgcagttttcgtaccaaatgcatttttttgttgttgaagaggaattcaaaagggatacaccacaaaacgtcggcgcaaaaaaatagattaaaaaactcaaaaattcgaaaaaattttttaaattgttttatggttttttgaaaacctagatgttaactgggaacaaaattggtaatccttcggaattgggggccccggcggaaaaaagaaaaaaaaattttcttttaactttttctagggtagaaaaatggcactggattacgaatccggctcggattttgcaaaatcattgattttatctatgatttttcatcaagtacttaatttttttttaattttttcgttttctaaaattttgcttt

SEQ ID NO: 8279 - DNA, 2628 bp, Heterodera glycines
  misc_feature (2512)..(2512): n is a, c, g, or t
attttgcaaaatcattgattttgtctgtgatttttcatcaggtacttgatttttttttgaaaattgtttttttctatattttttctttatttctttttaaataaaagtttgccacaccgttttgtctcggcggcgtttcagcagagacgttttgtcctgctcccttccaaactaacaaatgagtgccatcccctccgggaaaaataaagagaaaaaattgacaaattccagaaaatggccccaaaatttgctaccgcctgactccaaattgcttgggttttttaattaacccagaaccctaaaaatgctctttttttgagttaataaattccactcaaatttttaaaaatttctctgcttcgcctttcggtgccgcccgactccttctttccaagaaactgtgcttcatttaggaccaactaattatttggttgtttttacaaatcagtggcaaaacgtggagtgtgtccatgtgattttgtaatgcctcattaagtgacttaccccaatcaattatcgaccacttagcttttcgtagtgagttgggttggttttgataaaaattttcatttattcggtggcattggctataattgcatgaaattgtgccatttcttagggctgattttttccttaactaaattgttccctttccttaattctaattacaatcaattaagacatttggtttattaagctcattattatgcatctttttttggcattttctcctttctttttgccgctgctcggccaaaattgggtccacagtaatgagaacgaattgacgctgaaaataatgccaagtctgttggcagacgagaacgatacccatctttattatgtcagagcatactgtatgaaccgaggcaaaagattccacgccaactacggtacatttgtcgtgaatcggtcagcagcagccaatgaggacaaagtgaccattagctttgaacagaaagaaccctgtgactattatgccgcggaagttctgctgatgcggtccgggagtctctacggaatgggatgggtaaggaaaagggaaagaaaacgcaaaaattgaaaaattataccgaaaaaatattttgcagttacaaaattatgagattggacaccttgaaaacaatgggatgaaccatcggattctgttcggcaattatttccatctgaccattgggcccactttgaccactgaaaaccttttctatcacatccgagtgttttgcgatgcgaaggaaacgccaacaaaaaggaccaaaactgacggtgacggattaataattttggggttttccagaaacgatttgcccaaagaagccgagaaattctcgggtcaagtcagcaaccgaggcatttgcgcactatttttgattattttttgttttgtaatttagaaaacggtgtaacctccgatactttggaatttcctgaaaggccgtgccaatacaacgaataccatttcaaaacgttcaccaaatcctcaacaatggttgtgttcggcagtgagttgcggctgtgcaacacttatcacgtcaaagtgtgggcaacgccaacggaatggaaattgaaatatgtacgaacatacagtacagtaatgggctgacaaaacaagcagactgtgctttcaacaattgttactcaaaaaattatcaaaatttaacaaaaagttttcctaattttgttccaaaacaatcaaataacaaaaatgccaggctctaaccgatggggcggggcgaggacaatttcccattcgcccgaaaaaatgttaaaaatgggaaaatttctaaaaaaaaaccatcgcattcttgccaaattaatgcaaaggttcgaattgcggctagtgccgatcagtcctcccccgggcgagtgccgatcagtcctcccccgggcgagtgccgatcagtcctcccccgggcgagtgccgatcagtcctcccccgggcgagtgccgatcagtcctccccgggcgagtgccgatcagtcctcccccgggcgagtgccgatcagtcctcccccgggcgagtgccgatcaattccccacctcgggcgagagctgactccccaggcgaatgccgatcagtctcccaccccaccccctcgttttctttcaaatgccctctcttcagcccgacgagcgtccaatggtccatttcgtgtgcagctcctacgggaatggtgaaaagcgggaaattgtgttcaagagaaattttcacctacaaattacgcccgcccttggcgaaggggaggaggaaaatgtttattatgccgaagttgaatgcaatgggaacaagtaccaaacattcagaacattcacaaagtccaaaacggacgtggtgctgcacgtttccgactgcaaaagttacgacttttcggtgcgcaaagtgccgaaagcgttgtttaaaccacaggacaacatgagaaaagtgcgttttcaattaattctatcggaaattgcagtataaaatttgaccaatgcacactactctctgttaatgcttagagaaaggaacaanatttacaacttttggaccaggaatggtcccggattgatgataatttaaatcacaaaccgatcattgatgattagctggtaaagctcgcgatggcttctggactagtcagctgatgg

SEQ ID NO: 8280 - DNA, 2344 bp, Heterodera glycines
aattgacgccgattatgctcttttcgttgccggacataatccaccgccaaagtgcaagaaatatcgcgaggcagatgaaagaattttgagactgacacaaaattttaacccactaaacattatggaatttttggtcggtgtttctcggaattatcagatggatgcttagaattttagtgataaatgtttgggtgataatattatacaataatggtggaaaaattactgtcccttggggcccagttggcggggcccagttaatccggggcccagttggttggggcccagttggcggggcccagtcggcggggcccagatggcggggcccagtcgtgcccgtccgataaattttcctattgaatatcaaaagaaaatatccgttttgcccctcctaattttgtttcctttgaattatgggcctaaaccgatcaactttcagacgcggagaaagtcattttgcgggaggaggcggtcgggccgaatgtcgtcgactgtttgcgcacaatcggcgaactgcgaaattcgctgcagaaagagacacagctcagaatggtccgctttcttaaatccaaacggggaatattctgtttacaaatgagactcactgttcttttttcgacttttcccgtttcttttgttttttatcactctctccccccattttaggtttatgagaaggaaatggccgagttgcgctgccaattgcgtctttccccgccctcctccgccctcgtcgctcttccgccctttccttcgcctcgtccttgctacgacttcgccccaatttcttcgtcttctccgacttccgcggtggccaacggaagggaaggccttctgattgagttggtgcgtcagcgagaacaacagcaacaactctttcgtcccaccgcggtgctgccttccgaagttcagcttttgacctcggcaattaattcgttgtctaatgggtcgccccagggattggcactgcaaatgcagcagcaacaacagcaacaggacaacaacggcacaatgactgtgccaacgaatggaattggacaagacgcgcaacaacagcaaatgggccaacagctgaccacggctttcgacatgagagagcctcttgcggtggtgcagcaacggacgatgggaagcagcgaagaggcgaacgcaatgccaacggcggaaggggcggcggtggacagcgattgtgcaacgccggcgaccatttcacagcaaaacttgcaggttctcttcgtcgacatattgaattgcaattcttttatctgcaaactttgcatttgtttaggcactcgttttggcaattcgccatttggagggttccgccgccgccgtttcgtctcccctccaaagtgtccgtcctccgtccgccctttcttccgcggattctaacctcgcgttattccagtgaaacactcctcttttccttgtttttgttgtttgttttctcatttcgttgttaattgttaaattttttgttttgttgttttcctcccattcctttcggcatgggtttccataggttaggccttagtttttagatgttttttccccatttttgcgctttggcatggcggacagatcacaccgtaactttaacccttcacactttttgttatcgggttttcgtttcgattttaaatgggctctttttggaacattgaattgaaatttctaactcgagaatgaatgaatactttttcacttcctttccaatttttttgcaattattgccatttccatttcccttttttgttatcgctgttatttttgttgactcttttgttaagctggttaaatcctcattatttccaagttttatttaacaatcgctgccaaatttcgtatttcctctgagaaagtcactcgattgtctgtgttttctctatcgttgcggaacaaattgttttgaaagaaagttttcaccgctcaataataaattaattgttgcttttttcaatgggaatgtattgtgttttacatttgtgagtgattgagtgtcaaaaaggtcatttgtttttgttggcttacggtatgtgtccctccattagttaaatttatttggcctattaatagtttttgttgccttctttctctcgtttgtcttctcctcttttattccacccattcgtcaaattccgatctcttcggcttttctccgtcgtccgttccgttttcgttcttctgaagagatttggtgggtacatcaccctctgaaaatgtcttcccacccccccctcccttttgggtcctttttttactggtgaataaagtgaaccccatctgctggcgctaaatggtggggtggtgacaacccccccccccccggggggggtgggggggg

SEQ ID NO: 8281 - DNA, 1124 bp, Heterodera glycines
cataattggacaaaatgcgacgaatttttttttggttttgtgtatgctgaaatggcttaagcaaattcatatatatcgtttatgaagatcgactttgacaatcaacatgaatggtatgaaattttcaaaagaatctctaagagtaagtggatcaaattaaaattttaatagcgacacttgcgccctgaaatgtacgccgcgaataattaatggcgcttcgacactagctccgctcagtcaaaaaatatatataccaatttctcacggaatccaaagaaatattaagccacattaatatatgtagattgtggcttaaaataaaatattttcacttggtttgaggcttccacgttcacttttattatgccttctttattttttgcctttttcgggattgtcgtcacttaaatgcctttgtcctcagcacctcccttctgggtccttgttttactgtattgaaatttccctgggggttcgtaccccgctttacccccccccccctcccttgcccattctcggcttgtctcgcctgttcctgctcaaattgccacgcttcgtagtcgcgcagtgccatttgaacgtacgaagtgacctttttttgttagcattttctttggccaatcgttaacccccccccctcttcattcacataatgctgttcctccgttctgacgtatttttgaagcatttccaacgccaattcgcgaaattcgaccaaattaagcgcctcacattcgccgattagtctaaaagcgaaattaagcccaaaatcacggggccattcgttcacttggccaaatcgtctggctttgctggaagtgctgtggaaggagctgataattaatatgccatatgataagaaggaatggacccaaagaggcggcgcatcgctcctttttcaggcggagataaccaatgatatgacggaacattttggggtctctgtccaaaaaaagattcccccctttgtcggtaggaattgcttaacagaaaggaaaattagcatatcaattaacacttgatttgccaaataacgcaaaacccacgcgggcgattagtgcccgggcgaaaccaatcagccaatttgctgcgcggatccgccagcaaatcggtgcgacggacct

SEQ ID NO: 8282 - DNA, 950 bp, Heterodera glycines
ctgctgcgcatcactcaaatgacaggacgaatggtaagctaacaaagccaaacaaggagttacgacgatgaggaaatttgttaagcaaaatgaacgcggaaattcggaaaatggcgaaaggatttggcaaagggggcaattaaagggaagggacgacggagttggcatttgacaatggaaacattggcgaattaaaaactcaaaaggcaattcgaaaagcacaaataaacacattaaatgctaatattacacaagtgaatgaaaagggttggccattttatgataaagaaataaatattatgaattagacaccgtgtttcacagaattcgctgattgatcatctcaaattctcccattttctcctttaaaagtgttcgttctcttctcgccgcttcgtccgtccgtttgccgtttcaatttccctttggcgactgattagcgtcggttcgtacccaaattggccatttctgtgttccaaattgtctccaatggctccgttttgatcctctgtctacctgctggcgccacttccgtcgtctgtttgtctttgccctccgccgcccctccgccgactttcgccgctcgtcgccctccgcgcgctcccctcgcgtcggttcgcttcttccatttgcttccggcggtccttccgttcccaccactccaattgctcttcagcctcctcctcctcctctctgtgtctttgctgatgcctcgccgccgttccgtttgtttcataataattcgccgatgggtccgtttgccgtcggggcgctataaaaggcgaaagtcggccaaatgttcattcatttgcccattcgttttgcattttctgaccttttcccctctgctggtcatttctctctttctcttctcgcaatgcttcttccgttgccttttgcgctgctaggaaatggcaatttttaattctgccaaatagtgccttttcgcg

SEQ ID NO: 8283 - DNA, 764 bp, Heterodera glycines
cccctctctgtgctttaactttccaacctcaaacacttcaaaaatggagccaattccgccgctgttaatgtcggccaatttgcgataggacacgacactgcacgcactttggacgagcggaggactgtacatcacctgaaacaaacataagcaacattcaaatcccttcttcatggcacatgccatgctgactactgacctggtaccattgtcccataaatgcgtccaaattgaactcggccaccgccacgggctttgggctgcacaacggactggacggctgcacaatcaaattttggatcatctccaaattctccccgatcgcctcctgttgagcggcggtcagagtgattggggtggaagtgttcaggtcggggaacaaagcggccaaaacaggcggcaaagagacggacggaggaaagggaaggccgagggccgaagtggcgttgagggggtcggcagaagcagaagcattggcagaggcggaggagggcagcacggagccggaggtcagagttttatacagaacctggcaaaatgacatggcattggcaaatgagtgagtgaaaagtcggcacattgttgatgaattgtttgccgggcagtggcgaattgctaccgcccaacaaattgccaaccgcccttccgattccaccagcgtcgggtgtcggtttgccgtccttgttgaagccgaacagatccaaaaccgttcctatcagtcccccaggggctggtgagtcatccgacagcccaccgtactgaaa

SEQ ID NO: 8284 - DNA, 5809 bp, Heterodera glycines
  misc_feature (5672)..(5672): n is a, c, g, or t
ctagagcccgatgcaggaccggatcctgcgcaggattttgcaggatcccagtccgcaatcctgtattttttgggaaaaacaggatttgcaggattaatccggccggatctggtcctgcaaacatttttgaattccaatcctgcaacaggatccgcaaatttgaatttttgtgcaggattatgcgggattttattgattttttaaaaaaatttctaagacagaatgccaaatgtacagaaactttgttatttttataatatacatatggattaggtatgaggacgcgcttgttcattctattcctgatgtcaatttttcatattaagtttcaccagtttttgtctaaaatatatcggaacacttatttatcgttttggaaattttttaaatttaattgaaattttttcaaaatttccaaaaatccacaatcttaaatgcaggatttgcaggattaatccggccggatccggtcctgcaaaaaattttgaattccaatcctgcaacaggatccgcaaatttgaaatttccgggctctattaaaaacctcaaaatacagttacagcatgcatgggactcgaacctgagaccccccccccttttggtgactaactcacagaccactaagacgaaaaatccagcataattgtacttggagcccaaaattgggccgctatgtaatggatgaaagcggatcaacagcaggagcagatgatcaaaacgcgtcatcacaaatcattaaaattggtgataattagggctgtgaattttaggttttaactaaattttttgctcgattgatttgaagaaaggagctcaaaaaacgcatttctgcattaaaaattttcgattctgatgtcactatcggtcactagaaatcactattttggctacttcgtcactaaaatatttaaaaatcactattttggcgttttgtcactattttttcactatttcgacattttttggaaaattccttaacaaaaatgcaataaacccaaaaaatacacccctaagaatcgagctaaaatttttcaaaatatactcctatgaaatgaaaaaaaattttctcaaaaatttactttcttggcaaaaatttttaatttaaaaaatttttttaggtaactattttgggttttttggtcttaaaaatcccagtcctactcatttgcaactgcaatcagtgaataaaaattatttttgctcaatttttggctgaaaattatgtcactattcgtcactatttcggaatgtttgccactattttgtcactattttaacatttttaccaactattttagttaactatttcgggattttttgtcactaaaattcacagccctaataataacccatttaattggctcggtttttatgggtttaataagtacgaatgataaaataaatttatctttaatttttatgttatttaaaccaaaacaatttaaaatccttttattcgcactttaaaattgattaaacattttaaaagcaaattactgtatttaactttagtatttttgaattagcaattttgcacaattctgttaacatttcccactaaaattttcaaaatttttctccgtcggacttcattgatttgtgatatatgtgttaaatatattgatatcaagaatcttaataatcgtaaagttaaaaaatttttgctcattcattactgtgtttgataaattttagctcattttcagaattttggcctttagacttgttgttccaattcaattcgggtatttcaatttgtcgaaatggatgtcgtaatctgcaccctgaaaaccccagacaaaattctgacaatacaaaaatgatgataaatggatagtgaatataggatttagcaattttcgccattatggaatcaaattctgcaaaaaatacaaatattgggtctggtctgtgccaagtgaccccgacggggtaatagtcaagtcggcaaaattaatgcagcattgttgtgcgaaagagcggacgtaatttgaacaaattaatcaattcatcaattaatcatggataattaatttccaaacaattaattattttaattattatttttcctcatttttttaagattcccgtcaaagtgtccgccctgaggaatcaagtctacaaggtgcagcagaacaaaaagatatcaccgaaacggggtaattaatttattttagggcatttacacgccattgatgggtggcacttatcaattgattgtccaaattgactccaaaaatgtgccgggttcaccgagcagggtgattctcacattttatcttaaattatttctattattccaagtccattcccatcaattacctgctgaattaatctctgtcgacgcgaaaccgctcaaatttggcgtgataaatgaggatattaggtgaaattgagaagaaattagttaaatcatttttaaatatttattttaattcgtttaatagaactataatcgacgcacgaaaggccactgctggacatttgtcggcacaatgttcaggaccgacacggcccgaatattgcgaattgatggacaacagagacggaacggtaatcaactcggacatcttttatttaattgaaattttatattttattaaatttttttagattttttaatttattcaactgaatgttaaaagtggaattaattgatttgaaattcatttattaattattaaaagtttataaattttctatgtttcacgttttatttaagaaatttttgaccatattttcccagtttttttattagaattaatttttaacggtttttttttacaaaagaataaactttttataattggcagtctgaatttctattaagctcaatatttattaatagggctgccaaaagtatgcaaatgcatatttttttcctggcttctccatgctctaaatagtacgaaaaacactttcttttttgtgtttgcgtataaaaatcgggacttttatttgcatatttttgcatattttgggcctttatgcatattttgcatattttggcttgttttacattttcatgcatattttgccattttttgtgcatattttcgattttttgcatattttgccacttttcttcaaatattttccgattttttgcttattttgccatttttcgtaaaatattttccgttttgaatttttttaattttaatatcaaagaaaatttagcatgatcaacttactttaaacaatattttattcttttctaataaaacaaaaaagaaattcttaaaactttttcataagctgacgctgctcgagctacaattgtgagatgccgaacaacaagaaattaaactgtaatattcaaagaaaattaggaagaaattaaattttaattcaatatttaaataaataaaataaataaaaatttattaattatatatattattaaattcttttgagacaaaaaattttaagtgaaattaaaaagcaaaaggtcgcctctgtggttttacattccatggagaaaaaaaactatgagacagcagaaaatatgaaaatgtatttaaatcaagcttatttagcaaagccaattattttaaaacaaaaaattattattatattaaagaaaaaacaaaagattaaaataaatattatataatcaaacaaattcagcgactgaaaacaacagttaaacgtgcagggcagggttgttccgggtcgagaaaaatatcgggtcgggtttcgggtcgggtcggccgaaaaatcatcgggtcgggtttcgggtttcgggtcgagaaaaaggccgggtttcgggtttcgggtttcgggtcaattgacaaatttttaatttgtttaaaaatcaaatggcactgcaatatttgcagcgaattgcgccatttataggacgatggaaataaaaccaaatggaatcaggtttttcagccatttgctttgcttaaattcaagaaattcatacaaaatatctttagaaaaaggataataatgaatagggatgtcaaaaatatgtacaaaaattggtcaaaatatgtacctaaatatgtaaaaaaaatccccaaatatgtaagaaatatgtataaaaacccaaaatatgtacgaaaatatgtaaataaaatttttttaaatggttattttttgggaaaaaaccttcgtaaagtgttaaataggcgtaaaatggcataaaaatgacctaaatatgtttagaatcaccttttaacatttaaaaaattatttttggaggggtacatttaaaaaaagtttttttttaattttttcactagaaatttctaaaaattttcaaaaattctcaaaatatgtataaaaaaataaaaaatttgccaaaattttggattttttttttgaggatttccaaaaatttccgtaaaaaacccgcaaaatatgtaaaaaaatcaaaatatgtaagaaaaagtccaaaatatgtaccaaatatgtataaaatcccgaaatatgtaaaatatgtataaaacccagaaatatgtaaaaatatgtaaataaaagtcccgatttttgtttgcaaacacaaaaaagaaagtgtttttcctgctatttagagcaagaagccaggaaaaaaatatgtatttacataaaattgacatccctagtgattgaatttcttcagggaatatcccacaattatgagattaacccatgatttgttatttatgttttacaattaataaaattttcagtttaaggtttttttgaaaattttttgccaaattttctggcactgaattgtcggcttttcaacgtacactgaatcgtcggcactgaatcgtcggcactgaatcgtcttcacactgaatcgtcgtcactgaatcgtcggcactgaatcgtcggcactgaatcgtcggcactgaatcgaggggcaccgaatcgttttggcgccgacgttttggcgccgacgttttggcgccagggtcgttttggcgccgacgttttggcgccaagccataataaaaaaaagaaaaacacccaaattaaaaattttgtaaaacaacaaaaaaaaacgtatttttcgcgaaggtaatactgccgatggttggttgccccccttttttgaagaaaatttttttgttttcaaaagtcacgaaaacatgcttccaatggttttcagggtcgctgctgacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgttttgacgccatgtagggggggggggggttagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaatgagtggttgtaaaaaacttttgggtaatgaattattttttgaaatgagtaaaacaccctattagtgatttgctgtgccgagaaccggcaggcaatggatggctttcaatctgcaagaaattagatgggcaatatgtggttgtaaaaaacttttggttatggaattattttttgaagtgagtcaaacaccctattagtgctttgctgtgccgagaaccggcaggcaatggatagctttanatctgcaagagattagattggcaatatgtggttgtaaaaacttttgggtatggaattattttttgaagtgagtcaaacaccctattagtgctttgctgtgccgagaaccggcaggcaatggatagctttaaatctgc

SEQ ID NO: 8285 - DNA, 1681 bp, Heterodera glycines
  misc_feature (1576)..(1576): n is a, c, g, or t
  misc_feature (1653)..(1653): n is a, c, g, or t
aaaaaaaatatattattttttcagttcattcagagagtatgtactaaaagttccgaagttaaggcttgtgctgcttagagaaaattatacccaaagtaccatatcatactgtcgtgcacatataaaaattcttgaaattttcatgaccttgaaaaaatatatattatttctcagctcattcagagagtatgtactaaaagttccgaagttaagctagtgctgcttagaggaaattatacccaaagtaccatatcatactgtcgggcccatataaaaattcttgaatttttcatgaccttgaaaaaatatatattatttctcagctcattcagagagtatttactaaaagttccgaagttaagcttgtgctgcttagaggaaattatacccaaagtaccatatcatactgtcgtgcacatataaaaattcttgaaattttcatgaccttgaaaaaatatatattatttctcagctcattcagagagtatgtactaaaagttccgaagttaagctagtgctgcttagaggaaattatacccaaagtaccatatcatactgtcgggcccatataaaaattcttgaaattttcatgaccttgaaaaaatatatattatttctcagctcattcagagagtatgtactaaaagttccgaagttaagcttgtgctgcttagaggaaattatacccaaattaccatatcatacactcgtgcccatataaaaattcttgaaattttcatgaccttgaaaaaatatatattatttctcagctcattcagagagtatgtactaaaagttccgaagttaagctagtgctgcttagaggaaattatacccaaagtaccatatcatacactcgtgcccatataaaaattcttgaaattttcatgaccttgaaataatatatattatttctcagctcattcagagagtatgtactaaatgttccgaagttaagcttgtgctgcttaaaggaaattatacccaaagtaccatatcatactgtcgtgcacatcaggggtgtgacttgtctcagaaaagacgagagcgagagtttggcgagaggcgagagtccccaaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacgttggggggtcggggcgggtgccggtaggcgccgccgaaaaaattttgaaaattgtcttncggatttgttcacagattttattcaaaaaatgaccaaaacttgttttttacattttttgtttttaagtcgctttttnttgtggcgctgtttttccaaaataaatt

SEQ ID NO: 8286 - DNA, 928 bp, Heterodera glycines
ctcggcaaaaaccaaaaataaataaaacaacgaaaaatgtctttattaatgaaaattaaattaagaccaaaatgtccaaaagagaacataaataaatgtgtgtatatatgcatatgtaagtttaagtgagagttagcgtagtaatggccgcgtagagttttcttttatttcttgctccttttgttcgttttgggttcgctgcctaaaataggataattaaaggaatttccactcaaggcatatcattaaataaaaagacgaagtgcctggtgaagtttcgtctttttgtccctcctctccgcgactcttctgaccctgaacagaagcggaagcattcggcggagtgccagtcgagaaaaattgctaaaaataaattttcttcaaaactaggtggcggttttcccggtttttactgccactttgactaacaattaaacattctgaactgtgactgctcagattgagaaacatataaaatattacaacagtaagtccttacaaaattttctctactagaaaggtcaaatttttggcacaataattttgtgcaatttgagtcattttttagtggttccgccagagaaaatgcaaatttgatcatatgcacctaaaactaaagaagttttcaggcctaaaagagaccccgtattaaaaaaaatgattcaaatgcacttttttatttaaatcatttgcaaataaaacctcctgtgacggtggaaacggtgaattgtcagcagacggagggggacacagtgaaagtccggcgcgtccgaaaatacgtttctgaaaaaattgcatttacaatttgaaacggtaaacttagaaataattaaacggctgagaaaaaatcagtagcagtcaaaataggctttttttttaaaatatattaagttattttaacgacaaaaatgcccacaagacctgcagg

SEQ ID NO: 8287 - DNA, 3646 bp, Heterodera glycines
tatgagagatttaccactaaaaacaatacctgtcgcgatggcacaatcggttttgcttcggtggcggaatgggagccaaagatgacgaagtcgactggagaccagccgcatttttcttaaacaacttttgtctcccagaaacataacccaaattattaccgttggtccaacgcaagcgacagtttgataaggatcttcctaaaacaattcttgttacgacaaaaaaaagaatacattaaaaaacctctgatgttgactcgggaacggctccgaaataaagacccggctaaaaagtattttttaaaaagcatggaaagggaaacaagcaaaccgattcgataaactcgcaaagttcttcaatcagaagcattgtagccggaaaaagttcggcttggactacaagtgccaaccacgcacgtgtttgtttaacacggaggtaaagctcgcggagattggaaagcaacaaattcaacatctaaaccgtgtgtttaaagtcatttaccactcatttcttgttgcttttcaaacacttacacttccgtcgatggaatcataaaaaccttcctgaattttttaatcgtttagaaaaatggtaataatttggaaaacggtcaaattcatgcctctttaaacagttcggcgaacgtgttaagaaaatcagtgcaaacactgtctgtttttgccaccgtggcaaaattggtccaggggagatcgtctttggccaatttgtgctttttaatcacctcggaacggcgctgaaaaaacgtaaaaagtgcattaattggtcaaattcccgttttgtttgcgtttgtgcattacataacatactaatttcaataattctttccatcttttgatacggggcatcaaaaattccaagagtagccaggaagaagtcagaattttagaaaaatgttggttaggatatacgtaaaaagccatttcgtccaaaagttcaggcggcaagtatttcatattagccatttgtttttataggagttagggatacttttccgggtttcggtgagggggcagttttgatggaatcgactttaggatgtgtcacaaatttaaattatttagggatacctatttgttcattttgatattaaacataatgccaacatttatgaaaattactcaagtgctttttaaattaaattccaaattacttggtcggctgacatgaagttagggttcggagaataaaattatgttattgttaataaatatatacctaaaatagttttgtcagttaaatatatgtatattttggtaaataaatttggcgaacaatacaatgaatgaaaccatgcttaactagttaaagcttgctcttgctgggggaggggggggggggtttgggatgatttgacaacatatttttgaccaatcctatctaataaatatggcagatatttgttagtacgcatatctgttacacttatcattaacattttcttgcaaatgtgctgttgtctgaccaacaaataattaaaacaaaaaatgagagaggaaaaggtgaacgaacggtcactaatccctcccttcaaaaaatgacaacaaatgaatgatttgaaaatgtgggggggggggagagggggcggagtcttatttttgtcaacttgggcaccgaccattttctttcccaattttgtttcatgtgtttatcgctcccacgtaaaacagagtgagtcgaggcagtacgattgggtttttacggagtcaattgcgtctgccaaatttttttatgagccatattatttttcttcattttccaaatccaaaacggcatctataaacctcggggattgcagtatggatctggaaagtcatatttgcgttcatttttgtctgagtgcgaatttttgaaaaaagcgcgctgcaaattggaaatcggcattccgacggctgctcaaaaaaataatcaattggaaaaccgaatcagaacgcataaatgtcggaaatcaattattgattgcttcgtttgttgagcaatgttggaactgcgctgctacaatttgacgacaccagcgttgaaccggcagttgcattcactttctcaccatttctctttgcggttttgtgccattgcctgaggatccggcactgtgtaaagctcaattacggaaaatcgttaattgttttgcgtccatcacaagaatatccggggttttctaccaaacggtttacctcagttgggccggcacggttgggcccccaataattcaaaaaatcttcatttcaaaaaaaaatgctttattgtaccaacaacttttgacaatatcaatattaaaataaaaaatacaaaagctcatcaaggattcatctggtatttcgggaaatacctttcaaatactcaatgatacagtgatgtcggttaactttattgtgatcattgttgttgggaatgtcgacgtaatagttctggaccattgcaagaattcgggcatcagcattacggtattttttctttttggaagagctcaattccttagacaaatatgtgcaagcggcatccgtagccttaaatgggatgttagggttaaataagcaatgaattttgagcgcgccgcaaaaagtgtttttaaaacaaaaaaagtagagacgagaataatctatttctgtatgttttgttggagattgatgtgttttttgacattggacggttcaatcccaaagccatgttaccacttcagtcccgggtctgtaaatcttcagggattggttgccgccgtctaaaaattgcaccattcgattttctcatcgagacgaatcgaatggtatataatttatatgcaaaatcaaaatggtagtattcttcaattttacctccatttcaactaattcggtccacggacccgaattcgaacaaaaagtcgaaaattcaaattttcgatttttgatctaaaaaaggttcaaatgtttcttttattgaagcaatgatcaatttagttcgtttccgtgtatttaaacaagttattttcaattatttggcgttttgcccaaaatttgggtaccaaaaatgcaataaaaatgaaaaatacatccctaagaaatgattttctcaaaaattcatctgcaaatttatttattttttttgacaagaatttgagactttaaaaattatttatctcaatactgatttcacttaattttattacctttttggtaaaattttacgattttacacccttaaattcggagctttttagcagctatttttggggttttttagaaggtaacaactaattatttaggcagtttttattattggttgtagaaagtttaggtcaaaatttctgaagagcaaagttattttatgtcatgaaaaagtttttgttaaaaattttttagattttaatttcttaatcccatacgatagttatacaagcctgcaccgcggtattgcgcctcactttgtcagtgcttcagcggcatgttcaagaaaatgactccaacgtgatttgaaaagtcgaactttttttattttagttttctttccagtttcattccggcagacacttggttggcagtgttggaattgtttacgccggctcaaaacggactcgaaatagcacggattagtccccgctttgaatgccgtatggatgagcatttcaagagtaggaaatggatcagaaat

SEQ ID NO: 8288 - DNA, 4378 bp, Heterodera glycines
  misc_feature (892)..(892): n is a, c, g, or t
atatgaaattaatttcactatttcaaattattttcatgtatgggcaggcgaattctgtgaacaccgttctctcagctgttttcttcccccaaatccctgcttaaacggtgggacttgtgcttgggaggtcaaaaagtaaaaccatgctagtcattagcttgattaattgcccttcattgcctttgtcccttttctgttcgtccgctttgtccaccgtttgtctgtgtcccattggttttgatggcccccgttgtgagaaagccgcccatgctgaacaattggagcaatgcgatcgggaacatcggtgtggccaaaatgggaaatgccaattggacagtgccattggcgcattgtattgccaatgcaaccgtggtaaggggaaacagtatttcaaaatgtcaaatcaaaatgccaaagacagacacaaacgtaagccaagagtcgatgaaaagcatcatttgctcttgcaattaatattttgtacactaccatatgcatcatttttaggctattttggggagttttgtgaggccaaattgaacccgtgcagttctgctttaccaaccgcaccgatttgcaaaaacggcggaatttgtcaagaaattggacccgaaaaagcgtaaacaaaataatttaatttaactttaaaaattgtttatatattgtatttttatttattttataattaacgcaaattaaggatttgccagtgtccagaaggttggacaggcgatcaatgtgataaagcagaggacagttgtgcagggaaggaatgtgtgaacgggggaaaatgcattggcacccatcacggcactgcctactgtaactgccccgacggatacggtggagaaaattgtcaggtaatcagaatgacaataattaattaattcanatttaaactgagcatagattgagcagaatatatgtactaagtggacagaaggcgacgagggaatatgcgggaatggacaatgccaagccaaaggcaaagggcacaccgccaaattcgaatgtttgtgcagagacggatggacaggtgaagaagcacaagggcagccgaatgatggaaaaaagaaagaacaattggcatttttcagggccaaattgcaatgtgccaaccgatgaatgccaaaaatggaaaaagtgcctaaacaatggcaaatgcatcacactgattgatggggatgagttgccgcgaaaaagggtgtgtttatgccctgacggattttgggtaatttaaatccaaaataatattcataaataattctgtttcaattagggtgatcattgtgagaatattgtcaactattgtgaactggagggaatttgtgtgaacaagggcacttgcgaatccgtcgggccaaattatcagtgccattgtgacaagaaaagtgccaagttttatggtttcttttctctcttaatggaaaaaggctttcatataatatttgatttttacctttttttggtcgaaattgtgaacaaattgtgaaaccgtgtgaacccaacccatgcgcaaatggcggaaaatgttcgccaaattacgacgacgacaaaatgggcttcgaatgcgaatgcggcccaaattatgcaccggagacaaattgcactcgaaaattggtaattaaaaaggaaaacaaacagcgaataaatgggatcaattgtaattagacattgaaaaattaattggcaattgacagagtccgtgcgaacaatggccaaattattgcaatggcggaacgtgccaaattttgccaaactcttccgattcgccgcattgcctttgcccagccgattcaatgggaattcgttgcgaaacacgtaaaatatttaagctttccaatttactaatatatgattttttgccaggaaagtccacccattacgatttgcatttttacccatttttaaattcgtcgtccatttttcaaacaattcgttcgcccacttttccgtgtttcgcgctcattaaaaagccattttcgctctgtttttggctccgatttggtctaatggacggacaaacaaatgaagtgaaataataaaatactttaatccatttttgtataattattttataattgtttttgatttttccgcagttttccccggattctcatcgctctttttacatttctataaaaacttttgaaacgatcggagtgaaaaggtacggtatattaaaaagggaaaagttttcttttgaattttacagtcagcggacagatattctgctttttgatcagtttggcgtgacaattttcggcagcaaattgcaatttgacaatgggcgcccattgactgctcaaatttggcaccacgtaaatgttttttttcaatttgatacaaaaataacagattttggccattagatttgcttaacttacgacgtcaaaatcattcgactgtttttgaatggacattttgtccaagttcgttctgctgtcgttagaaattatccagccattttcattaataaaacctgtgaaattttgttggccaaaaatggcggaaaaaatccttttgttggtcagctgagccaagttggggtaaatgagacgaaattggggcaggatttgtaaaataatttaaatattttcattattagctgtattcgaaacatttcgaagacgcggaaattgtccgaatggcgtggagttgtcgcgaatggacacatcgccaagaaaaggcattcactcacttaaaacattaaatttacaaaacgaatttaagcgattttcactcattgaatgggctcaattcacgacagtcgatggtaaaataattatattaattatttatttttataacaatttatttagttttcaacaaggcccaaattgctctcattcccggaatttgcagtgaaagcgattgtcagccggggcggataagcgattgtggccaagggaaaaagcgtataaaatgaaaaaagaattcattaattaaaaataaataaataaataataattatttggatgttgccatttaaagtggtgagtgatacaaattgttaagttaaaacgccgccccatctgctgttctgtccccgttctcagtttgtcactgtccccgtgccccaccagcgcctaattcaaattcattgggagggtaaaagaaaactttaatatttaattttttaataattctcgaaggatccctcgagaaaatgtttcggcctaccggcacttcgcccattgttcgctttgagagcaattttcggcccggccaaacctttggctggggccaatttcacgtcgtttatttggcggaggattcgctcggaaattgggccatttgcgaagtcaaagagaaagacaatttgccaacccattttgatcacctcaatttacagttcgatgtcgtcgtttcgcccacaaaatgttctgatctttttgtgcccggctcatttaacaaattgacagtgcacaaattccgcgtcgaagaggcgaaacaagcggaaaaaagcgtaaaaagcacaaaacgattactaattatcacttatcagatggacccattgcttctccaattcattcagatcaacctcaaatgtttgaacaccgaattggtttccaatgtcgtcgcgaaaccgcccttttacatttgcgatcgcctggtcatatttaatgcattttgataaatattttttaatttattcatttaactcagtcagtaatttctcgggttcacccaccctttttaatatttatttttcctcatttttcagggccaatgggaccgtttggcaacttttgggcgcactttcgctttgccttcgtgcacgccaactgaaaatgcaatgcaggttaagaacaaaattaaatattgaacactaattactatataattggaatcactattcaattgtacaggaggttatcggcgatttgcatttcgaaggcccatgcgatagagcagcgaaatgcgcacggaaagtggtcagtgaggggggggggggaaggaaggcattggcaattgttaatcaatgcttttttgttttctatttttgggtgttaaaatattaaattttattttttatacaaatattttttaattctgtttttaatcaaattctctttttttcctttgtcttttgcaattttttctcaccttttttcctttttcagattcaaaccatcgaaaatgcgagcaaaagtttcggctccttttgtacgcgtcccttctgcgatggccaattgggcatcaaaacggaatgccttggcgaacggagcgccattagtggcgccaatccatcgacgacggcggcacaaaatcctccgtcggctggtgcgacaccgcttgtggacacgtacgagcgaaagcggtgcgggacaaccgacgatggcggaaaacctcaccaaacagagcgcgtgctgtt

SEQ ID NO: 8289 - DNA, 1590 bp, Heterodera glycines
gggaagtgccagcgtggcaatggcaaaaatatttttaatttttttggattttttggcaaatttaaggcctcagagccaccactggtgcaatgtgccacttgtgcacctggcgaaacgtggcaacaaattgtgcagaaaattgcgacgacaacaaaagtgccgatgggaaaggcatttttggcatttcagttttggcatttacaggacgaatctgtggtcaattctgatgtgtcggggagttgcgtgaaatgtccaccgaacagttacaaaacgagcccagggtgagagggctgctggactttgtattgtttacgttttacgatgaaatttaaaaatccgaagggtccatccgtgcactccgtgcaaagacgacagaatcaccggaggggtggtcggatgcatgcgcgaaatcgactgctattgtcagttgaaaaaagagcaaaaagtatttggccacagcaaacgttttgttcagtgaactgtccgcccggttccgtttactgtccgacgaccgattcgtgtcaaatgtgtgcccatggccaatttatgccctacaggtaaattcatttcaattccctaattttcaatattcaagcattctttcagcggacgattgcaatgcatcggctgtccccccggcacttccactgaacagcaggtcgatggcatggcattctttatgttttcaaaaacataatttgtaattgtttaagggcaccaccagcgcggaccaatgttcggtgcgttgtgcggtgggcgaggaaatgggcgcgggggaacaatgcgaaatgtaagagcccaatttgaaaacaaattattttttctttctattagattaattaattgattattcggtaaaagattccaataaaaaagtcaaagaaattcataccttttggaaacacacaataaaagtggttcagcttttgcataatttgaatttcaaattttgaaggtgcgcccgcgggacattccgcgcggaaggaatgaacgcgtgccgacgatgcaacgtaaaaacaaattaattcaaatcaaatgtttattaattattcattttgtttaaatgttggccattttcagctcggcttcaccacccctgcgaatgggtccaattcggcgtcggattgttcgctcattttctgtccgcccggccatttccgcaacacaaccattggacctgccgatgacagcttcaatcagctgaactctgcgttcgaagctgtgtgtgtgccgtgtcccatcggatattatcaggcaaaaaaaacaaatgggaaagaagcatttaaatgatggaagttgtttatgtttgatttaataactaatacctatttatttaatttctcccttaattttttcgtctgagtatggcgccgagcaatgcgtacgatgtccgatcggatggcaaacgcttggccatggtgccaaatccgtgcaggaatgcgatcatacgcatgatggcacatgcaaacccgacgaacccgcgccttgccccgaaggttgccgtaattatttttattttttaaattgacaatgcaattttcaaggaatgaaaggtgtacagacgcggggccaaacgtacgaatgccataa

SEQ ID NO: 8290 - DNA, 2578 bp, Heterodera glycines
  misc_feature (2482)..(2482): n is a, c, g, or t
aaactcgaacagaaattcttataatttaggcctttttctccaccagcggcgagtcaaagcggcgaaaaagatgagaaatgatcggctattttggagaatattgaatggacaaattggtctgctgatcacttttgatgctcatttttgcttgttaattttgatgtgtctttctgacgaaaaaattcatttctttaatgtttgacataaagccgagagtcggtgaaccaaaaagtagggatttgtcgagctgttgtcaaacatacgagaacgagcaacatccctggtatatattttgctgaatatgtatttacgttttctggactagtcagctgatggataactcagccgtacaataaaaaataaagcctaggcccaagcaagcctaagactaggccctgcctaaaacttaggcctaagtctaagccgaagcctagcgtaagccattgtatgagttgtcttttagctgagttgtcctcggctgttttccccagctggctgatcctggcgcggtatttcgagttttaactcactggacggtcaatcccaaggccatctaagtcccgatctatacccaattcgtttttgaaaaatacaaacaattaaatatattcaaacaaaagcaacaaataaatgtgaagagcaattatcagatcagttccatctagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaatttaaaaaaacttattttcacctattttggcgttttgcccaaaatttgttaacaaaaatgcaataaaaaagaaaaatacacccctaagaaccgacccaaaaattttttcaaaaaatacatccctaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacacccctaaattcggaactttttggcacctattttcccatttttagcacctattttgggggttttttagaacctaaaacctacttattttggcagtttttagcacctaaaaatcgaagccctagttacattttatgattcacaatatttaattatatgcgaataaatacgaagttgattgctattaattgcgcaaatattacttcccattaattgatttcacaatattattttccacatattacttcccattaattgatttcacaatattattttccacatattactttcgattaattgatttcacaatattatttgcccttacttccgattaattatttcacaatattctttgcgcaaatatttcattgacgtatcatttttatctgtgttagctgaatacaattacgcacaaaactttgaaaaatacaatatcggtttcataaaaccgcaaggtgctgcgtatcgaaaatttttcaaacccagaactgtaaaaaatagagtgtatgtaaaacttgaacattttgcaaaaaaactttaaatcgcttgtgtaacactttttcagcgggttttttctggtgtttatcagaaatattctgatttgacgagtccaaaattttagatgttctgacttgggggtagtgccctatttttgtctgggcccggtcaataagaaggtggtaatggttaaataaccatgaagttggtggtaaacttcggtcaacaagagctaccacgaactttggtcaaacaaccacgaagttggtggtcattcaaccatgaccatgaccctcttttttaccctgtcaataagaacgtagttcatggtcatttgacgggagttggtggttagaaaagctaccaccatcctacccatggtattcactttttataaaggtagtcaaattcgacaaaaaaattttccagagacaaataatttttatgaaataaaaaaaattaagtaaaacgggccaccaattcatgtcttttctcaattccagcttggcgcgcttgacgataatttaaaatggcatttcgattttcatcctcatttatttcatttaaatcatcattttcatttgactcttccgtcgccagtggtggttcaggcaaacgcatttcaatggcaatattatgtagaacagctgctgctagaatggcagttgcgatccgtctaagcctcaagcgacatgatgttctgaaatagcgttttttattttaaaaaatcatttaacaactttgcaatcgaaaagcgccgcttaaaaattccgagtgcatgctcaataacagaacggcctttgcataaggcagtattgaaacgcttctcggcaacagttttcggatcacggaaggngaccattagccattttttaatggatagccactatcaccaagtaaaatagaattcccggccagtcccgattcgaaatattcccatacatctgactgc

SEQ ID NO: 8291 - DNA, 2082 bp, Heterodera glycines
catttgtcatttcccaataattcattcactttttcttccgctgtccgtttggcccggcattcattttcagacgatattttgcattcatttggcccgtctttggtggagacaatcgcctaaatgaagtgaaattttgattaccttaaacaatgaaaatgctgttgccactcacccaaattcaaaaattataaagttgacattgttcaaatttttgtgctcccattgaaccgccgtcgtccccccaattgggcatcgcttcaacacccaaacgaaatatccatcatcgtttccttctttctccaattttagcatttcgttggtccgctcgttcaccaattcaaatgccccaatttcggttgattcaaaaagtttaagtcgaattttgaagcaggcagaagtggtggcacggagaaatggctaaacaattggaaaccgaaattaaatggcaattaatccaaataattttaatcggaaaccaaaagcataggcaaattaaaaatgattattccatttgccctatttgaaattgctgatccatttgtagaagttcctcgttacgtaatttctgcaacacaatcgcatcgcttcggctggccatcttttgtcggagtgtgcaaccattcaaacaatgcttggacaacagtcgcatttggaacatcggcaaacaaataattggaatggattgaattcaactgattgaaattagtgagaaatgtgggcgaaatgagacgaagcaaattgttcaaatgatgcccatcgcaaaagccaaaatgacggatgtttgtcgcaaaaagaatcaaaatttgtcgggaaaaacatgcaaaatcggctggacgtctcttttgtatgaccaaatagacaaatacaattcggtgtcccttccgtcccaaatttgctggttggcatggagaaatgagatgacggagtgatcaatgtacctgaaaaaggatcaacacacataatacaccaaaaaggtgctgaattactcaatccgaaggtgcttaaagatgattttgttgggcagcggacggtccggcaccgaaaatccttcagattggccctcgacaaataattttggcattttaatctccttgcgaattgtgatcgttctccacagcgtcaattctgttttgccatcaaaatgcgcgtccactaaaacttcaaaacgcggagagagcagtgccattttaagaccaatttgaggacgacgaaaaaacggaagaatgcccatccaaacattgctacaaatccagctgaaatgcgtaaaaaaacttaggtaattagaaatttttaagttaaaaatcccttacattttccttaaacgtcggttcattttgcggcaattaaccaagcacacttagaattaattagtcgtaaattatcggtcggggtcgttttcgcgtggctgttttcgcgtggccattttcgcgtggccgttttcgcgtggggacgttttcgcgtgagtacctgtttacgatggtcggatatgttccaaacatccatttttcgaatcccgaacccgaattcgaaaattttctttactttttttgtttttttatttcctgaagctggtaccttctttaataatttgtcagcgatgaacgaaaaaaaaataaaattttataaaaattcaaaaatttaacaaaaataacaaaatcgggaacaaactaaggacgcatttcatagtttcgggaaataccaatgaggaaattcttaatgttttcgggattcacattgacatttgcataattgtgatcattttgggggagaatgttgttattgatatcgttataacggtggacgagtcggagaatccgtgcgtcggcatctcacatcgccaaaatttcttaagcccatatgcgctaaattggtcgaaaacatagagtgcgccgtcatgttctaacttaactttgtttctatttgttttaatttgagctgctggttcatattgtaataattttaagtcttaataaatttatcaaattcacttaggtaattataaaataaattaaaactcgaaagaaaataaaagtcgaacaaattttggtaaaatatagtgtgtgtgtgtgtgtggggataatg

SEQ ID NO: 8292 - DNA, 4022 bp, Heterodera glycines
tggtcgcttctgtacagaaatttttgaatacataatcataaggtccataatcgggatttgttggcaacggatggtcctgcatcggaaattccacaaaaatttgtccttgttgtccttgatttgcataaatagtttcgcttttggtccaatttgctcgtcctccgtgtccttgcgaattgcgatggtcattccaaattgtcaattcgccttttccatcaaaatgtttgtccactaaaatgtcgaaacggtcggaaatcagtgccattttgagtccgagttggggacggtcaaaagatggcagaatgtccatccaaacatccgcacaaatccaactgaaaaattggaaacgaaaattttaatttttcaaaaatttccttaccgtcggttcattttggaggctcaattagcacacttttccctttaaaatctgttgttatgtaacttaaaaagagacagttaaaatgagaaagcaaagtacaaatcaatcaatgatgcataaggctgggaatttaaggcactaaaaatcttcaaaaagtcgactaaaaaagtcataaaaatcgccaaaaagtcacgaaaaaatggaaaaaagtcctgaaaaattaggtgaattaatttatagaataacactttgatcatatttaaaatatcttaattttaggccattgtcgccaccagcgaaagaaaaagaagaagcgggcaaaagcaacgaaaatgtcgtctaattattagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcttttttgagcccaaaacccgaaaaatttttcaaaaaatcattttttcgccaaaatttctcgagaatattgaataaatttaaattttcttaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatatttcgcgatttttgccattttatgtccatattttgcgatttttggtccatattttatggccatatttcgcaattttatatccatatttttggactccctactaattatatttgaggcatggccaaatctcactaccgtatttgctctaattatccccaaatctccattaatcccccaatatccaattatcccccagtctaggaggggtttgaaaaataatcccaattggaaatgaacttatcgcaccaattgaaaatggatttgatgctctcttttttctaagaaatgctttttgttgattcttacatttatttaattttcttttttgtgagagttttttggtgccaatgtcaatcccgcaaaacattctcagttttcccgaaacaatgaaatgccatttattattattattttttttttttatccgcccaactcaaattcctatttttaatattcatcgccaaaatggtcatcagaacagcaaacaaaattatcatcaaataaaacggtcggacatctctcaaattatcactccttcttccgctgatcactgggcccgggagtcgagaacactttttcatcgctttgatctggcggagacagcggcctaaataaaccaaatttgaaatgaatgaacatttaaagtactgtacggaggacactactgtaccctcctgtccatgctctattcaaaagtagagtgccacgggaccgggacctggtagcggacaactgagtacaattgagtaccaaggtcccctgggactattcccggttttcccaggcaaaaattcctgggttttcaacccgaaaaggtcccggtcccgggtttgcccaaaattcccggtcccgtggcactctattcaaaagtaaggccaatctttttgcttacccaatacaatcatgataaagatggaagatcactccattcaaattgtccaaattttcgtctttttcccattgaaccgccgccgtctccccaacaattggacaccgtttcaacagacaaatctcttcgtccttcgtcagtgtcaacttttcttgggtcatttcgttcaccaactcaaatggctcaacaatattcatttcgttagccactagaagttcaagccgaacattgtaagcgacagaagtggtggcacggagaaatgtctaaacaaaaaagggagcgtaaatcaaatggcgcccggaaaatgcgtcagtggaaaaagcgtcagcagaaaatgcgtcagcgaattttattgtcttaaaaacaagttccttgcgttttcgaggtcactgaccacgaatccggtatccattccggcctatttccgaatctcgaacccggactcgaacaaaaaactcaaaagtacaaaattttggcgctacttgcaaagagcactattttgaaaatgttttcacttttttttggaaaaatttttttttgttttttttatgcagaatttgtttttttaacatggaacgtattgcatactatttaataaactgaaaaaaacattttaaaagaaaatttagcgctagttaaaaattgacaaattttgagttttatcaaaaaccaaaccaaaggggggaccctattgttttgcaaaatttttttgagataaaaaatcgtgaatatattttttattcgccataattatgctgttaatacttaatattcatcattatgtgtcaaaaaaacaaaaaaaaatttttccaaaaaaaagtgaaaaaattttcaaaatagtgctctttgcaagtagcgccgaatctctctagcaaaacttgctcaatttatttcgaaatgaaattctttgcttatcttttctctttttgtcttgggtgatttcaaccgttttatacaaaatttaggcgtatatctatttaaaattaaatatttgtattaacagatgattaaagttttcattctcgtcttattttgtacattctcagtatcagccgaatacgatgactacattgatgatgaaatagaaggccaatcctcagcaggtatggaaaagtacaaataaatgcttattctctctctctccctttccctctctttctcgctcttttcattataatctctgttgttctctctatcacccgctatctcatttctgctctttcttttcacctttttaatattttctttcttctctttttttcattttttccctttctttatcttcactttttctttaactcccttctttcactgttttaaatgtttctccatttcctttttctcttcccttcctgttcctttctcgcgttttttcaaccaaaattgtttctgaaagaaggaaacagcaaatagtaaatatagaaaaaaaataattaaggtttaactttttaaatgccactaattgattttatttttattttcgaaaaatcggctgctaaacaggaactggatttttaaggattttttaactcctgactaatcatttatacttaatatataacaaatatgatgaaaattttgctttttcattttttactcaattcaatcatttcagttgaaacggtagtcgaatttttggcaaaattcgaaaccctgacagcatcagcggcagatggtggttcttttatgaacatcatttctttgagcatggtctccttt

SEQ ID NO: 8293 - DNA, 1787 bp, Heterodera glycines
gtattaaaccaaaaattaaaaattgaaataattttaaatattcaaaaatgaaataaaaaaccttttaaaggaacaaattatccctacttagctcaatctcaacgcctcagcatgggaacgataaaaaaattttttgggcttgaccaattaatctcaataatgaaactatataagagaaaaataatcggcaacaacataataaactatctaaattaaataaaaattttacaaagaagcagatgtattagctggccaatcgaataacatatatgaataaataatatatttttgttgattcaaggcatacggagataaaaattctaaaagaaaatggaatctgtcaaaaataaatgctattgaatactgtgggtccagtcgggtccatcatcatacccatattggtagcggtggtgttatcaatcatttattcaacaatattatacaattggatggtccgactcttctcgacttgcagtcggatcagagtctgattgcgtggagaagtggggaaggggataagagtcggattaaagggaccaccttctcgtcgacattaggttatgtcatatgtgattaggggtcgtggtgataaggtcaatgggttccaagacaattctgatgtcgttgagatacatctagatcattcccgtttcgaacaatgcaaacagtaaataatatcacatgtccaatatttagataaatctagatgggtatgaacacggaaagtgagtactctttgttaattgacattatattgttatcaattattgaggacatcatcaaatgtaaaaaaccaaatttcataagcgggctcaatcctaagccaaatattaatctcttttcaattacgatagatattttttcaacaataaaaattaattagttttttacagagcctggcgggaacgggattccgcgggaaaacacgggaatcccgttcccgttttttttgccggacgggattttaacaggaacgggaaaatggctggaataccgttcgggaatcccggcccgtcattttcgttttcccattcccgttcccgtaagttttttatcaaaaacgggaaaaaagtacactgtaagaatgggagtctgagtaaaaattttgaagggaattgtgtgaaaagagattgatataggtatatatatatatattagagagcggcgggaacgggaatcccgcgggaaagtgaaaaattaatcatgaaaattagtcaaaggaaaaaaattttaaaaaaataattaatatattctttaaaaggaagattgccaagtgtgcaaatggcctaatggctactctccttgactttcccttcttctttccccttgttcaatccctctacagaaattaaattattttgaattttttttttgtatactcgtgggtttcctataaagaaaatatgattcctatagttttttttaaattgatacatattttatcattttttaaatgaaaatcctaccaatttagcttaataatcccaaaaaccaacctttttttgttgaaaatctgttaacaaattgcacccaaatttttaaaatttcccccggcggcgcctatcggcaccgccggacccccttttccccaaaagttttttggaaaaagtgcgccgaaaaaagtgatgagaaaagcaaactgaattctgatattattcgatcatttagtccgaaaatgattaattgtttgaaataattaaagaaatttgttttaaaattttcattaaatttaatttagctttaacaattggattttattaaataaaaaacaaaatgaaaatttaatt

SEQ ID NO: 8294 - DNA, 5264 bp, Heterodera glycines
  misc_feature (61)..(61): n is a, c, g, or t
attaatcttcgtcatgtgttaatgacaatcacgtaagttgaccacacagaatgttcattgngcatgtaattaatgctaattggttatgcttgttaatacggaaaatttttttcggtaattgaaaagtctaaacattttcctttcactaaatatatgaagcgtgaatggttttgcttaataaattgtgaattatgttataattaatactaaattaccagagcttccttttttatgtaaataatagatattttttccatggatttatttcttatatattttagcatttttatacatattttatttacatttcgcgatttttcttacataaaaaagaaagccctgttaattagacatttgaataagaccgaatttatatgtattcaaatattttttttgcaatttattttagccagaaaatatacatactattttagcttggttttaagcgtctaagactcgttttacttccatattttacatttttgtccatattttccatccagattttagtattttcaaaataaatttgaaaaatacacccataaaaaaacacaacaagaaatactctcttaagaccgaataatttgaaaaaatcaaaattaaaaaaaaattcactgttattttgttggaaaaattcgttttcctcaatatgaaggaaacttttttttttgcaaattaccataattatttgataatttcatagcttgtggtgcatcgataatgaattgcagtgactccgctaaatattcggaacttataaaagtgcgtcaaagcactgaaattgcttatgcattgttcagctgttcatttttaattttgtgcgcttttcccatgttcaaattggcccgagaacggcacactttgtacattctgatcagcaaggtgagcaacacaaacaacaaattttccgttttgagacagtttgtgccatgccatccacaggggtagagcgcaaacagaaaatcccgcgattgcggatacaatttgccacgaatagagaaatgttagggctatccaatgatatcaagaatgtttaagttagttgacactagacaaaatgaaccaagagaaaatttaagaattttggtaagcgaaccgactggagaaaattggaatttcgaaattctttggggaaaataatccaaatccataattctctaataaataattttctttttaaaaattttatccataattgccacaaactcccaaaaattcagcggaacgcggaaaaatcaacaaatggaaaaattttgacagaaaattattcataacgttgtccaaaatgaactaaattgttaattatttatatcgttcgatggccttaagacttttctaatatcatccaaaatttcaaaaaataaaaaacaaacgctaattaattaaactcatttctgttaggctatccatttagtagttaattatggtgctatgtcattatttaaaacatcattatgtgcgttatttaaaaaacaccaaaataaaaatttttgcttataactttgctctaaaacaaataaaattttcttaatgatggctttttaaataacgccctttatgatgtttgtttttttaaataacgactccgccccgttaattatgttagccacataattgcaaccaaaaaaatatctgaattcgtggtgtggtcaatgaagtgagagatgatcaaaattttgaccaaaaaaaagtctttgaatatacataacatgaatctcgaaattgagagcaaagaaaaatttgaaataatttatatttgcttatgttttgatgctgatcagaaaagtctcttacagcaacttgatcagatcacgcattattcatggcgaacggaacaacggcgggaaaccccaaaatatatgcaataaaaagcgaggaaatttccgaaaaaatttccaaattttgccttttagatttttccaacaattctctacctgttgtcaagtatcccaaccatgagttcagtcttttttctaatccctgccaatattcgtggattaattgtgaaaacagcgacaaattgcaaacaatttggctgggtcagcatgcgtttgcacattgttgcagtggctgcaaaccgtgcccatgccgtactcttcccgtttcattatgcacaaaaagtcacaaaaaagtgagacaaaaaacaaaaacaaaaagtgtgattttatatggccaagacaggacaaggatactgtattttggaacggtggtgattggtcaaatcccaaaaagtatcaataaggcaaacctaagaaaataatcaatggtaataattagagccacttttcctgaaattttcatagcaaatatgcaataaaaagccaagaatacacacctaagaatcgaccaaaaatttcagaaaatataaaatatacccctaaaaataatgctaataatttaagttaaattttcaatttaaatttttttccaagggcaatttatgaaaaaagagaaaaacatctaaaaatatgagcccattttcagcattgaagaattagtttctgacatcacatgaacccggatttgtatacaaattcaaattttcgtattccaattttcaattgtcttacattagcattgttgaaatttcagaaaaagttttcatttgaaaatcaaataaaaaaatacaataaatatgtataacaaaaatttggaacttttattaggaccgttaatcacacataaaaatagagaccggcgtgcgaaatttacggggtcccaatccgcaatcaggcattttttggcaattgcggcatttttgggattaatcccgcgggatatcgtttttgtttttttattttcaatttaaggacaattttcatccaatgtgtggtaatgcatctgttggccatcatttcagttccattttacctatgtaaaaatttattggcgaaacaatttaaattgtattttattttttaatttagatgtttacccctactcttggacctatttgattgtttcattaccattttatggggcaattgcgctacgtttggcatggattaaatgtaaaattatccacattttttacttggcatagaaattggcattccatttgcagcatgcattttttatttaaaattgaaaaaaaaacattttccttgtaattagggctttagttgcgcttttaaacaacaaaaaattccaactctttttattaagggtttgacaccaaaacaggaattttcttaatttttatcaaaaatgataatttttgctgtttgccccccaaaaaaccaaaaaaaaaaagtctcaaagccaaagcatcttgaaaatttagcctcaccggactctcaataagcacataaaaactgaacctacaattaaattaacacactattgagccggatttaccattgtacttctggacccggaccaaacgggtcgcctgccgagtattgaatttgccaaaagtcgggtccgactcttgaaaacccggggggtatccggctctctggacttggttgctgctttcaattttcagttaaaaatcgaaattggcattcggaagcggcacaaaattcggcatcggacaaggacagtgtgcgaatcactgtgctatgttttgccgttcaaattcacacactttgctgtgtgctatccgttgaagcagctaatacgaaatggttctcagaatttatgaattgtgatgagcatccaattggccaacagctttattttctctacatattgttcgccaatttgtattttgtgtcggatgaggcaatttttaattgacgattaattaagctaattgttgattaatttgggtgcatggatttaaattgaccactaattaagctagttgattaattcagctctgatttaaattgaatagacaaaacgggtctgaattattgttagtagaacattaattaagcaatttttcttgaaccggatttaaattgtcttttgtaattaattagccggaactctgactaaatgaccagtaattacgctattgattaattgggctcggacataaactacttgaaatagtgatttgtatattattaactcaaaatcaatcatttaaggttctttttatggcgctttgtagagatatgcgagttgaatttgtgcgaatgatttacaaaattgtgccctttttgaagggaaatgctccaacagcaacaacaacaataagaacaacacaactgatgtccaacacaacgcattacagtaaccgaatacagaatttcaatgttcgtaccgtaggagaaagtcgatgactatgagatgatgagatagtggttggccgatggacaaaaatgtaaaaatcaaaaatctgctgattactatgattttatcaacttttcaaggacatatctgagtttagcagattggataaagaaaatttatttaaaaaaatttgactatttattgtgattgaatgtatttttaatctttgtcatcttctaagccgtcgatttgaattccttttcattttgtgccatttactacaccaatcgcttccaaatgctgtcaaatttcatctgaacattttggaaaaataataggaagaatttgattttttcgaacccaaatcgataatgacctaaactttctgtgcctaattaagcccatggttttgcttactctcgcattgcatccgcacgtgcccggactagcaacataacagtcaaatggacaattgactttcagacagctctccgtcacactatcgtacaggcattgttctgaaagcgtaaaagggacaaacgggattattagcaggacaaccaccaccagcaaaagtgccattgaagaagaggggatcaaagaaattttattcatttttaattttaatttttcaataatggaggaatttttgggatttaatttaattataatttaaagaatttatcaatttataccaaacattcattgtgcttatttctatgacaaaaggaatgaaagtgcaatgaatgtgaaacaaattttgcgatgaaaaaaagcttttttttgtgttttaattaaaaaatggtaaaattccaccagacaagcatttgaatgattacaaagcatttttatcgttaaaactttttcttcgccattttggttttcatttttgattaaagaataagcattaaaaaacaattaatgcgacaatgaaataagtagtatatagtcccaaaaggttgcgggtgtttcccgcacgagcccgtgcctatgggaaggcgcagccctttgaatttgccgccccataaaaaatccacgatgggggggtgtttcaaaaccaaaacctattgaaccacttt

SEQ ID NO: 8295 - DNA, 2100 bp, Heterodera glycines
catggacggaccgagcagcagcagcggcacgtcacgccttgttgagggacgaagcagtgcaaacagcagcaggagattttaaaaagcaataatgccacgacccaaaccaattaaattttaagttttattttagaataaatttttacttttaataatttaaatctttaattacccaaaaatttatttattaactatgaacaaaaatgccaaaacatggtcacgacaatgttgagggacgaagcagtgcaaacagcagcaggagatttgaaaaagcaataatgccacgacccaaaccaattaaattttaagttttattttagaataaatttttacttttaataatttaaatctttaattacccaaaaatttatttattaactatgaacaaaaatgccaaaacatgtcaactgagatttcgactgaactatttgttgagttgagatgataagcaaaatttatataaaaatcgagtgcgttaaaactggtaaaaatcccaccgtcacctttcaaatctcggtttttctaaaatgtgctcttaaaaatacaaaatcgcaatcccaattaaattatttaatcttaagaggtccaggttcttttcaattctgctttgtctcgatttttcaaaattgatcttttgtttcttccccatgtatatagttcgcttcgctgttcatatggctggctttatcccatccctcatttgtccgctttatcctatccgccatttgtccgctttattcatccccatttgtccactttatcccatcccccatttatccgccttatccatccccatttatccgctttatcctatcccttatctgtccatttgtcctattgcccattttatctcatcgcccattttgtctgcattatctcatcccccttttgtctgctttatcccatctcctattttgtccgcttctccccatcgcccgtggtttcgtctcgctctgtccatctccaatattcttcccggaattgcttggactcatcctcgtttttttgcgcgcgtcagcccatccccgtcggcgttatcgacgtcaaacccatcggcgaagctgctgcaaattcgcagtttgtcgcctgctgaaatgcgacggccgacggacggaccattcgccgatcgatcggacacttttgatcgcacaataattgcttctgctccctcactgaatttcttcaaaagtttttttctttttttttgcccggggcgaaaacgtcacaaaaattgcgcgggcatttccgagcgcaaataaataaataaaaattgaaaattaccatcgtttctttatgcaccaattgctgtgcggcgcttcaattcggtcaaaatctgaagagcatatgcagtgaagaagcccaaatttgcatggtattttgttgcaaaaattacagattttgcacattgcccaaaaagttgtttacaaaatgcattaaattgggcttccactttcatgtaaattttttttcttgaaacgttcgaagtaataggaaaagcatcgtcttttttttttactttgttactgagattggaaatattgagatttagttttaaattaatttgaagaattttttggtatttatttaattttttgcatatatttaatgcaaatttttttacctttttatcacatttttaaggggtttttaaaaagcacaaataacaacaaagccatattataataaaatgtttttattaacttttgctttcgctgctttcattttcattttttctgtttacataatttatttaattgttttttttatcagttccaattattttgttgatttgagcccaaatcacaatcaatttgcagttaatgtacgttttacactgttttttcgccaaatgattctttctgtttgtctttttttgaacagtttaaagaatgaatgaattacctaaattcataaaatttatttgttagtttattatttaaatttttattttgcattttatgtaattaaatgggtcagcgccgctgcgttcactgccaaaccgcaaatttctgcacacgtcacaacaaaattaggcttcttcaccgagacaaactgaagccatgcatgtggtcagcaaaaataaataatttaaatttaaat

SEQ ID NO: 8296 - DNA, 1558 bp, Heterodera glycines
  misc_feature (118)..(118): n is a, c, g, or t
ctgaagccatgcatgtggtcagcaaaaaataaataatttaaaatttaaataatttttttatatttaattttaggctcaacaaacacattcagtcgcactatcgtccgctgaatttgcnctggacactttgcatgcgttcaattttccaatggaacaatgaaacagtgaatgtaaaaaacattgaacaaattaattaccattttaaaaatttaaactaaacgagtttttttttaatagttttgattaaataaaaaaaccgaatttcaaattagaaaaatattggtctgaaaattttcatcggaacacaaaaattaactacattttcattataataaaatctaattatttttcattttaagcatttttgggtgtaaaagcttaatttttcgcttcattttggttctgtggtgccatactgtcgacgtaggaaaaaatttaatttctatgattattgttatttgatcaaaaaataataataaaaaagcataggtttggagccacctgctcggcttcgtctggttcgtctacctccaatggtgggccctcaatgaatcgcttccgtcggtgaacgcgccgattgcggactattgggtgatgggcacggcaatgctgtgcagtcaggtgaataattaccatgttaattgctttccaattaatagaattaatatttgaataaaattaatattttttcatttaaatacaaaaatgttatgcctaaattgcatctgttcaaaatctattgcagctctgtatgcttctctcctctgcttaccatattttcgggtgccattcgcctcagcgccgcaaacaatggtaaaataaatttttaaaatatttttgtaaaattcaaatattttctatggaaaggcttcgggccgaccttttcggcgtgtcggctggactcagtggactgtacatgaccggactgtacacttcattttaccattttccggttagttcaaaaaaaaaattatcagcgatttatttgctatttttggaccaaaaattaaacctaaaaatttccaaaatttaggagcttcaaaaattttacggcactctgatcggtgccatggtggttttaatcgccatttacgtgccattccgtcgcttctccatccagtccaaatgtcgctttggtgtgccggatgtattgtatttgtcaatggcactgatcgcactatacccgacttggcattggacccaggcaaatgctaattattaaggctggcattttgacttgatgctaatatgcattaaaaacgcatttggattgatttatgttgctttttcatgccatttccggtgatttttgagacttatatttttctgtaacagtttcgaaagaaaaacgaatttggccaatctattgtcattttgcgctttaatattcttgaaatttttctgcttatttttcaatttttgagtctttttttgtcatttgtttacgtgcttttaaattctttagaataatttttatttttttagctacacggcggcttaagcaatgatcatgtccgccaatgtatgaaagagtcttttcgcactgttcgcgctgctt

SEQ ID NO: 8297 - DNA, 2637 bp, Heterodera glycines
agcctgagtaagtcttttgagggaaaactatagggctgatggccaggtttgaaccggcatatctggcttaaggacagtgcttttacggctgaactacagaccgtgccctgtacgacgccccacgcgatcatataagatttacagcgcctcttgtgatcctttacactccctctcgggaaacctacgactttatgccaccatggcatgctctggtatcagggaatgcttgtcttgtctgaatcgatccaaattgggcaaaattcatattcgaagagtcggtcgagaaagttactctgacattgagacaaatgtcgatcatttcaaaaaaaaaataattgcgtcgaccaccaatcctttaggcaaattcgatgtgatcggctgctcccaccagtggtggcatttgctaatcctcgccgcgttgacctattcccactggacgggcatccaactgctgatcacttaccatcgcacggcactgatcagacagcagcctctccatacggaccaaatgcttcttcaatctgccgcttcgccttttgtgccagcgctttcgtcgtcgggccgactgggaacgaatctcttaaatcacaccgcgacatcaaccaacggcggatgaccacacaaatcataacggagggcaaaatggaaaaacaatttcgcatttaattgtatttaacatgcacaatttcagatgaaaaatatttttgaaccaaaaaaagggctcccggaaataatgccaagggaaattgcgtcagtatactgtgtttctaaaataaatttctgttgtattaagtaatgtaataataagttcgagattgtgtaaattttgtaaggtccgattaatataattttgaaaattaccgtaaaaaacatactgtagtttgatttccttttggggtcattaaaaagtactcttatatttaaattaatttatgtatatttttcaaaattttgaagaaaaaaaaacttctacatttcattttttcgatataagtcgtttttgtaaattactttaatagaaaaaaatacaaaataatttaaaaatttcctttcccccaattgattttatttttctttttgaatatacgtaaatggtaaattgattttttcaaagcattattgaaacatacataaacgaaactgatttattatttttacaaatatttccatttttcatttttactttttttctaatattgggtgatagataatataaatttggcaccatattttttaatgttttatttctttaacaaaaaaaaaccaactaacaaataagcaccaagggatgttgcaagtttcgctttcgccttttcgctttttattttggttttttcgctttttatttttctctttgcaacatccctgctaagcaccaaagaaaatttccgcttttatcagatttaaggccatgtttggattctacagaatgaatttggccataaatataatttttggcatgatttaatttgttaatttttgcaataaaaaaatcgtgaaaaattatttgtttatctttaatatatattctttattagatggaaattccaaaaacatttcattactgcaaattaaaattggtaattaatttggtcccgctttagggcatatattcccattttcagttataaaacactaaaggaatttcagagaatcgttaagccaatgtcttttttgttattgttttctattatttatctacatagcccagcaattattattggtagagttttaaaatgcaatacgaatttgataaaaattaatataatttatcaaaattctatttttttattttacgagtaaaaagcatcataaaagattcattttcgagattataggtggtaaaaacaaagatcatttcgctgaaaaagagaaatgttttgctattttcaaaatcaaacaaatgcacacaaaagtggcaaaacactcaccaactttaaaattcgaattcaatccgaatgaaaagccgacggttggccaagcgattaatgcccttttgccgaccaattttggcatgccattggcacaagcgatggcacagtttgacttcaaagtggaaatccgtgaacgtgccattgagtgtgcgctggtgtttgtcgactttgaccaatgggagaattcatttttagaacatcacggagtgtacaaagtgttgctttacccaaaatcagggtaagacggaaaggatacggtactcaaattaaaatcattgtctgattttacaagttcagaaataatgtacgcacaaatgatcaatcgatgacacaaccgtgggcaacaaacactgatcagaaaaaaggtaaattattaatacaaggaaaaataagaaattttttttagctgattgtgaatttcccataatttatcgtcaatttcaagaaattagaataattagggcaaaaagtgccaataattaagaaaatatccccgcgttattcttgagtttattccataatttagatcataataaatacaatggtgaaattttgttcacaatgacaaatttcaaagcattttcggagggacgaggaccaaaagaaaattacagtgacaaagtgataatcggcggaatgccatggaaaatttggattatatataataaagacactattggattttatttgtgttggacctgca

SEQ ID NO: 8298 - DNA, 1508 bp, Heterodera glycines
tttgaatgccgtttcgagtcggtcatttgcgctcttcgggagtgcccctccttgccccccccccctccccctgtgactttcccatccttcccttcccttcctttgcccctcggcactttcttcctctccgtttttctttgtttgtgtttgttcgaggccaagctaacctcttcggaattaatgatacgcaaataggagaagcagaaggaagcggagaggttgcatgaatatgcccttcccaaaatgccaaatggcaaatggcagggtgtgggagctgctgactctctgctgctgggagaggggggaggggagggcccttatctgaataataatccccttgtaacgagaaatagagttaataataatatgaaccagatcaaatgttcatcaggccccgcattaaatctgcagtatttattgtgccattatgatgcacgatatgatttttaaaaatcaattagaatttatttttgctatggaaacctttttatagtgaataaaattattgaaataattttgtttttaattctatctttcgacaacagattcagccatatcaattaattttctaaaatgatttaaggctttgtcgtgaattttagaaaagagtaaaaaatttgaatttacctggtccttcgtttttaaaaattactttgtaacgagaaatagagttaataataatatgaaccagatcaaatgttcatcaggcgccgcatttaatctgcagtatttattgtgtcattctgatacacgatatgatttttaaaaatcatttagaatttatttttgctatggaaaccttttatagtgaataaaaatatagaaataattttgtttttaattctatcttcgacaacagattcagccatatcaattaattttctaaaatgatttaaggctttgtcgtgaattttagaaaagagtaaaaaatttgaatttacctggtccttcgtttttaaaaattactttgtaacgagaaatagagttaataataatatgaaccagatcaaatgttcatcaggccccgcatttaatctgcagtatttattgtgtcattctgatacacgatattatttttaaaaatcattaagaatttatttttgctatggaaaccttttatagtgaataaaaatatagaaataattttgtttttaattctatcttcgacaacagattcagccatatcaattaattttctaaaatgatttaaggctttgtcgtgaattttagaaaagagtaaaaaatttgaatttacctggtccttcgtttttaaaaattactttgtaacgagaaatagagttaataataatatgaaccagatcaaatgttcatcaggccccgcatttaatctgcagtatttattgtgtcattctgatacacgatattatttttaaaaatcattaagaatttatttttgctatggaaacttttatagtgaataaaaatatagaaataattttgtttttaattctatcttcgacaacagattcagccatatcaattaattt

SEQ ID NO: 8299 - DNA, 3086 bp, Heterodera glycines
gaagaaaagaaagaacgatagaattctgccaatgggagaagagggggaaaggggaagaagaggtgggaaaaacgatgcgatgcgatgggatgactaactgatgacattcgatagggacaagacaaaatggagggggggggccggggacacccccgggggaaaagcacaaaacggcacaaaaggggggacactgccgaaattatgagttttgaccaacaaattgaaaaaaaattatcagtattttagtttttcctaagcaaaaaagacagacaaataaaggcgggcgaatttagtgaggaaaggcacagccaatggacacacggggagaggaaaaaggggcagggaaaagaccgccccttcctcaaaaagaccgcccaatcagccccccccccctcacaatgcacgcgaacaaaagcttaaaaaatccaagtttaaattgcttacaaaagatttaatgtcaattaattaacttattttcttcgctcattttctcctctccttttactctctgtcccccattctctcgcctcctttcattcttctcccctactctctcgctctctcttttacactgttcctccattctctctttctcctttcattctctcctactctctcgctctctctttcacttcccacattcgctctttcttcctttttctttccctgctttcattttgcttctttacatcctccaacaataaaatgaataaatgtgaatgtacggtgtccacacctcctcctcctcttcgctcccgcggttaaaagccgtcgatctcttctcccccccccctcatttctttctcgaggctttctctcctccgctttttaagtggcttgttaacgcaaacaaatgtcgtgtttgttgaatgagaagaaagggacgacgaatgacaaaatgaaaagagagggggggggggggatcagaagcaaatgactaacagcaactgctaacacgcaatcatccaatcagtagtgattcgaattaagtgagaaaatgaaaaagcaaatttatagcaatcacaacgacgaagcattgtcacagttcatcaatgaacaaatcgtcatggaaaaagcgccgaaaaaaatcaacttcgattttcatgctcagaatctcacaaaatgcttatttctatcaaaaaaaaatgctcaaattgatcatggaaaaccaaaaatataacatttgaacattttaaacgtgttttgaataaattttgtaaaatgaggcttttgaaaattttgatctgggagccctgtttttaaatcattttaaagctattcggttcgatagaaaaaatcaattgacttaaatggcacgatgacatttcgcctactggacatttcgcctactaagccaaaatcggacgtttcgcctactaagccaacatttgacatttcgcctacgaatttttgcctactgaaaaaatgctagagaaaagaaaaaaagagagtgaaagagtagaaatgctttatttttcgatcaaataagttcgtgaaatacttacgagtcttaaaaagccaataaaaagccccgcattcattgaaatgaagacagtgtactgaatcttgagagtgcagccaaagaagcaaatggaaaatgtttctgacaacgatttgaacttagccaaaatgcggatcagggatggcacggaattccgattttcgacatttttgaccaccggaattccgattttcgaaaatttttggggcctcggaatgccatccctggtgcgggtccttgacgagaccgactttgaatcggacgaaggattagcaagcaccttgcacctgatcggactcgttttcagacctttatggaggggcttcacatccatggaaacaaagagagtgatgaatagggagtccaattatatggaaatccatatttttttcctggactgttgagggcctgaaacgcacgaaaaacatgtttttagcttggtttgaagcttctaggaaggatttctatatccatattttccatatttttccatatttcgcgatttaggtccatatttccatatttgtccatattttggcattttgtccatattttatgtccatattttggcatttttctaaaaaacctctattataacggcccccaacagctaaattggctttttgaccccgaaaaaccggaaaaattccgaaaaaataattttttaataaaattttctcgaaaacatgaataaattttaatttccttaaaaatcttaaatttaggtcaaaaataagtaaaaaaaaaaagtaaagtttcgctttctagttgattttttgctaaaaatgagcaaattttagatttatcatatttttttcttctaaaatgatttttaataccatatttagccatttttgaaagttttactttaatttagcgaatttgaaggaattttgaaaatataaatgcaatttcaactaataaattcgaagaaattttaaactcaattttgaaaaatttatgtccatattttgaaatttttgccattttatgtccatattttgcgatttttggtccatattttatggccatatttcgcgattttatattaatatttttggatgccctaatcatcagtaggataatccaaatctatttgctcactaacggattgtccagaggagtcaggcaatagctttgatctgttgcaattataaaaaataaaactaatttttatatacatattcaatgaatattataaaaaaaaaattattttttttaattaagaaaattctatttaaatttgaaaaattcatcataaacgacgataattttactctaaataaaaatattttatttaaagaaataagaatacgaatccctaaaatcgaatttttctataattttccactaaaatcgtagtaattgacgtcaatgaaaaatattaataaaaaaaaacatagcagaaaattttataaataaaatgaaaacccctttatatagaaaaattagacctaaatttttgaaaaaatcattaaaaatgacgctttcaacttaatttatgttttttcctgcttttcgttaattagaagaaatagcaaaatgatggttaatttgttgttgatctcgatatggttcgaatgca

SEQ ID NO: 8300 - DNA, 1149 bp, Heterodera glycines
agtgatgaagaagctaatgatagagatgcacactttctgtgttctttgaaaaatttatttgctttttttggctaaatttcattagcattataaatatagcgaaatatatgtcaaattagaatatatatttggtgaaatttgctgtcgaaagagctaggtattttaggttagtaggcgagatattcaataggcgaaatgtccagtaggcaaaatgtcagattttaggtgagtaggcgaaacgtccgtatttggcttagtaggcaaaacgtccgaatttagcttagtaggcgaaacgtccgattttggcttagtaggcgaaatgtcagtaggcgaagtgtcagtaggcgagatgtccagtaggcgaaacgtccgcacaccgacttaaattcctagccctgcttatcaaaacaaaaagcttttgtagtgaaaacccggtttaacgctgccgctgacttttcacattatactttttacccatttttgtgcctttttaagccttattggtaatcattaacactccaagctccgtttacaaggacgggtataccgatttgcaaggacataatggggaaaattcataaatccaaggacatttaaattttttctacaatgaaaaacggttaatatgtatttattcaaatggcttgtatttttcacctgaatggattaaatatggaaaatatggatatagaaatccacccggctcccggtaaattggacaccggaaaattggacaccgaaaagtggacactagaagattggacactaatggaaatttggacaccggaaaattggacactatcgtataaaaataaataaataaaaaataaataaaacaaattttggtttggccaaaagattttatttagtctgcacatacttatgttttttataagcgtaataaaacggaaataaataatgtttttattacataaaacttcagcaaaagaaaacaaccataacatccataaaaaagttttcttttggataggattcccatttttagtgtccaaaattccggcggtgtccagttttccacttgttgtccaattttctgatgtccaattttccagtgtccaatttagcggtccccaatccaccctagaagcttttaatcaagctaaaaacatgtttttcgtgcgtttcagg

SEQ ID NO: 8301 - DNA, 3320 bp, Heterodera glycines
  misc_feature (59)..(59): n is a, c, g, or t
ttttgtgatattttgcgctattcttttttcgtttttctaaatgtcaactcagaaatgcncaataccttcacaaattctttctgttttccttggcaatataaacttttaaattcatcaaatctttcaatgaattctttctttttctgttcataaaaactctttttcatcattttatttttatttaaattcatttcttttttcatttgtatattttttttttgcgattttgcgcctaataatttaccaatttttgtctcaattctgcttctgttttcccaaagatattttccaattgccttcaatttctctttaattgcatcaaactttgtgataatttgtcttttaatatttatacgaaaatgattttatttgataatgtattgcatcaaatattatttaatttaactataaaaaattcaataaaaataatttatacatggcattttttaatgccatatgacaccgtcaaaaaataataattttaaatttttataatatgaaaagtttgaattcattttatttactcagccattttctgccttttaaatattttattaaaatccagcataaatggcattcataaatttgtttgattagttgtattggtaattctcaattatatttcactttcattaatttcatcatttgatttaaaatttaaaaaaaatcaattttattcaataaaaatcttattgtgataataaatgcattatttttaatttttttatttatcttaatttaaagaaataatttagcaatgaatttacttcaaattttcttatttattgttatgataaacgcacttggttgttcaaatggtattaaatttaaaataaaaaaagtaaatattaatctttctttctagcccagcttaaatgcagaagggatacggtagggacaataaacggtgttggcttgaagatgaacttttccgaagaagaatgcgagtcaacatatttctggcaatcggcatacaaatattgttatgcttcgcattgtttaagaggtatgactttggttaaataagaccaattaaacgaattgaaaagggtaattataatgatgaatgttaattaattttaaagtttgacggttccctggagcacgactcaatttaaaacccaaatatgggtcaaggagtttaattactacttaaatactgagttcacaactctgttcttatttatatcccacaaatatggatttaaagttcaacctaatgcttcaagtcttatctaattagagttcctccccgatcttaggtggaagaaatgtatgggctcataaacgaaaatacttgaccaaactttttaagaatgactcgaaaattaagaaatgtcatgtatgaaaccatcataatcctcttaaagaaaaaaaaggcttttttggaaccgtactattatgcttggacaatcaaaacagaggtatggaacatgtgacttaattactattaaatacagagcctacaactctgttcatcattatactataccgaaaaatttatacgaatttgacattcgaacccgtatcagttaatatgtatataaaattaggattattctctccggtcttaggaacaaaacaaatctcttagactaaatttttttaggacgattcgacaattttgtggatggcatttttagctcgtcataattcactttatcaaatattttaaggaaatgaatggcttacgcattatgggtgtgccaaaagcccggagaaaggtgcatgtagcgacaatgttgagaaggagatgaaagatttgtatggccttgctgtgagctgttcattttgtacaattggacgcaaaatggacgacatgagcaacaagaatttcccgctgtacaatacaaccaatgttgtaatgccgccatcaggacgaggtgaaacatttaattaattaatatagttagtagagcctggaaatttctaatttgcggatcgagttgcgggatttgaactaaaaatcttttgtctagaggggatcccgcgggattaattccgcatttcgcaaatccactatgctctacacggtaaaggttgttttaatgtgattgtacagtcaccgttcggaatgtcgtttgtaagctatcgtggcgcattacccatctctgtaaaggattttttgggtgctagtcgctttgtaaaactgccaaacttacagatttttcgttactttttaacacaaccaaattaaaaatctacatattacgatagctctgggcttgctctattagcataaaatttcagaaaatttcattgagttttcagaaagtcataaccaaaaagcaatctatgcgctagcgtgtgataccaagattaaaaaaggcaggaagaaattgtaaaaattataaaaaatgaaatttttcgttaaatataataattaacaaaatgaagaaatggaaacaatttatttggtagaacattggaggtgccaatgagaatgtgccgtctccgaaacattctttcattcgatcagcccaccggccgaagctggccttcatgcgttattttaggcttttgttttttcgtatcaatttgacgattcattacctaaatacaaaattaagagaacataagccaaagcgaaaaagagtaaatgaagaattaaatccggctctttgatagacttcgtcagaaaaattataacgatttcatcatttctacctcctccctacatggcgccaaatcggtggcgccaaaacgttttggttgttttaatctattttagaaacaaaaagagaattttgaaattttttattttcgattttttgttcgaatttcggctccgggttccgaattggtcgaaatggatgcctggttcgtgagcagcgaccctgaaaaccattggaagcatgttttcatgacttttgaaaacaaaaaaattttcttcaaaaaagggggcaaccaaccatcggcagtattaccttcgcgaaaaatacgtttttttgttgttttacaaaatttttaaatttgggtgttttcttttttttattatagcttggcgccaaaacgtcggcgccaaaacgtcggcgccaaaacgaccctggcgccaaaacgtcggcgccaaaacgtcggcgccaaaacgatacggacccctgcccaagtgtgcaaatggcctaatggctagtctccttgactttccttcttctttcccctggttcatccctctacagaaattagattatttttaattttttttttgataactcgtggggttcctataaagaaatatgatccctcatagtttttttttaaatgatacatattttatcattttttaatgaaaatcctacaattgagcttataatcgcaaaaac

SEQ ID NO: 8302 - DNA, 1538 bp, Heterodera glycines
cagggtcgacagtgttcgagtgcacatggaagaaatcaacctgagcttctcccaccgttttgcggtgatgcccgacaattgtctctccatgtaagtttggcattttgtttttttttgacaaatcaaaattgcctttcatttctcggatgggaaattggggaaattgacccaactcgaaataactactttttcttccatttttatagcctcggcacggagctgctgggagctgttggctttatcctaagcttacccgatggtttgggcattcgtgcggacatctgtgcagcgaagtggttttaaaccgccctaaattttggagactatcttttttttttgttagcgaaactcctcaaactccgtccatttcgttttcgcaaaaaatgtaagttgtatggcgttttgtttgtttttattgcttttttatgcattttcattttaaaggctcaaagctgttttgggtgaaggtgctggtgactcggggaagaagaacgaaatggtgtacgttgaatttaatccggataaaattggtcacagttccattcgaatgctattcggtcatccttcaaaaaccaaattagccaaagactcattcctccaacaaattttaaattcgaaaaaagtacccaatttattgaatttctatccctgaaaaagtgggacagtaacatgcgttaatattcgatactttgtttatgttttttattacaattaattaatttttcccaatttccataaagccttttggcattttgatgactgagttttaaatatctttttcatttgaaggatcgagggaaaagtcaaatgggcgaaatttttgacggaggatgagattcaacgggagatggccgacacaatgtagaaaggaggacgaatgatcggagaatttaatcggaagaactttttttgtcgtttcgatttacaaaattttcgaaaatatgttttgttatttggaaaaatgtaaaacatattcctattatccttaaattacataaaagataaatgaattttgaacaaaattcggcaagcacatataaaggatctaattttttaaaatatgtatgtaaatgctgtaacttttaagttaattgtaagcattaaaaaatttaaccaaacgccgctcaagcataaaaactagagttgagcgggaccgggaccggggcgggaaatcccggttttttcaggtcccggtcccggtttttggaaaaacagaaatcccggtctcggttttgcctgtcccggtcccggcgggactaaataagcactggtaagaatgggggtctgggtgagaaaagagaagggaattggtgagggatcacaaatttttgataaaaataaattaaatatttattttcatttatagcatttgtccatatcataagtggtcaagtggataaacgtttttactttcattatttgtctcttcggttcaattccctgatggaacagaaaattttttaatattttctttaccattattttaattgaatttaattaataaaaaatattttaatttaaaattattatttttttca

SEQ ID NO: 8303 - DNA, 2130 bp, Heterodera glycines
cggcgatccttcttttaggcaccgcagcagatgaagctgcttttcgaatcccgggattggtttgtcgtccaccgcccgttggaagtaggcccaaaaggtggtccaatcctccggtttcccagaaaacgtcggtggctgcaatcgaaccgtttcgaaagtcgtcaatgtgtctgctcgagtttccgaacgatggtgatgtgagggagctgctccctaagttcggaggcgttcccgactgggatgctcctcccttcgaatacgggcatgatgggatgcccgagggaatgcttgtccctggtcattgagcgtaagtcgctcaaatcgttgctgttcggcttgcagcggttgctgagcttgtggccgctgttgcgccgggggttcgttctctccccctcggttccttgccatccattccctgaccgggttgttcacccgaacactggccactgatggggcatttgagcggcgttggatgagcgcagccatgtttggcatgacgggtggggccacccggttggcttgttcgaatctttgtggcgcttggccaacttgtccagcctggaaccgcgccaagacatccctgaacgatgtctcccactctggcatgcttcgtcttgccatggtgcgtgggagctccttcgatgggtgactgtcctcggtgtcgactgatctgctcgatcgggagatgctctgctccctttcttcgtcctcaaatgtttgcctcatcgcctgcagatcaccgagatgctcagccgcaatttggagcagttcggcaggagttggatgctcccgcagttgcagatacttcgtcgaggctggcaagggggcggccacgaaatcatacaagaaatcctgccgctcctcgggtgccgcacccgcttctgctattcccttatcgaaatgcccttcaaaaatccgggtgacctgtccaagtccccgttccattgccatcagccgcgcggcgtgctcgggcgcttcgcccctcgtgaaatccgagtccatcagctcccgcgcttctgcgattcgcgacgagagtgtgtcagccgctctctcaatccgatctcgggccgacctcaccgtaattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcggaggggagatccccctgatttccgttcccgtttgccgcttcctcatcgagcggttcgttgttccgttccattttcgtttcgctctggttagtccgaggtgtagcgggaggtgctcccggttgctggtccttgttcgtggcagaaggccccctgctaacggcaccaactttgtttgtggcaaaaactctctgccgatttggcggggagtttctcccttccttctactccaatccactcctcaaaattcggtctcttttctctctctctctctcttttcgctgccgctcggtctcttcccaagggggtggaatggagagaagggcgggaggcaaacaagaagtgggctgttgtttgaataacggcaccaccgactcaatttgggggagaagccggtgctcccaggttcaaccgcctaagtccgagctcttcagtcagcactccggacgtgccaactcttccgatcgctgaagacgggagtttcgctcccgtttctctctctcgtcgttcgcgtcgccgtccaatcaccggggatgattggaaaaaggatggggggggtgggatttgaatgggcactcctgggggtggagtcccgtttgacttgctggatcgctccgaaatgcccaggcaacgtgggccggagaagaaagtgatttgagattcgggagacggctcccttttgaccacccgcccaaattgatgaacacaaataacagaaaaaatagtttattgatgaagcgctcaaacttgggtaattaaaccgtgggagggggggtgggcaaaaaagtgacaaacgggaaaaatgaggagtaaaaagtggatgccgggattgagtggtgaggagagagataaaggccaaaaaaaacaatttcttttcccgggagggaagggaacattaaaatgaacaaatgaatgat

SEQ ID NO: 8304 - DNA, 2083 bp, Heterodera glycines
gcgcagcattcgctcgttccccgtcctgtcgtccgaggggagatccccctgatttcagtcccgtttgccgcttcctcatcgagcggttcatgtttccgttccattttcgtttcgctctggttagtccgaggtgtagcgggaggtgctcccggttgctggtccttgtttgtggcaggagccccctgctaacggcaccaactttgtttgccgttagcacaattcgtttgttgtgttggtcctcggcgaccgcttgtgttgttggtcctcggcgaccgaagtgttgttgcttggttccccctgctaacggcaccaactttgtttgtggcaaaaactctctgccgatttggcggggagtttctcccttccttctgctccaatccactcctcaaaattcggtctcttttctctctctctctcttttcgctgccgttcggtcccttcccaagggggtggaatggagagaagggtgggaggcaaacaagaagtgggctgttgtttgaataacggcaccaccgactcaatttggggagaagccggtgctcccaggttcaactgcctaagtccgagctcttctgtcagcacttccggcgtgccaactcctgtccgatcgttgcgctcgggagtttcactcccgttttccctctcgctgtccgattcgctgtccaatcattgggggtgattggaaaaggagagaggtggggttcgagtgggcactcctgagagttggagtcccgtttgacttgctgaatcgctccgaaatgcccaggcaaaggggccggagaagaaggtgagttgcgaatcgggagtcggctcccttttgaccacccgcccaaattgatgaacacaaatgacagaaaaatagtttattaacggagcgctcaaactcaaacttgggtaattaaaccgtgggaggggggtgggcaaaaaagtgacaaacggcaaaaatgaggagtaaaagtggatgccgtgattgagtggtgaggtgagagattaagaccaaaaggaacaattttttctccctggaggggagtgagacataaaaatgaacgaatgaatgatgtgacggacaaattagtgatgaaaaaggggggggggatggtgattggtaaatattttccccccggggttcggcccagataaatgcaaattggacaaatgagcaaacgaatgattctcaaatatgcgataagaaaagggaagagtcaaaggccggggagagaagctccctggcacaaatcgtaaacattgtgaatggaaaaatgcgaaaaatgtgaatggtccaaagtttgaattgacaaaaaacaaagggacaaaaaatggggaaaaatcggagatggccggaggagaagtgtcggccaaagtgaggacaaaggcaaattcaaaaataaatggcaaagcggcggggcaaaagggggagagcagacgcagatgtgaaaaagagaagaaaagggggcaaaattgaaatacgacaaaaattgaataaaattacgatagcaaaatgttgagaaaaatgggaggaaaaagaaagaggtgaaaagtagagaaaattgggaagaaaaggcaaattccaatcattttcttgacccctctcgctctgtccctcaattgcgacgggaagtgctcccgttcgaccatttgtttcttttccctctcttctcccggcggggaaatgccaccgggtgatcgagcgcaccccctccgaaatagtcctcctcctcccgtgacagttcccggggctttccatcgtccactccgaacactagaaaaccttcccatgaatggcttcctcctttggcgggagcagacctcccgcccgttttggtcatctcgtcgcttcttgcgacaaaatgagtgagaaaaaatggacagacaagaacagagaaattagaaaataaaatgtgcagagagaacagtagcaaccatccagagacagtgagtgcagcagaaagagtgtgttgtatcggcgacaaagaagccagatactgacagacaatacacacttaagagtgaaaagaaattggtactcttgcactttgtatccgctttttttttttttcgcatttttcaattttttttacttttt

SEQ ID NO: 8305 - DNA, 4053 bp, Heterodera glycines
caggtctctttctctctctctctctctctctttctctctctctctcttctacagctttttctggccgttgacgtctgcttgggctataaggcagctccgcatatttattcttagcgatgagtgttttttgcattatttccagccacaatttccccgacttcggcgcacgtctgtctctctcattggacggaacttcccccactctctcgcccacaccttttctctcgctctttcctcttccttcccatcatcttgttcttttcccttcggcatgtgtctttcacttaaaaaatatctgtcttttcaaccctttcctctctctcgctctctctctctctctccatctccctctctctctctataccctgtcggtccccaaaaacgtctgtcccttccctctcctctgtctcttattaagcgctgtaattccccccccccgcctctcccccagggcgtacgtcgcaaaaaacgtctgtctgtcctctctgcgcctgtttctacctttttgcccactctctccctgccaccagtctcgcccgtctgcaatcgccgttttgtttgagcaaatatattcgtctccccggctcattcacttcatttccctccccattcatccattcattcccccccccccctccaaagtcgtataatcgcaacattcccttgaaaaatgcctgcattttaataccaaaaaatccagcatattttcatttaataggcttcaattacgaaaaattcactttaaaatgtgaaatatttcttattttctccattttcaaaaggaaaaaaggaaagtgatcactttttcatttcatttctcctccgattatcgctgcttctccgtctttgccattgccattattttattttgttttttctttcgatttgcttttccctttttctctgctgtctcttccttcccctgttcttcttcctccccctccgttcgcctcactttggccggacacggcccagtcgtggtccgactgctccagcgtgttctgacacggctgctgaggtattggatcatgactgaaccgttgtctggcgaactgtccccagcagcagcagacgaaaaatgaatgaacaaatgaatgaatgaatgaaaatggccgaattgagcagggaaaagggacggacggaaggcattggcatttcgaggcaaatggggaaagggacattggcattttgaataaggaacaaacaatggcattggcattctgatttccgattggttgtccagcccaatgagtgccttccgcttataattgtctattgcttcaattactaatgaatcatttgtcactcacttatatttttattccttttcagagtcgcaactttcgcaggctttgcaaaatcgcataaacaacaaaaagatggaaagaaaggagcgattatttcataaatgtcatatttatttgagaaagctctgccgatggttttctaaatttatgaattattccacgtcaatggcaccgaaaaattgaatttgcaacaatactttcaaattttcaaatccattatataaatttgtgtttcctcgttcgctattttttgcctctttttcagctgattcttacgcgcaattaagacaaattaataataggagtaaatgatgtgatgatgactaattgcattcgtttgccaattcgtcgtaatccgtgcgccgatgtgccaattatccgccgattgccaagcccatccattggcactgataagagacaaatcttattggatttaaatgacgggaaagccatgatcggtgatcaggagatctttaaaaagataactttccgcttacaaaaacgcgtcattccgctgatcagagtgatcagttcacttttgccactgattcatttgccctttcttttcttttgctaaaatttgtgcgttttctgtggcttttccctttttattctcttctattaccatcattgttctctccttccattgattacttcttttattacccaatgtacataataaaatgttcatgagcaaaacacggccattgggacgaacggtaaaatcagtgccttttatgtgtatgtatttatttttacataaaattgccgttcctgaattattaataaaaaaaaaaatcactctcaatttcacattcccatgggcacactctcattctctctctatctctcccgctgatcactcactctcattctctctctatctctcccgctgatcactcactctcattctctctctatctctcccgctgatcactcactctcattctctctctatctctcccgctgatcactcactctcattctctctctatctctcccgctgatcactcactctcattctctctctatctctcccgctgatcactcactctcattctctctctatctctcccgctgatcactcactctcattctctctctatctctcccgctgatcactcactctcattctcttgccccttcattcaccctaccatttgctctctcccgctgatcacacactctcattctctctctatctctcccgctgatcattcactctcattctcttgcccctatcattcaccctaccatttgctctctcccgctgatcactcactctcattctctctctatctctcccgctgatcactcactctattccctctctatctctcccgctgatcactcactctcattctctctctctatctctcccgctgatcattcactctcattctcttgcacctatcattcaccctaccatttgctctctcccgctgatcacacactctcattctctctctatctctcccgctgatcactcactctcattctcttgcccctatcattcaccctaccatttgctctctcccactgatcactctcggttcactcactctctttttttcgttctctttctatccctccctctttttcactcactctctttttactctctctctctttctttctctttctctgatcactctttgcttttcttttcttaagttttatgattaacattccctttcaattttgctgctgcttcctcccctcttatgctaaaatgccttttcttctgctcaaatgcttttcccacctccctttcgtttccttcccatcctttcaatttcattttccatggccctctcccaaaattattgggtgggcagtgatcttttgctgttctgtcggctaatgtgattgaggggggggggggcaaagggatgggcgggggaatttattttggtgggatttccccattaattgccccgctatgcttttcccctccaatgcgtagaccatcatcattaacagcgacacaagacgagcttattggggggtccacaaatgctccacccaaaaaaaattttggcgcatttttgcgaattcctcggattatcgcaatatgatcaccgaaggcccaagtgatgtgttcgtgtaaggtgtattattttgtttttgataatctcattcgactatccggaatttatttttggacagccatcagcgaattgagtggcggatgggtcgacgatttgggctgagtttcctcaagatgagcgatggtcgaggggggggggggggtaaagagggggctaccggaatttaagtgagttttttgtgagtttcaagtagaaaaccccttaagacattctccccaattctgctgacaaatgagcggaattctgctttatcccttctctgaaaatctctcttcatatttaatctgatgctaattacctttttattccctccaaatgttaacacattcattcactcattaactgtccaatgaaaaatatgcccaaaatgccttgggtaataaatacgcggctaattgactaattgatcgaccgcccgggggatgcattcattgtctgcccaatgaacatcccgagggctgatcaatgcgtcgcgacactcttttgaggtggcgtcagatgaattgcgcgcgcgaattttggaaatgttgcgctcgtccgtcccgatttgtcgggaccactgaccgaccacgatataaattcttttcttcatcaattatttccatttccatccaaaacaaacaaattttggaaat

SEQ ID NO: 8306 - DNA, 3324 bp, Heterodera glycines
gagcagaggcgggggggggggggggcggtggtcaaaccgatcgacggacggacgccggaggatgacggaattgggccgactcattgacccctccggcgcacccatcgacggggacattctcttccccgcccgaagggccactccaattcaattctcacacaaactcagccctcccccccccttcccaacccctcgggggatgtatttcccccacccttctcccgaaactcacaaatattctcgcggttcgacaatcgatccgatgcaaattctccgccgtcgcgcccacaaaatgcggccaaaaagccacgaagagttggcttattttgttgtcagatcatttctcatttcatacactttctcaatttgttttttttatttgcggtcagttttccctttgtccctttcctttgattgctttcccccctttttccccttttttccctccgttgatcattttgttttctttccttccgccgctgattcatccaccgatcccttctcattcttcggccaaaaaactcgcaaaatgtgggaaaatgcgccgccattgcgtttccctcgccaaatgaccttcacggcgattaatcgcccaaatgcgcttaaaaagtgacttttgcttgggaaatgggccattctccgagtttttgtcccaaggaacggtccaaaattaaaagtccaaaaagtgaccaatcacttgggcattagtccgttttccgcaattcgcttcggtgcttttccaagtgattgttcgtgctaatcccttcgaattcatttgtccgctctggtccgatcagatttgctcccggattttgcagggtcggttctcccccccccccccattatccctccccctcttccgttactaatttgatcaacccaaattttccacccgtaaatgccgaaaagcctttaaattatgccttaagggcatttcaattaagagttcaagcgaccacctgcagcaaaatgttagacgaatttttactttcctatgaaaattagtcaaaattccttctcccctcgcatttgatgagtttcgccgattccgtcgcctctccgccgggagattagcgcggagattaggccaaaagagacgaaacaaaagtcacgccaaatcaaaggcccaaagggaacggaggggagaagggaagggaccagtctctgctgctgcacggaggtcgcgcagaaggcaaaagcaaaccatttttaggttcaaaaaaattacgatggaattccaaaagtggcgattgaccgtccattgagttaaatcactttgaatgcatagccgctcaaaaaaaaataattttaatgaaaattgaaaaagatactaatggcattagtcaattgccaatcggagttggcttggcacttcccaatgccatgctcttttcctcccctcatgaatccccccaattcctttcattttttctgttctttcccttctgatcgatcagctgttttgtccctcagtcgccgatcacttcgcttacgccaatagcaaattttaacgaatctttgagctttttcttcacaaaataacgacattctctcttttattcgcttttctcggataaaatttcagccgaatgaatgaaaattggaaattgatccgattcgatccgtcttccattcattttccttttctcatttctttgaaatatatttttgacattccttttttcaaatttttttaatcattttttaggttttatttttaaggaaaggcattcgacgaacgaatggcatttgttgggcatcccattttggcagtaagtgttgtcaaataaatttactaagttcctttcccattcatttcgctttaggacattcgcaagggtttccgtcttcggcccactcaaaccgtggacaaatccaagccgatcattcaggcggaaggggagcagctgaccgaactgcttcaaaaccgttcgccttcccccgcggagctgccccaagcgaaagccaacggagtgccaaaggcgacaaaggcaccgccgccggcaccgccgatgactcagcaaaagaatgaggcaaaaagacagcagcagacgatgacggcaaaggtgttgtatagaaaggactaatgaaaaatacttttaaaatttgtgacagccatcgccgaaaaacattggcaacggtcagtcggtgagtgccgaccaacggcaaaaaatgttggcacaaatccgttccggcggtgttcgtctgcggcacgtgcaaacagcagataaaagcgggctgattttggacgagcaacagaaatgcacaatcggcacgcgtaacggcgccgcgtcacctcagtcgttggactcgcaggggtgagggagcaaaacggggccaaccaaatgccaagcgcaaaacgcaccggtgaagcgtgccaataaaattgcatacctttcgagagtctcgactttcatgaacaattcatttgattctactaacaaatcttagccaatatttagtcgccctccccgcgcagaatctcaaaaataatttccgattaaattgtattcgactgatcaaacgcactaacgaaaaagagcgaattgaaagtgcaataaatagtcattagcacattaattacgaattgcttatgtatgtataacaataagccaaataaatgttttggtcatttaaaatttataaaagtgttggcacttttttacaatttccaataaatatttaagaaagagaattctttcttccaaatatcttttcccaaatcgcttttctctgctttatcttccttcccaaatctctttctcccttttccttttcctttgtcttttttctctttcttttctctctcattttctctcccatttgaatttcatttaattttgttaaacatttcccttttcttccttccttttgggctctcttcgcttttccccctttttatttttgcttcgcaaattgcccccttttccaccagaaagagtccctctccgcgcaccactccgtcctcctcctcaactccgtcctcctcctccgcgtcggccttttcgccgactccgatcagtgcgggaaaccgtggcggttgttggcaccgctcgccgtccggtgattcgtccgattcggtgccgttggccaatgggtgcgccgctgtgccgctgagtcatcccccgacggagcattttggccaccatcctgatcacactgatcactgctctgatcacttccatcaccatctttcacctgctgcttctcttctgccccctccgctcttttctcttccctctcctctctccgtctctttttcttcgctctctccccaaaaaatgcccgttggccgcgtggcgagtcccctgccaccagcgaaat

SEQ ID NO: 8307 - DNA, 1396 bp, Heterodera glycines
ttgaattattggggcccaaacgtgacggccaaccgtgccggcccaactgagctactccgttagcgtccaattcacaatgttaccaacaatttatattaattagtttagtacaattaaaaaataaacagagctttgattatatgtatcaaggatttactgaaaataatttaacttaatcggaattagaagaaaacaacaatttaattctttaaacatagttaaaattggtttttctctttcattttcataaaaattttcgctaggtatgttattttgtttaaaagtgtatcagtttgatatgccgtttttggataatatatccaaattaaaaactctgatttgcgaaaatggaatttggcccagaaaatgatttggtgctcaaaaaaaaattgattattttcaatattttttgaaaattggtatatattttttaattaaaattttcaacttaaatgatttacgggacgtgccgtttcgacgccgtaagaaataatttcttgttttattatctctaagaaaacatatgatttaacttattttaagtggattggaagctttgacctctgattaagaatttgatcaaagaaaaacaccctttgtattggttttgaatgcattggcattttttattacgccaatcattttttgctgcttttttttcttttataccgtccatgttgcggttttcgcgaaacgccctttttgtgtcgtcaccatttttgcggttttacgaaatgacgcggcacctttattttgcgactttttcgtccataatccggtcccgaaatattaaatatactatttttcattttaaattaatttatttggcgatatgatatctcaaatcttcttcccattttgtcttttgacatgatctttcttttccagtctttacttttttgaatttgtgatattgtgtcagcaaaacagccttctcgtttccgacgatttatttggattgtaatttcatcttcggatttcattctaatttgtattttgtttccgcattaaagtaattagcctaatcgtggtgtttgctttggtgcgtgttcgttcacctgcggcgaagtgaaaagaaaatattgttgtgcattacgccgaaataggcacgagaaaggtgaaaaaggcacaaataattgaaaaaaggcaaaaaaaagcaaaacaaaaacaattttcaaaatagaaaaataagtgcaaactttctaatattttatttcaaaaatgaagtaaattttaagaaaggaccatgaaaaatgaaattttatggcttcttgaatttttgtgaaaattttcaatttttatggggcgcattttttaaaaaatttggcccattcttagggttgtattttttatttttaaaattgtccgaattttttaacattcatttgcttaaaat

SEQ ID NO: 8308 - DNA, 1493 bp, Heterodera glycines
  misc_feature (54)..(54): n is a, c, g, or t
tttatttttaaaaatgttccgaattttttaacattcactttcttatgatccagncatgaaaaagcccgaaccccggacgctttgtctagcttagagtgcagcgggaccgggacctgaacacggacaactgagtacaactgagtaccaaggtcccggttttgaccagttttgaccgggaccgggaaattcccggctttttttcccggttttcacagccaaaaagtcccggtttttcaaccaaaaaagtctcggtcccggtcttgcccaaatttcccggtcccgctgcactctagtctagctcgaccccgacctagctgaccttgacaaaccccgaccccaacttttctcatcatgaagaattggacctaccctggcaaagagatgggtgagttaggtttggctcttttttaaattttggccaaaagatttgtagatttgtagcaattcatgcattaactgctctatttcaaacatttcaatgcaaaaagttaacctataaagaaatacactaaaacttaattaaaatttcatgcttaaaaaaactatgaaaatctacagtaaccaaataaacggctggccaattagtagggatgggaatttaagtcaaatgacttttttttttgcttactttaaatgaccttaaaatgagctaaaatgtgttttacactttgtttcaagcctcatagccaatagtaattaggaaaaaaggaaaattaaattttttttcgatttaaactcatgtaattcgaactgataactgaaataattgaaattaattgttatcaattatttttttatgtctgagtgggtccatttttattaaattaacaaaatatgtgtcgaatgatggaaacgtgtgtcgataatagggatgtgtgatagtctcggttctcgattcttgactcgggaaatttctcgggtttttcgcttctcggtctcgggtttttagtctcggaaaccgagaaatttttacactgttgaggatgaagaagaaaaactattgaaattttgaacaatttttcttaacaaattcattaaaatcccaaaaaattttcgtgtcggtgcctatcggcgccgccaacccacaaaattgccccaagatttcaaaaggcgaaacgtctgattttaggtgagtaggcaaaatgttgagtaggcgaagtgtcagtaggcgagatgtccagtaggagaaatgtaagtcggcgaaatgtccgattttgggctagtaggcgaaacgtacgattttgggttactaggcgaaatgtccagaaggcgaaatgtcgtcgtgcccggccggaccctcttgctccccaaaatttttgaaaatagtgaaacgcaaaaaaagcatttttaaaagcaaaaaaaggtcgtcaatttgatgttgagactcctgcgcataaattccagttgacctaccctttttatgtgtttttgaattaaaaaaaatacttttacattaatttaattaagatttctcgattcccgagtcgagaaat

SEQ ID NO: 8309 - DNA, 3190 bp, Heterodera glycines
cgagctcgattctcggtaaaaatcatttctcgcacatccccattcgttaaggcggcgccgataggcacgataagcgccgacgcgaaaatttttcaaatttaatttacaaattttgcaaaatattattttaaaactttttttgcaaaaaatataataaatttatattgttttttttgtaagatgtgtagagacgttatactatttaaatattttccaattttaattaaatttaaataggattattttttgaaaagataaaaatattatttcaaaaatgttgacttcttagcttgggaacctaacagagttatcctggcaaaaataaaatttttatttttttgtggtttacaagcaaattaattttttttttaaattttaatttattcattcttggttattgcccatcttagtgacttatttttttgaaatatattttcatgaggctcgtaattttgtagccaaaaaatacgaagtttttgaggttcgaagcacgaatcttaaagttcacacagccctggtcctgatcttgactttatcatttatttcgttagtcatgcacaaccttttttgacggctctttaatttcatgaaaagaagtgaaaaactcattaaaatttagatgtttggcaattaattggtcgtaatttgttgacactttgtccctgtcatattttcactgacaaaaaaagcgtgtgattttttacataagcatgcctgtaaatttgtatttaataatggggaaatttgtgtaaattttgaatgatttttctgttcccccataatttggtttgacttattataatttctatatatcagttgattaaaaacgtaattttaatttatttttaaattttgaaattaatcaacgtatgctaacacaaaaacatgaacacaacgacaccaactgacactgagcagtttcttttgttcctcggcggtgccgttgaactgttgataaattttgttggcattccgttgtccattgccaatttgattttggtggcacgcacatcggtcatccacccgaacatgaaagccattctcatcttccagagcctctttattatcttggtaaattaaattcaattaaatcaaagtatttaaataaaaacaagaaatgattattattctaaatttaagcgtggttcctgtcgttttgtcatctgtctgttcaaattcttcctttgggacccaattggtgccgaatctatgcaatttttcccggcacttttgaaaatatatttcatcggcatttatgctcgtaattttgtgccccatgttctgatcgttgaacgcattttgtccactttatttgtccgaacatatgaaaagaaacgtggccatctgttcactattctgtggacgccttttgcggtgagagtaatgacaattttattagccaattaaattatatttccagaaatgcctaaaaaacttaaaattattagttttttcataagccaaaaggtattttgataatgttgttaagcataatgttaagatgcatttaccgatgaattttatatgccaaatctgtttttttctgtcctatgtcactctaattcgagagatgattaattcttattcgataagatataagcgatcaatttttatttacagttgatcatcccaatttatattgccaccacaacgccttcaccacatgatcataagcaaccaataacgaatctgatcacaactgccgtccaattgctgctggtcggaagcattgagttaggcattttttacaaattaagccgatacaattccaaaatttatcaaaaaatgttccaaaatattggctcgaataatctgtcaattcgttatcaggtaatacatataaattaattatataatcattatttattttgaaagctctctgaaaacattcgcattggcaaacagctaattccaccgctgtttctgaatttgggcaacattttcgcggggacaatgattttattatgggactttcttgatttgccattttatatttatatattcaatttggctgcgattatcaactcaattttcggccttcttatcgaatttttcattataacgtaaacaaatgtaaaatttaaaatattaatttaatttaaaagttttaagatgccacccatttttgaaaagggatttatgccattttttgaaccgtattggcaaaatgtttggatttaatcttttggcctataatcatcgaattgctgatgcaactgtaaaagttggcacaaataatactgctccatctttgtctgctgtcaatggcattgctcaacggaatttgatcagcggaaaagcattgattgataaccaaacaaaaccagaagatcattttgccatgctgaaagaagcatgggagaaggggccgatgaaatgacaaaattaactgaaaaactttttgactcattctaattttggttgagaattaatgctttataaggaaaaaaccgaatcatttgggatttacatgaaatgccataatttgtgttataaattatatgattttgcatattttttctacgcatatgctatgaagaaaggggctcaaaaataccattactgcgttaaaattttggatttggtgaaggtttttagtgcatataaaagcatattttggggttttcgagaataaatgcatattttgccatttttgcatttttagagcatatttcggtcatttttggcaaattttaataagaaaaatgaaataaaaatgaaaatacaccccaaagattgaccttttggggaatttaaaaaatatagccttgaaactcggaaaattttgaattttttgcaagaactattgaaaaaattgttgatattagttgtttaagcatatgataaaaattttaaaaatctgtattttacacaattttggcatttttttgagggttaaagccattttgggtaatcccaaggcatatttgggcatttttccggtttttaagacatattttggggatttttagtgcatattttatgcgcatatttggcatttttttagtgcatacaactttgaaccctactcataattaataataaaatccataaaaaattaatttatggaattatttgccattgttctctttagaaaaataaaaatgaggaaaaattagaattttattattgttgcttcagctgtttgaattcttttgtaattcccgaaaattttcttccatctgtcaat

SEQ ID NO: 8310 - DNA, 1387 bp, Heterodera glycines
  misc_feature (133)..(133): n is a, c, g, or t
gaattggcatttggccatttcttgggcccctttttcccatccttttttcaacagggcaaaaagtttttttttgtttgtttggttatcaatcaatgctttgcggctgatcaaattccgtgagcaaatgccatgnacagcagcaagaaggggagcagtattatttgtgccaaatgttacagttgcatcaccaattcgatgattataggccaaatgattaaatccaaacattttaccaatacggttcaaaaattggcacaaatccctattcaaaaatggatggcatcttaaaacttttaaattaaattaatattttaagttttacatttgtttacgttataatgaaaaattcgataagaaggccgaaaattgagttgataatcgcagccaaattgaatatatgtatataaaatggcaaatcaagaaagccacataataaaatcattgtccccgcgaaaatgttgcccaaatttagaaacagtggcggtattagctgtttgccaatgcgaatgttttcagagagctttcaaaataaataatgattatataattaatttatatggattacctgataacgaattgacagattattcgagccaatattttggaacattttttgataaattttggaattgtatcggcttaattggtaaaaaatgcctaactcaatgcttccgaccagcaattggacggcagttgtgatcagattcattattggttgcttatgatcatgtggtgaaggcgttgtggtggcaatataaattgggatgatcaactgtaaataaaaattgatcgcttatatcttatcgaataagaattaatcatctctcgaattaagttttttaggcatttctggaaatataatttaattggctaataaaattgtcattactctcaccgcaaaaggcgtccacagaatagtgaacagatggccacgtttcttttcatatgttcggacaaataaagtggacaaaatgcgttcaacgatcagaacatggggcacaaaattacgagcataaatgccgatgaaatatattttcaaaagtgccgggaaaaattgcatagattcggcaccaattgggtcccaaaggaagaatttgaacagacagatgacaaaacgacaggaaccacgcttaaatttagaataataatcatttcttgtttttatttaaatactttgatttaattgaatttaatttaccaagataataaagagactctggaagatgagaatggctttcatgttcgggtggatgaccgatgtgcgtgccaccaaaatcaaattggcaatggacaacggaatgccaacaaaatttatcaacagttcaacggcaccgccgaggaacaaaagaaactgctcagtgtcagttggtgtcgttgtgttcatgtt

SEQ ID NO: 8311 - DNA, 5975 bp, Heterodera glycines
tttttgcctcagattccaatgttgtgctcgagtcgtccgtttcggaagaagccaccaaagtggtggagcgcagcaaaagcacgcgcctttaccacccaatcacttccctccgccgcgcactcaccgattggctgccgcaattttaccacggcccggggcccgccattccgccgctgagccaacgcgaaacgcaaagcattgcgacggtcatcggatcgagcgcgatgagagcatcgtcagaagtgccaccgccacagatcagaacatgcgaaggtggcaaaatggcagcaaagggcaaaaacaaaaaaaaaaggacacggaaaaacggacttgggagaggaaaaaaaccgaagtagttcgtttcccccctcccctcaaaaaattgaaggaaaaaaacaaactgaaatttttcaaaaaagtcataaatttataaaaaattgcaaaaaaaaaaactgaaaaattttccaatgcttttccaaagtttcaaataaattgttatttttaaaaaatttcctatattaagattttttctgtttgaaagtttttaaatttcgggggggaaacgactcgtgggatacggtggaggaaaaatgaagtgcacctaaaaagatttatccctggcaaaaaaggcctcggagaggtttcccctgacaatttgaccactggccaatgcttagactgtctatttgctcccttaaaattttggaatttgaaagtaactctgcaggcaatgagctgttgaccgatttgcccaccccaatttacacgtcgccaatcggaagtgcaaccacagtgactgtgcaggcgtttcccctctccgaagcgatcattggcgtcgtcgaggcgcacgacacatcttcgacctccaaagagcctcaaacggtcaattcgctcaccgtaaattataacgaaccgatggaaattccaatttccgcgaaaaaggttggcctataaaaggaaacaatcaactttatgtgggcaattaggaagaacggcggatgtcagtgacgggaaaagccaattcaatggaaatgggtgaggaggagccatcttcaagaacgccggaggcagcaaaccgacaaataggcggtgaaacgcaaccaatgaccgatttcaatggcccgaccggcggcgaaatcgacttggaaaacttggcactgtttgtggacatgttcgtgccaattaactccgaccagtttcatcagatttattattcgctttcagtttctatttaccattcgattacggaaaacggggggccgggcttttcaatgagctgaaatggctgtacgaaaatgcccaacttttgcacaccgaagggcccgagagcagcaagtgcgaggaatggcatcgccgtttcaaagagttcagcagcacggccaaccaactgacggagctgtacaaaaatgtcattcgcttgccgaacaaagtgtggtttctgccttcccctcccccttctctcttctgtcctttcatttctgttcttcacttttagagtcttttgcaagaaatttttccatatttatgggaggcgcaaggacttttgtctgttctttgcgcgttgctcaaatggatgcgcaagggaaaccttctcattgcaccgacaggtcactcaatcaatcgtgggtttaatttgcattttcatatttcagaatcggccacttggggactcgaagacgtcgactacgactcggagccgtgggccctcggcggtggtcttttgcccgacatgcaaaggctcgtgatctcttcggccaaagttggcgaaattttcacggttaaatacgcgattccgctgtccctcacttgctacactatccaacccgtggatttgctcagtttggacaaggtttcctcatccccccctctttgaattttccctccgttcagtcgctgctcttcgatctgttcgccctgtccgatgagcaacttcttgccaactccgccatttctctgcccggcaattcgtcgcttcgtcccgaagagtttttcttcgacctcaacttcgccccgttccttaaatacggtgccccgtcccatcacttcgctgccgaatgtgcggacggaggagaggccgacgacggagaggcgaattcaaaaggcctttgctcattggcacttggcattctgaacgcgtcaggcctcgtggaaagcttcaattccgaatgtattgtcaaattccggcaaaagtattacccgtctctctcaagtgaacaacaaatggaggacgactcttcccagtcgcccggagatgtaccaatggaattaatgccattctattttaatctttccattcactcagagcacgtcgcttgactcggagattgcccataggttatccgttccgttgcgtctgaccagcgactttctcgcctccttccccagcctcgtcgagattcgctggctgatgggctctaatgaggcggtctccgtccgtcgtctcctccactgcgtttccgcctctttggctttgaacggtcagacaatgcccatttaaatattcgtttgtttgtttcctttccactttaaaggttccaacgggtttttcactatcgtcagctccgattgtgaggagcgtgtcgaattgctcacccgactcggcctccaaccactagtccaccgcgacatcgacgggttaatggatggatttgtggtgatgggccatgctctttgattcgccatgaaggaaaagaagcagcccacgttctttctctcccccccccccgtttttttgacactgtttcacaaatctttaatgttaaattgtacctttcctaattatgtttccatataatcagtcaaaactaggctttctctgtttgttattgtccaaaattccgcatggccatcggtctcccccaagatcattgttttgaaaacttgaaatggaatgccaaaaacacacatggggttggactttcaaacaaagagcgtagccaggcccttgagcgactaccatgtttttacttttgtgtcaaattttaaggaaatttgggcccgaaggtgctgataggcgtcgcttgggaaatttgagatttttgatgaaatttcttaaaagtggtacttttttcgagtttccaaattttcgttaaaacacccttttttcgaactccccatgatattaaaaatgttcactgtaccgaaatgaatgcctcgatttccattcgcttctctcatttccaattccctcgtccctcccattcgctttgcccttgtctcacctatcacttaatcatcaaattaatacctaattaccaatggtcgttgtcaacgaataaaaaaacaaccctcattaatttcctgcaattcgtctccattgtttttaactatcattttgagtcatccacaaacccacacaaatatttttatttattcaccattttttgtattatggttacatcacattttcgtgataaatttttatgtattcccgattaaaagggccgtgatattggttggtgaatttgatttgaaaattctttggtttatagcctttaatctcttattcaaattcatttagctttcgatttcattttttggtttcagcgcgtttggatgaaatttaatccgtcgcattttccgtttcgattgatccctcatggttctttttgccaatatagtcctcgggccaacgatacatgctcttcggcattcgacgatcctttcccaacaaagccttacaggcgaaaatacggactcgttacggaaacagctgatctattcagcttatgctcctttactaatgctaacaactgctcatctgtatgacatttttatggtatttccatttccccaggtggtgacagtgacactcattagggcgatggacggggccaaagtggcgaagaagggtgcggcatttttagaaaaaagctaaatatttgtacattcctacgacgatgacgactacttctcgaacgacggaattaattgcttgtgcttctcaatctccactagtgtttatttcggtttctgaacgtgtttaaagcttgaaaaggcaaaattaattagcatacaaagtaatctgaatggactcgggggatgcacatcagatgcgggtaaataaaaaagggtcgagattagcggggacagagctagagcaccacaaaatgagaatttggactaaagtattgaaaagtcaaaggccgtttcctcattgtctgcgtaaaccgtcttcacagtttcagtgtccactgcttcacattcgagtcttggccaacagtaagcagtcgattgtcggaaagccaagcaactccgttgatggcactcatcgaatgggcaccgcggatgactagcggatgttcaccgctttgttgcaagtcccaaaccatcacattggtgtcgagagaacccgtggcgatgtaccgactgaagacaaagagtggccactttatttgaatgcattgtttacccctgcccatgaaaaattattatttaactgatttttaaattccttaaaacggattcgggatttgtaattagttggaatttatgttcttattcataatcagcgaccccaaagatcttcgtaatttttgcaaagggaggacagcggtcaattttgcgaaaactcagccatgtaaacggacgattttttttttgcttaaaacccgttttgttgcggcgctcttttttaaaaattttccgggaacgccggtatgaaaaattttagtaatttttgatgaaatttgttaatagatttgtccaaaaatttagtaaagttttttcataagtcagtaccacgccattaacatataatcaacctgttgctggaccaggcgcagcagttgatccgggctgtatgaaaagaccattctttttcagatgccactttgaaaccgtcgtccacactgtaaggcaccacctgaaggcaaaaggcagataatgacccgaaagtgccaaagtgtccacttttctggcaatgtccgtggccaccaaatacttcccatttgggctgaagttcaccgaggttatggcacctgcatgttgtaatacttttttctcaacaaatgcgccgccgttggtaggcaaatcgtacaaatgcacgcgactgtcctaaaggacaaaataaaaataattttttttgaaatttttacatttcctccaactgccaaaagaattccattggggtgaatggcaacagaagtaccttcgtactttatatcgataacgcttgattgttttttgtcggtgaaaatgaaaatggagcgatggcatgcgaccgcaactctttccccgttttgcccaatgctcgccacaccgcgtggttgggaggacaaacggtgggaaagcgactgaacattttctaaaagaatatatgtaaagaaaagctataaaaaccaaaaccgaccaatggaaggggaaagggcattttcaatgaaagcgaccgaatcgtcccatccgatggaaatgagcaaaccgccgctggtcaaactcagcccggacacttgcgacttgtgcacttggggagtcactcgttcagaagagccatccgagacattccaacgggctgagttttcaggttagaaaataaatattaaattcctaaattaagaagtttcctcacttatatgtccctcaaagtcagcagtgaatgccattcgtcgatcttcggacagcgtcaacgcggtgatggatttgttatgtcctctgagcactcggcagactttcagtgtctcggggcaaatgtaattgatgaagccgctcaatgagacactgacgatccaattcctaagccaaaccacggccaattgttggtcttctatggccgagccgaaggacaccgtcctaaaaggaatgtcaaatatggcattatttggaatggcaacccaattagttttcgtccaggcacatcccaaattttgatggttttgtcgccggaagcggtggccaattttatgccacccgaatgccaattcaacgcgaacactccgccgctatgcgcggctgcgcctttgcacgtttcgtccaccaat

SEQ ID NO: 8312 - DNA, 1747 bp, Heterodera glycines
tgttaattacgccaaatgcaaattaatgtcaaccgaaacggactgattgtgtggttcccaaaaacggattttgcccgattggtctccactggcaatgtaaaactcagagggggaatattttgccacggttgtcaaagtcgcgtgctccgtatacacatcacaatcggcaatattctggaaaatggaatttaaaacattgaaaatgaaccgccaaccaatccgaatcacatacttcctcgtctctgatgaacacgctatttccattgcagtaaaggaatttggttccatccgaattcgacgaaacaaccaaaggcattccacgcacagtgcgcggaagtgaggcaaaagtgcattctgaaaggaacacgtatataaattgaataaattcactgattgttgttcgtttattttaccattaccttttttaaattcttcgtccgaagatgtcatttgtgaatatttttgtttgagattctttttaaccctaaaatatgtacatacagtcatggtcaaaagtattgcaccaaaaaaattttttttttttttgaaaaatacgattttctcaaaaatgaatcgtgtgaaaaaggttgtattttatttactaccaaagaaacgttattaatgcactaataaataccaaaactgccccgatgactttctttgccgtatagaaaatcggtcatgactcaaacaacctcccctttttggggtacttatgcagtttaggccacataaattttttgttttgtttttaattataaaaacgtgtttccaggggtattcggggccgctttattgcccaaaaacgattaaattagactgaattgaatagaaaataggggattcatggccattccatgcatttgaatagtttttgggcaataaacgtggattttggcgaaaatgaattttcgactttgattcggattcgggtttttatgtttaagtcgtagacccatcatctcggtgagaattttgtcctcctctttctgacagacctactcaaatttccaaaaaaatttccctattttaagtttattttggggtgttcagatcactataaaggagtgatctgacggtccaaaagaatttttgatcaacatcaaaagtagtttagaggaatttttcgaccgagaaaatcaacttcaaaaaactatttttatgcatgtacgtatgaaaaatttttgaataatatctcaactcaagaaaagtcaggttttttgtctccaactcggtcgttcgggaaattttcggtctcgaaggcacaaagaaacgtcaagtgactaatcaaagaacttaaataaatgacgaaacccaatgcaaagcacacacagccgcttaaaagctgtttagccgaacaaaatgaatcaaaatcaattgaccccctcgcgactgagtaaagagcattcacgcaatcgatacataggattttcaattttatcaaaacatttatgtagtgaaaaatggatggataaattggttgtaaaatgcgggatcattgttcattgttacattcgtgaaaacagatgttttactaacaaagtctaaccacccaaggtaataaaaaatataaatattaatgatacagactgaaaccgaacataggtataatttgtcccatcaaatgacatttacaaggcccaagggttattttgggtggctgactccatacattctttcgagccacgataaaaaaaaagatatcagaaagcaaaatttatatgccttgcagttaaaaatctcaaga

SEQ ID NO: 8313 - DNA, 3702 bp, Heterodera glycines
tgatgtaataaaaaatatattaattttattttttttataatttttacttagttttaattgtcacataaatcactgccccattggatgctattccaatcgtcccaattatacaaaatgccagcgcaaaagcaatgaacgtccaacaaggatgttcatccatgtaacgcatgtaaagctgaaaagcgaaataaaaaattgtaaggtttttacaaagaaggtcaaagggtactgtatttttgagtctgatcccaaatgagaaggacataaattttcaatttttgaagtataagccgagcttggccgagaccaataatgtacaatcagatggctgacgaatattaaattgaaaatttaccaaaaaaattccatatttgtcattattcattacggtacaggcatctcacggatcgaaaacaagggcgatctcggatgtataaaacaaatccgttctactcccgctaattttagttgctcatctatgacatgctaactatttttttaaataaattcaaaaatgtgtaccgaatatccaatagggtccaccgcagaaaaattcattcttttaaaatttcagccgacaattgtaaattcagggctttcaaaagttgaaataatgctattgtgatttaatgtgttcatttgacgcgcaatttaattattataattaaattctcgacagtgcgtttctgatgagtgccattaaagcaaataaatgtttatctaatacataaagcaatttacggttgaaacaactgagataaaaaaccaagaattcagaagagaaattagattaatgtattttgtttggtgctgttagttttcgacaatactattgcgatttaatttgtgcatttgacgaacatggggaaaaagtgccaatgaaatggcatttttatgcgcaaaaatacataattgttattattaataaattatgattaagtcaaataatattcaattcgatttaaagtgtaactgagacaaagtatcaaataagacagagaagaaatttgctattagatttaataatttttgttgcgctattttccaagttttgaagcgtttcttcataaattactggcatctaataaaattttttaattaatgtcgctgtgaattttagtcaaatgacttttttctgattttaaatagccttaaaatgacttaaaaagttatctactttgttgatgcttatatctagggccccgacttttagtgacgaaaaatcgcaaaatatttagctaaaatagtgacgacaaagtgccaaaatagtgaaaaaaatccaaaatagtgacgaatagtgacataattttcagccaaaaattaagcaaaaaatttttttattcactgattgcagttgcaaatgaagtaaatttactttctaataatttcgtggcaaatattgaaattttaaaccaaaaattttgtaaagaaaaaaaaatttggtggatgaatttttaagaaaatttttaggtcgattcttaggggtgtattttttgtttttttggcatttttgttaataaattttactaaaaatgtcgaaatagtgaaaaatagtgacaaaaagccaaaaaagtgaattttcactattttaagtgacaaaactccaaaatagtgatttctagtgacgaaaaatgacgtccaaatgaaaaaattttaacgcagaaatgcgttttttgagctcctttcttcaaatcaattgagcaaaaaaaaagttttttcactagaaatcggtgccctacttatatcatacattttttactttttgagatttttatgaattttttaaattttttaaattatgactttttatcgtttttatatggctttttcatactttttgacgatgaattttttaatcgactgttggcaatttttagtgaattaaatacagtcctattaattaattcattttttggatcgctagaaagttgcaaaaaaagctcttttttatcaaaaatgaatagctcccggtcgtttcgacagcaaaggaattttcgacagtaaacataaaaacaaataattcttattaaaataaattatattacttgtcagttttactaaatttcttttaaattaagttactaatatgtattgcttgttaataggaatatgattttacgttttttacctagaaaaacttcagaaaaatacacccttaagaattggcccttaaaattttaaaaacacacccctaacaaaggagggcccccaagtgaatgtggagtttcgggatgaaacttggtgggtgggtagatttaccccggtttgttatgtgaattttttaccgtttttgctgaatggacatgttcgccgagttatgcggcttttccttttttccttccttatataatttgcaaagaaaataaaagcaatgtggttatgcctgtggctttactttttccccaaaaagttcgaatcccacgattttaatttaattttttttgttcacaattaaatattttttatcagatcattatcaaaatacattgttttgatcaaattattatttttttaatttttgctaaagaaattaattcattttttggacgaaaaatgtatgcaaacaaaaatgacctagttcgcttatcagcatggggaaagtgctttcggtggaccttttatatcataattcagaacaaatacctcgagaattccccccccccccccaaaatgccaataaatccgacaaatgtaatccatttaatggaagagtattatcatggtaatgctccaaatccatcgccaatcactgtcgaggagaagcaattggcagaagattttttgaaaactttgattttttgtgcgaataaaagcggcgaaattgagattagcgaagagctggtgttggatgattttgccaattttcatcaaaaggaagatcaggcagtcctatagaatcttcatcatcaagctatgccccctctcctaaaaaaattttcaatactgatttcgcctaattttgtggtttgagaaaattttacgatttacacccccttaaatttgaaacgaaacttaattactttttacagtcgaaaagtcccctcctaaatttataatatttctatcgaaaagtcctttgctgtcgaaaagtccggcgcccaaatgaattgctgcataacattttttagcatcaaaatgaaaaaacaatggttcttttcacaatataaagtaatgcatggaaaatgaattcggaaaaacagtaaattctaccgtatcttcacaaatgagtcctttcaacaaaagtacagtttggtgaacggattgtcattgtccagcggagtgttgcagaagggacaaattttgtgaaagccttgtccgccatttgggattagtgtctttgaccaatgtctgtatgtaaagatattgattgttacagtagtaatcgatgtttatatagaataagtccacaaatatgatcatataacatgaataaaatatgcataacaactgcaaacaatggccaatgattgaatgaaaactgccaaagccatcggaaatgccaaaaaacataattaaaaataaaattgtgcaaaataaaaatgagcataaagtggtcaatacaatttattatttttacaattaatcctgaaaatagactaattttagaactttaatatttgtcaaataaataattcagaaatatttttttgataagaactttaggagatctttttgagaaatataattaattttctcccaaca

SEQ ID NO: 8314 - DNA, 2597 bp, Heterodera glycines
  misc_feature (19)..(19): n is a, c, g, or t
  misc_feature (33)..(33): n is a, c, g, or t
  misc_feature (42)..(42): n is a, c, g, or t
  misc_feature (64)..(64): n is a, c, g, or t
  misc_feature (96)..(96): n is a, c, g, or t
aaaatgttattcaaaatgnttcttctgagtaantttttaganaatattttttacccaattattnaaaatatgaaatgatgagttacttcaatttgnttgttttccaggaagcaattctcccatttaccaggagagcgcacttctcttttcgagtaaatgttgccgttaacggacactaaattaattgacttaactttttttacattaattttaattttaaatttggcattatttaagcaattctgaaaaaaatgagaaatttctcaaatttttgaattatttttttcaaaatgatgacaattaccttctttccaacaatttggagaaatttcgctgtctgattcattttcatcatcatcattgtttgaagaggaagctgataaataaacggaggcaccctgaaaataaaaaaaattttaaataaattttctctgtttctcttttacctcatcgtcattatcattgggtgaaagaattagcacaccattagtaaccaaaccatcaaattgaccatttgacttttctattttatttgcgtctgggcccaaaaataactgaatgaataaaaataaataaattatgttttaattgttttgttttgaaactctaaataaattttataggttgtccatttcatcaaatttacagcattttagtgtgtattgtcaattttgcctattatttacgcataaaaaatatctctaaaaaatttgtgtcacaatcagaatagttttcaggacaaaataattttcaaattttatttcttcacttccaaaaatttttcataaaaaaaaactagaaaaatccacgtccacatcagaaaagttatttgtgcaggacaaatgtcttttaaaaattaaaaattaattttctttttttttaattaagacttctgtctgaacgaatggagaggaataataattttatttaaattttttaaaatttaaataatgaagccatttatgtacatcatttgaatcgtcaaagccagccgcgtaaatgtacacattgttgggggcattacgctcggccacaatgcgacaagcaaaccgagaaattgtcgtaaggtgatcaatgacgaagtcaatcttttcgctattttctctcccaatctttatttaattaagttttaagaaaattataacatcttttaacagatacaaggtcagagatcacggatttggaaaacattttggtggttttgggggcaaaataattgttttagttgagagttttgtggctttttattaattttgcttttataagctcataaaagatcatcaacagttttcgaatgatggctaatttttcaaatggattgtgggatacaaatccattctcaccgtgatttgggtgatctctgtttctgaattattttcagataaaatcaattttttcgctattttctctcccaagctttatttaattaaattttaaaacaaattataacagctatttaacagatataaggccagagaacacggatttggaaaatattttgcgatttctggaggccaaaaaaggtattttgcagctattaaaaattttatggtttgctaagctaataaattcattaataatttttgaaatttttaaatagaatttcggattgtaaatctcttgccaaaactaattagagctgctctctgtccctaattattttttgatgaaatctcttcgacctgaaacatatcccggtttgggtcctgactgtattgagcaatcacttgttgtatgtcgctgaatgagaatgttattgagtgtgtggtggtgtcctcttcatcattggcactaattggccatggcatcggataatttggccattggttattggcccgtgcagttcttccgatcattgcagatgggttttgttggatgccatttggctcggcacgctgatcaaagttcattttcacgccggtctttccgaccaaaattaattggccgtagctgatcagtggttggcttacggaagcagcagcatctggtttcttcgcattgtatgatgggactttaacgaaaatttaaaattaaattaaaaaaattaaatcgaaaaatttcaattgttttttcattataataatttgtaataaaaaaaattgacctgacaatacaaacaaaatgagaagaagttgcgaaatttgagagcaaattttcatttctaacaatatgtgtaaggtataataatgtgcacagataaaaataatttttattttttttattttattgacaagaaaattgattttaaatgctttgaagaaatgttggcaaagggaatacgaaatattttcatggatataaaaatatatttgtaatttaggtaattttaaaatttttttacatttttatgattaagaaatcttcatttaatatcattaataatcgaatattcttatataataaaacggaagatttcacctttttttttcgttttaaccaaatataaaaatttggacaataaaaattatataaatttaataatgaaaaaatgataggtaatggtgcaatttccataaataaagcaattaattgttgggtttccttcaaatttatcattttttctaatctcttttaaaggggatcgattctgaaagcgg

SEQ ID NO: 8315 - DNA, 1769 bp, Heterodera glycines
tcaaaaaatgaaatcatttcatagggatcgcacaattagggatggatacattttattttgtctgtgggacaattgacaaaattttaacaattctcatataaattatgcgcacaaaagttcgccataccttcaggccctgaatgtcccccttgacgacaagaagttggggcaaatttcggaagtcttgcaacacctgtggtaaataatgaaagtataataatgacatgactaattagtggtaaagcataatttgatcaattccttaaccaattttttctctgctcttgttgtccccgccccttgcctctctatccccttaactttgtctatttaaacgaatggctttatgcccattttttgtggaaaatttttgaaaacttcagtaaattaaagaattcgtttcattaatttcgaaacactgaacctattagtgcctacagcaaaatcttcgattaaatttcattttgataaaaaaaaacatcatcagcacctcataattgcgacagccgtgcacaatcattttctttaaacgcttgtgctgcgacaatcgttccacagtgactcggttgatcttttcaaggtccagctcgcgcaaataaacaaacttttaaaaatttaaaatgtcaattaagaggattagaaatagctcaataaattctacataaattgaaaaaacaactatttttatatcctcttttaaaatttagtttttttttcataaatttcgacaaaaatacttgaagcgttaatattcttcaacatcttatttttgattctaaaataggctaaaaccaaaaaatgccaaaaagttgcaaaaaattgagtagatttaattttgatttgtaaccaaaaaataaaaataaatttcactccaactgcggtagcattcattataaaaaaaaatgttcacctctaactggggtaaatggttagccaaaaagccaaacagcgaatcgggcaaaaatgggtagtccaatggacggtccaccagacagactctctcaattcgatgcttccactgctccatcagtcgaagcaagtcgcgctaacaaataaatgttatacagaatatggctgttttcatttatttgttaatcctgacatttttctgtcaaattatctccacaaaaaatttctgcaaagttattgtttttaaaacaatttgtatatataaaaaataataaaaaagtttcagctaaaaacacaaattttataagaaaaaaagcgttggaatattttttgagggggggggcaataattccataattggtaactccgcgccctacctcatgtcgatcaaaatggcatgagcagcaaaaaacatagagaacgcgacgactccaaaacacagggccatccaagctaaaaaaataaatattctttacaccaattttgtacacagcaatgttaatacttctttgaaaaaattctgaacaaggttcttacatatgaattttagtattacataaaattttcttttttgataattttttaaaatttatttctaaggcgaataatagtgaaaaccaaaaaaataataattgttttgggtgggtgattaatgtcatcgaagattggattaatattttaaaaaaaatttaaatttatttttattattttgggtgattaagtcatcgaagatttgattaatattttaaaaaaatttaaaataattttattttatttttttctatgctttttccaaccaaaaatatgcatagttaaaaaaaaagtaaaaaataaactgcaagccgcaggattcgaacctg

SEQ ID NO: 8316 - DNA, 3226 bp, Heterodera glycines
  misc_feature (3183)..(3183): n is a, c, g, or t
tctcaaaaccgaaacaaaaggacggtgatcatgacaatgtccatttcgcccaaagagtatgcttttacactaaaattctgtgggtcttaggctgattatttaaaaaaaagaaattttggtcaaacggtgccgacaaagggatttaaagaaattttgaattacgagagaacaacaatttgatcaatgatcacacaacgaataataataaacgtccgactagatattttgattcatttgaggattatcccgatttgaggacttgctaaaattaaaaaactcgtgaaaacaaagaaaaataactttcccatggaccaacggattaaatataacaaaaaacactccttattgggtcgtccaagttttcaaaatcagtcactatcaaactaaaattcgtatcacgaaaatttcaattaacgacattacgcaatttcagatacgattttggacacattaagcaattttccctccattttgggagccgtgccgaccctttcactttcgtaacttttgacgatggtaaaatgctttttctttttttcttttttaattatttatgcttttccttccaaggaattcttttcaccaacaaaagtgaggatattcttccgtcaattttccttcggactgttccaatgggcgccgttttgcgcgattttgtcggcctttggatgttgggcttggacattttgccattcagtcacctgcacgacgtcgaactgttcacctacaggggctgcaactgtaccatggacgcctgggttggacaaaacgatgattggctaattaattaacaatgaaaagactgttatgtgtcaaaaatttttggactgaagggaggggtcaaccatcttcccctttttctccctctcactatagcgcacgctctctctcttccctctctctcttcactctctctctccttctctctctttctctctccctcactctctctctctcttttttctctttcattctctctctccctctctttcttcacctccttttatttttctctctctctctttctttctctctctttctctttcccactctatctcaccagtctctcaccagtctctcactctatctcacctgtctctatctctccatctctctctctcgttttcttttttctctctctctctctctctatcttttcacctccttcactttttatctccctctctctttctctctctctctttctttctgttttctctatttctctctccgtctctctttctctctctccttctctctcttttcacatccttctcgatttctctctctctctcactctctccccgtcctgtctctctctctccctctctttctttctctctctgtctctccctctctctttctcactctctctcccgtgtctctctctcgctctccctctctttcttcctctctctctctttttctctttctctcttcctctctctttttacctccttctctctctctttctctctctctccatctcactctctttattcttctctctctctctctctcttttccactctttctcactcttcctctcactatagcgcgcgctctctctctttcgctttctttctccctccctcaccctctttctttttttctctctcacttcctctctctctccttctctctctttttcttccaaacacatataaattttttttgggcacattattttttagtgatcaactaaccgtaaaaaatggttaggtgccgaaaaaattcctatagagctggaaaaagctcttgcaaaaaatttatgacgagcaaaaagaaaataaaatttccacaaatttcttttaatttttagtgtgacttgtaagcctaaaaaactaacaaattaattaactcaaattaaaaataaaatgtaaaatgccatttttaaaaagttcaccaaaccgaccgactcggaagagccttcgatggacgattttcacatttccgctggaacaaaaaattgcaattattcaattgaacaacaatcattcaacatcgaagcagtggagaaataccacagcaaagattttgcgattccaatcatagcattaattgatgaaaacttcagcgaaatcgacgtgaaattgacaggtcttccgacaccaaaaattatttaatttggcattaaatccaacagaagatttataatattatgggtgaattgtttgttggcaaatcacattaaaagtaatttcctctgcttttaaagcagggttcgatctcaaaattttgaaatccccatttcagccataaaaaatcctcatttgccactaaaatacctcaaaaaacctcatttggaattaagttctcattttttaaaacctcataaaattgcgaacaaaatcagtcaactgtcatatttttcgtttgaaacaatcacggcgcctatcagcgccgccggacctatttttttttttaaaaattggcccaagaatcgcaaaatttgtaagttttggtaaaaatttataacaatctcatttaaaacgaccaaacaaataaaaaattcgatttttattgttttaataaattgacaattctcttaaattttttgcttttaattgcttttttgtgcgtggtttttccaaaaaaaaactttttgggaacgttgggagggcattgccgataggcgttgccggaaaaaatttgagattttgagtgcgatttgttaacagattttgtcaaaaaatgatttgactgagggtttttcgaaaaaatttttaagatttgaagaaaagttcgaacattttgccaaatatacctaatttttcaaaaaatcatgcgtttttgtcactttttttttatcaaaaaaccacaaaaatccgcaaatcctcattttaaaagcatttttcagatgcaaataacagaagtttaatggaatttcacattggcacaaatcggtctctgaatgtcacatttcccgacgtaaaaaatggaaaaatattaatataaaatacataatatttatttttttattttaaacattattttaaaatataattatttttaataatattttaattaaaaaaggtgtcgccttatgaccaaaatttcgcaacattgccaaatggaagtttcacaatgattctgtgggtggcactgcgcaagaacagttacgaaattatgttgaatgacacggcgttggacaacagacaattttggccaaatgattggtgngaggggtcgggacgagagaatgtcacacatatcgtggtaaaaa

SEQ ID NO: 8317 - DNA, 2682 bp, Heterodera glycines
  misc_feature (24)..(24): n is a, c, g, or t
aattaaaaacgtgcataaattgtntgaaatgttctggtttttattaaactaacaataaggcttttcaaagtctaataaggctttttctttttattctttttgtaaatagaaaaaaagtttttctcatttattattactttttaaaaccaaatcacaattattaaaatttataatatttttattgtttatttatttatttaagttgagtggtaaaatgctattacttgaggagccaataacaaaccaaattgaggttaaaagctataattagtggcaagaaaaggaaaacgataattcagataaaagaacctgtaaagcttacttacaccaaattctatcggaaaatatgcaacggcgtacagtttacattccgcctccaactgcagaatgaaaccgaccagttcaaaatcagtttgttacacgacagaccggaacaccacgacagaagtgatcaaaatttaaattaattaattattataatccattaagcaaataaataataatgtaataattcagttggctcaacagtttttgaaattgaagtcgcactaccaagcaacttcactttcgtcgttcattatgtgaggaaatgggttttttacttaaattcttaccaatataaaattgattttcaatataagagaattggaaaaatgttatgaggctttggcctgaagcttttccttacaatttcaaaaaatataaaacaatttttagtacggtattagaacatctaacaatggaagcctaaccttaaatgtcgacgatcagagagaatatgagtttaaactcattatcagtgacacatataaattcattgtgaatagaactttgttttacgaacagaacacaagcattacgccggcttgggcaataaattttgtccgggtaattaacgtactaattgggcaattaacacttttattgaaaaggtggaaggcaatgtgaatctactcgaagagccatcagtgaacatttcaaaggtaagttttaattttatgaaaaagtgtcaatttcttaaatgattatcgactagccgttttgacaactttttctttgagtttagtgcagaaaatcggaaaaaaatgccagaacaatggaactctcttcagtgctaaactacggagatgttgtgacaatccaaggaaagtttaataaactcaagccagaactgaacatttatttgcttcacgaggcagcggaagcggacacaaaaagtgagtgacgagaatttcgtaataaaatttatcagtgaaatggtcgcaagtgtcagaaccgaaaagcctggaaattattctgagtaaatttaaattttgctgaaaaactcacataaccagcattcgtcagtggaagggggcaaattggcggcatgtccgtgccgagaaaattaagacgatagaattttatttgagttgataaaagctaaaaatttaaccaattcgagaaatatggttttattattacataagtacaaatcttttaagcggctacggatgcaaccgttggtgacgtgctgttgcatttgcattttgattttaatactacaaaaatcaaatgcgcccataaaatatattcggtgaattttttcctaataaaataaaattaaattaaattttacattcaaggaaaaaaaatatgttgatggaaagaacacattcttaactgacatattattgtacgaatctcaaccattcatattgcaaattctgatggctgatgatggcttctacggaagcatttcgagatcggattataccaaattttgtgattattacgtcgcccaaatcaatcatgagaaagcaataatgccctttccgccttttgccattgaccatattcaagtaatattaaaggcgaaattttaaaaattaggctggaggcttttttgtattttctgagactttttattaagttggaaaaatattcaaaattgcataaaaataccaaaaaatacaacaaaaaaaaaatcccggggcttattgataatgttagattaaaaacttttttatattattcaaaatttgaaaatcaattccacgtccaggtccgagcttttttcaaaatgtcaaactcaaataaatacccatcaatcccttcccctcccactttcagatcgatggcgatttgaaaccggtaaaaggaatcaaactgattcaagttattctgcctaataactcaacacattttttggatgacaaaaataaaacgattaattgtacgcccctcccatacaaacaaatcaatcggaccgatgggcttttgaaagtgaatgaaagcataattgtgatgatggagttgaggggatttaaccccggggaaaagcaagaagtgggcgtgttcttctacaaccaggcaattggctaccacgacctcagtgagtggtgacaatttcattaataaatgccattaaaaaggggcggggtggggcttaaagcaagcaacagattaaatttgaaaatattttttaattcagtgcgaatccgaagatggcatttcaatggaactgtattctttgcttaattatggagaattagtgaaaattgaaggacgagtggatcgtaatgccacagtaatcaaaatttatttgtttcatgaagtggcgcaattcaccgaaatgagttaattaaattcaaaattaaataatatatatacaattttctacattctatctttttatttatt

SEQ ID NO: 8318 - DNA, 1098 bp, Heterodera glycines
ccccatttacggaatgatagcgccaaccctaacttttccggaatttctttctgggcgagtttgattgtgaaaattttggaaaaacgcctatgtctttttttgctcaacactctagacaatttcaacaccccattcccccccccccccccccccctcgcatctcggttttcaaaagtcaattctgcaccagagaagattcgggagttggaaccaaaaacacttaattgaattgattataaattaccaaaaactcacaacaaagaaaattggaacaattatccaaacaatgcagagttatcttttaatgatttttttcatacagttggcaaaactgtgctgaaaatattactgaccgataaacagctcatcttcagccgacattatgtgagtaaacaactgtttggcattctattttatttaaaaaattgttaatatttaattatttgcgaagaaacattacatttagagttgcacgggaccgggacgggcaggaaatcccggtttttgaaaaaaagaaattccggtcccggtttgccagtcccggtctaattaataaaaaatattttaacgtaaatattattattttttcttttttttaaacattctaaaaccgcaaatttaaccaaatatttggtcaatttttggcaaattctgttaacatatttcactcaaaatttcgaaaatttccggcgccgtctgtcggcaccgccgcccccgccccaaatgtacccaaagtcttttgaaaaaacagcgccacaaaaagaggtatttaaaaaatttaaaagattgttaatttattttaaaaaatcagaattttgagactcagaaaattccaagattccccgcacgaaatgaaaacttttaaaaattttccaatgaataatggaaaaattcttcgaattcctcccccaaacgaaaaataaaaaattttatgggtacatttttaaatataggcaattttcgtaacaaatgcgctcaaatttgcaaatttttttcaaaaaaatttctcttgggaaaattcccggttggtcccggtcccggcttttctcgcgatcccggtctcggtcgaaaaacttggccccggtcccgaattttctg

SEQ ID NO: 8319 - DNA, 3069 bp, Heterodera glycines
ttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcatttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcagaacgaaagccgtctttgtcaaagcgccttaccgagtcaaaaaatttggaaatgtatctcatatgcaatttcaaccaataaatttgaagaaattttacattcaattttgaaaaatttatgtccatattttgacatttttgccatttatgtccatatttcgcgatttttgccattttatgtccatattttgcgatttttggtccatattttatggccatatttcgcgattttatatccatataattacacgccctagtaataatcggatttcaaggcaaaatccgattacgattatccgattccgattatggcccaaaatccgattaattgcgattccgattacgattccgattccgattatggcccaaaatccgattaattgcgattccgattacgattccgattcggcacatccctgctttgtaccccccccccctcccctttttggaaaagaaaattttcaaaaatttttttcgaaataaagttgttttatgggttttctgggtcgaagaattcgattcttatatctatttcggcccatttcgaaacactgacccggactcgaacaaaaattcgaaaattcaattttcgaaaaattctaaatatgcaaccaaatacatgaaataaaaatgagaatcgattcagaaggcaagataaaggggtcggggtcactttggcgcgggccattttggcgccgcgaactttcaagtgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcagttttttgaggttttttggccataacttttttgtgtgtcaattaaattttttgaaattttgcaggctattaggtactatcaagcgctttaaaatgatatcaagcttatttaatttgaatgagaaataaaaatgttatagcgtttggcgccaaaatggctggcgccaaagtggccggttcccaagataaagtatttcgtgcatttgaaccggttttgctgcatatttagaattcgggcaccgaaccgtcccctaccgcactggggcgtacccatagtgttgaattcaaattcaaattttcaacgcttatttttttgaagctgaaacggaccattcccgagagatcccaactcacatgctaatttgactcatgaatttcatttttgaacatttagaattacaccatagttgctcttgaatttggagatggctaaacagacgcgcgacgagggaaagttcgttgagttggatggtgccgagatgggaaaggtggtggtgcgttttccacccgaagcaagcgggtgagtgaatgttgttgtgatcactgatcataaacaaaacaaggggagagaaatgaaagaaattttaacacttccaaccaaaattcattgttttttacgcggcgacaagcacgtaatcgagcggaaagaggggagggggacttcgtaatcaaaggcggcagaaattaatgagaaaaaaaatcgccagcgatggagggggaggggaagaggagaactattgagataaagaaccctagggtttgacatttttcggaaacggacagaactgacggacgagttactaatttatttcagttatttgcacattggacatgccaaggccgcactgctcaatcagttctaccggcaccaattcgaaggtcggctgattctgcgcttcgatgacacaaacccggccaaagaggacgcacacttcgagaaggttttgtttcacatttctcagattttggggggtaccatttcaaaagcattaaaaatctttcgctttttcatcacaatgcttaaacccaatgcttactaattcaggtgatcgaagaagacctgcgcctgttgcaagtcgagtgggacaaaatgagtcggacttcggaccattttgacgcccttttggacttttgtcagcaattgctggtcgctgggaaggcctacgtcgacgacaccgaagctgagcaaatgcggaaggaacgcgaggagcgggtggagtcgcggaacagaggaaatggtaactttttgggtttggcaccgtacgaaattttcaagaaaaaaatcttagaaaattctatggaaacaaaattttttgaaatttttgtttcttcgaattttttcagaaaagtttttctaacatttttttcttgaaaaatttctgtttgaaaatttttagaccttattttgtgccgaaaaattttcggtttttcctttatgatggtatcccttccaagactcttttacccaaatttttccaaaaaccaaaacaaacttcctggaacagtccctgattcagcggtcgagcagaacttggcattgtggaaggaaatgcaggagggcagcgagcgtggacagcagtgttgcgtgaggatcaaaatggacatgaagcacaacaacggggcgttgcgcgacccgacaatttaccggtgcaaaggcgaaagtcacgtgcggcacggggacaaatacaagtgagtgggaatgggaaaaattaatttttagtttctaaaaactcccaaaatagttgctaaaaagttccgaatttaggggtgtaaaatcgaaa

SEQ ID NO: 8320 - DNA, 2413 bp, Heterodera glycines
cttttgtcagcaattgctggtcgctgggaaggcctacgtcgacgacaccgaagctgagcaaatgcggaaggaacgcgaggagcgggtggagtcgcggaacagaggaaacggtaactttttgggtttggcaccgtacgaaattttcaagaaaaaaatcttagaaaattctatggaaacaaaatttttttgaaatttttgtttcttcgaattttttcagaaaagtttttctaacatttttttcttgaaaaatttctgtttgaaaatttttagacctgtccatactcaaaattttggaagaatggtattttgtgccgaaaaattttcgggttttcctttatgatatcccttccaagactcttttacccaaatttttccaaaaaccaaaacaaacttcctggaacagtccctgattcagcggtcgagcagaacttggcattgtggaaggaaatgcaggagggcagcgagcgtggacagcagtgttgcgtgaggatcaaaatggacatgaagcacaacaacggggcgttgcgcgacccgacaatttaccggtgcaaaagcgaaagtcacgtgcggcacggggacaagtacaagtgagtgggaatgggaaaaattaatttttagtttctaaaaaacccccaaaatagttgctaaaaagttccgaatttaggggtgtaaaatcgaaaattttcttcaaaagggtaacaaaattattccaaatcagtaaaaaacatgtttttcgtgcatttcattcaggctacggggagctcaggaaaaaaatagtgaaaaaacctataaatcgtatccctttcattaccttttgacagagtgtacccaacctacgacttcgcctgtcccatcgtcgacagtttggaaggagtgacccacgcgctgaggaccaccgagtacatggacagggacgagcagtacaacaccatttgcgactcactcggactgcgaaagccgtgcatttgggcattcgcgcggctgaacatgacacacactgtgatgagcaaacggaaggtgggcaaaagtatggcaccgagcattagcaatgtctgtttcgttcagttgacctggctggtcgagcagggcttcgtctccggctgggacgacccgcgaatgcccaccgtccgtggcataattcgccgggggctgaccgtcgaggggctcaagcagttcatcctggcacaaggaggaagtcgctctgtcgtcacgatggaatgggacaaagtctgggccttcaacagaaaagtcatcgacccggtggcgccccgctacaccgctttggaaaacgcttctgccacgctcgtgccggtgacggttcgccaatttgtggcggaggagtgcgggcaggtgccactccacccaaaggtactcacttggccagtctcgcccatgctgaccggacaattgcacgtgtagaagcccaacggagagtccaaggaaatttggttcggcgccgatttgctggtggagagagcggacgccgaatgcttcaaagtcggcgacattgtcacctttgtgaactggggcaacatgaaagtggcccaagtgcggagggaagagggcgcggaggggggacgaataacggcggtggaggtcgacttggacttggacaacaaagtgagagacggaccaaaatgccactcatgtcagaccacagggcgggaccataagctaaaatcagtcacggcattggtcggacacatttaacttagtcaatgggggagggagggcacgaatttcaagttcattcccctaatattgagtcattgtcttccaggactacaagaagacgttgaaagtcacttggctggcgaaacgtgccgaaaacttcgcggtgaaaacggtccgttttgatcatttgatcagcactccgatcattggcaaggaggaggactggaaggagttcgtcaatcgcgacagtgaggtgagttggattgtgcccattttgttttgttttacaatttttttaaatttcttttagcattttggcactttgttggccgagccggcacttcaaaaagtgaactgtggagacattttgcaaattcagcgcaaaagcttttacatttgcgacgcgaagacagccaactcaatgacactcatcgaaattccggacggcaaagagacaaataatgcagatgtggacgacggcgaaatgccaacattttgtgccaggcttttaccctcctgtgacgacagtgaaatggcaacattttgtgccaggcttttgccctccggtgacgacagtgaaatggcaacattttgtgccaggcttttgccctccggtgacgacagtgaaatggcaacattttgtgccaggcttttgccctccggtgacgacagtgaaatggcaacattttgtgccaggcttttgccctcctggtgacgaccagtgaaaatggactctaga

SEQ ID NO: 8321 - DNA, 1676 bp, Heterodera glycines
  misc_feature (38)..(38): n is a, c, g, or t
  misc_feature (66)..(66): n is a, c, g, or t
gggccagagggaaaaagagacgaaaaaggaaggaaagnagacgaagaaggcaaagattgttaatgnagacagtgtattcatgtggaagtattcgcaattgttttgttgtttttatttggtgatttctggtgttgattaaaaagaaagaaactgtactcaattagcagcagtttaatgcgtcaaaaccaaaataaaaaaaatttttaataattttttaaaattaaaaaataaaaaaagctttgctaaatgtaacgaaagaattgaaaaatcacgggcaacaaaatttaatttttttttattaaatttaaattattttaactgagttaaatttcaaattatggaaaatttctctaaattgaggatccctgctctgtgtgttgtgaggtgtttgtctctttccgccgtttgagtctcgtttttctgtttctcccccctcccccctcttttccgcctgttccaacgcattctctccctttcccttttccccctcaatcggcggttgtgtcttcaaacacatttaaaatcgcttttgagacgggagaaaatgaaaaagtgacggatgttcgtcctttccttttcccttccttccgtccgtccctttctttggccttttcttcgatttgtcgcccgtttctccaacttaacaaaaatcgccaaaagtttgccttaactttggttaagctaaacaaaaacaaaggaaagagcgacggaataaataattcggcttttcctcaaaagcattttaattatttattttatgttttttttcgccaccactgttaaaaataaagagaattaattgccaacggcgatggatacaaattcattttctcattttcatccttttccttccccccccccgtaccaattggaatattcattttaaattgaccataaaagcaacgaaattgggaaacggaaaaacatttattgtgtgtacattttactggaaatttattattaaagataaaatgcgctctgtaaaaaatgctcgacgcaaccacaaaatttcaacttggaaaaataggccaaaaagaaaaaataatgcgcgaaaaaaagcgaacaaagcaaaacaatggcaaaggaacagcggaagagagagaaggcaaatattggagacagaagggaaacgagaggaaggacaacagaaggagaagaagcggataaggacggaaaaggaggaggagacaatgagggcggggaaagcatcggcaaaagatggcggaaatggcaagtgagttgaggggagaagagggggaagggcaagggaggtggaagagggaggggagggggaagagaagcgcatgggagagggaggggattctccattttctagagttgtacgggacgggacgggacctggtactgaaaaacacgtacaactgagtatcgaagtcccggttttgaccaattttgaccgggaccgggaaaagtcccggttttttaccggttttcccagccaaaaagtcccggttttttccaaaatcccggtcccgtacaactctaccattttccaatatttgtttttcatccttttagcaatgaaaagtgtgtgactgctgaggcacttaaaaatgtacaagtgaaatcaaaaacacgaaaaaggagaaatcggttggaagaaaaggagaaaatggggcagaaaagagaagaaaccgaggaaaagaaggggaaag

SEQ ID NO: 8322 - DNA, 2142 bp, Heterodera glycines
agaattggggacggacgcagacaatgagggatattatttgcagttaatgacaggcatttgtgccatttttaattcaaaaatgaaatactcgccatttccccgccctccccctcaccccactgtcgttcctgccaacctcccgcatcgcttcttttatgtcgtactgttgttgcttgtcgggctgttgctgctcaaaaagcaccaatgctttggtgctgctgctttgcacatcccaaaaactgtcccccatttccgagccttccctcgacccaacggttactgttgacgccaaatgaaactaaaacggtgagattataaataaattaacgacttttattatttgtaaattcatgacataaaaagatacttttgagtcggtgtcaaacacaattagggaacagtcgtcctcgagcaggtcactggaagtggcgtgctggtgttcccaattcaggacattaaacgcaacacggacaggcttctcgaacagatcgacaatatcacttaaaacactgcactaataaagttggatcgaccgataattattcttcgattaagaaatttaaatcccaaaagctgacattgagcaaaatccgacggtgtcgccttcttcggctcgccaactttgccctttgattggcaaaatgcggccaaatgcgatgattccgtcgcgaaggcacagaatggagcccagtcgaatgccttcgtcgttcggatcgatgacaacacttttgaggatgccccattccataggctttccgaaagttgccgaacgatggaggggcggagggatggcggaacggaaaacattggcaaggtcgtcatggaaagaacagacgtttgtcggaggctaaaaatattaatacaaacaagtaccaatgccttattaaggtaaaaatttaaaatttaggtcgacaaattgatttccctaagttttttaaagataggacaaaaagaaatgatttgtaaattctaattaaagacctaattattcttccatatttttgggaggttaaaagaatgagtgtcccgactcttttggctatcgctctctttttaaaaatacattttgaatgtcctccacaaaattgagcgaccattgtggcggctttaccgtgtttcccgactggacaaagttgcttaaatagaagtgttgattctgcttcttaataatgtggaccatgaaaagaaacttgtgcccctttttcaatacttcaattattttttcaaaaaaaaatcgtataatataaacgcatttacaattagaagatgacaggccgtgactagaaaaaaaaatcggagggagaacccgaaaacttttctttttattattcggtgaaaaatcaggaatttgtagttgtttttcgccaaaaaatgacgccaatttattgccttttttaaacggaaaagtacatcgaaaatatacaattctctgaaattccgtccagtttctaataaacatttataaaaataggggcacaaatttcgaaactaaaaaaagatattataaaaagcaacaaatgtaacttaggtaattcatccaaacatacaaagtgagaaaagcgtggcaatgttcagtttcacggatgcccgagctggagagttgtttcaccaaatttgcattgactttaatggccgatttcagtcgtggcgaatacaattcgatgttcaatttttcgtctgtcgaagcagttttgcatttccgccatttgcagtcaaaaattgtgaggttcggaacacagaaaatcggaagacaaatctaaaatttacacgcatttcccattttgagtgagattggctaagattaattatgcaattatcagaaccaccttaacagattcgttgtgtcttcccccatttgtccactccactcgttttgttggcaatatttcgtccacttttttccaattttgctctccacattcattaatttcgtattggtaccaatttccaattcgggcaccgctaaattcagcacgaacttccaatgcacttaaatcgtcgtcgtagaccaaaaaacaggtgttatccttgacgccaacacaaagagcaaaacgacataaaagaatgctcatttaaggaatgaaaataagaaatgcgctagaagagagggttaatgcgaaataattaatgtctaaacggaaa

SEQ ID NO: 8323 - DNA, 2407 bp, Heterodera glycines
caataggaaaaaatttttttcaaggacaaaggtttttctttttctctcatttgggcgtactatttccttgtctctaacatataaaataacacatgaatcatttatctgccaataaacaatttttttaaacttttgactaacttagaaatattctccagaattttcccttcaaaatgagcataaaatggttttaatttctctagtattcaccaagttataagctaaaaaaatttcataaaatcaagggtaaaatatagtgtgtaccttttactgtttgtatttgttcttttggcgttctgtatttattattattttatttatttgctttaaaaaattgaaatttatacacaaacacaaggaggaattgaacttgagaccccccttttggtgactaactcacagaccactaagacgaaaaatccagcatatttgtacttggagcccaaaattgggccgctgtgtttactaataactagggatgggatttttaagggtgaaaaagtccaaaataagggcgaaaaattcgcgaaataagggcgaaaataaggtcgaaaaagtttcaaatttagaggtgaaatttttcaaattgctgttttttacatgaaaataatttaaaattaaggcaaacaattttattcattgattgcagttacaaataaggtacatttcaaaattttcgggggtaaaacgcatgcgattatcagctaaaatggttttgtaaatggaaaaagatcgttccacgtcgcaagatgtcaatggagcaaatttgtaaaaagggatgaggtttgggggtacatcagattcagtgtttttcccagacagaatctggcaaaattgggatattttttcaattccattgttcttggccacaatgtccgagaattttttgcgaatttcggttgccttttcgccataaacactgtccatttgattgtgaacgccagcgaatacatccatggcatcaaaaatggtcattccctgtgtttccaattttgtaattgcagcagataattgtccaaaatttgaatggatgtaagccaggtcctgccaaactgaattgttgaaagacaattgacattccttaacacacacagcatcatttgcattgaatgaattcactacctaaaaaatacaaacctttactacaaaaaataaaattatataaattaacgcttttaatgcctcaaaatgctcccaataaaaggacactgccgttatccaggtagtccaacgagtcaaaactggccgaggggggatggacaattcagggcacatctcacgatatacagaaaggcgatgcggtgctttcagaaatatttgctttgttttgcttatcaatttgtccacttgcgcaaactcgtcacgaactttttcggccacgcggtgcaatgcgtgacacaaacatgtcacatgcaacaaattggtgtaaaaaacctgaaaaagagaaaaaatttatttgaattttcttttttctaacttttaattgtcttccggcctttttcatgtacgcagccccgtccgtaaccaaaaacagcactcgctctttcttaatattagcagaaaaactgtctaaaattaaaaaatatctaggaataaaagctaaacgactaccaaggccttcattaacaaaacgcgccattgctccactgtccaccttttcaagcgctttcacagaaattaaatgcggggggtgccattttttgccatccaatttgcctaacaacaaattggcgatcattcgccccgtaaccaaaaacagcactcgctctttcttaatattagcagaaaaactgtctaaaattaaaaaatatctaggaataaaagctaaacgactaccaaggccttcattaacaaaacgcgccattgctccactgtccaccttttcaagcgctttcacagaaattaaatgcggggggtgccattttttgccatccaatttgcctaacaacaaattggcgatcattcgccccattttatccgtagtctcgtccactgaaatccagacaaatgcttcaccaatgtcttccttaatttttgtcattgtcttaaaatcaaaattgaaaaaattttttgaacaattttggaacctcagaaaaaagttggaccaaataattttttcgaagagttgactggtctggcacggcgcgttgacaatacttttccaaaaaggaacacaaaactgcgttgttcagcttaaaaatggtatgttagcagacacaagtgctttgcaaaggtcggcagaaaattgctcttgtttattttcatttgttgtcaaaaaaggctgatgctgaatgcttttctttttcgaaaatcgatccaaattcttgcgatgttttgccgtttcattgtgttgctttaaatcccaagtattgcgaacatggaatctgtgaaaaatcgtcatgttgct

SEQ ID NO: 8324 - DNA, 934 bp, Heterodera glycines
  misc_feature (875)..(876): n is a, c, g, or t
tttttattaatttttacttattattattattatctagcaatttaattttataattttattaatttttaaaatttcttatcaatttaattttattattttgcaaatataactatttattatatatatatatatttttttttattattattatttaaattttatttccttatttttcaatttttatttattttattttattttttattaattttgttttattatttattattattattaatttaatttatttttatttaaatttttgtgtgtgttaatagagagagagagagagagaggaatagaaacaagagagtgagtgaatgagagagagagagatagatagagaaatggtcagttttcgcacatttgctttttgtggccctaatgaggaccgtttggattatattgatccaaatcaaaaaaaaaaaacaaacacaaaatttgatcaatatttggtcattcattcattccttctttcttttcttttcgtcactctgggctaattttttcaaatagtcgcggcgcacaaaaacacaaacttaacttttttttattcattaatattttcgattgtaaaaattaataaatttttacgacatttattttttagatttttatttttaaatatctaattaatttttattaatttttatttttattttaacctttctttttccccataaattgctcaataattttcttctcttttttctctctttccttttttttcttttctcgcatttttttatcggcgagaattacgcgttgcacatccttctcataaatttgccgccttcgtccccctttcgcgcactttgtttgtgccaatttggcacaacctccaatcggggcattttctttgtccccttcctccnnactctccctcctttttctctcctctatactatccatccaaatgtcagaggtgtagtcg

SEQ ID NO: 8325 - DNA, 1656 bp, Heterodera glycines
  misc_feature (1558)..(1558): n is a, c, g, or t
agaactctaaaaaacaattttgacctaaacatggagacattaatagaaaatttaacaaaaaaataataaaaatttttatatatttttcttaataattgaatgcaacaaattattaacaatcatgaccttatattaataaattactgattaccagaatgcactccaaatgcttgaatggtgtcaagaaaatttaaataaaaatgttttctttttaaaacgttttttgaataatattattaaaactagaaaaattaaatattcaaagcatatgaatatgtctaatttttaaatgatttcgcacaaaaactttcaaataaattacaaatttatgttataacatatatttttctgtaaataaaaacatacgtatgtcatgataaataataaataaaagaatttgttaagaaataagtatataatttatgcaatttaaaaaaatttataatctattatatacatattttttattctgaatgaaagaaacagctgatttagataaaaaataaagaattaaaaaaaattttgaaatatacaaaaattaataaattctcattgtaaattttagaaataatttaataacaaattaaattattaaaagattatataagcgaaaatatattcagagtggccaaaatgtcaccttataaggcatttgttatttaattttataagttaaaaattttatttattccaaaagcatctcgtatttaataattataatatttattcgttaaaaaaacttaattgtttaaattcatatatccaaatggtgcacaaaagtacattaaatggagaagagacaataaatgactggataaaagatcttaattattataatgtttattcacaatgctcaatgaatcgttcgcgtatggcatgaaataaattaaaactattttaattacactacaacaattattattgataagataatataaaaataataatgatgaatgaaaggatctaattaattaacaaaaggacacgatagatatacaataaaataattgtctgatagcatgaaaaaaatacaatttaattcataaatactattctatttctgctgaaaaggacgaatgtattaattttaaggattttaatattttaatttctgatcgtccaatttcgcaagtctaaaaataaaaataacaaaactttgttaataccttttgatatatattgtgattgttttatatatttcacgaattgttatcaaaatgattgattaaatctttttcatttaacccatttaaatttttaaattgttttagttttataaaaatttctacaactgtataactcattttttgcattttatttaatgtgctttgattacaaaccaaaattgctcatttttgtaaagttaataaatattttttgttatacattttaatattcttattcgcatagtattttttttataatgcctataataattattctctattatatattattttgataataattttgttaaaaatttcaacaaacattttagagtaaaatttataaaatgacttttttgaaagaaaattttcagggctgatattattctagnatatattttgccaaatttacttatattaatataaatttgtaaaaaattaattctaaaattaaaataagattaaacattactttctttttatagttttt

SEQ ID NO: 8326 - DNA, 1529 bp, Heterodera glycines
  misc_feature (30)..(30): n is a, c, g, or t
  misc_feature (39)..(39): n is a, c, g, or t
ttctgctgaaaaggacgaatgtattaattntaaggattntaatattttaatttctgatcgtccaatttcgcaagtctaaaaataaaaataacaaaactttgttaatatcttttgatatatattgtgattgttttatatatttcacgaattgttatcaaaatgattgattaaatctttttcatttaaccccatttaaatttttaaattgttttagttttataaaaatttctacaactatatatttcaacaaacattttagagtaaaatttataaaatgacttttttgaaagaaaattttcagggcctgatattattttagattatattttgccaaatttacttatattaatataaattgttaaaaaattaattctaaaattaagtaagattaaacattacttcctttttatagttttttggctgaagcttaagtggatataccctttcttaggaagactattttttgacattttttgaatccaaatttttgtcccttatttatcattttgtttgtttttttattttgaaaattactgcttttgtaattgaattttattcatttttattttggttgtattataactaccttttactttaaattgtttaataatcaataatataagaattgtatttaaagtttaaaaatggttttgttttagtgataatctgcaacaattaatattttaatcaaatgcaatttaaaaaattgatttacacattgaattctaaattcccccaatggtttaaatatacaatttattaaagaagctgcatttcccagggctacgggagaaaatgtgtccaaaagtgtatgctatggattatacgaccgaatactttttcaaaaaatatcaatgaaaagggcgctgatgaaatttgcttcatttaaagttacaaaaatattttacatttaatagatttgcatgtttttttttacttattttaaaagcgtggggtaattaattttttaaagggcaggacaggatccagcacagagaccttatgattagagaccgactaaaaaggcacgaaaaatcgcgaaaaaggcactataataggcaccaaaaattgaaataaaggcatgaaaaggcacgataatcccgaaaaagaaaaaaggcataataaaagtcaatgtagaagcctcaaatgtattatttttgcttgcgcagaaaaaaaaaagacatatgcctcaaaatgcgagttctacttatgatcctcttttaaaacagaatattttaatttttagtaattttataataatctttaaaaataatgacaagccgggaccgggacctcgcttttcgtccggcaccgggaaccaggaattttaaaaattcaaattttgatttatttcaagtgaaaataatacaaaattaaattttattttgttttttattttataaatcaaaaagttaaagctaaattaaaataatgaaaattttcaaatcaaattttctttaattatttcagaaattaatcattttggaatagatttttttgtgttcgttatacttttgccgttagaattt

SEQ ID NO: 8327 - DNA, 1557 bp, Heterodera glycines
aaaatacattaattatgggaaataaaaataaataatcataattggtcgtttagttcagattatgttgttcgatgggctattttattaaaattctattacataatttttaaattaaggaatttgttttatttattgcatttattttgtttacttaaaaaatttattctacctaataaaattgctgggattttctctaattctattgatcataacggttgactttgtgcttttagattttagatatattgagaatgctattttatttattttatttttggtatatattatgaaaattttttggaaaaataaatatgaatgaagattataattgtgaaaataaattcaactatattattatttaagaattaaaattaatttaaaaaatttaaatgttaaaagctttttaacttctctcataagcatcaattagatggtgttgagtccgttatatgaaaaaataatggggtttattatttaatttaattatgcaatttatggttaaccattaaaattctaattttttttacaaccttttttaattttttaacttaaaaaattttaatatattataaaatgctcgcttattcaataaatatgttgcaaagtgacatgagattaattaagtagaataagaaatgtaaaataaatgtttaaaaaataagactattcattcttaatgaactacacaaaaacaaattcttatgatgattaaatttaaaaataaatgtaaattgagctaggaatcaaatattttaaatatttaatctcaaatcttagaatctttcgggcaattattcattatggcgttctaagaatcccagatttttttaataaccgctagaaattggacaatttccatttttattttttcttaataaattttaagttatagatcattatttaaaaaatttcttatagaaaaacgaaatttctaattctattataattaaaaattaattaccaaaattaaaaaaaaataaaaatttgaaaatattgttaaattaattgtcactaacgaaatgttaatacggatatgaattctgctggtgatactaacatataaggggagtgaaataattccataaaataaattgaatcaaataaaaaacaaatatattctttcgcctaatcaaatagtcgagcgatagcactacgtgtttaaccaaattataagctaaatttttataatatcgcaaaataagtcagaatatgtaaaaatctaattaaaaatggcagtgatggatggccaaaccatgttataaaaaataaatctaatttatttctaagaaagtaaattaatttctttaaatccaccgaaattgaataacataattgctcaaaaaaaaggtctaaatttaaaaaaaaataaaattattttcacccaaatataaaccaaaacaattggaaaaataattaaatcaaaagggtgctgtgcaattttgaaaaaacaaatgagttttagtcaagtgattaaacgcaaaattaatattcaaaatataaaataaatattcgtggggaggattaaaattattctattatgtaaacaaatttcgaagg

SEQ ID NO: 8328 - DNA, 4060 bp, Heterodera glycines
  misc_feature (3961)..(3961): n is a, c, g, or t
  misc_feature (4015)..(4015): n is a, c, g, or t
taattggtagtgctgttcgagaccaaaaatttcccgagactcgagaccgagactcgaccccgagacccgagaccgagaccgaaaaccccgagaccgagacccaaaaaacccgagactcgagacttttttcaaaaaattttcctattcgcttaaaaatcgttaaaaacattttttgactctattcttaactaattttttgtttttttttaaattttgattcaatttggtacaatatttatcatttcaaaaacgcacaaaacgaaaattcattaaatttaagtgcaatttgttaactgatttagtccaaaaaatgaaaatatttcgaatttaattgttaaaattatgattgaattcccaccgaaaaatgaataattttgaaaaattagaagaaaaacaactacttggaggggaattactttttttaaattttcttatttcttaaaaattatgaaaaattactattacgtttgaaataattgcatttattcaactgaaaaattatgaatcaaaagccggcggtgccgatagtcgccgccggggaaaaattttaaaatttgagtgcaatttttaagattctgtccaaaaaatgtccaaatttttgcggtttttagccaatttaaaaaaaaaatagcgttttgggtgccggcggtgccgataggcgccgccggggaaaatttgaaattttagtgcacattgttaatagatttagtccaaaaatgacaatattttatgattttaaatgttaaaattttgattgaattcctatcgaaaaaggaataattttgaaaaattagaagaaaaaacatttacttggaggggaactgatccaacgctaaaatgaagaacataaccaagagaacaacccaccggaccacacctacgagtaaacaaaatgaagcaaaaaattaccaaaaatatattaattttaaatttgtaaaaagccaatcattaggggtgtaaaaaagtctcggtctcgagtctcgaaaatcgagaccgagacttgaaaacccgagaccgagactcgagaccgagaccaaaaaaacccgagacttttctcgagtcgagactaccgagagtctcgaacagcactattaattggagacggggtgattaagataaagggatttttttcaaactaattcaaaagaggtagcttaatggaggcgggcatataattagagaaaatactgtaggtcgtttcataaaatgcgccattttatttgattataagaaaatcaaagttttacttttgtacatattttggactttcggcattttttcctaaatttttttgagaatgtttgaaaatttataaaatttcggaaaaaaagaaaaaaaaatttatttttgaaaatctttaaaaaaaaacgttttttacaatcaaaaatatttttaaatatacacaaaagtgatttaaacctattttggtcatttttatggtattttgttctatttcaccctttacgaagaattttttccaaaaaataaccatttaaaaaattttatttactagcgatttttcatacaaaaaaatcccatccctataaattacattttaatattaattaattttaaatattattttttcattattttaaccatcagtttttccccatccggcaacaaagcttgtcccatttttgaatcgttcaattgaaccacaatgtaagcagacgggagggagttttgacgtgaattcaacatgttcatcgggaatctgaacaaattttcgggaaataaaatttaatttttttaattgggccaaaaatgccactttgatcagtgccaaatcataataactttcgccaagaaattcatttgtcaaatattttgggtgaatgaacacattcgaattgctgcgcgggaaacgagcaagaaatccatcataatttttatcatcgactttgtttgaggttgaattgaaccctgaaaagaaaatttttattttaaatatttattaattttaattgatttgattttttttttatattgtacaaaaattactgtagggcacttaggacggtgctaggccatttcgtaaaaatgccaattttacagatttttcgagttcagaatatttcattaagttttcagaaagttatggcaattttttaaacatgtttggtcaaactttttgaaaactcaatgaaattttctgcaatttttatggtaatagatagagcaagccgggagctaccgtatgatgataccaagcttatttaatttgatagggtttagaaaagttatgatggatttttcttgaaaatcggtaagtttttacgaaacgacccagcaggctttaggactattaatctgaattaaataattgctgaaatccactttttcaaatgcattattacacttaaatagggttaatcagtgcccagagtacattaatgcatgttttatgtccttgaaaagtactgtgaatttagtagtgatgctcgagaccaaaaatttcccgagactcgagaccgagactcgaccccgagaccgagactcgaccccgataccgagaccgaaaccccgagaccgagacccaaaaaacccgagactcgagactttttttcaaaaaattttcctattcgcttaaaaagcgtttaaatttttttttttgtttgaggagattcattggatgagatagcctttattaaaactcggtttaatgtcacctttttgtcaatttaaattgaattttaaaattttgctcgttaggttattgaaactaaatgggttttatgtaaccatgaatagaacctttattttaattttaaagattcgacagagtttttgacaattcaaaattacaattagcagttaaatatgttttttagcttacgtatttcctataagctcactgattctttaaacaactgactaattgttgcaaatttggccactgttgttacttggcaacccattctaatgaaaatctatgagtttgtactctagtaaatccatgcaataaaatttaataaatattatcattttcctgtttttttcattaaaaacaggaagaaaatcactcaaattccgccaaaaaggattagtgtgacctagcaaataaatatgctttttgattacaatttgccattgtttcttggcaatgcacgcacttccaaagtctcggtccctgctaattgtttggccgaatacaataataatataaaaaggaaaagagaaatactgtaaagaaacaaaaaaggtccaataaatttacaattgcgtgatttcataaagatatctacaattttgaaaaatatgtagttgtcaaactgaaaatctttctatgacattataacaaatgttataagttgagctaaagttatgatttattattcagtaaataagatttaataataagatttatttatttatttgttggctcacttttctaaatttcaattgaaattttcacaaaaataccttgttttggcctattttcctgcaaattttcaaaaattttgcttacatttaaaagatttataaaaattcactcgtcaaaacttaatatgttggaaaattggacttcttgcaactcctggcctattctaaatttttgtttgtcagaaaaatgccaaatttgactgacattttttacggtgtggcacattccctaaacctgcatcactttcttagaccaaaccaaatttaatcttttttcgatttttgtattttgcaaaaccatattttattaaattcaattgtaggcgaaataattcaaaaactctctgcgtttttaatcaaaaattaataaaatttttagaatcagaaattttgatttagaaaaaataaattttgaaattttggcaattgtattcttcgaataattttaagaggatttttctgatagtcccacaaaatgccaaaataagcacaaaataggcgcaatggacaagcacaaaaattccgaaacagacgaaaatcggcattaaagtcaccacagaagctttcaagctanaaatagctttattaaacatattaattgcacagaaattttaatttctttcactanaaatcccagtcctatactcacaaaaaatcttttttgaatacaatt

SEQ ID NO: 8329 - DNA, 1798 bp, Heterodera glycines
catacagtacccccccccccacggtaatcaaagaagcgaacaagccatttctcgcttaggctaatctgggttttcaggcgcccttcttcaatttttgtttctccgcagagatttcaaaaacagaattctttttttctcagggtttttccttgttttcgaccacagttctggtggtttttaattcacaaatttatacacatatgtagtttaaattcacttcgttttccattttaataaataattaattcattaaaagaaagaaagaaaaaccaaatggggggaggagagcatggaaacaaatgggtggggtgacaattaaaaaggctgcttaattatgattaagttttttttttgattaatttcaaggtctgaaaaattttatttaagttcaaaatttcaatgaatgcaacgcctaacgatcaaatattcaaggtaagataaatatttataatataaaaaatacaaaaactaatttaatttaaaaagctctgttcgggcaaggatcaatgctggacagtgattatttatgcttttattgtgacctttttgactattggtggtgttttgtttaatttttctgttattttcattacaattcgaacaaagtaagattttttactcataaaaatatatttgtaattaaatttctggtgttattttctcttttcaggtcatttcgtggcaccgttaacattttgttcgcattttattcattgtgtgaaattgtccatttgggtggcaattttctgtcaattttctcagcattttctggccaatattttatgccgtataaaactctcattacttttgcttttgcccctataatttgcggcacttgcgctgtgattttgttgcttttcattggcattgaacgcctttccgctgtgcttttcccgtttaagtacataatgtttttcgctaattaataatttaattgttttttgattttaaggaaaattaatcaaaatagttttcttgccattgttttggtgttcaatatcattcaaatcattatgctaacaatcatttattcgcattgtgaagacacgcaacttgactcagttgaagtttttgccaattattatgaagttgccgttctattttatactgtccgttttttaaatattttcccaatattttttaaaataattacactgattaagagccaatgctctacttctggtctgtttgaagcaacaatggtaattgtgtgttcagtggttatttatgcattaattgcggtaacactttactgtcgcaaaggtcggtatttctaagaaaagaagaaaaaaattacactaattaaatgaaaaaaactgtttgaagatgaaaaaaaaagttaagtagtttttaaaattattttaatttaatgttaatagacaaaataaattttatttttaatattttaaagatacaaaacaacggaaaaatccattaagccagcattttttttaaatttaagtaaaattttttgttatcaaattttggtggggcatttacgaaaaatgaaaggttttgtgatactctggcatacaatacttaattaaatctagtaaagaaagaggccaaaaactgacgaaatattagtaaaaattaatcattaaagttgcggactaatactattgtgaaaataattaaacaatattttttttaattgttccttttttgtaaaaatactaaaaatgaaaaaaaatttaatttgtctttttttttgcattttcagaccaaagcaattacaactcggcccaattcaacaatagaatattccgttcacttttcacaattgtcgcagtgaata

SEQ ID NO: 8330 - DNA, 1540 bp, Heterodera glycines
  misc_feature (52)..(52): n is a, c, g, or t
  misc_feature (57)..(58): n is a, c, g, or t
  misc_feature (60)..(62): n is a, c, g, or t
  misc_feature (65)..(65): n is a, c, g, or t
  misc_feature (73)..(73): n is a, c, g, or t
  misc_feature (94)..(94): n is a, c, g, or t
  misc_feature (96)..(96): n is a, c, g, or t
  misc_feature (110)..(110): n is a, c, g, or t
  misc_feature (117)..(117): n is a, c, g, or t
  misc_feature (126)..(126): n is a, c, g, or t
  misc_feature (129)..(129): n is a, c, g, or t
  misc_feature (137)..(137): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (172)..(172): n is a, c, g, or t
  misc_feature (174)..(174): n is a, c, g, or t
  misc_feature (177)..(178): n is a, c, g, or t
  misc_feature (184)..(184): n is a, c, g, or t
  misc_feature (207)..(207): n is a, c, g, or t
  misc_feature (256)..(256): n is a, c, g, or t
  misc_feature (265)..(265): n is a, c, g, or t
  misc_feature (267)..(268): n is a, c, g, or t
  misc_feature (279)..(279): n is a, c, g, or t
  misc_feature (282)..(282): n is a, c, g, or t
  misc_feature (295)..(295): n is a, c, g, or t
  misc_feature (322)..(323): n is a, c, g, or t
  misc_feature (331)..(331): n is a, c, g, or t
  misc_feature (334)..(334): n is a, c, g, or t
  misc_feature (367)..(367): n is a, c, g, or t
  misc_feature (371)..(371): n is a, c, g, or t
  misc_feature (414)..(414): n is a, c, g, or t
  misc_feature (416)..(416): n is a, c, g, or t
  misc_feature (437)..(437): n is a, c, g, or t
  misc_feature (439)..(440): n is a, c, g, or t
  misc_feature (455)..(455): n is a, c, g, or t
  misc_feature (462)..(463): n is a, c, g, or t
  misc_feature (467)..(467): n is a, c, g, or t
  misc_feature (471)..(471): n is a, c, g, or t
  misc_feature (474)..(474): n is a, c, g, or t
  misc_feature (484)..(484): n is a, c, g, or t
  misc_feature (490)..(490): n is a, c, g, or t
  misc_feature (498)..(498): n is a, c, g, or t
  misc_feature (501)..(501): n is a, c, g, or t
  misc_feature (503)..(503): n is a, c, g, or t
  misc_feature (509)..(509): n is a, c, g, or t
  misc_feature (511)..(511): n is a, c, g, or t
  misc_feature (516)..(516): n is a, c, g, or t
  misc_feature (522)..(524): n is a, c, g, or t
  misc_feature (527)..(527): n is a, c, g, or t
  misc_feature (532)..(532): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (545)..(545): n is a, c, g, or t
  misc_feature (558)..(558): n is a, c, g, or t
  misc_feature (562)..(562): n is a, c, g, or t
  misc_feature (569)..(569): n is a, c, g, or t
  misc_feature (585)..(585): n is a, c, g, or t
  misc_feature (590)..(590): n is a, c, g, or t
  misc_feature (595)..(596): n is a, c, g, or t
  misc_feature (643)..(644): n is a, c, g, or t
tgtgtccacatgttattaccctttcttctcacaatgcctctagggttgaaantaatnngnnngangaagaggnaattctttcgaagaggagaangngtggtatttttggngaattgngaatttatnggnattgtttnattagggtaaatttttgagagnantnanataaatntnggnntatttnaggagtaatttaatatggatagntttaagttgaaaagtttatagtttgagagtgtaaagattaatttgaatngttgaattngnnggaatgaatanggnaaaatgtttgggnaataattatttgatttggttaattatnnggagaagnaanattaaataatgggtaatattgtgttttgtgttnaaanaaaagaatgtgttttgtttgttagtatttatggtagattatgngnggattatagggtattttattngnngagggataaagtgangataagnnaatnagtnggngaagaatggnattggnattgggantangnatttantntgttngtgttnnnaanaaaananagntganaaangagatgggagggngggnggagaanagaaaaaagaatggtnggagnaaatnntaatggaattttgggtaagggatgttagtttaaaaatgttaatttgnnaataatttgttcttcctctttttttctaaataaatgaaacataatgtactgagtaaaagtgtccatttggttggttttctaaaaaatgttctcgacctatatgttcgaggtttcttgagtttcgtcatatccattgtccttcattttttaatttcgtttttaatatataatatttctttaatttattttttttagaagactcgagaaagagtatttgttcaattcaatcattttatttaaaattctcacatttttcatacaaacaaacgcatccaatctcaaaaattcttttttgaagtgtgtgtgtgtgtttgtgtgtgtgtgtgtgtgtgtgcccgctcactcaaggactatccaattgccaattccccatgaatgatttctttttgggcaatttgaccctggcactaaaaaatgccaatttttattccactaaagcttgttttgtgctctttccatcacattgttaagaaaaacctcctctttccggtggcaaaatgggccgaggggagggcatcgaatgagtctcacccccccctttcccctaaagtcggtgccttttaatgcattaaatgccatcatttacacatggcactgcttttgcccgttcctttcgtcgctcgttcggtcagccatctgtcacaaatttgacgcaaaaaatccgcaccaaatgctggccgtctgatttgccttctgcctcaattggcctaaggcaggggcgctgtatttattaggcccatgtgttcaggcgatgttgttttatttgtatttcgctttatttacaggattttttatgtgcttcattgtgagttaattacttttatttacctcaattagtatacattaatttttagagtttttagatttggaaatttaaattatatctaataattttt

SEQ ID NO: 8331 - DNA, 2040 bp, Heterodera glycines
tacttaaatgccgacccagcagtaaaagtgtcgtcatcattttatttcgccattgttttgctccaaacactaatcacattacaacaacagatcgtctcaaacgcagcaaggcaaaattattgaaaatttaaaaactttttaaaagatatattttaagtacatccatcgatgatggaacaaaaagcgccgaatatccgctggaacaaatgcaacgaaatgcaaagcgaccgcccatgaacggcacgggcggaccgtcgcgtgtgctgatcggcatttacattgaatcaatgggcaatttccaagcagcggacatggtactgatcagattgaaagaagcaaataatctattcggaaataatatgacaaaaaatcaacaaaaagccttttttcaaaagtcattatgcgagcagagagggcaattttggaagagtcgtgggtttgagtcacaccagtcgggtttctcggggttttcaacaatcttagccctaactaagtctcgaaaatctgtttgtctcatctgttaatacaatagcaagtttattatataaaaattttcaaaataaaatattcaacaaaaaaagttctaaccgtttttttgttttgtttaatgagatgaagaattttttataaaattgaacaaatttatcgagaatatcgaaattaacaaaataaaaagaaatccgattcaaataataaatttttaaatcttctaagatttaattataatgaatgcctctgcctcattaaactattactattacatttggagtaaaattttaaaaataataaacagagtttcgatgtggatttgtatctgtactcacattggcgggacccttcactgaaacacaacaacgacgattatgtgctgatgaccgacccgaaagttcgggaaagaatttggtgaataatttaattatttcttaaaaatttttaaaattaaatattttaaaaaaattattatttatttttttaataaaggcttcccgacctgtactttgcaaatgcgcggaccagcaaattccacgatgtgaccattcccaactttagtctgttcattgaccgggacgggaacattgcttattcaacgaggcataaaactgataaattgataaatgaccggaatatttagggcaatttaatcaaaaaaaaaaatggtcaaattttttatttaaaaattttaaatgagttttcaaatttcagagtaacactgaacgttgcatgcaacttggagctagtgaggagcaaaaaataataaataaatggccaataaaatccaatatctcaggcgaattatccgatggatagccaaacgtgcggtatccgaatggtcagctgtgagttaattcatattaagaataactcattctaacatggcttgctaattatttttgtattgagagacaaatcccggctttttccaaaagtccatcaaattcggggatttgttacacttttagttcgcaaagcagttttaattttaatgaaaatatgtgcaaaaaattggagccataaataatcagaattttttttttaatttatctactataatttcttcgcggcttcttttttgcaagatcaaaccatcaattcccttagaatttttcaatttagccaaaacgcccgggtaaaatcaaaaaatgcaaatctcccttatttttttgggtgctagatcgtttcataaatccgccaacgtgggcgttttataaatcggccagagggcgtttttttcatgtagtggcgggcggatttatgaaaggcccattttggcggattttatgaaacgatcttacgcgattttttgcgtggtgagccgaagtgacaaaagtatcaatgttcgtaataattaaatttaattattattttaatttaatttgataaataattaatcataacttagcttcaacttagtcaaattattgaaatttggtacttagcgacagctccaagtatcctctactacttatataatttttaaaaaattactaaatttacaaaaagttgtaaccaaaaaagtacgaaaaatttgactcgacaatt

SEQ ID NO: 8332 - DNA, 2596 bp, Heterodera glycines
aaatagtaagttaatctaattattatgtacattgatattttttcacttcgtcctagcactttttgttctttttcttcaaattctaaaaacatgcttcacactcatcagatgcttatgtggccagccaagtgaatgtgagttggttcaaaatcggcgccacccgctacaacccggagattgggctgcccgagttcaaaattgtccagctgacgcccgagtcgtgtgacggctcctatatgtacgccatcatgtcgggcacgttcaaatatggtaacaaataaaattttgaaaattctttttcataattttgaatttcagataagttcagctgccttgaggcagtgattcatctgaacagacaaattggctaccacgtggtccaatcattcatccccaccgggcttattgtgatgatctcttgggtttgtgttagtcaattttattaatattgtaatttcgtatggctaattatattcaagtaaataattcataaaaaataattataaaagaataatgttacatcaggtagtttgtgagataaaatgcggaaattggataaaaaataaaaggcgaattcgagaaactttaaattaagcatttattccttaaataaattttgtctgggacaatttaaagaaaagcccaaaaaatatgagaaagcgataagcgagaggaggaacatcccctaatataaatgtctaaagtgattaagataaacaaatttcactctggcaaaataaaaaacttaatcaagttttaaattaaaacttttgaataaaaatatttcaggtgtctttttggattgatcgaaggtaattaattaattttttaatcattaaatttattttctttttagagcagttcctgcgcgggtgacactttcattcacaactcttctttcactttccacactcgtgggttttacaatattttcaataccgtaaatttaaatgtttacggtatatttaaaaagatattctacagtatattaaaaaaacacctttttagggaaatggcttacgcttcaacttgccacaggttgcctacgcaaaggctatcgacttttggtttggatgtgagtagcaatttcgaaatttgaactcaaaaattggaatataatttttaattttttttccttaaatttaaaattttttaattgggttaaattttaagtttttaaagcctctttaatttatggtgtatttttttaatggttttatcagaaagcatttaattttggaatttttttaaatattaaattttttaaatttaaaaacttatattaactttcgcgctaataatgaaatctcaacctctgtttttgatcagcttgcatgttcttcgtgtttctgtctctcgttgagtttgctgcagtgaattcgtacatgcgtgaggcggagaaatatgagcggttggccagttatagtgccaaaaaaggttttatttatttatttatttttaatttaaataaaaattaagagatgacaaatgaggaaggaaacccgtgggtttattccgagtaatatttttaatttatatttttaaatataaattaaaaaataaattttcaaatatttctaattcataaaatcttagatttttctgataccccatataattattaaatttattttcgcttactgaataaaatatatttgaaaaagcattttttacatcaatttttgccatttccacaaacattcagtgatgatgacttctcctcgaccagtcgatcgcccgttcttccttttccctcgtcacaccaaaaaaattcgaagaaaaagtcgggcaacaagtcgccaatattgagtgccaacaacaaaaacgattacaacaacaataataaaaaagatgagcaagaaaatgagacgaaggcaattggtgccaaattgcacaattggacgagcaatgccattgccattccgtcacgtttcggccgatgcgccgacggcggcgccgcaggggacaccaaacgcagcataacaacacacaatcagcagcaacagaacggaacaatgcgaatgatcaggcggggcatttcgccaagattattcagcaaattccccgcaaatagtccaagttttgcaaatgagaagcgagaaaataaccaccgatttttcgaataagtaaataaccggttgaaacaaagtcggcaaaaatttggaactattttctcaactatttgattagtaatttttagaacctggaattgaaagatcaatccggaaaaaccctaacaaaatccggtattgttccggactctagtaattttatatctcaaagttccatttttaccagtatattttggaaccaaccataagtgtcaggcgggccatgcatgaatttactttttgccttttttgtatccgtataagacacaacaaattaaaaaaactgttaaattcctaacaatgtttgtgataaatgataaatataaaatgctttcaagttttcgcatcttagaaatttttactgaaaaaaatacaacttaaaattggtttacagtacgctttttcaggcatccgaccattttggctgaacgaattcttacggtagaacattttgagcagttggcagagaagcgaatgtccaacag

SEQ ID NO: 8333 - DNA, 3298 bp, Heterodera glycines
aattgccgcggccgcgcatcgcgcaaaaaaaaaatgccgcgaatcgcggatcgcggtcgcgctccagccctggtgtccaatttaccggtccccattcttggagcatcaaataataccaagaatattacatttggtgattaagcaattttatgattacattttccattctattacccctttgcgggttttataaaacgactcttgttttggaatttttcaaaacttattgttagagcacttaaatcataaaagcatttaaaaattatatttgtttaatcttgtaatcttttttgagttatttttttattcccttgtaattgaaaaagtctgcccatttaattcttctcacctccattagcaaatggtcgtccattccatttgctatggttttttccttctcttgtcagcgcagcttttcccatgccacacgactttcaatgtgccgttggcgtcaatgtcgaataccacttttgcacctgcagagatgacaaaaaaggacgttaaaaaaatcgtggaatatttttattttttttaatggcgagaggaacaaagactcgggatcccgatcgatcccgatgaattgaaaattgctcggaacggaccccgaagtcgggatcgagattttttaattagggctaggagaaataaacaaaattggttaaaattaaattttcttcggcagcatccttggccaggatgaagcttcccattgaaaattttatttaagccttaatcccccaccttgtgcaaaatgagagagtgcacttggcattctcacaggcggcacgaacacgaaaaaatgcttcagggctacagctgagcatgtacccgtgctgacgcatgaattccccaacgaaatgatcgaccggaaatgccaaattttaaagattgatgaaatatcaaaataaggactagataactgcaaccgctttttttgcgacgcgttttttcaaaaaacttggggagggcacaaaggggggaggagtcggcatagccgataaccgcagtcgttttaatgaaatttgctaacagatttgtgtccaaaaatcgaccgaccaaccttacccaaaatgacaaaaattctcgctaatttttccaaaatccataaaattataatacaaatctgttaaaatatggtcaaaattctcaattttcagaaaagaggtcgtcgcctaggacgacgtacccccatgtccagacatttgcgccgcctatatccgataacgggtttaaatttgtgtttttttcaatcctttaagtcataaacagcattagttttggactaggcgaaaatgtccggcgcaaaggcgcatatgtcgggtaaccggtaccgtcccccacccccccccccggccaaaaaacgtgactggacaatttgacagtaaaatacacaaacagatatgaaaacaccgtcgcctatggcacaatcggttccctacggcgctgtccgattattgcgggcccttgttagttaggatatgttttcaaaaattgccctgatcagtctgtacatcgagaaatcctccaggacccaaccctcttccatgctctttcttccttaccattcgattggtgaagtgatcaccctcgacctgagatttaaacaccgccgttgtttttcaaaaatggcgaaaatattcttttttcccaccttggtcattgttgatcgacgcgaagtatccattgcgaaaaacgccgacacgagaagcgctcgtgccatgaccgatgccaattgcatttgtatttttcggcatttttttatgcgattggaagtttggtaaatcttaaatctagtttaattttttaccgttggttgataaaagttaatgatttgtttgtttatatttgtcttgacttattcggtgagcatttttaatctttagaatgactatgatattgaaatagaagaagaaacaatagaaattataaatatagacgacgatgaagtatcagactattcacagatatacaatctctagccaaatgaataattcaactcttagaaaaatgaaacaacgaaaaaaaaagaatattgatcaaaaagagagcgaaaagcaaaaatcgcgaaagaatggctttaaatcgttaaatttttgtagaagaaagtcaggtagaaaagcaaaaaaaccgtgaaagaatggcttcaaaacgtaaaaaagaattaaatggaaaaattgaatcttatatttgtgcagatagtttaagtgttacaaaacacaacatagcttttccgattatcattagggccgggaattaaagtcactaaaaatcttcataaaaatcgccaaaaagtcacaaaaaagtcataaaaaaggcaaaaaaagtccaaaaaagcacgtaaaaaatgcaaaaatgtcctgaaaaattaggcgaaagttaacaaaatcccatttttaataatttatagaataacattttgatcgtatttttaggcacttaattttataaataggtaccacctaaatgggcataaaaaagagattcttccaacaattaagaaaaaattcatccaggtttcattgcctttttatcgatcgaaattttatttttcggcattttcttcgctaaaattcaaattttgcttcagtaagcctaaaaaaatcacgaaaaaagtcgcaacaactcaaaaaagtcataaaaatcccaaaaaatgcgaacggtgaaagtgacagagtttttcccaatgagtaaacaatctctggttgtaattatgcattttttcagcgtcaagttccgttctcagatttacgaaatggtggtctgataaatattggcgactataggctcaagccataaatggtataattaatgctgaaaagatgggaagaaaaaaataaggttttcttttagataggattcccatcttttgtgtaattttagcaaattgaccaatcatcgccctttttcgtgcattttttgcacattgatctatcatcttacttgttgaatgcctgatctactctaaatgccttaattattatccatttaccctacacaaatttatttttcaactcaattccaggatttattttaggaatttggtgtccagttttccggtgtccaattttcctttggtgtacaaaattccggcggtgtccagttttccgcgtggtgtccaattttctggtgtccaacagggctggagcgcgcacagaaaaaaaccgcggccgcgcaccgcgcattcaaattgccgcgggcgcgcatcgcgcaaaaaaaaaatgccgcgaatcgcggatcgcggtcgcgctccagccctggtgtccaatttaccggtccccattcttgcatgatcaaataa

SEQ ID NO: 8334 - DNA, 1450 bp, Heterodera glycines
  misc_feature (1427)..(1427): n is a, c, g, or t
aatttatatagatttttacaatgtattgtattataatacactaatcttttatttataaatatgcaaaaaactcatataattgttcaaataaatattttttacaaaggaaaatggtaaaaaaactaaatatttaataagaaaatttattccacaatagttttaagtttaaaatataattttataatgcaaaaaactaacaattttgaggcaccttttttagcaacgcagaaaggtaaagcttgcccgtcattcgtaaaagattttaaataaggaaaatgtctaaaaaaataaagaaaaagttcgatattaaaatcgccattttttggagggtttgctgaaaaaattatagttgaaagataaaacccccctgaattacacccccattttgaggggggttgaaaaaccgaactctcggtggttctagtaaatacggtattatgctaactaaattattctaacgtactaattaagcagtttcccattaatataggaaattgaataaattttcaaatttattaaaattaaatgatatgaaaatactagagatcgacattttgaaaaaagcctggacctggacctggattccatgttggacctggatccaggcctggtggacctggattttttgaaactcatcttaaaaatcaaaaaaaggtttgaaaaaattaattaattgcttagaaacacctaaaaatatctaattaataataataatgtatttttaaattaatttaatctttttttaaaaatttaaaaaaacatcggtcacttgaaataataaattctaaaattttgtccaggaaaattcaggtttttcgtgttttgcctggacctggattttttttcacattggacctggacctggatttcctggacaaaaatccaggaaaatccaggtccaggaaaaatccaggttgccgaaaaatgacctggacctggatccaggaaaaatccaggcctggatccaggtccaggccaatctctacaaaaaacatccgaaatttattgccttttcatcacaataacggcaatggagacattaaacaaatcaatttactaggccaaatcagcattgagataaataatttttaaaaatcttaaatcatgtcatgaaaaataaataaataatttagaagatgaattttttagaaatttttcatttcttagtggtgcattttttgtttttattttgttaagaattttgggcaaaacgccaaaataggtcaaaaaggctttttcaaaattttttagggtttaggttctaaaaataaaaacctagaacaaaaaaaacattttttgcgtgctttcaggtcacagggagctcacaaaggaaggtccccaggtgtccgtgggatttccgaatgaaactttgtgggtgaatagagcacctatgggttcttaagaaaaatggtttcaatttctgccanaataagtacgggtgccgagttat

SEQ ID NO: 8335 - DNA, 2271 bp, Heterodera glycines
ctgtggcaaatgcggcgacggaatcggctgaaatagggaaaattgaaaaaaaaacattttttttatcaaaaagaagaaaaatagcaatttaaaaattaaaaaaaacaaaaaagtaaaaggaaaaaaatcgaaaaatcagaaaattgactcaaagcaaaacgagacgaaaattaaataataaattagccaaaacaccctcccacgataaacttttttttcgcacattccttcgacccatggaaagaaaaataaaataaaaattgtaattaattttttgacagaaatttaacgagcaattttttgagtgcctatttgaaacggttaaacctcaatttccgtctgttcatcgctttccctttgctctccgtccgcccctccgccggtgtttcgaatgcgtcgcaatttggcaaaacctcaaaaacaacaaattgttattttttctataatcgcaaatggccagctgaccgttctcgagcagaacttgagtctgttcagggagaagaacggccggaacatttggcaattcggtgaccaattcatttttggggcggtggacggaatggcaaagcaaacgaaattgtcgaagcagcaaatcaacgcctaaaaagcaaaagccctttttagtacgactttttttttactaaaaaataatttaatttttgttcctaataaatttatctgttaaagttttagtgaaatttagctttttaatacttttcttaattggaaaaatgggtttaaataggtttatctcgtgcatttaaatgagtaccatcaaagacagcaaagttcgaagagccaaaatcaaaaatttcaattttgcgtttaaggcccgactctgcgcgcactttgaaattggccaacacatggacgacctcttgaatacgacctgtgacaattgttgcggctacttctgaaaaataaaattcaattgcccttccatttggttcgtcgtcctttgcttctcaccccctttttcgtcaaaactcagtgccacggagtgcggctctgtccgttcttcgtcctcctcgtctttctgctctttttgctgttcgccttctgcactatttgccaatatttgctggccatcgtccgcctcatccgccgaagaggacggcgaatgttgcggccccgtggcgtcctctttcgcctcctccgccccctctgagtcatccgcgcgacgccgaattttcagcccatttttgttgcttcgatttatcttcctcttacgaatcatttgttgaaaaaaacaatttgcttcactaaaataataaattaagaatttgtatacagtttaacactcagcttttgtcttggttcaattccctcgaggaatatgggttattggcattattataatggcgctctttcaaaatattttccatttcttttattcatgcgcttttgttgcgcaatcatacagtaaggtgcaaaagtatggaagcaacgcttttttatgcaaaaccgcttctccagcagatgagtgattgaatgaaaaaattgagtaccatagcaatactcaattttgattatttccccttgaaatactgtagaaagcagtcatttttgccatgccaaattttgccccctttctctgtctcatcatcagcgggtattcgtcgtcgaataaccattcaaaatgcaattcggtagagaattagcgaattttgcgctctttctgataggcttactcattttttagagaaaaaatttccaaacctcctaggaccccgattttcagtgttttggggtgttcaggtcaccatgaaggagtagtcggatcaagttggtgcaaaagacttttttgatcagaatcgttagacttagtaggaattttttcaacaatttttctctatttaaagttatctagtttttgttcgattgaattgcttccatactttttgactgtaaatttttcatgttttttagaagatggttttttctattattgcttccgacaattggggcgaaaatttcccgagactcgagaccgagacaagactcaaaaacccgagacttttttctatgagaccgatacaagacataaagccagcccgttttcgtacgggggtcgttttcgtacgagtgatatccaaaaaaatatatacctaaattaattaaacaattgcatttaaattatcatatactaatgtttaaataattgctttttaacgttttgagcaaattaggtttttaataactacaaagatgatccacgcaagtaattaaaacaaaacgaaacaatgagaagttggaacatgatggtgcatt

SEQ ID NO: 8336 - DNA, 1226 bp, Heterodera glycines
atttggttcgtcgtcctttgcttctcaccccctttttcgtcaaaactcagtgccacggagtgcggttccgtccgttcttcgtcctcctcgtctttctgctcgttttgctgttcgccttctgcactatttgccaatatttgctggccatcgtccgcctcatccgccgaagaggacggcgaatgttgcggccccgtggcgtcctctttcgcctcctccgccccctctgagtcatccgcgcgacgccgaattttcagcccatttttgttgcttcgatttatctttctcttacgaatcatttgtcgaaaaaaaaaacaatttgcttcactaaaataataaattaagaatttgtatacagtttaacactcagcttttgtcttggttcaattccctcgaggaatatgggttattggcattattataatggcgctctttcaaaatattttccatttcttttattcatgcatttttattgtgtgatcagcgatcactgatcaatgtatttaatgtttttagaagatggaaagagttaaaagatggtttgattcggagattctaacgatgatcttccaacattagattaaataaatctgagatgggttttttgttcaaaagtccacaaatgttgcaatttaggcgcacaaaagactggaaccgttctaataatatggtgattaataaaataggtatcaggtagagttgagcgggaccgggaaatttgacaaaaaccgggaccgggacttaccgggaccagaaaagtcgggaccgggaccgggaccaagtttttcgaccgggaccgggacagcgaaaaaacccgggaccgggaccaaccgggacttttcccaagtgaaatttttttttgaaaaaaattgaaaatttaagtgcactttgttacgaaaattgccaatattcaaaaatgtaccaataaaattttgtatttacgttttgggggacgagttcgaggaaaattattaaaaattttgttttcaggggggggggttcttggaattttctgagtcccactgtattttttttaaataaatttacaatcttttaaattttttgcttttaaatcgctgtttttgtggcaatgttttttcaaaaaacttttttggaacagtgggagggggccgggggtccggcggtgtctataggtgccgccggacaaatgttgaaattttgagcgagatttgttatcagaagttgttcaaaaatgaccaaatatttgg

SEQ ID NO: 8337 - DNA, 2754 bp, Heterodera glycines
  misc_feature (2742)..(2742): n is a, c, g, or t
  misc_feature (2744)..(2744): n is a, c, g, or t
ataaaaggcgagcaaatggcataaccaattcgttggtgttattcattataatgaaatttcataaaatatttaaagaagagtttctgttgccaataaaaaataactttaatttaatttattttattttattttcatttaatttaatttcctttagcagatccaatttctaattcaatccttctactacttcccaaaatgcttctcacttttcctttctgtcttctgttgatttttgctaaatcatccaattgccaaatgcaaaatttcaattgttttgcccaaaatgggcccaatcgccgcctctctcccgcccaattagcagacacagccttttggcatgagcaattccaaaagattgaactcatcaatagctcggacttcaaattgaaagagtttatttgcgagttgagccaaaagcagcgaatatttgaggcagtttttggaacattgccaagagtaagttaaccgcttaattaattaattaactaatgagtccaccaccactaattaggcccttgtccctccttccatggatggtgaatttgaattcatcaaaagtagaagagaaatgcttgtccacaatgatcccgctttgagtgaagtgctcaatggtttatttgtcactgcaatgaatgccaaacagaaattgcaattatttccgggtgaataaataacacttttaattaattaccattattaattattaatttgtttcctttttcgatgttgacgcttttctgcttgtcaaaacgatgcgaaagcatctgagttttgtgcttctgttcttggccaaacgttaccgaattcggctgagtgattcgaaagagcgaattgttttgacggaacaaagtctaaaggactttttagaagagtcattccaattaatgagccaagtaattaatatattttttcaaatatataaccaattcttccgaatcattagcccaaaaaatgtattagctgtgaaaattgtgcgaacgatcagacaaaaagcggaggaaagaattactcgagaagaaagcgattgctccaatttatttcaaaagcaattcaaattgattgggacggaaatgggctcttaaatcggtcgaaaagtaaatggcactaattaatttgggctttaaaaacccaaaacaaattaagactcaaatcgccgccgcaagcgaaagaaattaatgaaaattttcgagccgatcactctcgccattcttctgctttttctagtgattttcatcatcattttatttattctttgccacgctccgattatttcctttcgcaacggcacagcgtttggcggcggaacaaacgcagcgatcactgagcaatcagagcaaagggacataaaatgtaattaggaaaaacaatgattaaacacagtgccaaggcatttaaaaaccctaaaaaaaaagtcaaagaaaaaagcgaacggacggagagaaagggaaagcaattattaaatgctttcaaaaaaatatttttttaaggtttgaacgcattcaaagggatttcgcccgttgttgtggacaggcaaaaaggcgatgaacacgacgagggggaggagaacgagcagttggactgcgcaatttgcctcggccccattgattacggcaccgaagttaggccattgcccgtctgtaaggtgtgccatcttactgtaatacagtaacaaacaactaaatgccatttcaatcactaattttagcacaaattccacgacgaatgcattgaattatggtaataataataataattattatgttattggtcccccttttttaatagtgtgacataatttaggatccgaggcggacacaacgcgtgcccattttgtcgtcaagaaatattcaatttacaaatgatgtcaccgacattatttccacgtacaaaatttttggtttttcttgattaattaattaagcaaattgggtttaatggggaaaaatattcgctttttaacttttagaacaccggcagaacaatgatgggacaaatgaggcgacattaatagaaataacaaatggaaggacagaagaaaatgaagaaggccggagggaggaagaagaaggacgacgaacaacagcagaagagggaggagcagaaattgaccaagtgtaaaagtggaaatgttaattaaccgaaaataataataataataataaaagcgaataaaaaacggagttttattatgtgatttggatagttattgaatgaattcgacattatccaataaatgtaaatttgggtcgggacggcccaaatttttcgggcgactaatctggtcattattattgataaggttaaggaaaatcttttcacgcactttgtcaaatctaaatttaattataattaatttgcattttttttgcttgccgttttctttgtctgcggatttattggttaattaaataaaaagcacagattatagtaattgatagtaatttatcatgacaattcccttttatatatattaaaatacagctgataatttcgagggactttctcatcaaaatttcttttcttgcacgaccgttccgttttcgaatcactaaaattaaattattaaatccaatttggcattatgccccccgtcccaaccaatcggttcaaacggaaaaggagttgccgactcagtgcgctgctccacagattctcatcgttcatgtttttgttgtacaatgcgaaataaggcagaacgttgttttcgtttactaatgaaatgtcgaataattatttcatcananatttttaatt

SEQ ID NO: 8338 - DNA, 1042 bp, Heterodera glycines
  misc_feature (88)..(88): n is a, c, g, or t
aatagaatagcaggtgatttgccaaatctgttcttttcttaccaactggtggctctttttggttcagcttaatcgatgagacggcganaattggcgacgttttctccaaatttgtgccgaagttcagtgcccttggcgcggcacttgccgaaagaatgaaaagaatggcaaaaaatctcaacattttcaatgcttttttgtgcttaataagataaaaaagaaaataaataaatatttaaagaaaggaaaaaatcgcaaattttgttcttttaggaaaaaatataaaaaatgtttttgcttttatgaataataattagaattctgccttttttatacagcaaattaaaattaatttgagtttcattctttacttttcactaacaatttgcaacatttcttggaaaccaattgcttttgcacaattataaaaatgacctttactgttacaataatatgggaagcgaaaataattgggccaaaggaaataaaacaaattaattgaaagaaataataaaaattaattttattaaatttgaattgtgagtaaaaaaagaagacgaaaaggaagtaaataacaaataagctaattaccagtagagaagggcaaataaacatatcacaattttaaaaatcatattaattttgataataatataaaatcattaaattttctttcgtcggcaccgcttcgaagacaatggtcataaaattgaaaccatttgcttatttaaacgcaatctccgcccaataatttaaatttaaaatcggaaccatcagaaagacgattgaaaattttggcataattaaaaataatcaaatttcaagagatggcaattggcgcatgttataagcgtgttgtcgatttgtcatttttaccttaaaattcggccattttttctcatttgaaaatttaaatgatttctttgccaaaaacttccaaagttccccccaccaccacccatttttattctcattccaattgaaatgcaagaaaattgtgtctccagcagttatatttgccattttcatgcttatttcgctt

SEQ ID NO: 8339 - DNA, 2174 bp, Heterodera glycines
atggaaagtatgataaatgaaaaaattttttgtggccttataatttctttacagattgttcgtgcagctctgcattgaaaacttgataggatatggccacttaagagtttcagaaattttttgtatcaatacaatttttggagagtccggaaccgggatcccggcaagtaaagatgtattttgaaaataccataaaaggttttagcaaaatttagaaaaaatagaaattatttagaaaccactaaaatttaaatttacttttgtttaatcactcacttttcgtatatgtttcgtctcatctatttgagttttttcagcttaataattaattcattaattaatgttttcgattttcttgaaaaattccaagattatcacggtcccggatgaagaaaatccaaatcccggtcacggttattgaagttccggcaaatcacggtcttggtttccgttcccttcggctctaccacagttcgatcagtcggtttttcatttgaacaagcaaagtggccttatttcccttgcaaaagagtcaaaaatcgcttcctcataaaaaagttttgttaattgagttcaattgggtcattatcattcagattttaagctaaaaagggccactggaaaattaaaattcgttttataaatttcacaaaaataccaaatttaacttacaaatgcatgcgatgcaaaaatgcagtcacattgtaaaatcccaattttattgtacaattcaatgaaaataaatatatcaattcaattaaacgatgccaaaaatatttaataatagaaatgacaaatcaataatcataagaaatttttatgacgcatttggcagatcatttgagaaaatgcacatatataaaaatatatgaaaaaagctaatatattgcaagcaaaggttttattaatgaaaaagaaaaattggaaatattaattctccaatttttttttcaattttcaattttataaacccaaaaataaagatttttaaaagataatgtcttcgatttgcagctaggaaaaaaagggcggatggagggggtggggtacatacacataatccgcgctaaatataagaaaacatatgcaaaatttactatatttcataaaaatttgtcaagatggttaaaaaaatcaatttttgtataaatgttttgccttttcccccacaaaaatgccattcttaggggtgtatatttaaccccgaccccgatcgggttgagggtcgggatcggggttatcggggttggaagcgtcggggttcgtggtcggggtttaccccgaaaatggccaaaaaagtcggggttcagggtcggggcggggtcggggtcgcaaccctaaaacaaatcattgaaaaattcattttcacaaattaatttattgtaaaatatttaatttaaaacaactagttactaataaattttctttggtgttttaaagttatatttttcaataatgaataactaattttttctgatgaaaattaaaaatttaaatagtagtgatttaataatcaaaagattcactacgtcatgtaactctaggaaagcgcacaagattgaataaaaattttattaactctaaatttaatttttattacattcaatttttttgaacatttttaatgtaaattattatattgttatcacatagaaaataatctttaaatcttcaaattatgaagctatttaatatcatttcatttttttaatatatttcaatagaatttttgatgtttacttattgaacaaatagctaaaaaagtcataagtaaaacttaatcaaataaatacaattataagaaaacatttgctaactgttaaattgaaaaagaaaaaatgataaaacctagaatatagaaaaaggcatatttttttaaatatactaattgcttaatatgtaagaaaagaaaaatcttaattagaacatattaattaaaacacgcaatttttacaataaataattaatttaaaaaatatatataattaagtgaaaatctataattgatgaaatataaaaatacaaaaataatgaataagaaagattttacaaattagtcaataaaaatgcagtaaaattcacatcacataaaaagaaattttttaattatcaagtatttaaattataagatgaaaatttccatacataggtctaattatttaaattttactaaa

SEQ ID NO: 8340 - DNA, 2701 bp, Heterodera glycines
aaatccattagctcttaatagcatattggcaaaaagtcattataataaattctattttacattcaaatgatgacgtgaaaagtaattataataacagcttacgcaaatgactaaaaattttcgattggtttttattcacattgttaaaagaattataataaatttatattttcatgtaaataataatttaatacatattttaaaattagttacgttataataaaattatataacaaatatataatttgaaaattaaaaaaatagcttaacattcttcattcgatttagattatggcagtatctgctgtaattgttgtttgttgtgtgatcgcaaagccaagggacaacggcagaaaaaggtaaagcaaacgaatgcttttgcatagcaggtaattatgggcaatttgaccgggttttgtgatgggaaaagcgaaattaatgagcgaaaaaagaggcaaaattggcaaaaattcaaaaataaatttgtttttttattaagctgagctcactttgactttgactcttgaggaaatgttccgttttgaagcggaagtcgtcaaagtgttaagcgataaatttgaaacgaaaaaagaaacaaaaaataaaacaaatgccaaaggaaagggaaaagaagtggcaaaagaaaaaggtaaaaaataacagtcaattaataataacaataattaattagttaattaattgtcttaaaaattaggcccaacaaagcctgaagaacaaattgctatttttgaggtattattttttgcttttgaagtttagatactttcattttttaggaaattgaaaagattttaactgcaattgaaaatgaaagaaaacgaacggactttcagaaaatcatgaaaccatttgaacagtttttgaagcaacaaattcaaggtgaagaaatcagggacggttaatcccgatttaaagttcccttcttaccccggtctcgacttttaaaaactcaaatcccgacccaagttataccttcaaaattcgcaatattaaacttaaaaaagccgaattttttaattttaacgaaaatatttttttaattggttatttttttaaattggctaaaatttttaaggttcctcaattttttttttaatttgtaaaaataaatcaaaaattcgtccattttgaatttagtgaaaattgttccaaaaaattgggcgcgcttcgcttttgccaatttgggcagggcattaatgaaaagatgcacaacaaaatggtgggactcaacagacgaaaagaaaaagcaactgcacaaatggtggcgggcgtttagcttctcgtaaacattttatcaaaagaaatttattaattttactattacaaattattttgattgtaaattaaagttttgatccttcgataatggggggacgatcaaaagaagccgacaatggtggacaatcgcgacaatttttacgaattacgctgaatcagtattgttcgagcagcctcaaacactacgaaatggtgctggaggatttgtgggtttttcaattccattaaatatttttattttttaaatttaagagcaaaaaataatgaaggaagatttgttgcaagtcgaattaattcctttggctgaagaaaaagccgaaaaatgtattgtaattaaaattttaaagtgatgcaatacaatcatttattaattaaataaactttttttccatttaaagcagaagcaatagaaacgggagaaatggacgaggaaatgccaattgaactgtcagtgtacgaattgggcatgtacagaagattcaagcacatggcactgctaataggcgacattggtagacaaatgtttactgtagagtgtacagtaaacctaagaaaagaattatttatttgtcctttttaattaagagattcattacggctaccaaggtgtttggctaacggaattaggccaatttggcaaaccacgatcactgccatttatgtacggcattcgatgcgcattaatccattttaaatgacaatttagcaaaaaagtgcggctggacaacgtggtcacgcgtcacagtttacgccaaattcaaacggtggtcgaccatttggagatgggtccgtacataaagtacgactttgtggaaggaaactgtgccgatttcacaaaatctttgcttaaattaatttcctggacgaaatcgccggaaatgaaaagcgatggcaccgaagggaaagaaaatggcaaatatccgccagaaaaagtaaaatatttaataacaaattaattgacagtaaaaaaacaaattgttgaggtcgattattcggaatggaacgtaattaaaagggaaggaaagcaaattgaacttgcggaagaagtaaaaacgtttaaaattaaattttgaaatttcatccctttttttcagcccattgttcacaaacaaattgaattggcgaaggtggattttctgcagaacccacgcttggtacaattggtgaaggacggaccagaaattataaaaggttttatgcgcgcagtcacacaaacggtgacagcaatcggaggcatggcaagaagaagaaactgactgatcagcagcagatcacacaatcggtcaactgatcgatcgatcatagttgccgatcagaccattcattttcctgttggcattcattcgtttatcacagtgacacatttgcgataaaagcagagatggggagcggtttacctcag

SEQ ID NO: 8341 - DNA, 1595 bp, Heterodera glycines
ccattttagaccataaataaaaaattcgataatttatttttcgactttttgctcgaattcaggttcggggttcgacttaggtcataataaatgtcagattcggattctccgacccttaaaacccctaatatgatcttttcttgaagaaaaatttcaaaaattttgtttttcgaaaaaggggagggggggcaccatccgtactattaccgttaatacttaatattcatcattatgtgtataaaaatacaaaaaaaaaaattcgaccaaaaaaaagttgcaaacaaattttcaaaaagtaccttctttaaagtagctccaaaaaggggcgtatgctaccatctaaactattacccaagatatttttagcacgcaatgtttggtcaaaaggtgtggtgagctaagttttgacttgttcaaatttaaaatttttttccaggacattaaatttggatgcctaacagttgaattagtttaaaaaatgcgcatgtttatacaattatagggcttttactccacatacaatacataacacataatataggaatcacaacaaagaatcatcctagacattacacagtgatacattatctgctcgatcagaacatcttcttcatcttgtccaatacgttcgtcacggcaagcactttgcggatatgcttcacgtacaagttgtgagcgccataagtttgcggaagggccaagtagagcagaaagacggtcttcagaggcacgtacagcagcagaaggcccattgatagagccaaagagatagtcgaactggcaaaactcggcgaacacgcaccaataaacgagccactgggtgtattccgctgaaaattggggaattgacattgtactcgaagagggagagcacagctggaaaacccacatgtgttttgagtgttgagggtcaacaagctcgcgtacattgggtaggccacagcttaaacaaagggaagcgattggttaacagaggggcacaaaacggaactccctcctcaaaacgcactgataagagtagagagaagcatattgccagggcagagcatcaacacgagcagcacaagagaggaagtgatgtagaagagctgaaaccgggaaaaacagtgtaaattaaaaaaagaaacaggagattgggctggctccaccttctcacgttccattccgcttatttcttcggccttcttgatgaacggatgttccaattcgttgagcgttttctgcagcaccggaagcacgtccttgaagtctttgatgggcacttcacgcagctgaacgctcacaacactggcagaagaagtcgtcgattcgtcagaagacattgttgcgctttgattgtcagcccaatgctctttaatttaatacaaatgaaagtgaaaaagtgacgaaaatcaatcctatttaaacataatttccaactattttgtctgtgtgttaggtaataggtggtatataaaaataggtaaaatgctagtcagacacacttacataggtatgtatttaaatacaaggtacttatgtactttacagaaaccataaaaaaaattttattttttaaatcgtttatagaaaatttttgtagagggtttttgggg

SEQ ID NO: 8342 - DNA, 2097 bp, Heterodera glycines
ccctcccccagcagaagacagccactctcgatagaatgagtcccgattccgggcatcgagactctgccggagtgtcgggtgccggtgccttcgatatgacgatagaaggactgcggacattgatggaatttcgtggaggcgaagcattggagaaaataagcaccgactacggaaacactttgggcctttgcgaaagactcgcgacagacccaaacaacggaatagcgaatacgcaggacgaactgaagaggttgcctttgctgaccatagtccgacaaactcttctttctttgacttttccgattattcggccctttgttggcttttaagccccaaagtgccgctgaaaatcctcgtttgattgcccaatcttttaaattttaaggcctctgtgtgaattgacctttgaaattggaatttcaggcggagggatgccttcggtgccaatgaaatccctcccctcccgccaaagtctttctttacgctcgtctgggaggctctccaggtctgtccgatggcatttcttaatgagtctttttgtcggtcaatttaggacgtcactctgatcattttacttattgccgcagtcgtttcacttgccctttcattttataaccccggatcggaactcggaggttcgcttttccatcatttacaagcgtcgtctttcctcaggtggaaaagacgaaactgagcaggaagcgggttggatcgaaggtgcggccattttgatttcggttgttgttgtcgtactcgtcacggctttgaatgattacacaaaagagagacaattcagaggttggccatccccgggaaaggcggacaaaaaatgaatttaatttgaatttgaatttaaggattgcaagcgaagatcgaaacggaacacaaattcgcagtgatccgcggaggaaagcagctgcaagtggtggtcaacgagttggtggtcggagacattgcgcaagtgaaatacggtaatgatttgccggaaaaagcggacgatggcactttgacaagccgaccattggcacttttactcattgacactttcccttgcttcttcaggtgatttgctgcccaccgatggagtgctaatccaaagcaacgatttgaaaatcgacgagtcgtcgctgaccggcgaatcggaccaaatcaaaaagtcggccgagcatgacccaatgcttctctcgggaactcgtggtcagttgtgcccattttgttgttcgcactttccttttagtgatggaaggcagcggtcggatggtaattactgcggtgggagtcaattcgcagatgggaattatcatgaaacttctcggcgcggcaaagtcggcgatggaagacgagcggaaggagaagctgagggaggagaagcggacgaggcgcaggagcaaagcatcaggtcagtgggagcattggccaattgaggagaatggtattcgggtggggcaccgtaaccgattacggtgggactttggcattatttccaccatttccttctttcgtgccgagtcttttcataaattggacaattgggcattcttcaacaaataatttatcataatttatgctcgaaagcaaaaaaattatcatcgatagtaaaagtgttatccattagtctgcaaaaaaaggttaatagaggagaaccaatgggtaggctatcaagctactatcatttgttgtgctttcattgtgtcctttcgcttattggatagtatgtaccaaaaacctaaaaaagaacactttcagacatcaaacttgacggttacaatggcgcaatccctccggggtcggcaggaagggccaaagatgactcggaagttcagccggccaagaaggaacggtcggtgcttcaaaccaagctgactcggcttgccattcagattggttatgccggtgtgtgagggggggggggcgacggatcggcgaaagtgtcccatttgaggctcttttgttgctgcttgtacggtgcttattttgggcattcgcttttgcatccaacactacctaatcgaccaaaaaccattcgttgtcgccgactttcgctatttcgtcaactttctgatcatcggcgtcactgttctcgtcgtggcattgccg

SEQ ID NO: 8343 - DNA, 1192 bp, Heterodera glycines
tttttggccctgacttccaaactgatcagaaaaaagtgatcaaagttcccgaaaaatcaataaaaatgacaaaatttttaaaaattcataaaaaattttaaaataatgatagagtaattaaacttattttaaaatgatcagcaaacatatctctatcaaatagcatcataaaacaaatttaaataactgcataaaaatattctaggaggagtaatactttgaaaaaaattcaaagtaattcaccatctgtcgggcggatccgaacccacgacaatgggcaataagatgtaagagaaaaaaaatccttttttttgctggcattttcatttgatcacttttttctgatcatttttggcgctggggccaaaaaagccgaaaattgtcaatagtaaatcgaccatgctctacacgatagaagtgtttttaaagtgatttgaacacttacagttcgaaatgttcccttgtgagcatcgtagtgcctctttcaccgagttgaaagcttttcaagaacgctatgaaaattgaaaaaaatgtatttttagactttgcttatttttacctgtaaacttcttgtgtttgcaaagtcaaagtcgcggaatagaacactttgaatgcaagctgaaaagcttttattgccaaagcagatgagttaccattacctctttaataatgtttttgacgtcttcgttttgaaaatcggcattgactcgttgaattgcttcctcgatgtactgttgaattcgtctttggatttcgggatcggcaagcctctcctttgaacacactccttttccgaggacaagttgcacagtttacaatccatcttcttcgattgcgcagacctagttacgaaaaatttaacgaattgaaaaaggattttacgataaattccgctgcacgacgagcaaagtgcatgtcgcactccattccaggtacaaacggggccgcgaaaaacaacaattcagcggcggttgatccttacaggaaataacttcagtataagtattcttcggtaaatcatttaccaacaaaatactccacaattgcgagaatttgttgtctgttgtagctttcacggcctactacgaccgttttcccatggtagggatagcgctttccgtcctcctttacgtcaacgcctgccgcaacagttatctgaaaaacatttgtctgggtccgatccccgcctcaa

SEQ ID NO: 8344 - DNA, 4754 bp, Heterodera glycines
  misc_feature (4666)..(4666): n is a, c, g, or t
atcaataggtagccaactgcttttcggttgcatctcggtatgcttccgtgaaatagttgtttttcgttggaaatagctgcgaggcgagtgtgcgcacttggagcgcccctgccgggttacgcatcagcaccagatagtgcgagttgttgcgcgcaacccgtagttctttcgcgaacaaatgttgagtgaccaacacaacgctaaccccccaattgtgcgatccccgggtgaacacagtgtcaagaaattgttgccccataccaaccatgagatcatccagcaccatcagcagttttccatcactctcttttgcgcgccggttaacctgctcttcggttgggcttccagcatgtacaacaaccctacagccaacgatgtgtccacttttctgtagctgtattatatttgggttcaactccccataacaatagaaaatctcggagatgggttccgaaactagcgcattcacattcctcagcattcgcagcacccattccgattttccactccccgtgctccccgagattgtcagcgtgaacgggtgtctgaattgcaaatgtttttcatcaaatttttgaaaattgtcagccatttgtttaatttcataaattgtttcaaaatacctacattttctattttatatatacatataataaaaaataagtgtgtgtgtttagatcattcttaaattgttcaaacaccaaatggacgcaattcttgcaaccgattggctccacaatgcgttcccagagcgaaagacaacaacaacaacaacaacaacaatttctagtgtgggagaagaattagacgatgccgtcaaagcagtgagttttacacaaaaataaatttaaaaaaaaataaataaatgaataaataaaatcaaggaagagcaaatcagttggcttaaaattatcgaagaggaggaggagcgaggaaatgaattgcaaactggtgaaatggaagtggaacgagcgaaaggtttggttgtttacaaaaaaaatgaaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggttttttaatttaaatttatcagctcctcaattgtaagatatacattgtttttaggtccgtatttactactatgtgaagcatggcgtaaagctcgtttatcctcagcttccctgtgttcttcaatttggcggtggtgaccattgttctctgtttccgcttgagtgtctgagcgtcataaaagatgcttgattaatacgcatcgggtgttttatatgtgattaagtttgctgtgttattgttgttgttgttgttgttgttgtttttttttttaatttctcctagataaaaaatgttaattattcaaaattgtaccgcggtgtttaaattacagctgttgcctttcacaaaagagcagtttttgaaaattgcaaaaaatggcttcaattccgagtacgacccccaacgatttcatgcaatcatcatacgactacgtctccccaaaaaacgcactcttgcatgtcttttatttcgatcagcccgtgctgtgttgactggtgtgccttgtccagacagagcggtgcgcgaggcacaaaaaatcagacggagggtgcagcatgcgttgggctcccagctaggaatccacgagttacgtgttacaaattgttggttcttgcactttatcacatcgattgtccatgctgaactttttaccaacactggacccacacaggttccgcaacatcaaatatgatcctacaatttttcccgccatgcgttgtaaaatagtcattgacgacgacgacgatcacactttggtcacttgtctagcctatcattctggaaaaatcattttaacaggatctaaaaggcaggacaatttgaaccacgctttgcattcattcttagctgtcttaaataattgatttgttcatccaattgtaataaacacttttttgtttttgcaactgattttttttattaattccaagttgagcacccaggacggttagaaattaaaaaggcatcatcatcatcaccaccatcatcggcattaaattgctgtaattcttgcccctgctgatgctgaactgtttgcgcttctcggaatccaaacggggttgtcttcatgccgggtcgaatgcgccccttcacataatggggctgatagtctttgtgagcttcgtgggtgtacaggtccgaacacggagttcgaccaatttgaggaaatttgattcttattgacgcactgcttcccggaacaacatgaacatcttccatgttaagcacatcgtcactgtggcatacaatgttaggcggagtgttttgtggaattgtaaaaaaaaaaaattacatttgtccatcaatgttgtaatgttccaaaacaatgtgcttcatggactcgaagtttagcagttgctgggcggaataagaaagacgaaaacttcggactttcagttcagcacgctcatcctccccacttgcgctatcacaatgacgaaagccataattttttgggccacccgacacaaattcatatattcgcctcgaacaatgttccctcttcatttggcccagcgcttcgccttcaggtacgtgttgtctcccactgcttgccacgtaatagattgagtcggtatctttgaaaatgatcacaatgagaaagtagcgttttttttttgttgaacttaccacaataaagaagcttatggcccaatgtctgcacctgcagatgtagacgagcatatgaagtgacaaaaattgcaattggcaggcagttggttgacggcgctttcgcaaattccgcttttttcctcacaacaactcggtccatatgaggtgagacgtgatgaaagtcaataatgtcgatggtgtgattttcgagcagtgcatgaaattcagctggagtccgagtataacgtacttccgtaccaccaactcgttgtgcaagttttccccagagtgagtttgccagaattttctgttttttttttactcgattttatacgaaaatttctctaaattatttaccgcaaccattcgaagcccgggattgtttgaaattttgttggggtccagctgaatgccctcaatccgcttaaattcatcaacatatgctctgcgctgttcatcggaatcacaaccgggtggccagccgcttgcttgtactttaaggcccacaaaagtgttaacgtattcacgaaaaagttcattgtcccactcttcataatgccaaacctatattttttttaaaggctcgatgcactgaaagtcatttttttttacctcatataagtcaactactttataaccaagctgtagggctttgttcaattcggcatgagtgtacctgaggcaaaaaaaaaaagattgacagccgcaaaaaattcccaaaattacgcggaaacccatgcccttgctgcatcaacgtgttgacatgcccgttgttgccgattgtcagcacagcgcgcgcaaagcggaaaagttaggcgtccgtctgtcgtccggtatggaagcaaagggattgttagcgggcgtgtaacaggatcgggcggaagaacacggacaaacaacaggcccgagaatgagttcgcgtcgggtgagcaccagggaagcggtgacgtgggtgggcttagtagcgtttcacgggtaagaacacgggggttaccaacaggaaacgagaatgccttcatcacatatggatacaagcttacctgaaaataaataattaaaatttttttttgctcaattattattttataactatatcaatgaggattatctcctcgtccgagttgcatgtgtaatgaagaataaatggttcagtgcgaccaccacgcagtgcatcctctcttggatcaagtggtcttggaacaaatgaggcattatacagccgccgaaattctgggtctactcgaaggcgttgcttcacttcacatccccagacaacctccaattcaaacccatgttgattctccagttcaaataatcgcctctttgttcgttcatacaagtcttcagctgtcttaccacccgccaatttttgtgtctgtcgtttacgtaacattttggacagccttcaccgttttatgaaaattaaagaaaaagaataataacattttttttaccgtgataaaagcagcccatatactcaatggcaaggtcccgttcaggtggatctcgtgtgactaatccatcaaggcggtaaccagtgtcctcaacgttagcttcaccaatggaccactgtgcagattgaacatgcaccccaacggatcgagcccattcgtattctcagcaataattttgcaaaattggagcacactttcgcgtagaattgccacgtcattcatacagtatagggatgagttgttcacgtaattgaaagcgtgaagcgcgattctcggcctccaccnatgaaaaaggcatttctttttgtgcttttatgtgatcaggttgataaaattctttgggcggtaaacacgcaatctttgatgcaaattt

SEQ ID NO: 8345 - DNA, 1649 bp, Heterodera glycines
tctttcagcttgtgtctgccgcaggtttgttgaacctctttgtttttcgtttgttcatttgtccgggtttacgtgcttgagggtcacttttttcatctgataaatcgaggcaaaagagtaataatagtctcataactgatcaagcaattatttgccaagtaatggaccgaaaaacattgatccgtcgctgatcagttgactggtctattcgttgatcagttaatctgatcttgtcttcgaaatgaccgataactcgaccaatgggtgatcgataaaaatttctgatcactcattggtgctgatcattctgacagttgcccgcttaccaggtcaatctatgcctgtgactgatcagtgagtccatggatgggttgatcagttcccaaattcgtcctccattctttctttggccttcttcccatgattttcgctccccaggtttacgagctgttcctgaagcaatttgtcggcggactgcacaccgtttacaccaaactgaagcggctcggcattcagccgctgatttgcagcgtggagcaggtgcgagcactgcgcaatttgggttccattcagtcgggcgtcaaccgatgcaaactgatcgagacggacgacttcgaaacgctgtacaggtgcgagacagaggacatttgaggaaagtcgaggagagattccccgggactgaaatcacccgaccattttggcattctttgagactgtcgaaaatgtagctgaatctcatcatttttggaactgttgatcggttcagaaaatgataaaaccctgccttatcgatttatttgtcttggttttttgataataagcgaagattttatctgatcactcttactcctctctctctctctctgctgattggctcctcctctttcccttaatttcccttattttctttcactttttgctttttttattcagagactgcaccaacacggggtatgtgtgagaagaacaatttgccaagcgatttgttgttgtggcggaaaagcaaatgcctttttactccaactatttttttttgtgtgtttagcgctcgccccgggcgaccgctgaagcgaacgatcagcgacaatctgcgcaacttcgacagcaacacgcggcaacggcacagcgacgacgcacccgtgccgtgctcattctcaagccactgtaaagatgagttatcaaaacgacattctgaagacgacttttacgcgccgtccaaagcatcggccgaccgtttgctgtcctcattcattcccatccaacaccagcacatgttgcaccaatatctgaatgatcatcagacaacatttgatcagaatcgcaaccagcaacggcagaggcacgagacgagcacatcgagcaataacagcaacaccaccatcacagacaacaacaacaaaccacaaccagcacagcagcagcagcagaaccatcatcacatgttgctgagcattcagcaagcgattgttgcggctgctgcaatggcagcaacggtacaacaccaacaacagcaacaacaacagcttcggcaacagcagcagaacggcacaaacaaaagcaatgctattgttggggatgaacaacaacggcacatgccattgcaacagaacgtccaaatggaagtgaagggacaactgattactgtcgat

SEQ ID NO: 8346 - DNA, 1584 bp, Heterodera glycines
cagcagcagcacgggcgaaggagaggaacgaagcggaagtgaggacggactgtcgaggagaagcggaggggcggacgaacgcgcggcacagagcgtcggcagcagtcggaagcacttcacagcggacaggggaagcgggcggcaaaatgacgcggtggaagcggagagtaacagcacgagcaacgggtgaatggtgtggggaacagatagacagtttaggggtggggggggaaatgcagatcaggcgtgatcagcggatcaccaatgatgttagattggggactgactgatcagtaagacaggaagggaggaggaaggcgtgatcactgatcagacagacgtattcgtatgctgatacgataaagaaatggaaaaaaaatttgtaaaagatagtcagagaccaaacgatcagaaattgattgttgctaaactgagtgacgaaactgaaacaccgcaagtgtttagcaacagcgaaagcccaccgacgcaaagttcgcctccctcttccggcgatgggtactgctctttcaacagttccgactcttacagcaggtcaaattcggacagagttcggggggagggaatcattgttatcttttaataacaatttcagcgaccgacagcaacaccaccacatgctgaaccgtttgaatatggcggtggaccgcgtagagaaagtgttgacggaccaatgccaacactttcacggttggtgcgccaacggaaaacacacaaaaagcaaatccacaatttagcaattgtaaatgagctcaaattggcaagacaaagccaggaacggaccatgacgagagggcgggcggagaaacggcgatcggcaggtaaatacatttgtaatcctcatttttcttttttcaaaatcattgattttgtatatgatttttctcgtgttgttttttttctaaaaagtggtaaaatcccttttctgaatgatgtaaaactcataaatagctttagaggtggctattaaatgtatggcaattttacttttgttttcctattttttttgatgcgatacaaccatctcttagctccgtttccagaacatttctcacataaattcgttcagaactccttcaccaaagacacattagactgaatagaagacagcagatgaaaacaaattcagtaaccacaacaacagccaaaagcaaaccaacggaggaaaaagaaagggaagcgacggaaacggattcgaaatgatatttaatgccacaaaacaaatggaatgattttttcttttgagatgaagagatttaaatttccgttttgatgagtttggcgaaagagagaaacagaaaaagaaaaatgtacgaaaccaacacaaaatgatcattttcagagtgcacagaaatttaagttaacacaatgaaacaacacacataaaagaaatggcagatgagcaacagcagagaatgtcgtacaataataattaggtgtttttcaatgattgaaaagggacggatgagcaaaaataggttaaataaatgagaggaattggttggcgattgtatctgatcatgtgaaatgaatgaggagagaaaggaggggtaaatggagaaggga

SEQ ID NO: 8347 - DNA, 1223 bp, Heterodera glycines
  misc_feature (44)..(44): n is a, c, g, or t
ggggttccacgcatttgtccatgttccatccaccacatcatggncatatgtctggagtcaccaccgaacccgttgtcagcagtggagcagcggtacgatttgagacgaagttttcacgcatttatccatcgctcctgtaaaaaagagaaaaatttatatctattagtttattatttgcttaatgaatgacaaaaccgaccaaggtattggagacggactgcgtttgtacgtaaaagttgtgtgccattgtcggtgacaagaattgccatcggttgttcagcaatcgcttcgcacacattgagactctgttcatcattcacaacaatattccgatcggttggcacttcgttggcgttgagtttgacctgaaaatgccagcaattgaattttttgatggaatgtcgtgagcattgggccaaactcacacaaattatgctgatgttatccgcgcggagagtgctccatcgcttgaaggcatattgcagcagacactgcgcttgattcaacggcaagtcgacgtcgaactgacaatggatggacaattagagcaacaaaacggccttgagacaaattggatggaaattttgacatttgtggggtcaaaatttcaaaaaaataaggtagcctttaatgcattttgttaggaaaattgattaaaaattgtcaatttttagtagaaaatcttttttaatttctttgagatttccagggttaatttattcgaggccaggaaattgagtttccatgtgatatttaacccatcgttgtgcgaggtgtacctggtcaatgtcaatgagttggtcacaattattttcgtccaccgatggcgattcgtttccgttgcaggtgaaatgttttgagcgttgttcagcttcacgcaacgcttcaataattgcacgaacaccaaccactgttgtgagaccatcggttgccacgacgacaaaatcgtcggtgtgcttcagttcaaacacatccacgtcaggttcggggctaacctaactcaaaaaatacatcaaaattcaaacattttgggcacaatttaaaaataataatttaaaaaattgttcggatcagaaaaagattgaattaaactcacaatgtattcattgctgatgggattcaatgaccaaaagtcgcccaatgaacgagcgacagccaaaaaaggaatgttttcagtggcggtggaacgccggaccgggccacgatggcctcgcattggacgc

SEQ ID NO: 8348 - DNA, 2321 bp, Heterodera glycines
  misc_feature (10)..(10): n is a, c, g, or t
attaaaaatntattattatttaccgaaagaattttacaaatgaagaaaattaaaatatttaaacaatcgaaaaacgctaagaattgacaaacttttgtgaagtaaaaaaagttattttaaaaatgagtgattatcgatggaactttatcggctcaaataataattaaattcaaataactaataatttaaaaatagaaatattgaacaaatccaataaaggacataacaaattcactcgcattataatcgatatttttaattaaataaataatttaaaaggcaatttagcaaaaagtgatacataaaaacaaaagattaatgaaaaatattaaaatcagatttaaatttaaaaatgcagagctggtttatataaagaggtcatatttgaattaaaaatgttcttctgccaatgcttgcattttccgacagcctaggtatggtgaaagacaaccaaattacaaatttatagcaaaaaattcactgaaaaattaaatatgtcttaattgaaaaaaatttaatttttaaaacgaatgctttcagtttattatttctgttaacaattacactcaaaattgcataatggaaaaattcttcgaatttttctccccacaaacgagaatttaaaaattttatgggtacatttttgaatataggcaattttttgtaacaaagtgcactcaaattttcaaattttttttcaaaaaatttcacttaggaaaattcccggttggtcccagtcccggacgaaaatcgaggtcccggtcccgacttttctggtcccggtaagtcccggtcccggtttttgtcaaaattcccggtcccttgcaactctaatattaccttttttgctaacttgctatagcctaatatgcacgaaaacgagtttttaacttggtttgaagcttttatcttgaactttttggtgcatttttttgccttgcgatttatttttttgaaaaaacggtaaattttttgaaaattttgcaacttttcctaccatattttattacaatttccaaaaaattttccggcggcgattatcggcaccgccggaccttcagtttaccttaatttttgaaattttaaccacaaaatgggtagaatttgtcattttttatctgagaaaaagatcgaaccggaaaatgcagatttttttttgcatcacaacctcaaaagctattggtaaaattaaaaaaaaaaattcgcttttcgcttttcgcatttcgctttttatttttcaatttagcccatccctggtatttaccattcagttttacagtccagctattacacgtaattagaggttaaattgagaatcttgtattgtaattacgaggagaaattttttttttactaactataaataataataaaatacttttttttataaaattaaatatttttcatttaaatttggtttgatttcatttaatttcgcattatatttctctgaatcgtttctaactttttaaatataattcaaattattaatatttttttacgtctattaatattgagaaaatttttttgagaaaaactttaattttttcaattttattttcccattgaatttgtcttcgttcatccgttgatttaatttagcagcacggcttcttcccccctccctcccccgccaaacgcccagcattttttgtctgtacttatgtgcctaatccaccaaaattatccgagtgttttgcaaataattctgctcattaccatcagcattttgataaacgaaccaaaatttgtctcaatgggcaggtcagattttatataattttttttttttaataataaattaaattattccaaaaaataatttcgattggataaacacctaaaatattagctaaattattggtttcttttttaagtgatccagtatcggacacgcaaatcctctcaacattgctcaacagaggctatgactggagagttcgtccgcccggcactaatctatccattcctggtaaaaataaaaaataataatttagaataatattaataataataaatattttttaaaaattttaaattgcaagtagaacagaaatatttatcattatggtcgacatttaagttttaaactatttcttgtataatttttgattaacggagcataatctattttattcggacaagtatttggtttgagcagagaattattttcaacgattttattgatcattgcttttaacaatttataaatattttggattaccttataaaaaaagtaaacccatttaattgtaaaaagctttactccaatatatccgcacgaattttccggtttttaatatttcccaaatttatactaa

SEQ ID NO: 8349 - DNA, 1595 bp, Heterodera glycines
aaaaaatggatttaaaattaattttattttaaatattttcagttattatttgttgcaattgtacattccgtcgacaatgttagtcatcgtttcatgggtaggatattgcaccttaattatttaatacttcatataataatcctcacaaaaagaaaaatttaccattttaaatatttttaaaaatttatttaataattgtttattatttaaatgaaaatgtataaaattatttagagtttataaattaataaaaatattttcttactttatatcttcgagaataaaatttattcaaattcaaaaaacaatttgttggtgcatttcattttcctttgggtgtccttttggttggatcgcactgcggtgcccgcacgggtcacactcggtgtcaccacactgctcacaatgaccacccaaacatccggcatcaatgccaaactgccaccagtcagctacagcaaagcgatcgacatttggtgcggaggtaggccaatcaacagaatttaaagtctcattagcgagtctcggggcttctgacggtgcacccttctgaccagggaagggggaggagaattcacccagtgctatgacgttagtcaaaaacatcaaaatgggtgttagtcaaaaaaccatcaaatgaaaagattttttcatataactttgctcaaaggcaacgaaattttaaaatcttgttgtcattcgttagcgctaagtgttttctattattctgcaaaatttcaaaaaaatttattaagtttcagaaaagttatgaccaaaaatgttcaagaaaacctggttttttgagtttctcaggtcataacttttttgaaacttgatgaatttttttgaaattttgcatgattattgaaaacacttagggctatcgaaaaatatcaagtttttaaaatttggtacattttaggccaagttgtgaataattttatgtcacaaattttccatttgatggtttttcgactaacgcccattttgatttttatgaaatcctctttggtttttcttacaaatttgtttgttttctttttttttggcaaaaaaccgcgaaaactgctattttcgcccacagcgactattataattttgaaaatttacaacgggaaaaaaggctttgaattccccgattttttttcatttttaaattctccaattatcaaatttcttaattgaaccccagcaaataatttcccaacaaaaaataataaattcttaaaaatttattattttttgggcctttcaatgactttattaagcatgtttggccttcattttctcggcactgcttgagttcgcttgtgtcacctatatttcgtcacggatgttttataaaagtttgtttatttaaacacgcaagctcatttgaaattctcaaatttcatcatgaattagaccggatttccatggacaaatatccagacatggattataaatattgacgaaaaaatctcaaaaatgctgaaacatgaataaaaaattgtcaaagtatggaaaaaatttcccaaaattgagttaaacaattaaattttggagactgaatgagaaacctgttttaattacgaaaaaaaatatatataattcaa

SEQ ID NO: 8350 - DNA, 3985 bp, Heterodera glycines
attaattaagatgtttgtgtattttattataaaatataattaaatttatgcgcgggatccatgatttatttttttaactaattttttcacgtgctgagtcgatccacaaaaaaaactcagtgtgggcgatccacaaaaaaactcagtgattgattggtcattttccggaagcctatcgcaccactttcgggcaccaaaagtgcctgatccggaacccggaccggcccggttaagaacaattttttgttcagttttttaagggctatctcccaggccgggtccggttcttaatccattcacttggagcccgtcatgggtcgggcacatctgccggaggaccctcagcctcgcccccgaccagggatgtgcgaaaataacaaaaaaaaattttcgtatacgaaaacgaaacgaaaaagggcattcgacacgaaaacgaaacacgaaacgaaaaaagaaattttgaaaaccgaaaacgaaacacgaaacgaaaaaattttgagtgacgaaaacgaaacacgaaaacgaaaaaatagccattttcgtacgaaacgaaaaaaccgaaaattttttaaatatattcaattttaattaagaactttaaaattgtatcctctaactgagggaattaagatcctaataggtggaaaagcggatgtggctctaggacaggggtatgaccgaaaaattttcaaaataagaacatcaaggacaaaaaattattgaaaaattttacgaaactggaaaaaaatattttttgtgataaaaactcaaaatttttacgattttgaatagcatttcgttcaattttttatgaaattctatttaatttccaattcgtaaatttcatttgaaatgaatttcgttttaaatttcttaacttttttacgatggatttgtaaattttttcaaaattatagatacctaatttttgtgaaaaatcgttagcaaaattcatataatcggttaaaaagcgcaaatttgttcgataaatctgttaacaatttgcaatcaaatttaaaaaaatttcccgccggcgcctatcggcaccgccggactccaaaaactcttgtttaatgttcgtaataaaatttagaacgaatctatattagtattttagttaaaaaatatggtttttattgattaaaaacttttcaaaaaaccctgatccgtatacgggtccgtatttttcctgcatacggacttatacggagtaagggttttccgggtttttagtccgtaagtctgtagtccgtatggatgcctagtccgtagtcctgatcctgatccgtattttcgccaaatgtcgctctctagaaaaaattatcaacatttcaaactttagatacaatttcctgtcagatttatacaatacttcaagaaatatcttattttttcttaccaaaaaagtcattcttaagggtgtaaatattttcgtctttttcgtccaattttgctctgacgaaaacgaaacacgaaacgaaaaaaaaaattttgaaaaccgaaaacgaaacgaaaaaactttggtagacgaaaacgaaacacgaaaacgaaactcaaaaagtgccgaaaatgtaggacgaaacgaaaacgaaacgaaatttcgtccatccctgcccctgatggtgaatgaatgaatggacatttggaaatatggacgattaatacatgcatttatgccagaaagttgacatactctattaataaagactaatgagtattgaaatgatgtgcggcaaggcataaaattttttgcaaatacactacaacaaataaaacaaaaaaacaacctctcccctatgaataagcacacctcgccaaaaattttttccaatgcaaaagaaaattattttcctttttttggtggaaaaatcatttataaattttccctttttgtttgcaataattaatgcttgtgttccagtgggccaacttcttgttaacttttgctctaacctttttggtacggttctcttaaacggaggcattatttcttcaacattttcttactcataatttttcattttcaaaaatttttccgtcagagtataattgttttgagttttatttacaattttcaataattttaccagtaaaatataattatcgtattgtttcgggattgaagataaatataaattattaatttgtcttttagctggtgggcttaacagatattttcccactaaacctttaaaaaaggttattaatgacaaatttccggacaaaataaaagatttaaaacgtagaaagctgcaattgtataggaaaatgaaatctattcactgtaatcagcttaaaattgagtataaaattatttcgagagaattaaacagacaaattaaattgttttataatgagaaagaaaccaaagttgtgccaaagggaaattcctgtattcacagacatattcgaaataaattggggcagaatgcttccttgcctccacttgttagctccaatggagtcattgttcatgaaaaagcggataaatgcaattacacttccttgtggtactccggtgaaggtctcaaactttttagaaaatgcgctatcaattttaacactgaatgatcttccccttaaaaaattagctaaaaaatttaatactttgccacctatacctatttttttgattttgcttaaaaacaattctattggaactgaatcaaaagcttttgcaaagtcaatatatattgtatcaacatgttcatcatttggattgcagaataaagattaaaaaatagcattattagcaatacttccatctgcaacacaatgcattgcggtcaaaatgtgtcgtgggccaatgattgatgcggtgcaaaatggttcatatgctgtctcattgcttgctttgtaagctttattttgcaaaatggttcatatgctgtctcattgcttgctttgtaagctttatttgttaaataaattgattattgtctatttatttcaaaagaaaaaatattatttcctttaaaggaaaagtatttttaatgaattaacttcaattaaatttcatatttaaattgccaaatttagaatgttgaccaacttttgaaattttcagtgtttttttctaagagcagttatcaaaaataatgaaaaaattaataaataatgacttatataacatttgagagcgggtattagtcacttttgccacgaaattttggcaaatgttatgcggtgctaattttttttaataatttgccgccgaatagagatgccagccgctttcaaaacatccaatgtttatttaattttgggttttattgctcctaattatttatgcttttattagaaaagaccctcaaggcgttgcaatgtggccatccatggcaatgcgcggtcatcatcaacggtgtatccttttacgacctaattaaaaatcaacaaatattaaaatatgcctttattattatttcaattatctaatgataattgatcccccctccctccttaattacatggctaatttccgtgtcctccgcgcttcgttgttcattgaacgggtcaaagtccgaaattccgcattccgaataatcttgtgttggtggcgacaaaatttgttcgcataatgaaatttttttgccaattatacagacgaataataacagcagcaatttggcaaacattttttgtaagattttttctacaaaaaattaataaacaaaaaaaaataaaaattattttcataagaattatgatatagaatttttgtaaaaaagaagctgatatttataggaaaatagtataaaagaattcttttgctccttttaaatgattacaaaaaaaggtgaattgaaaagccaaaatatttcacaaaggaaatgggaaaaacatatttattttaaggttttactttacgaatcatttatattatttttttagttttcatttaacgaatttttatgaaaaattttgccttttcaatataagaaaaattttatagaatttttaaaatttgcttttaatgattagttat

SEQ ID NO: 8351 - DNA, 3154 bp, Heterodera glycines
cgaataaatgggttatgcattgatcggagcaggtcgcttcttctcgtatcacttcccaccacccctcaaaaaaatctcagaaaattgatgagaaaatttaaaaaatatattttcaaaaaaaaaaaaatttttttttttttaaatcatggtattccgtgccaaataagccggaaattaaaaaaatgcatttccaggtttaaaattgttgtattatagtatattgtttatttttagcaacagaaatgcgtgggctctcgcatgggaacaagcgttcatttcgctgttgaagtcatacaaatcggaccagttcagcgtgtccttcatggctgaacggtcgttggaggacgaaatttcacgtcaatccaacgcggatgcattcactgtgttcctctcttacacgtacgtactaaactcacatccaaacaccaaaattattaaatcaaaactaacaaaaaaaaactttcaaccgaaaagtagggcctaaaagcactaaatttaatatgcaatcaatattcttataattaaaaaaaacatttttgtttgactttttcccccatttctttgtttgtgacaggttcatgttcatctacgttgccatcgctttgggccaatatgcgtcggtgccgggccagccccagtccgtttttgtgcactccaaattcacgctaggcatttgtggcatcattggctgtgtgctgtccgtgtcaagttccatcggactgtttgcactcttcaatatgtcagcggtcagtcagtccgactcattttttacatttttccaatttgccatcatgtttttcccattttttcctcgctagccacccccccccccccctcgaaaaaaaattttaaaaaagacatttttttattttctaactttcttttaaagagagagagagagattttaataatttatttgcatttgcgcattttgttaagacgctgatcattctggaggttgaaccctttttggtgttggcaattggtgttgacaacattttcatccttgtccactcataccaggttaagagggaaattgcataattttttttttttaaagaaaaaatagcttaaatttttttatagcgccttgccaatgatgttgaccgaccgttgcctgatcggatagcacaaatttgtgaggatgtgataccgtccatgatgctgtccagcctttccgagtgtttatgcttcagtttaggtgtgtgcaaaattttttttcgtagtatttctaacgggagcaaccagctcgtttccccccccccccccccccccccccccccccgcttttaaaaaatttctaacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattcgacattaattttggcacatgtgataattttggtagaaatgagtgaagcaaaggaatttgtcacaccatgcacatctaatcattataaattccgaacaaaaagtgatttgacagtgatcaggaaaaattgttgggaataaatatttaacgggatgagaaaagttggaaaattcatcattttgtgattcaatgtagccccccttatgccaagaataacgacgaaatgaccgaaattttggagcacaaagttggaaatggattaaactttgaagtttaacaatttcatcacgatggtaaagatttacaggcagatcgtcaagcacaatgcgatccgaaatttttctgacaattgacttccaagttctttaaataaattagaagtcagatctgttttgggaccccacctgaacaaatacaaatcacatggttgtacgaatccggtacaccctggaggtattgtctcgagacatatgttgtccctggcaaagtcagttgatgatgatgggcctgttggtgctgctccaccaatggccgttttcccaaattcgaacaaaaactcaaaatttataaattaaaataaaacattattaaggggttttgaggttgctgaacacggttatgacatccattttgaccaaatttgaaaaccgaaccctgactcgaacaaaaaacccgaaatttaattttcgactaaattcaaaattaagcctaggcttaggcttcagcttaggcttaggggtaaatgtttatctgagctcccaaactcaaaaacacccaaaatcgaagacaatctaaattccgcaaaagggagcataagcccaggagggcgtctaaaaaaacgagaataattagcaggaaaaaaagtattgaaaatttattaaagttttccaattatgtcagaaattcataaccaaaatattcttaactaatcatttagacattttataatcgattttcgttcaaatacgaaatcataagcaaagattgacttattttgacagcagcggcagaaatgcagcgataaagacgaaaaaattaaagagagagagacagagaggggggggggggggggaaaatgagagaaagagcgaaccatttgtccaattcacaagcggaaggaatgaaaaggaagaaaatagtatagcgtcgagaagtgagagagaaactgcatattttgctccctctttcttctctccatttcaactcatcatcaatttctcctattcttttccacttgttcccagccaatcccttccattccttgagactgtacttctcaggatcatttctgtagtacggtttcccggtgggagttccaccttgctcgccaaagcacccgcgatgacgagactcggcgtcgtcccctgagcgtgaagctcgccggggtcgtcgctggaaagcatttttggtgatcgcccggcgttgaggaacgtcggctggccccccttgggggtcggccgcgggggcgacgctctctgagcgggtttaaatggtgcgaaaaaac

SEQ ID NO: 8352 - DNA, 1510 bp, Heterodera glycines
  misc_feature (1407)..(1407): n is a, c, g, or t
  misc_feature (1423)..(1423): n is a, c, g, or t
ggggggggggggtggcaacggcgggtggggggaaaatgaaaggtgcaccatttctaacactgataataattttaattaaaaaatttcaatgattcccattttttttaaaacaggcgctctttcgtcaatgccagcagttcaaatgttctcgttgtacgcttcggtggcaattttgctcaatttcattcttcaactcacctgtttccttgcggttttcatttgggacattcaacgccaagaggtaaacaaaaacaccacggggaaaggggggggagaggacgcgcagatctgattgaaaaaatggccaaaaattttattagtcaagcgcctttgaacccgtcgagaaagagaaaaagtcatggtccataaaattgtctggctacatttaggggggggaggggtgaaattcctaaaaatgttggctaattttttttattttttacggctgaaaatgatgcctgtcattagctccaaaattctccttaatgtgtcctgcctaacttttggcgtctattttgtttaataaaaaaaattgttttctttcccagtccggccatcttgaactgtgcggtttttgtgtttcaccggtgccgttccaaccgacggacacggaaagtcggattgaacgatggatgcgcgattactatgcgccggccttgctctacaaattttcacgatgcgctgtggtaaaaattagaacaattttatgtaccccctggggagtttactttatttattaaccctcctcgaatggaggctttattttgggatttgggaaccacattttgggggtgcactccaattttttttgtttaaattaaaatttcaaaaagaaatatcttataaaaattttttattgtttgtccggcgaaatttacacaaaaaataaatatttgttattattattaaaactcactaacttttaagatttttttgtttgccatttggttttcactgtcttccgcaattatgaaccgcataagtgccggacttgatccaaaaattgcggtgcctgaggtacaaaaaaaaatgaggaaaggaaaagcatttaattgaaaatttaagataataataataattattattatttgttttttatttcattttgctaatatattatacaaattaaacccaaggattcatatgtgtacagccattttgtgaacatgggacactatttgtctgttgggccaccagtgtattttgtgctcaagggcgactttgactaccatatgtatgctcagcgaaagcaggtgggtataaaaagccgaaaattttgagtttctaattgtaagacttttgttttggaaacttttattaaaaaaaaatttccgtgcctggtacccgcctttttctatcccctgaaagtcggggttttttccggattcgtagcatacgggcaattanaaaagtaaaatttatnaattaattttgatagttttacaaaatattccaaaaatattgaaaccaattattatagaaatttttaatgacttatgaaacaaaattg

SEQ ID NO: 8353 - DNA, 6603 bp, Heterodera glycines
  misc_feature (61)..(61): n is a, c, g, or t
  misc_feature (146)..(146): n is a, c, g, or t
gcgtgatggaaagggtagcatcccttgctgatttgtcgccaagcctgtcgccatgtgcttncctctcgttgcttcgtttactctggcaactttttgttgctcttcgttcgtgaaagcgacgggaccatccccgttcctgcacattntcgtcgtgctgtgcgccgttgcgatggccctcatttgctgggtccatgttgctttcgctcccgtcctcgaattcgagtcgttgcatttttcgtttccgtctgttctgttcgtcgaccgaaatgtttcgctggagcccctgctaacggcaccagtttgtcgccaatcttttatttgcgccgcgcgcttggggttggggtgggccaagctgaggcgggattggttcccgctcctcttcaccgctctcgtcccttttttctctgctcactccgctcgctgtgccgtaaagggaatgacccccttttttcaccgttcgctctgatgggtctgatgctgctgaccgatccgatcagcgccaaagggggacgagaatgggaggggggaggggtgacaaatttggattggtgcttgagggaattgtgcagcaaatcgctgcttgcttaacggcaccaccgacaaggtttggggaagggcttgtcggacccctttgactcgacgaccacgggtttcgactcccgttccctgcggcggacactccggctggtgggagtccgctttgatcgatgcgcgcttctccggctggtgggagttgcgctgacgaacggccctgtcctttcgtcggacgatttggcaccgctcggctcttccttccttcactgccctgcttggacttgacgacgacgggagttcacacccgtctcttcagctgctcctactggtgggagactgaactgctcgaatttgccgctacttcgggtcactcccgaatttttcccaatggctgatgggaggggaatttgggatccgggagggttgagggaaaagacgtaggcgaatgtgatggagtgaggagggtctttttccctccttaccgtgtcccccgaaaacgaattcgagacttcgattccgacacaaaatttattaaagaagcgatcgacgaattaaaaatgcgtaaatggtaaaaaattgatcgaaaagtccagcaaaacgaataaaagcgaatgatccgtgggggaaggaagcgaagagagcgaccccttgggcagggccgcttaaatagacattcgacaaaatgggcggagtgacagacggcccgataatgcgatgagaaaaatgggacaaaaaatgggcagaaattgtgatgtgaaaagtgtgaacaaagaaaatggcgcataaaaataaaatgtaaattggcagatgtgaaaagttaaagaaattgaaaagaaagaactttgtgcaaaattgttttgcacaaagcttgggccggagattagccagccgatgagaaatgaatttgtaaagaagtgaaaaatgggacaaaaaataggtgaaatgataatggctggtacgattaaatggagaggaacgtgatcaacatcagcgatttaggaattgatgaatcgggaatccgcccgaacgtctcgtcgcctttttgctctttttcttccggtattttttcgtctttgacggtccggcccatgtgctcgtgcttggtcccgagaaaacggactcctcgaacggtcctcctcgtctgtgtcaagttctttcccgattcgttgtccgtccgtgccctggttgaacgcgagcactcgcgcacgccgtggcgggttggcacccgccttctcgtcgccaatgagaaaattggcgacaattattttatacgtcaaaatgatcaattaaatattttatttgaattaggtataataagtaaaggcaaaatcaaggggtggattttacgactttcgtaattccccgaaacatgtcggggcttaaccctagttttaactatgaaatatgcttttgttcaataattgaatatttataaaatttcaatttttaagatcataatcaggaacaggatttatatttttttacctattttgtaaaataaaattttataagagaagcacgaaaaaacattttctggccaatttttgaaagaaaaagacttttagcacaattattttggccgttttatataaaaaagtccgaaatttttatttagaaaaatgcattaaaaatgaaatttcatcaatcgaaagattcaaaaacttcggtttttggcacatataaatcccgtgtcaaatcataataaaatgggttgaatattcaagtgtttcttatttaatcatttctcgttgacgaagggattgtcatttgcttagcattttctgctggcccaactttcaccacggcaattgctatttgagtttttgtgccaatttttttgctaatgattttcggcaccaatttgctacacaatttgcgcaaaatgccaatcacttcttggcgaattgttttgttcagcaacagatagatgaacggcggaataccttcagagaatatcgagtaaaatttgattattgaaattaaaaattaaatatattaaattaataatattgttttttataaatattttttctttataaaaaggcttaccgaatgaaagcatccaagtgatttggccaagtgtgatcaaagtgttacccaccggcaaaaaattcatcagagaacaaattgtaacagcaacatcattgatgatactgatcaaaaacacttggacgaaaacctaaaaattgtataaaaatcaatgaaatatattaaatattaatcactttttaattatctacctttttttgcgagattgaagatatttgtgaattggtgttagtgattgcgttcatcaaaccatttgactgacatttaaagcccattttggtgaggagaacaatcgcaaagaccaaatatgtgccggttagcacagtgactaccatgtaactgtgtatggttgccaaatcacttcgatactgtaaaaatggcgtaattattattttttatcttcttgtacaaaatcgctcaaaaatataagaaagaaaattatactctttagcctaattatgtaatctttttgtctcatacaattgtgccgcttaggtcatcgttgtaggcaaaatgcgggttgacgaaccaagtgccgattacgcttgagaaaatgatcggcattgtaaacatgcagaagtacatgccgtagatgacacagaaaatcatccacagataaatgcgtttgccatgaaacagtactcgtgctgcataaccgtatgccaaatcaatgcagcgattcaatgccaaaaatatttgtgccgtgttctcaacagccgttaggcctacaaaaactcaattaattttattttaaatgtcgagaatttatgctggacatatgctaactgtcgatactattcaattttagcagcacaatgccataaaaatacatttatttattttttacctattgcacaagcgccacagacataaatgaatgtcggcgctgtacagaaaactgctccggtaatggccaaatatccagtgatgattgagcttattggtatcatcaacagatcagtgataccaatgaaaaacataaactaaaaaatatattatttaaataaaataattaatagttaggtggaattcgaagaaaaaataccgtgaatccgctatttgaagctctgctccccccaattaaaggctacctttttggaggggttgaacaatagacccctccaattaaaggccccataaggagggcttgttccagacacgcccggtttctgggacttaacgatgacaaaacgaaacctgatttcagattcgtatatgaccctaaaatatccctaaaattattttgctgctaattttgatcccagttcttaatttttttctgaaaattcgaatttttccagaatgtcaggaataaatcaggtatgcgtaattttcataattaccttgtaacatgtgttactcatgtgtttccaaagactaattaagcatggcaaatacaaaatctataattataattgtttaaatctttttatttatttgtttttaatttacctcactaataatgccaaaaaccatgtataaagcgccgaccaaaaaatgtttacgttgttccaacggaatctgatcaatgtcatagctggcacagttgtacaaacgattgtacagttcgggtttgaagaagaacatttccattttaatagttttttattcaatgccaaaatcaaaaagaaatttataaccttttaaaattataggcacagaaaaaaggttcctaaagactaaaattttctatctactaactctaatgatttcttattcatttgacttcgggaaatgcatttaatgaaatttcatcaagtcaggccaatgtttctaggctttgacaatggctaaaataattacagttcaaaagaaattcaaaaattactaaacattaattttcagtacatttaattagtataatcagcggacagatgttttagatggtgttgccatagggaatcattttaaagcctaataaaattcagtttgaaagtgtcaattatcagttatgccaatgtctctaggcatttcacaatggctaaaataattacagttcatttgaaaattaatttaattgctttattagcggtaatcagcggactataataaattgaatttgtcgaaaaatgttttttcgctcaaataacaaataaaatgaaaaaaaaaaattttttttgaacataatgtctgctttgatctgatgaatgaaagatggaagaaaagccaatctgatgatcccacaattaacttactcatttgaatctaatcatttagaaattttagcagattttataatgaaaatagaaatttaatttatccactggttttatgtgtttatacagctgacaagggatgtgatatcgaaattacaaaattttggctccgaggcttaaaataggggcacaaagaacccagaattcgaacaaattaagaatattaaaatccaaaaaattcaataaacatgtatgaaatagaaaaaaattattgaaataatttatttaaaatattcaagaaaaaataaacggttcattttaaaaagcaagaagtcgttcaaaatcggaatgaaccttttacaatggtctccgaaaatgcgatgtagggcttttgtaataccattcgaatcggggataccgggcgttgtaaaatttaaaagttatttcaaccaaatatttaaattttaccttaacaccatgccaaaataaacctttttttcatagccaactcacttcgaaattggtcaaaaatcataatctggtataaataattttttgatcagggtttccgacccccgacaatttaacctcccccaccgacccgacccccgaaatcttgttgttgattaataaaaaaaaaacagttttgcaaatgttttttgtaaaacaacataataaattgagccaaaattttttaatttaaaattaaatgtatgccttaaattagagaccggacggaccggggcctctccgggattttgccgggactcccggccctggtcccgttttttggacaaaccaccgcgaccgggagtcttggaaaaacgtgtcccggcccgggccgctgttcccgaatccggcatccatttcgaccaatttcgaatccggacccaaattcgaagaaaaagtcgaaaattcaaattttttcggttcatatttttagtctaaaaataatttaaatgttcttttttgttgaagcaatgatgactttcagttttttccgtgtatttaaataaagtgtgagccaaaatgtgcaagttgagtttccaaaaccgctttttagggaaaaaaggcttcattatgaatctgatcatgtctaggtccgatctctttcaattgaactgaatccccttttaccaactaaaaaatatgcataaatttcattgattttattgtacgtatagttttgtatatcaatgatttaaatttttgatgatgattatttgataacaaataaaattgatttgaatatataaattataatttgaatttcatcaatgagctgtaagtgaaaaaccgtcctcatggattttgcgatgaccgagaattttggaaatttataatacaataaaaaaaaatttttttgactaaaacaaaaaagattaaaaaatgaattaatttaccttaattttatagatattttcctagactttattgcatattatttttacaattttggggactatgatcaatattttccaaaatgggttcactattaattaaattagtagatccattattattttagactgaattatattaaaatattgataaattaaattttcatgaacaagatttaagtgacgaaattttaatgtaaaaaaaatttaaacgaatataaaaagcataaaagcgaatctcagagatttacacggtaataaacacacaatttatttgttttttaaatatttgccaaatcaaatttaaaatttggcccaaagttcgcttcgattttgtccccaaggtcgaacaaagagacgcacggaaacaatggatcagctggagaaggaatgagccaattggtagtatctgaacaaaaatgggcctaaatggaatacacaatttatctttcgtatattaagcc

SEQ ID NO: 8354 - DNA, 1847 bp, Heterodera glycines
gtgggtgccgcggattcggaaaacgcattatgaattgcccagaggatctgattgtgggtggaattcgaagggacgcccagggcgttcaaatccgacacgccgaggcttttcagacggtttttttggttgcttctgctggcgatgtttaccaacgattaattgtgagggctttctttttttaatgtattttggttgcgttcaacaattacttttctttcagcgctccaaaaatcacagaatggaaaagttcggcgtctcctttacccaggctcatgccggtgctattattgcggcatggcaacgaaatttcaccaaagtgagtgaaccaatcgacgaacacagccaattctaattgttcagagtatttacgaccacacattgaataaacctgcccagggaattcgcgtggtgcatccgctggcctcaacttccatccaggacatgttggagcagttcagcgaattccaattcttcgtcatcttcatcggctacgtgcttatggtttaaaacggagaatgtcctctaattgtattttggttctttactaacagattatttacgctggttggtcccaagtgcattggcaggggtggtggttttcggtcaagtcgagttgtctgttggccattatcggtgtgctggtgatcactttggcatcggttgccggcctcggcttgtccaccgccatgaatattcacttcaacgcggccaccacgcaaattgtgccttttcttacactcggacttggcatcgacgacatgtttcttctgctgcacaactacaacgatgtgctggaagctgtccgacaaaaagaggtggcggtgttgctcaaagagactggtgagtcggggaatgcctcgggggtttcccttcttttttcgggtcacttttcgtctttcatcctttttctcgcttttctttcacctttaggcatgtccgtgctgatcacttccatcaacaatatcctcgcctttctcaccggttgcattttgccaatccccgcgttgcgttctttctgtggtcaggtggccattctgctcacctccaacgtcctctgcattattcttctcttccccgcgttcattgcgttggatttgcgtcgacgtaaagcgggccatcgcgacatgagcttcgccgcccttttctgttgttgttgcaacagcagttgttttatcggtggcaaaaaaggcggtggcattgaaaatggaggccaaaagcatgccaaaatgatggagggcggggcattcaaaaagcgaaaggtttttattatttaaattattttgtgacagttttgctcgtaatgtgacgacgtaagcaaagaaaagaaatttaagtaaaacaataaaaaatgaaatgcaaaataccaattcattttctgtttttgatccaacttttgccattctttcaaattcaaaggttttccatttgtcagttggaggagtgcagcagtcgcaaccaattggtgaagaccgactccacggtgaccacccattcctccgaaattgacctgcaacagatgagtgcggctgtgttcggccctccctcgtccggcccactgatggcaaatgtcaactttggcccttcctcctcaccaccttcggcctctaacaataagccggtcacttcttcagcaacaaagtcgttgcacaaatggtacacattggtcgggtttctccacggctattacattccgttgctcaggcggccaattgctaaggtaaagggccacaattttctgattcttcgatactctatgaccttttggtcttttacacattttctccgtttagactgtcgttctgttagtagtgctgcgatgttcttgttcggttgcttcggtctttact

SEQ ID NO: 8355 - DNA, 2419 bp, Heterodera glycines
tgctaattgcactggctggtggaaattccatgtccaaatgaattaataattcatttcatttccaggtttatgcgcacttggcttcactctctccaatcctctttggaccgtgctgctaaaattggcatttttcctgacgacgatctcaagaaaatggcggctgacgcgttggcacgcaatttcacactttcagacgactttctattggctagaaagttgctttgttctgctggacaacggtttaactgcacggaaatggtatggtttagataaattttaaattataccaccgacgggaggagaaggaattgcacttttttttgtgcgttaatttaggcccgagactctcgggccgagagtcaatttttttaattctgaattactttcttcaatattatacagcgcggtgctaaattgattgaggacggacggatcaacccacgagggttttacaattatttgactgcttggttctaccaagacaatatgatgtaatgccatttaatactttttaattcaaattcttcgtctttttgtgcaggtattacgtgtcccaagcggcctttttcccgacgcctttgccttggcatttttctgccgctgatgaaagcgttgtgccgcccgccgatccgcttctctactcgcaaattcccttttacatgaatggcctcaccgatacgcagtcaattgtccaaatggtaactatttgagataaaataaaacctttgaagcttacaatttatgggttaccccacatttgcgcctatgtctaaaatcggattcaaacctaattttttcataccaggtagcctaaacagcattaaaattatgaaaacacagtattttggtttattaggagcattaattctcttgttcgaatctacgggtttaattggcttttgttagatcaaagaaatccgtgccatttgcgaccggtacagtgcggacggtcttcctgtttacccttccggcattccattcacattttgggagcagtacctgaagctgactttttatttggtgtccgcgattttggttcgtttttacacccattatattatttgacctacttaaattaatttagattattggagttgctgttttgttggtcatttcgattataattgtaattcccgccacaaatgtttttccaaatacccattttccaagttcaacccttgggcagctgcaatggtggcgataatcgttgttaccatgacggttgagttggccggcttcatgggcgtattcggcgtcaaaatgaacccaatttcggcagttacgcttatcactgcagttggcattggcgtcgaattcactgctcacgtcgtcttggcttttttgacctcgcttggctcgagggatgagcgtatggtcgcgtgcttggtatgtttttgttttgccagtccaaatttggtatttaatttctctgggcttaggaacacatgttcatccccgtcatccatggcggactgtccactttgctgggcattgtgatgttggcattctccgaattcgacttcgtcgtcaaatacttctttgtcgtgatgaccgcattggtcatcatcggcctcatcaatgggttggctttgctgcctgttttactttcactaattggaccaccgtgcgaggtttgcctgtctcttttttctttctttctgttattaattttcctctcagatcactcctgtaaatggtagcaatttgttgccgtgtccggcgtctgaacggtatcggcccgaagacagtccgaactgcttcaccaccccttcgtccacccatcatcaacagtcggacgagcaaaagagacgacgagggtgtaaacggatgttagcggtggacgactcatcgtcggcatcgtccactgaagacggtgctggtgcaccagcattcagcaaatctgacgaagatggtgaacaccaaaagcagcagcaatcggtagactgggacaacacagtgactaattaatacaatgaaatgagtcagttgaacagccatcgtcagcacgattaccacgaatcattgtcaactttgtatgaggcgagtggggaagaaagggagcagcaaaatcagcagaacacaccacagccgaagagcaacagtggcagtggaggagggggaggggaggaaaccaacggcaagacgagaagaacagcctctttgtccatgacaccagccgaccgaagattttgaacgataaattatatattgtagtaatacactttcagacacctcggttatgcctattttcatgttctatatttctgttcaacttttctaaatttttaattcatttgcaaacacagagcataatgagattgttttaaaaaactgaattctttaggaataaaatacaaaattttaatggtcatttagctcaacgaaattgaaagaactttaacaatgaaaaatatggaga

SEQ ID NO: 8356 - DNA, 1954 bp, Heterodera glycines
  misc_feature (1935)..(1935): n is a, c, g, or t
tgggacttataataacagcctcttctgtcctaccattggaattgttcttttgcttggtttgtgaatttcctcgaatgtttcttcgtccgtttcagtgattgttaccgtttcttcgacatcggccaaaatctgaaggttgtttggggattgttgctgttggtagtcactgcgtcgcctcccccccccccttcgggacataatttctccgatgaactattaattcccattattagttaccatgttcaaatgttggtcgaaggcatgcagtcggccgcggagttcgcgttcctggcgcagctttacataaacacgctcgttaaggctgagtcggatcaggtcaagcggttcctcaacagcgtccaaagttgccatcgaattgtcacagtaaaaattgaaatgattttacaaaagggtaaaaccagagaaataaggcacaaagtgcactgattgtgaacatgtgaaattcccttgtaagattgagaagaatttaaatgtaacattcaacaaataaacaacaaaacgaagcaaaaggattatcgttttcttttcctttctccgcccatccgagtgccattgggtttgccactttttctcttttctccgcccatccgacgagtgccaccgtttttgccattttttctcttttgtttcggtccgtcctttctctcactgttcatcctttctttgggattctggctcttttctctcattttgccttttcgtccaaaagtgttagcttttgccttatttgtcctcttagtgccagtttttgactgtttacgcatatcctgaaataaaaaacgaattttcatatgattcaattctctttatttgggacagcctccgctaccgctccttacttacttttagaaaaagatttattatggaatcatggaattaagcactttactatagccctggaccgtagagccccgctccccccggtttgtttggtgtgactccttcagccacctttttcattcgtttgtccaccagtcgataatgtccgtccggtcggctcattgagcctcgtttgcctttggtgaccacttggtacgtcactttgcgtttctcatttgagcccgccttcttgtatagcctgcagttatttaattcctgccaacatcaccaatttcttggcccgacctgcgcagttcgcgcactttctccccatgctccatttgctcattgtccacaattccctccgcctttttcttcgccttttccatgcgtcgtattcgccgttgtcttttgcgtgcctttgcttccgccactttttttattggccttgtgttcaattcgcgttgttctcgcttcgcgtaaaagtcaacgcgttcctttagttgaaatgcaattagagaaattcaaaaagcttctctctgaatggcttatgctaattagttactcactttgtctaccgggggctccaactgacagtggcgtttctcgtcgctgacaaaccattccggcaatgcttcatcgttgcttgtgtacctgatcaaatgtacaacaatgtaccaaacattttaatgccaaataacctattccaggcccagtcctccaagtcctgtgcccgctttttcgagtaaatcatttcctcgcccattgctaattgctccggcgttaacttcggctttttcgcgcttttggtgcccaatttatgttcatctgaaaaacaattcggccatagcaacttgtcgggttcgcttttcccaccttcttcctcaattgcttcgtttagtccgtcatcaaattccttctccattttggtcatttttgtcgttgctttctcttcgtccttttcctcttcatcgtcatcctcatcattgctctctttttcctcctcctcttctttaattcccttcaccgcttttgccgcacgttccgctaaccttttcaccgtttttaaagaaaacagcttaagattcaaaaagntgttattccgccaattggt

SEQ ID NO: 8357 - DNA, 1769 bp, Heterodera glycines
tttatgatattcgaaattgactcatcactttttcagcgttgcttttccttcggcttttgctgttctgatcagatcgtcgatctcttccaactctttgaattcagtatttcctccaactcctcgccagtatcaccctccaccatttcttcagccgattttacactttctttagacgctttttcctcctttttctgttcgtcaaccaatttcttacgccattttaaaatgcttctcagttcggcaggtccacaaacctaaacgggtttttttctgttagtattcactatatttctcattgtccagcttgtctctgtcactaactcactttaatgtctttcaaacattctttgatttcattcgtcgtgtgttcactgttcagcactctttctgagtcgagcaccttttaaatatgaaatgtaaaacaatacgcttctaatgatttgtccagcatccaccgaccaattccgaggcccggctaagcaattgaagcgcatttttggacgttacaaattcggttgcgcccagtccgctgtgttggccaagcaacgcgtcgtttccgtagccaagtgctttagccttgcgctctttacggcccggatgcaaaaggagtcgttgtctttggaataagaaaaggatgcaataattcaaaaaaaaaataataatttatccattacaaattcttttcgctttcgtcaccgcctccatccgtttggtcagagaacacttttttagaatccaacaattccgatggaactttgtcaggcttcgagtattgttcacaaacaacaaaaatttcagcagattcgagccgagaagcggacggtttccaaacatggacccaaaattaaaaaaaggaaattacttttgtaaatagcgaaatttaaatacttttctgaacaatttttcaaagacaccaatcaaacattgcgagtcggctgatcgaaaaatctaaacaatacaaaacaaacaattaagaaacgaaaagtattcctaattataattactttactcacgaaaaatccgcccttgcgcaagacttgggtggccaaacgaagcgcgtaaagtgacaaacaattctgctgcaatgcatcctgcgcccaattggatccaatattccgtgcgccgtcgtgcaacacacaatccgcctcccgagtgcccaactcttctgcgcaccgcatgccgagtcacaaaataaggaatttaaaaaaatcaatttttgaaaaagggcggaaaaatgataacattttgattcgaaatgaatgctgctcgtgtcccaccttttcttcgataatgactccctgcaaagtgatgcaatttttagatcggattcatgcgcacaagatcaactcctgcaaacgaaacgacttaagacaaaacattcgctctctcccaccaatcctcagggaagagactggcatttgctgctcggccacttgcagccaaccgccaggcgcagcgcataagtcgacgagggcacgacagcgctgaaggaattcgaagcgtttgttaagctgcagcaatttaaaagcggcacgtgagcggaagcctaaattttcgggggcataaaaagacgtaaattttgtcaaaaacagatgcactccttcacagaaacggacccgcttctttggccaagaagtagaacttgtccttccgctgcttcccgattttcgttattttgcccattcttaatacccatcaattaatgcatattccaaaatgtagtaaatataacagcgaaattttaactacttgaaaaaatacatgacaaa

SEQ ID NO: 8358 - DNA, 1522 bp, Heterodera glycines
cccccgtcgtcagccctattcgattcgattgcgtccgcgcttcggcggaagttgtccttcgctatcgacagcgcagccaggccgtcaattcttctccaatcactcccacccaaaatgaccataattttcgtttaattgcccttttccttttgcccccgcgtcgctttgtccgaattgcgcctcttttcctctctctctctgatattattcctcctcaatgagtgctaatttaacattgagtaacctcaaaaggttgccctccgctgagggatttcccccaaatccaatcaaaacctatcagttgcgcgagcggttactcaacagctccaaattccctccccccgcaattcccacccacacatataaattaatcaagtttttgtctctaattatgtggtaaacaggaaaaagaatattgtcatacgatagcataaacaaatctctcataatgtgcctaaaaaataaatgcttatcaaaaaaacaattcttaaattaggaagtgccctcagggaaaacattgcgccgacttttgccggttggccttttctctggcgatgatctcctctaattcgcattcccatcactgtgccaatacctcatcaccatccctttcttcctcctctttctcttcatctttctcttcatcttcctcttcctcttcatcctcctctttcgcttcatcttcctcctccttctcttcttttttctctttttcttccctcctttttcttccattttccttcttcgcctttcgcttcttcttcctcatccttttcttcacaattcccagcagaagtgctttgtcggggaatatcggtgaacactttgccgcaagatgtgagtttgtggggggagcaaaataaaaatatgacaaatgaaaaacgaattgccaaacattctttttatgtgaattgtgcgtttgagtgtaataaaactatgaaagaaagggaaattagcagcggacggaagaaggactaaaataaaaaggcgaatttgacaaaaaaatggcaaaaaatgaactgcaaaaccagaatttggaccggaataattaacttttgcttgattaatgatgggtttttgacacattttcagacggtccgccgcgcttcaaacaaaacgtgcgtacccatcaggtgggaatggtgaatggcagcgtttttctccactgatcattctccaatcacccaccccctctgatcagttcgcttatctcggcgacaccattcgcttcaaatgcaatgccatcggccgaccgcagccgcgcgtccattggtaccgcgacggacgctacctgaactacagctttctgctgcgccacccacgcctgaaagagcgcggcatgagtttggaagtgaagcaaatcgaagtgggagacagcgtaatttgggggggggggaataaagcggacgaaaaacggcggaatttggcagggcaattggacgtgtcgcgtgtggaacaacgaggggtccacgaacagaaacttcacgctacacatcgtcggccaatgaataggcctactttt

SEQ ID NO: 8359 - DNA, 2028 bp, Heterodera glycines
cagacttttgtgactatttcctcaacgtgcacattcacccgcggcgtgtccccgaggaatgcctttgccaatgggccgtccagcggcgcgagtcgctgcagaatgccaacaatgacccgtcgtcccacgcgcgagcactgccccaactccgtgccgatttggacctcagcgaatttatcgcaaacaatgggagcagatgcgcacgatatgcaaaggtggaggaaatcgcacggctgaggacacagccgcgggaagaagcgccgaaggggtggacggagaaggaaagtcggactgacagcacaaccccagcgagtagcacaagcaaacccaaacccagcagcacaagcacaagcgcagcaaaagtgccaacgaataaccccaccggaggacagggcacaaagagtgccgtgaagtggacactgcgaagtgagtgcgctgaatgaccatggtttagacccggtcaaactgttcgaccatctgctcgaggagggggtccccgaagttacgcatctgctcccggaactgatcacccccggggccatggcattccttcgggaagaattgcccaaacgatggccaaacaaaagcgcaacgagttcagaattgagcgccaaaattcgtatggccaacaaaattgtgggggagatgaagcaaagagaggggggagaggaagcggaagagaagggggaggagcagggaagtggggacagcggaagaacaaccgagagggcagcgaatacaacgacggggagcacgacaacgccgtggacgagcccaacgacgcgggcgcctcccgcatgggcggcaaccaaacaatggtcactgccacagagaggttatatgggggggggggggaaactctcgacacttcttaactcacgaacatgctctaaagtggtcacttttgcgtctctcgcattaaactctctccctctgttcagtgcccccatactttcgccaattggatgaccattcgctctctcacattgtcatccccgcggggcgtacgctgaaactttcttgtgcgttggttggctttaaaacggtgaataattttaattaattgcatttgtcattttgctgaaggcaaagccggcggtcagcccgaaccgcaagtcgtgtggagaaaaggggacgaagagattctgaggaacagcgagagcagaacgggctcactgttccagctgaagaagtggactttggagttggaagacgccacggaagtgagggaaaagggcaaaaggaaaaaaagagaaaaacaatggccaaaagaacgacagcggggaatacgcgtgcgaagtgttcaactccgccggactgatcgtccgccgcttccgcgtggaggtgcaggaccgaatccgttcccggcccattttggtgccgaatgtgctgctgaaccaaacggtggacgtcaacggcaccgtagactttgcgtgccaagtgatctccgatttggttcctcacattgtgtggataaaactgatcaaaaacgacggcacttttattcgatgggacaccaaacggcgccagtacaccttcaacttcatggacatgagcacacacaaagtgcatataaggggagcacaaattgaagagaaatggccaaattgcagagaacgaggatattccacgaaaaacagtcgaacaaatacacaatggaaattgccaatgtgaccatggaggaccagggcatttactcgtgcgtggcgggcaacacactcggcatggttagcccgggggaggcgatgaaacttttccaaaccagggctgggccataaaactcgaagccgaaattcgtagttcgaagccccgcgaagttttgagcttgaagcatgaagttctttaaattttccctaataaaattttagggggaggtaattaaaaatattttaaaaattcattatcgtgaaaaattattgaaaagggaacggcaatagcaactttgagcacttacggtgccgatggtattggatccgccgaggggtgaaaagaaattttgatcatgttccttataagatttataccaaa

SEQ ID NO: 8360 - DNA, 1195 bp, Heterodera glycines
cgcaaagagagggcgacttttggtccgatttgacctcgtcctattccattacggttgagcccgtcccgatgggacggcgcgaaagggcggcacgcgcaaagggcggcggaagcaccggcgatttggtgccgctgatgggagacgggcagcaaagtgcgcaaccgacgccggggccggaggaaggggcgggggaaacgtcgccactttcggagtacgaagtgccaaccgacgcggcatgggaagtgggaagggaacggtaaaagaaggggcgggatggagaagaggaccaaagccaactcacaagcagactccaattggtggacattctcggagaaggcgcattcggcgaagtttggcggggactgttgagtccaacgggggatgaggacggcactgagccggtgggagggggcggggaagtggcgaaatgctaaatttaatcaatggacaatttaagatgcccgtggcggtgaaacggctaaagtcggcagcgcaggagagagaactgatcattttggtaagccattaattaagagttgggaaagtattatcaccagcgaagcgtgatcagaatttttgatttgcttttattttttgtgtttcaggtgagtgaaatgcaaattctaaagagcattggccaccacccgaacattctccggctgatcggctgttgcaccggccttggccctctgctcgtcgtgttggaactgtgcgaacacggcaatttgaaggattttctgaggaaacatcgcccggcggaagcgaagagagagcaaagtgtggagggatacgaagaggaaggagagagtacgacgggagcggagggcacagtgaaagagagcgaccgcagcgaaccgaaacagagcccatctggcaaaatgtatcaggtgattgagaatggcacaaagaagccattgaaggaaccgtctgtttcaagaatatgctggacagtcccggcacttccgtgccaatgcccagcacttccgcaacttcaacggcaccaattctgaacagacagctaacccttcgtcatttggtcagattcggcgccgatattgccaagggaatggactttttggccagtaaaaaggtgatctgatattccatctgattacttttggtcttttggcattttctccagataatccatcgcgatttggcggcacggaatggtcttggtcagtggcaccttccg

SEQ ID NO: 8361 - DNA, 339 bp, Heterodera glycines
ggttggaagcgtcggggttcgggtcggggttaaccccgaaaaatggccaaaaatgtcggggttcgggtcggggttaaccccgaaaaatggccaaaaatgtcggggttcggggtcggggcggggtcgggggtgcaaccctaaaataattgacagaaaaaaaacatttgtaagaattatgggcgaaaacgacttgccagactaaaacgaccctctgactaaaccggccagactaaactgacccggtccgccataatacataggtatggcattgatattgaattaattgtaatgagcctgtgtgggtaagcatgcttaatcgaatgaatattcgttaaagaa

SEQ ID NO: 8362 - DNA, 2165 bp, Heterodera glycines
tacgccatgtctaatctcgtgaaaggcgctcaatatctccctagcggtgggttaataaaacattcattattacctaacttctatttatcttttttttaatttagcctcaaaattccgtttctgaccttcggcgatttggcggaacaatcgtgcaaagtcagttttggatggatcaaaaactatggaccattggcaaagtttgtgccattctcttttcatgaatccttgccattttcaaggaacattgtcaacataatcacaatcgtccaccaattcggcatctgcagcatgtactatctgttcattgcatcgacctttcaaacggttgctgtgtttgtattgcgtttatcaaaaccaaaactttttgcaggtctttgataaagaaaaagctgacaatgagcccaagggaaaagacccaacatggtttctcgtcatattgcttccgattgtcgctctcgtaagtggatgagtcatttgttaattgctgtgcactttaacaccttttcagaattccattgtgtccatgcgtatcctctcaattatgtgccttctcggaaatgtgttgatgatcaccagtttgacactcattctctttgttggtgttggcgttttttttcaatttatttcttttcactttcagatgctgtcccaaattgtattcacggaaagagctcattccattccgtttgccctgccatccgcagaaggctttttcaaagcgtgtggtaccatcattgtctcttgcctcgctcagtcattggtacgatgtcataatgttgataaagtagtcacttatcttcggttgtttttaggtgcttcctatggagaacaaaatcaaaaaacccagtcaaatgttgggaccctttggcgttttgtccggtggtatcgctatttcgactatcgtttacgcaattgtcggttttctcggctatagtgcttatggagagagccttcgtgatagtgtcttggaccatcttgaatgtgttaggtaagtgtggagttttgtgcatcattgtatagcaaatttcttttttcagtaacgcaaaagagttgactgttttgacttatatcattcggattgccctctgtctgtccatcttcgcttcttttatgctccaaatgtttgttatcgtcggcgttttgtggcctctactcgaaaaacggatcgaaaaactttctcgtatttggaaaattggcattcaattcatctttcgggctattttggtctccgtatgccgtgcgttttgttttccaatttaatttctattcacacatttttagtggccatttcttattccatcaataatttggccgctatcattcgtttgattggcgttaccaccggttagtcgtactcaattttcattcccaccaattcatttcgcaatgttttttaggcactctcctcgccttcgttttgcctgccattttcgaccttctcaccttcgtccctctttttcgcagtcagaatcgccttcgcgaagcaaatgttcggcttggcataaacattggtattatcggtttcggatttgtcattcttgttggcggattggtggtgaatgtcattacgatggctaacaaagaggaagattggaagtgcgctgcaaatgctacgactagcggaaatgtcacggcgacaacgcaatcgtacaccacaccgatttaattatcttaatcgcatttgcttaatatatattgtatgtatgtatatgtgtaatgtattggctaataaaaaaaacataaggtttcatacgaatgagttaaatttacctaattgataattacattaatagaatcactgattggaatgtgtcacttattttttaatcttcccattgccgaatgtcagcatttttatcacgatatttgtccattttgaccaattccaaaacccggcctcaattttttacctttttccatttttagccatttttgctcaatcattcagcaaaagttgttgttccttccttatcggaacaacaatcgccacagtctgcgcctcgtttagtgtcttttgcatttggccagggggagggatgagtaagcgcatttatggcaaaaggacgaaatgaataaattaatgggcgaacagcagagaaagtgacgaaggatgaggggaaacacagagggcttaatcgaagtcgttgaatatttggtcatttatt

SEQ ID NO: 8363 - DNA, 2302 bp, Heterodera glycines
cccccccccccgatccctttgttggccaattaattaattaattagctgttgccaatttctccgttgcacttcccccttttgtgccgtcccctcaactttccttaggaatttccctcccccctgtggagatggagatttatctcttctgttgcgctttgccaataatcgttacgtgacttatcacttcttatttagcggcttaccgttctctccctctcactttgccaacttcggatgaccaaaagtgtgccgagtccctcccggcgtccatccgttggccatccctcctcctcctccctttccgccccctctccgatgcccaatgaacttcgtaattcttcaaattctgaaaattgcccaatccgcgcgagttttggtaagacattggcttatttcttgcctttgctcaacacatttacgactctttttcttcagaaaattagccattttgaccttaacggggaagcaaaaagaaaacacatcaaaattgaaattgggcgaggagagagagagagggagggggagagagagtgggagaaagagagggggacggatagaagagaggggagagagagaccccacacaatttgacggagtaattagtttttactggccaaagcaaaaagcgacgagggaggggggaggggtaaatgcgaaaaatggatccctaaggaaatttgtcgggacttatgggtttaaagggggcttaacgcctaagtaaaaaagcaaaaattgggtgggaaagaaagagacgaatgaaacggaaaagcatcagaatggctaaaaaaacgccaaatttattagcagaaaatttaaaagccgccttcgttttctctcagatggccccacaaatttcgaattgaaacatcggcacaaccaaagcatcgatttgtcctcttcactttcgctgttttctatgcccaaaattccgtttaacaacagcagacaaatgcccatttgtgcgcagtgttctcgaggtgaatgagaatggtttagtcggcacgctcttttcggctttatccgctgacattccatcccaataaatatgtctcagctaatgaatgaaattatccaccacttcctcccgttttcgttccattaatttcttaaatcacaaatccctttttggtgctccatttctaatccattgaatgtgccattcattcattcaccgtctgcgatgaatgttttgccatctccgattgatccctttaaaacatttcagtgattatcgacccattcattttgcgtgttccgcccaatctcgagttccactcagattgccttaaggtaataaatgggggggggattagtaatgccatcgcgtgatccaacaatctctccgccttcgattaagcattcaaattgccccggctttcctgtcggctgtcccattaaatatgcaaaatgcgcgatgccaacgaaaaggaaaatgcaaaaaattctttgagataatttgacactttctagagatatgctagagaaaagggaccaaaagccatttgatcattttctgtgatcatttcctctcccttttttttgcccctccccctcaaaaaactcaaaagcaaataattcaccctcttctcttcccccccccctcgcttcactccctttttcctccgctgcataatttgcacttttttaccgcgcggtgtttgggcgagacttcaaaatcaacatttttgcccgaaagaatctgacaaagttggacgattattgctattaccgggatcttctcaaaaattatcgaaatgctttttcatccattgtttgtttttatgaaagtgatcagaaagtgtcggtgggaagcgccgctcaccgattgtggtgggtggtgggtgaccttgatcagatggcatttgatcatttcggctgaactgtctttgttctgtgctgcttcctgtgggttctttctttcaatcatccttatttgttaggtgttttgtggattccctcctcaaactgttgctcattttcacccctttcattcttttcgaaaaggaacaacggagacggacccccccccccccccccccctccaacagtttttgggtataattaattcctttcataattttcggaattgaatgaatttgatatcattcgatagccccaaattgtctccattttactgcaaaatttcaaaaaattcataatttttaaaattaactaaatttttttttaaatttttcagaccgatagagaacacttaaggttatcgaatgattccaattcattcaattcggaaccatctcttttcacctccgccctttccccttcggtttgtttcccttttcct

SEQ ID NO: 8364 - DNA, 5040 bp, Heterodera glycines
  misc_feature (77)..(78): n is a, c, g, or t
ggggatggctttagcacttatttgtctatcccaagcattcacacccggattaggcgaaccagccactatacagcaanncacagaggaatgtgagacaaattcaaacggaacggaatgtagtttcaattctgttaccctagtaaatcttctcccagtcggccaacccgtggatttactgataagagggccagaatccgtacttttgggaaccatgaccttcacccttaagggattgtttcaggaatgcattcccgagtccttgggctttatcagatcctataaaattgaaacattagggaacaaacggtgccctggaatggggtcctgcaccgggaaaaattgtgaaaatctgttaacagatcagtctgttcccgaattagccgaggcgaataattatcccggaaacacctactgcatcgatagtgggtcgttttggtttaatggctgcggagggaccaattccgcttgcctatattatcggaattatgctattcccactaaacacggaaataaatttatttacgaaatattcagatgtcctgcctggtactttaggattatgttaggggtaaaaattaatttgcatggaaatgcatcacattttgaggaaacggtcctatattcgggccacactttccatcttaaaatggcaaaattatccgtaacgccagccgtttttggcagtcccgccgctcctggattatccggcatattcattggaggccggggcaaagccgcactcgtaccgtcttttcaaccatctctgaattgtccggatgaaatatcggcaaacttaatgcagtgcaatctttccctaaattcttgcacaaagtgccgaccggaccacagtgaaggcactgtccgctgtcattgccgcgaaacggacgttgaaaaattgttggaagatccaacgactaaattaccgttgtccattggcccatttgtcctaaattaccgtcaccctaaggaaatttgggccgaaacagtttttgtaccgatccaaattgccttaaaaatggaaggaataaaattggccataagtcatcaaatggccacgtgtaaaataatcccagcagggatcacaggttgctaccggtgccgaatcgggagccgcttctcttacacctgtacagctagttacggtacccccctagccgaaatttcgtgtgaaaatggggcgaattgggccatcccatgcacaaataaccccatccagcacaacacttctctctctcttaattcggctgaaatcaattccatttgtaaagtaatttgccctgggggagagaccatgttcgtaatgaaagggaccctctcctatttaccctcattaagcagaaattggcgcatttcgggatcacgaacaaaccataatcccggtggtttcagcttccccgaatttggcgattttccccacctgtttaactggatttttggaggcattcaattggccattatcatatgtgtcatatttcttggcatattagtgctttattgtctaattaggctaaacccaattttccgaggataccgtcttttcattagaataatgaccatatgcttaatcgcgcaagcgattcatgccgaagaagaggaaaatcagtcattcatggaccaaaaatattttgaagtaaagatttttgtatggatgcaccaagaaataataggtcaggtttttcttgccatttgcatatttgtcacaatttgcgctttcgcatggatgataatggagcgtagacggcgttatcccatacgcttaagacgcgaccgtgtcgaaccgcaaagacgaccgaccctagtaatgcaatggctaactccagatggacggccggcattagtcatgcagtgacagattagtcgaaattgcctatgtacaaaaatcccacccacactttacgctaataattttataaaattttttcacattgcccaccccaaatgtgcattaatcccgatgggattctctatcagcaaattggggaagtatataaataggaaattcaccccatcacaccactctcgtttatgttcctaattgcctcctatacccgtacgtcctcatatttgttctgcagaaacatgaatcccaattattcataccccaacacttactcctacccggctatgaacaacaacgtacccaatcccgggtacaaccaggcaccccctccgggaatgggggtgcaacacaacaacccgccccgtaccgaatttccatcccaaaactacaacccgtaccaacaacctttttaccctcaccctaccaaccaaaatggtgcgtcaaaccctccggtttaccatttccctacggatgcccaaaataaccaacaacatactcacaaccaaacttacaatgctccggctccccaaaatccgctaccaaatcattcgactcaaaataatgccccagcggcggtccaaaatcctccccaaattacccaaaatcaccaacagccttagggcaacattttgaacggacaaaatgcggttcctttgaaccagcgcgttattcccccgccaaaatattacaaatcgaacaaagagaaaccggtaagaaaccgctccccattcttttcccacaaaacatggccattttttttctctctccccagcgccgtgatgccccataccgtcgaccggatccagccacaaagaaagccgatcccaaaaaagttcccgctcctggggtcaagaaactcctcacggaggtgctttctgagatcaatacccttagcgatgcgttgaacaagcacgcggccgaattttctcgtttcttccacttcatcgtgaaacaggcccaaattggtgaacaggaagatgagaaggagagacaggcgagaaaagcggaagatgagaaggagagacaggcgagaaaagcggaagatgggaaagaaaaacaggcgaagaaagtggaagatgggaaagaaaaacaggcggagaaggcggaagagggggaaaagcaaccggagccggctaaagaggattaagcccggggggagttttctgtcgccgacagaaaaaaaaatcggcggtgatcattgatcaccaactttgttaactttacttttttgccgtattcataaatttttgtcttaatgagagccactttttgaaattaatctgagaaatcccttaaaagtggtcatccatggttctttccctggccccttaatccgtttttccccattttttcttgtcattgatgtccaccatttgccccatgcgctcttcaacatgctcatctgtgcgaccgccccctttttggatccgcgcccaagcccaagaagaacccgtataaaagaacgaaggaagagccactcgacagaattcaatttcccattttaactgccatccaacagttatcaaacgatctttttccaaacgatcaaacgatccaattttcatcacacatttcaatttttcacatttttcattgcgtttttgaataaaggttttatccagaaaacctttcacttttccttcccataaggaaacccctttttccaaccaattgccctcattcctcctataggaatttggagcttccatcccaaaccataagccataacattttccaatttattcttttccgcccaaaaatttaaacgcaattttccatcccttttcccatactttctgaaccgccgttcccactccgaaaacggcggcgataacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgtggtcacaaataaaataaaaaatggctaatatgtaaaattggcgtccagaaatttttagactaatccgaagcaaagcacgaatgaattaaagaggcgaaagaattcacagtattgtttctaatagggaaatattgacaggatattcggctaaaaacgggtttgatcatttttagcgcatttttaggtatacatttgagacaattgggcaggacaagaaaagaatgaagttgatgcctcatgaaactcgtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagtggatgcctcatgaaaactcagaatacgaggaaaaatatgcggtcacaaataaaataaaaaatggctaatatgtaaaattggcgtccagaaatttttagactaatccgaaacaaagcacgaatgaattaaagaggcgaaagaattcacagtatcgtttctaatagggaaatattgacaggatattcggctaaaaacgggtttgatcatttttagcgcatttttaggtatacatttgag

SEQ ID NO: 8365 - DNA, 941 bp, Heterodera glycines
ccgtgaacaaatgagaacaacaacgaccgcgacgatcgatgaagtgctgaactttctacgtaaccgaatttcaccggtcgcaccgagaaaaggtgaaaactaacacataaatttatgtgaaaatctagttttcttttagtcatttgcgattttgagaaagccgaaatgaacgccgtatggagcagtttctcctctactttgcgaagacgtacatcggaatgacgcagcaacagctgcttgatggtgaaaatgcgtttggagttcgtcctggtggtctttctccattttcgtgtccactttttcattttgttttatttttattaatttgcttttaagcgtttgctgggacatcatttgcgtccgttggatctgaccatacgtactcacggcagcccttgcaatttggcatcgactcgcccgccccctcaacactatcatggccgtcaacagtggagcaaaattcgccgttggtgcagtactcattgagtccatcatcaacgacgacattgcagccaggcatagagaaattcccaaaattgttgatttaaaaaattttaagcccgtccttgggaagaacccgtcgttcgtcgcgcactgttcccaattccatattggaacgtgcactcgcatgcggcttctgccctcgctcggaccaacaatggcctcgaagcaacccatcttcatttctctgtatttattacttataaaaccccaaataaaataattttagaagggtctttgtcatcacccagccctttccgatttcatttctgaagtcagcggaagcatcgacagacaagttgacgcagcgaggtcagcaaggaacttcatacacaaacgacacaaacgctacgtgctgcaggacgcagtcatcatgagaattttggcggatgcaacatacaacaacgatgccgaaattcatgatgttatgacggctcttg

SEQ ID NO: 8366 - DNA, 1421 bp, Heterodera glycines
attaatagagaccgcattttgagggaaatgcctttttttctgcgcactagtttcgatatattaagcataaataacacattttccagttggtttgagccttctacgttgacttttattatgccttttttggcatttttccgttttggtgccttttttggtcttttttccggaaaattccattaaaaacggaataaaatcgggaaaatacacccctaagaattgaaaaattttctcaaaaattgatcgccaaaattcattttttttcttgataataaattttgggcctaaaaattttccttattcgaaaacattataaaatatttaataatgatttaaatgaccaaaattaagtttttggttaagttttacgtattttgcaccttaaaaaaccttagaaaaaatttttttaatgccttttttcatgcctttttcgggattttcgtgccttttcaggccttttttttcaatttttggtgcttattatagtgcctttttcgcgatatttgatgcctttttttgcggtctctaatcattacaacaattataatgatttgatcactgatatggacagcgcataaagcttatcacggacaacagatcagagggtgataaagcacatacaaatgatataatttggggggagggggaaacagcgtcatattgggggatcagcagcagttagaaggggagaagcgtttgttgctcgaattccatcgttcgttcgttcatccgcgggggccgtcctcgagtcgatcattgttcaccgctggagctcttcgacgctattagcagggacagatgaaaaagtggcgaaactcacaaatcaactgaatggtgtacagcaaaccgcaatactgaaagggaagtaagaacaattagtagggcttccatttttaggcacaaaaaatcgcgaaataggcacctaaaaaggcagaaaaaaattgcaaaataggcattaaataggcacaaaaataggcaaaaaaattttttttattaacattttttaggcagcaaaacacgtaaaaatttaaatctttcaaattgtaaatgaaattattaaaagtttttccagataaggacaaattttaaatcaaaaatttttattgagaaaaaaaaattaaaaattaggaattatttttttgaaaatttttcaattcttaagggtgtattttcttaaatcttttttcggtcatttcttaggggtgcatttttcgtttttattgcatttttgttaaggattttttcaaaaaccctaaaataggcaagttaggcacaaaaaccccgaaataggcaaagttaggcattataagtcatcgtagacaccccaaaccaagcggaaaatgcctttttcgtgcttatctaagcgtattaagtgcgcagaaattttaggcatttgccctaaaatggaagccctaacaata

SEQ ID NO: 8367 - DNA, 1067 bp, Heterodera glycines
  misc_feature (1044)..(1044): n is a, c, g, or t
gctcccacgccgaacgcaatcgcagccacgcatatgtaggagaggatggccttgaggttcatggagaacagcagcggcagaagtgatcggagtcgacgtgtgcacgggcgatgagcagcagaatcagcagcagttagaaggggagaaacgtttgttgttcgaagtccatcgtttgttgttcatccgctgctggggccatcctcgagtcgatcattgagggtctgccaatttgaggaaagtaatcacagtagtatcaaacatacaataatgagaaaattgagtttttgcaaaaatggcgcgcgtccgcgcgtcactcccctcctttttaattgtgacaatgaatttcgacaaaaagacacctgaaaattgctgatcatctcttggatcttcagattggtgttgattttacgcgtttccacatcactcccctccaacaaacgtttacgagcagctgaattcaattgcggacgtccggtcggctccattttgctaatgaaaaaaaaattgatataggatgacaaatacacatatgggatatttaaaataaaatttttaattttattttccggcgggaccacaattctgcagtattaccaaaaaagacagacctggaaatttttgatcagttcctggactttcaattgcgtgttgagacggcgcgtcttttcattgtcggcgatcaagcgcttccgcgctacagagtccatctggactcgtccaattcagaaggaaaacaacttttttgctctcattgtcagcaaaaaaattttgtgaattaagcgatttcagggaaagaatttgtttagatttgggcccccaaaatggtcaattttgaaggtttagaatcaactttttaattgtgacaatgtatttcgacaaaaagatacctgaaaattgctgatcatctcttggatcttcagattggtgttgatactgcgcgtctccgcatcactgcattcaattgatgccggttttttggattcatttttctatgaaaaaaaattgattatattacgatgaaaaaaacacacatatatatatatncggtcggggtcgatttcgcgccg

SEQ ID NO: 8368 - DNA, 1165 bp, Heterodera glycines
  misc_feature (44)..(44): n is a, c, g, or t
gaacctggcgcgaaaacggtggcgcgaaaacgacggcgcgaaancgacctggcccgtatatatatatagcattttgggtaatagtaccgatggtgttcaatacagaaatatgcatatgatcaactcttaaagcatcggcacaaatcgttaaaaccaattttaaactaaaaatcgaaaattcgaattttcgactttgttcaaattcgggttcggaattccaaattggtcgaaatgaaggccggattcgttccgtgtcggagaattcaattctgacatccatttcgacccgcttcgaaccccggacccggactcgaacaaaaagtcgaatatttttttcaacaaaattcacatttatacaccaaaaccggtcaaattgcacgaaatagtatgtcttgcgttcgctttatgtgtttctagattttatttgaagagctacggaatttcacgctgaaaaaagtgcacgaaatgtatgtaggccctaaaatgcactcaattcatcaaaaagttacgggtgcgcaaccaaagcgtgactagacaattggacagtggacaatccgacagtaaatccacggtccgattgtccggagtccaaccaaagtgagcccttttttggcgggacaaaagtatggaaacaaaagttttatttgatgaaaaatcattttacgcagagaaaaaattctggaaaagtttctgctaatctaaattttagtcctgatcaaaaaagtcttttacaccaacttggtccgatcactccttcatggtgatctggaaagtcaaaaatggcttgaaatctgggaaattttcgcgaaaaaaaatccttgggggttaggaaaaattttctgcaaaatttgggtaggcatgtcagaaataggacaaaattctctaccgaattgccttttggatggtgggtcaacgacgtatacccacagagcaagagagcatgaaacattggacatctcaaaaatcacttattttctacagtatttcaaggggaaatgatcaaacaaattgatcatttttatggtactcataatgttttccgtgcttgtgcttctctcatcaagtacaatccgcaaaaaaaaataatatgttaaaagcctaatccgttccctaatcattagccattttatcaacaattactcacaatgaatgaatgaattaatta

SEQ ID NO: 8369 - DNA, 4505 bp, Heterodera glycines
tattagggcaagggcatcggaaaatttggatggacggtaaaaaaaaggcaaaaatagttggcgtaaaaaacaaaaaatgcaacattcaaaacaatacagagtaccttagaaccttttttcggcaacctgggtttttctggaacttaattttcttggattttgtttaaaaaattcaggttcaggtcaaatatgaaaaaaacccaggtccatgtgtctatcaggcacgagaaacctagacaattaaaaatttgttactccgagtgaccactttttgtttcaattatcaaaatgatgaatagactgattaaaataatatatattgtcattaacaagctggatttttctggacctagatctgtacagaaaattcagatccaggctttttccaaaatgccaagctctaatctttattggtagagtaatcctttgatggagtcagttatttaacgaaaagtgaaaccgcaccaacagtaacaggcgaattcaaaaagcaaaatattttgaaaaaataaaagcatcataatacacgaagaatgatgaataatgaatgagtcagaattggaacagcaacaacaacaataatcattcactgattcattcgcttgatcagtccgtttgctgtgctttctgcgctttagtgctgctcctccttcgtctcctgttgctgccccttcccttcccattcctcgtggcgaacgtcgcaattgtcaaaggaccgctccaaggcccagaaacggccgagcgcgccgatgtcccacgcgttccgccacagctccgtccacggccatccacgcaatgttttgtcgtgggcagcgtaaaagtcattcttcaaagttggggaaactatggaaggcaattgcggcggcggacattctctcggccgacctttttgtcaaacggacgctcaacgagcacagagaagagcaaaaagtcgacgagttcaagccgattcccattcaacaggacggtgtactgctcgagccgttcgtctgtaattgttttgaggcttttgttagcatcaaaaaattttcgaaaagccatctcacgaactgccgagccccttccggaataatcgttttgtcccccagtcaaatgtattcaccggcacgagtgctgtgaatggacgccgggatgagcaccatttgctgacgcaactgagccaaacgcgcgcgcagcgcaatttcgtccggattggattttaaagtgaacacaagcgaagccaaggcggcgccgcaagcgacggcctgggaaaatttgggaatttgacgaaggataaccgacatggattaagacaacaagcgaccattagaggatcgaatgaattgcatgtccgtgaccctgacagtcggaaacatatttaaacgcactcgcagcggtcgctgacgcattccaacgacgatgtcgcggaaggaagctgcgtaatcgatggccaactgttgaacgtagcggcccactctggttgtgccgagtcgtgccaacagccgctttgccggtgttgaagaagtagcggcactttcagtcgcggccatcggttccatccagcgaatgtccgccaaagtgacggcggccgcttgttggtgggacgaccgcttctgctggtgatgcatgaaaaacgaagacattgaacagaaaaagaaatggatactgaaaatggggcaaattgaggggcaattaaataatgggacaaaaaacaaaaaagtacaaaattaatatgtaaacaaagataatttgaaacaccaaaattgggattgtatttgatataaagtttaaaaaatcagttgacagataaaactgaaatggaaaacaaacaaaaaaaaccaacaagcaaataaatgtgtatgaagaaagaacgtacataaaactttaaaaaggaaaaatggaatccgaggtggaaatctgggggaacgacagacaaaagcaacgaattgggaaaaggaaacagacgaactcaaacatttggagacatgcaaattgccgaaggcgataaagagcagttgatggggtcattgtgaaagagtgtatttgccgttctatccccccttaaatatgccaccactttcgccccctccccgtaatatttctcgatggcatttgcgtcgtttgcccatgttcaaatggtcatctcctcctcctcttcctcgtattcgtttctgtcctcctccatgcgctcactgacaccgaaatgggccgcacgatgtgccgctttgaatttgcgctcgatggtgtcaaaaatgcgtgccaaatcttccagcccacgcagcagcacatcccccgcggccaccccttcgaccgtttggatacggacgaggattttgtcctccaacggatggggcacgttgtaaccgcaaaactcgacgccgggcctggcaaaatgttcgcaaaaaatgtttggaagaccaacacaatcgctcatatactcacatttggcaaatgatgtgtttgagggcattgccaactgtgtggtcctcctcgtagagaatggcggttatcctgcaaggaccaaatatttattgaaaaaggagcagtctcgagaatgtgaaatcccgaggaatcatcgactggagagaccattgatcgtttcgcaaaactatcggaaaattgaaattttaaaggctaatggagaagagatttgtcgaaagacacaataccctttcttcttgaatttttgagctaattaatgtaagaatgactaatttgtcaaatctttaaaatctttatgaagtcctttcgattgacctccgttttctgtttcccccttctgctattttattttggtctcttcgtcaacagttgttctatgggaaaatggacagcgggacgctaatgaatcaatcagcacggaaatatttaatggcaatcgaaatgggtttcgtattcgtaaccagtagggcaaaagctccaaagttatcccgaaagagaaaagtaaaataaaatacaaaagtaaaataaaatacatgttagaagcttcaaaaaaatgcagaaaacttttttagtcattttagaacaatttcgagtcagcaaagcattcgacataataaattcccagccttagttaacagcgaccctgaaaatcccaacagttttgcattttgattaaaatgaggataatgtacaattactaacttgcccatgccaattccggatgaaatcaatgacaactgtttatttataaactcacattgtccggtccttcttgtagtcctcgatgttcaacagttccactttttgaggtgccaccgtcgggggcagacgcgtccgaccgacggcattccgatttgaaagtccagtctccatttggcttttgtgaaataaggcaaaaattccgttttatgggcatgtttttaattgggaaaagtaatggggtgggaaaaatgaaaatgagccatttgatgacagaccaaacatttggaaagtcataaggtcaaaacgacggaagagaaaactcgtgcctttttcaattaataaatagaaaagtgaacaaaaaatgggtaagtgatcgcacaaagcaaaaaacagagaacggaacaaacaaatgggaggcaaaagaaaagatcagttgaacagagggcagatcagatcattcattgaacggtcaaaaattgagtcaaatgtttgtgagtccttcgtccatccgttccccttcacttcgttcagtcgtccattgtctctttgtcctcgtcaatttttggggccaaaaagaaacgcaaaaatccattgccttcgatgtcatattcgaccaccaacggaacattgtcgcacatggacaaacgcacgcggtcctaaaaagggcacaaataacactgaaattttaattttcacaatttaaaagttaatggacgacagccacctaaggttttttttttgacaaaattcgtcatagcatttgacaattaaatttatggagaaaaaaatacattcatttggccatgcttttgacttttttttgaaaatttgttagagttaccaaaagatttgaatttgcgagatgggcttgcttcataatgcttacaaaactatttaatatattcaaatacaaagtaccgaaagtgaagtggccttggtgaagttggtcaggtacttgatggagaagttgaggttcaccttctccttcacagttatgtccacgcgctaaaaaggatttaaataacaactcaaaatgcttcttcattcacaaacatctttgtcatcgtcgtcatccgccgttttgtccttggagtagcgaattgtgtttgtgaccgaatctgcgaagcgaattgtcaaaaagttgtgcttatcacaactaatttttttgaaaaatttatgaaatttttcattttggagcttttgccaaaacatttttaacgattttcaatcgttacctaattggctatgtttaaggataaataaataagtaaaattgcgtccaccaacctccgctgccgctgaacacaacgccgctctttgtggcggtgatgttcatcgagtcggagaaggaggcaatgtcacggcacactttttggaactcg

SEQ ID NO: 8370 - DNA, 2738 bp, Heterodera glycines
  misc_feature (21)..(21): n is a, c, g, or t
ttaattctctcttagcaattncattcattcgttttttcccttttttcatggcaattcgtacagtgaaaaaaaaactgacaaaaagctgtgatttgcctttcaaacggtaaccacgtgtttaacttaaattcaataaaaccatttgtaataaatacagttttatcattttattttgtacgaattgtcattggccctttcgtgccaaatctttcactttcatacattaaaaagtcggctattcctactccaccccctccgatgcgaatgggctccccattttggtcttttgcgggcgaaaggggagggtcaaacccccgcccccctcccttcactttgtctcattcgacttgttaaggttccgtaagaagtgcggcctgttgtccgacttttccctctcccccacggaatgtgaacggtgtcgactcgccgaggaatgggaggaaacatggcgattgcatgccgagttggagcagcaggagaagaacctccgttttcggcccccactaggctcaaatgttccacgaaaaccaatgacacttccgccggaaaattgaaacagcaaaaatgattttgtaaaatgaattcggatgaataaatgaataatggttaacttcggataatatttttacttactttggcactcatttttaaattcgtttccgtttgcctttgtcttttttcgatgttttaaatttattttttctttgtttttcttctcccatcaatggaactgttgttgtgatgtttagtgattctttcctccttttgctgcggatgaatgatgggaaattgggacgagttccgcctttccttctctcgttctttgccctcttttctctgactgtctgtcgtgtctccatttgtcactacaaatttgtttttctcttgtggtgcgtaaaagaaatgaaaaagagggagagagagagaaggagggtgtagagaaatgggcgagagaaagaaaagacccaaccaatcggcggacggggaaagaaagggcttttgcatatgagcagtaataatttaccaaccattttatatgtcattcaaaggctctcaaaagctcaacgaatagctcattaaaatacaaaattggagtgaaagtccaaaaaattgaattttcgggttacagtaaatttattttcaaattttaattgagtttttatcgcttaaacattcttcctttaaatattatttcttcggatgtttggccctttttcttaaataacgaattaaaacattttaatttatttaaagcactttcatttctcaattataattcaatttcactcccttaattttatgtttagcgccacttcgacccggaaaacatattcgtcttcgccttcccatttttgccgcaaattttggtcttttgtgacagcagctgacttatagaaagaggaaagaaaggagggaaagagcgaaacatccgcggaggtacggcgcggcgcattcgttcgtttccaatgtccctcctttccctcctttctctcctctctctcttctcgtttctctctcctctcctttttctctcgtttctttttccctctctctttttctctctctctctcccctctctctcctcccctctctttctctgtctgaggtgtgtatgtgatgagagagatttttggtcgagtaaacacacagaaaatggatggcgtgctacaactgatcaaaatgaaaacaaacagatgattttagttcgttttcatctgattgttagtccgtcccttttctcactttataatgttttgttgataagaggaaagcaaagtcgggaattaattaaagccctggatatgagtggctttatcctgcccattttagaaggtctatttttggcggattcacgagtccctcccccccccctcccctctcccaatgtgccatttcgcttgcagcagtcgtacatgaaatgaatgggtacgagaactaaccagccaaccgaccaatcttctcagcagtcataggagggaagcgagcagcgctcgtgtggaagcgagcggcgaatgagaaatggggggaggggggggggggcagtgctgctgctgttggaagtgggttctgctggggggggggaaggggcggggactattcgtcgcccgtcccgtggtccatattcgctctgatttgtgcttatttctgagatgactcaccggcccaaaattttttaatttatataaattatgtattttggcacaaaaattctcacaaaaatggccattttatgcctaaatcctcaaattttgtttttagcgaaatgctcaaaatgagaatttaatgaattgatgaaaaacaattatatgcaaaactaaactaggctttataatcatttttttaaatatgctttatttttgaccagcgatgtgcgtattttgtaaaaagttcgatcacaactctctactaaatgcctaaatttttagaaaaacaaaattttccatttcaatttcaaaccaatttttctgtttccaaactcaaattcctactttttcttatttttgtttgtgtttttttttgcccttttcgtatcttctcgttttaccgaaacttttcttcaatcagtcgctgctgagaattaatccgtaaaacaaatgtacactcggcggagatgggaaaaacgcaaatggacgatgaaattaggccggcaaatcagtcccagagaatttggcattatttttgctagagattatagcgaccttttttcgtttgcgcctatgtccaaaatcggttcaaac

SEQ ID NO: 8371 - DNA, 917 bp, Heterodera glycines
ggtaaaaaaaggaaaaaaaagagatagccatttttggtcaagaatttttttgtttgggttcaaaatatcgtaagattgtttgataaggccagacaagagaaggcagctgttggtacctagtttgcagtaaaaaaatgacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgttcgatagggccagacaagagaaggcaactgttggtaccaattttgccgtaaaaaaatgagaaaaaagatgtttgatagggccagacaagagaaggcaactgttggtagcaagtttgcggtaaaaaaatgagaaaaaagagataggtattttttggtcaagaattttttttgtttgcgtttcaaatatcgtaagattgtttgatagggccagacaagagaaggcaactgttggtaccaagtttgcggtaaaaaaatgagaaaaaagagatagctatccccccggtgtctgctgctgcccttcccttccctttctctcccattccgattctcttcgctcttctcattcactcattgagtcttgagtcttatgactttctgtcccctcccttctcccgccaagattattgcccccccccaaaaaaaaaaactcaaataattcctccccttattcacgtgcaattccgcccgtgccgtggggtccacctcgtttcggcgccagcccaatttttggactataacttttttctttttccaccgaatctaacattgttggtatcattcgagagcccttctgatgctctatta

SEQ ID NO: 8372 - DNA, 961 bp, Heterodera glycines
tttgacttagacttgggataattgtgtcattcgtctcatgaccatccatcgttgctcccttctccgctgatgatcatcgcccccattcactgagtccgccattgccccattgatcctccctcccttcctccacatataaatagccagcccaacgaatcaacgctcttcgcttgcatcatattggacatttcatcaagcagtaaaaagtgctggattgaaaggggagagaaagatgatggagaatgaatggagggagtataaaagatgatgatgatgacgagttgacgacgaaagcgaccaaaacggtgaataaattgggcggaggagggggggggggagcaaaggcgaggaacagcagcgaagggagggggaacaaacactgttcattagttagttattagaccgctcctcaccgccacccttcctccatttaaaaaaacaagaagcagctggaagaagagatggaagaagactcatttcccttcccttccctttgttctccaaggcgggggggggggtgaccatttgggtttgaattcaaacgattacacaataagtattaaacaaatatatgtatatgtaaatgttgaattgcagctttaacctatgtcaaaaaggggcgctattttgcagcaaatttgtctgtctcctaaaatgcttattcctctccctgtccataatttacaactttgtcctttcccttggctttgcctcttcccgcgctttttggtctctggtccattttcctgcaaatttccgttgttttttccaacatcgtcctttacgttttctcttatttagcatcaacaaaaacaaactgtcaatacggcaccatacaacaaaaataaaaagcaaagggaaaaacaaacgacgccaaaaggcagcaaaaatagctgagccaaaagtgaagaaaataatggaattggccaaggaactcatcgccgaagtgttacggaccgaa

SEQ ID NO: 8373 - DNA, 1891 bp, Heterodera glycines
tttcttcgggagacaatgcaaagttcggcctggcgttgcccttcgccgaccgttttctggccgaaggagcggcagtttccattcatttgatgatggcacacgccaactgcaaagcatcggcgaaagaattttgtgaagcgacacaaacattggaggtgggttcttcggttggtgtcgagtgatgtgtcctattctaatttaaggtttggaccttcaaattgcagagggaagtgccgtacgaagtgagtgcccggccgccaatgctgccgctgttcttgcgccaggcagtccgttcccaattgcatttctcgcctttccgttcttggcttactgcgcgacaacgcgcggggccatccgatgggtttttgcctcttttgcggtagcgaatcttttgctgttttcgtcgcacttcgtccttttgcagtgtgtgtgctgcctctgactccgctgctccgcccttttcttccgatcgtctccaatcccaccaattcccgccttgcttagtccgttcttctctgcccgtcatcaatgtcccgttgcgaaatgtgcagcttaacagcactggtgagccattttggctccgagtgcacgtccaatggctgaagaaggaatgttttctcacaaaagcgccgctatgtccggaaatgaggtcgctggggttggccgagtttgatgggatgactgactttttcaattagcatggagcagcaggacggcctttggccactctcttccacggaccgatgccaaagccgagcgaattgcaatgccatcggagaaaacggcggactcgtagcattgagcggagaagagacagacgaatcgcagtgtacgacgccaaccgaaacactttcaccaattgtacgacgtaaaacgacggattcaaaagaaggcaccaaaatcagagaggaaaagagagcggtggaaggaacacatggaaatgtaaaagtgacggacggaattatgttggaaaaaaggggcacacaaagggcgacggagcggcaaaacgacgacgaaagggagacggacaacagagcaccgctggacagtccccgtagtcagaaccaacactgtacggatgtgctcatcccaacttcaaatcccattttcgccccgtgcgcccggcctttctttcacaacaaaatgccaatcttacgtccaaacaaaagaaatggaccatcactggatgagttacacttggccgatgggattggggccgaatgttttgctgatggaactcatggggaacggaggcgcacttctcggcatcaaattccatccgtttcaatggaaaaatcgaatctccccagcaacaaaaacacgtggcgcactccgtccagattgatctgcaatttcgaggaaagcattctcaacggacgcatcccagcaaatagtgttgtcagcgggtcgttgaaaaattaaatcaatgacagctgaacttcccttttagtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccgttgcatttggtgaaaaatgcctcgttggattggtccgactaaaacttttttccatttaggctcgctgcgagttggcggcggagacggtccccattccgaaacggtgcacactgcaaatagtgctcttacggtggttacttttcgtagttaccaaatgccactcatttccgtcggttcagtccgtgcggttcggtcgttaagctgttcatggtcgcggtgaatgtgctcgacatgccttccaattcgaggacggtgagcaaaatgaataaacgacaaaa

SEQ ID NO: 8374 - DNA, 706 bp, Heterodera glycines
aattgcaaggtttttttttcaacaggcacagcccttggctgaatgttttggctcggctttcgtttcggtaattttaattttgtcgttttttttaaattttcccaattaaaagggtcactgctttgtgttacgccctttttggtgcttgcgctcggtgtcgatgatgcttatttgatgctgaacgcgtggcagaggcttagaattaggcgagcactagcatttttggcgcaatttactcaaatattggtgcaccataatttcttaatgaaattccagcccagaatttttaaatttaacccagcttccggctgtttttctgaccatttaatggaccctaattattataagtttgagcgctgaaatggctataaaatttttacaaatggtcaggccaattcagtactgtataactgagcgcaataatatattggtgctgaatcagctggcgcagaaataataacctcctaagccatacaaaatttcagtttggaaaaaaagcttgaacatgagggcaagccagtgtcggtggaacaaattgtgcaacggttaatggcccaagtgatggtggacacgggtacgaattttgtgatttttccacaaaattttttaccaatttcttcaaggggcctccatcacgattacggtatggtctggaacaaaatacatggaaaatactggcgctcatcttttaaatgataaaaatttt

SEQ ID NO: 8375 - DNA, 1056 bp, Heterodera glycines
ctcaaattttcaaaattttcacgcggcgcctgtcggcaccaccggcagacgaccccccatttttccgtatttttgaaatgttgaccccaaaatggcaaaaaaatagccccatttttggcacaaaaacgggtaaaaatccctagtttttctctccatcgcttgaatttaaaatgaccggcctaatcaaaattttcccaaccccctaagaattttttctaaaattttccccactttcagtatcttttgtggtgttcagatcgccatgaaggagtaatctgatcatgttggtccaaaagatttttttgttcaccattaaaagtttagaggaaattttttgctctacataaatagatttttgtttaaatttaagaaaaatttgaaaaattttcttaataaacttagttaaaaaataaaatttgtccttggagatttctacaaaaaggcctaattttcatcaaaaaatttgctcaaaatcgtaaacttagtcattttttggaaaaggtacgcagcaaaaaaacggtaggggtcaactccgtctggccaactccgtctcagcaatgttcaaaaaactataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcgaagttttttatttctatctttttttatagttcgaaattttctgtactttttagtaggctaatagagcctgtgaagagctttcgaatgatatcaagattgtttgattcggtcaataacttcaagagttatattaactcaaagttggctcagacggagttggccagacggagttggcccgttcctgcaaaaaaagcggattgtgttttggcttctttaaaatatcttttaggaatttttccagcgattaaattccgtttttctaaataaatttaaattaaaaaaatcattagaaaaaaattttttaatcaaggatcactgagtttttggggtgccg

SEQ ID NO: 8376 - DNA, 4062 bp, Heterodera glycines
  misc_feature (169)..(169): n is a, c, g, or t
  misc_feature (3084)..(3084): n is a, c, g, or t
caaatgatgtcccattaattggagtaccaccgggcgggtgtcatgtgttcgagtgtccaaaaaattaaccagcttatttccagacagtggcatgtcaagggtggccttcctcctccctgtcatctgaagcggcgaaggcaccctgccgactcgcgccggacacccatgnacgcgagaaaagcgacgaccacgcgggcatttccacgcgtttcggcacaccgcccgaacaatttgctcaaggtatggtcaaaaataagcgactatatatgatgtacaatgattattttgcattcccccaggttactgtactactactgtcgtgcacttacgaacacggcgtgtgctgtcgttgtgatgatgattctcacaggtaccatatacatgctgtaaatacagtatccacatgctgtacatacagtatccatccgcttatttccaagcataggtattcaaaaaatggttttaagctaatattaaaaaaactaaaaataaaaacaattaatattgaaattaatatactcttttgcataaatcatatacatcgtgtcagtcaatgcccaaaattacggtagtaaacgcaactttctccgtttttcattatttgctatgctgtattttttaaacacagacccaatcttaacacacacacacacacacggtcgtttatactgtagattgtggagaccttactgtattttatactataaagtaagaacaactttccatatagcctacttgtacgtctccatctttggcctactgaacatccgtgctgagttgcggcctgagcagctgtttttgcgctcctctgacgtcattgagctgttgcatctgcgcaacgagttgccaataaattttgaaaattttgcgccaaatttaaattaaatttttttctcacccagatacatcatgccattctatgcagtgtgcatggtttttgtgaacaaaccaggcaatttctccgacccggttcagcgtcagagatggcattcgctggtgcgcgcgataattagcaaaaaaaatctcaaaattttttgtcttaaaattttcaggtttccgattttgaggggttgcccagctctgttggccgcttctccaccaaattttggctacgcgactatgagcaatttgtggagcaggacccggaggcaagaataaagtttttgaaaatttggattgatatgaaattaaattttttatttaaagcgcagggctagtttttagaaaattagaattttcaatgtttttaaaaaataaggagccagggtttgtttttgttttttttttgtttatttaggagactcgggatttttttgaaaatttcatttttttcctcccttaaaacatccttgggttcaaagcaaaatttaggatgcagcacctccattgaacgacctagcagcctttgaaggtaggaggggttaggattttttttttaaattttttttttgaatttttcatccgttacaaattaggcatccccttaactgaacgaaagcgcaacgaactggccgaatttcttcaatggcccgaatttcaagtgatcatttatttattttccttaatttcgatcaacgcacatatgtaaaaaacaattttgtttgaatatttgatttttcatatcccaattgttagcgctaaattttttgggacccagttactaggttacgaaatacaaaatttttttagttttggaatggttttctgaggctagaatcatccagcaacacaacaaacagctctgccaattcgtcggagctggtgctgagccgcttcttcttcacaacggcttcttatgggacagagttgcgcgaatggtccaagcgcgagctgttgcttggtcaatgggcgcagggttgccgattcggtgaggagttttgtttttctttttacaaaaatttttacagtatcccgagctggaggtcagcgtgtacgtaagtgatttgtaattttaacttaattccgctgagttggcctaagatttatgcaatattttaaatctgctcgcgtatttgcttaattggtctggttaggaaaatttattaagaattgaattgcctaatagctctccattttcctcattacgcttaatttgcacacatcattaagtccaattatgttcaggaagatgacgccaaatttttggatctgatcccgacaatggtatgtaaaacgtctcaaataaatttaaagcttgccattttgatcggttttttttgtgtcatttcgttttcttcccccatagattccgcagacaattcagtcctctgcctgcactttgttatgtatgtttctcgtctgtctgctgttcatgaccaacccaggcgctctattggtctcaaattttgccattttctccacttgcattggtgcgttcaaattttgaacattttttcctaaattttggcgaaatgttttccaggcgtttttggcatccaatcgttactcggcactctgcttgatcccatttttatgaggtagtggtgtaaatatttatcacatatgtacattgcaaaatgaaaagcaaattactggagtctatttgtgattcgtccttaaatccaagggcagtccttgatttagtagcctgcttgatgtattgtaatggatctaatttttatgaaaaattgctggtttgaaaataatgaattaattttttttttgacaaagttaaaagctgaaaatcctaatgcaccatacatattacagtattaacttaaaaaaaccgtatcactggcaataattttttgaaatttatcagtgctgccatcatgtcaattggattctctgtggacattccggcacacattgcctatcatttctacaagacgagcgttggcgaaaaggcaggcaccagcttagatgtggaacaacgactgatggactgcttggctaccattggtcagtcagtttttgtgtgcaaagagtaaattacggttagtgtgtcccttataaagtaacagtatagcttgaggttttcgtatgactcaatatacggtatttgtacgattaaggtgacctgaattattcggtatttgtagcttgcgattttagcgtaatccaatacgcatgttattgtgaccnccgctgaaatatacaattatggtagttcgaaatgagacaattaaacgatacttcattctagcttattgttaatctgatccagtgtaatgtatttttgatttgtttttgcaaggctttcctgtgctggaagctggtctgtccacgctgatctgtacctcgtcactgttctttgttgacttgcacatggccagggcaagttgtatacaatagcctttgattacagtatactctggctactgtatacgtacctacagttgctaaattttggtacaaatataggtgtttgcccgcacaatgacgctggttgtggccatcggtttgctgcacgggctgttggtcatcccggtgatgttttccttgtgcaacaccatacggcgacgagagcggcagcgccctactgtaaccggacatgccgttatatggcctactacagtacttgaaaatggccacagtagcgcaacagaagagttatcagcaactaaacatcatcgacaaagtgaacgacgacgacgatcaatgttgtcaacttgcaagggctccatcggcgtgccgcccaccattcttacagtaaaccagtgcgaccgatgagaaaaagtacggaagccggatagccgctactgtagtcggaaaatgtataatttattgtactgaattagctagtgctctcaaattcgcctcgaatacaaataaaacaaaaagtatttacgggttattacctaaataattgtcaattttccaattttactctgcatatttgttattactatcgatgggttacggtacatttttattctgtaaactatgcagtaattattctttcatttgaattttatgcctttaacccttcgcatttattcattttttacttggaatattttgttatttaaattaccgcggatagccatatatttttatttacttttataataattttgataaaaagggaatttaccattggctatctattcaaatagaaat

SEQ ID NO: 8377 - DNA, 4635 bp, Heterodera glycines
tcgcaaaaaatgcacctgaaattgcaatgggcgaacagtgccaaaagcatggtgaatgagtaaagcagacgaagcgcaaattgccgatttgaaatgcacaatgaactggccggattggtggaggtgcacaacggcacgttgaacagcgcaatgcaaacgggcaaagcgataagaaaggcaccgacaatgtgccgagtagcccactggtgaagacaatgcaaaagcggacggcgactgagtagaggaagtccgatgaggacgacgacagctgaacagagcgaagcggaaacattgccaataagcgacgatcaaacggtgccatccctaatcgaattttaccggtgaggaaaaccgaagccgtagcaatgtaaaggaaaaaaggcagagagacgccgatgttcggttggacgaggaacagaagggagcaaatgataaagatcagagcagacacttggcaaaatgagtgggaattgaggaagggcccaataatttgccaatgacaccgaaaatgtcgatgaacacgccagaatagcggtagcgtggccgtcgcgaccgttgttgctgctgcttcgactcggcggcggcggaggccaacagaacgggaccgatggaaccgccacggttccgttccaactgggcccggtcaataagaaggtggttaaatgaccgggtcaaacgaccatggttatttgacctggtcaaatgaccacgaagttggtggtaaaccgagtcaataagaaaatgaccacgaagtgccgttttgactaccaacctccgtcaaactaccatgaactatcttcttattgacccgggtcatttaactacatgcaattttggggcagattcacataaaaattttgtttttttcttctatttatgtgataatgagggatacgtggtcctattagagggataaaattaatttataattagtttattttaaagaattttaaaaaatgtttaaattggctcaaaaattaccacaattgattatcgagaaaaattattttatggatgtgtttttggttaattctttgttattttcgtaaaaattatttgtctctcgaaattttttttgtcgagttttgactacctttgtaaaaagtggttttaaaaatacttaacattaagataaattttttattttggtatcagaagaaagagcacacttcaatctataagaatcttatttttgtttatttttatctcacaattttccgtgtcaaaaggctcatggtaaatatggctaccatgggtaggatggtggtagcatttctaaccaccaactcccgtcaaatgaccatgaactacgttcttattgacagggtaaaaaagagggtcatggtcatggttaaatgaccaccaacttcgtggttgtttgaccaaagttcgtggtagctcttgttgaccgaggtttaccaccaacttcatggttttttaaccattaccaccttcttattgaccgggccccgttctctagttttttccacataaaattgttccatattttgacggttgaacattttgaaaatttatcattaaaaaaatattttttttcttaaattagaatttttacaggcaaaaattgattgagtcatttcaaaaataattccatttccaccgtaaccccaattaaaattggtcacctaccgtttccgctctgttcgaatgcttcgatattttcatcattcagcgattcttccgtcctttccattcgttgcaattttgcgattctcgcctttagaaatcgtaattcgtcggttatttttcgtttagccatttataaatcttaatttgtaaccaatcttaaaaatggagggaaagtaaagttaaattagcatattacaaatagaccaatttattctctaaatgagtttactttaaatactgttaaaatttattgaacaaaaaatatagagaataaaatgaaaaatgacctttattttactacctattttccccatatttgaattgttctttattggatcaataaaacacattagtaaaatgatgagatgaccctttaaagactgaggagatcaaaaccaaattactactaatctttatttcttgctcatttaaaagtccactcttacaaaaagagctcgtaaatgtgatgcttagcctcttttgaggtaaaattcaaaaagctccttctttcaggggacaaactgaactattaccaaaatacgttttccttgtaattaataaattagaattttgcttcgaattcgcatacggattttggaatttcaaaacaaaagtcattttcctaatcagcgtcacaaattaccctagaaatgattttttatctaaaattcatgggggggggtctcaaaacagaaaagtgccggcaagagtctcaaaattatgcggcattttttgtggaatgatcttccaacttattccccccgtttatatcatatagtttagtttatcttatgtatcagtcacagattaaaaaaaaagacattggagatcaacgaacatgtgaaaaagaacattttaaaaaaatttttaatttttaaattttcacgtaattcacgcaaaatacgtgatagcatcaaataaacgtctgattcgtgttcagcgcttaaaattacgctagaaatgaaattttgaaaaatatttgggggggggggtgtgacaaaccccggaagaaccttcctctaatcttaatatttattattttcacagcttcctctgataattttttcgttgttccatcttttgcggatgattcttttcatccgttcatttctatgtgggattttgatgaccaaattgaggcaaattttgggcccaatttaaattcggtttgccaactctctgaggaagaaagattaattaaagttgatcacttttccaatcgaatattacttttttagtcgacattttggagcttttcttgactttaattccaagccctagttaccaagtatttaaaaaaaaatttgcgattcgctcaagccgactccaaccgaatgcaacctccggcgccgaatgcgaataaatttgccaattcgtacacactaaacagcggttgcgatgtgccaatcgactcgctgccgtgcttcgcctgtctcgccacgttaagcgcctggacggcaagtgcactgtttatggcgggtggtgctcgctataagacagtcacgaatgagcgacgcgacaatagggttagccgacttttgcgccgcagacatttgcgccgcgccatttgcgccgcgacacttgcgccgctcagcaaaaaagactcttgcgccgcggacatttgcgccgtgccatttgcgccgcgacacttgcgccgcctaacaaaaacgacatttgcgccgcgacatttgcgccgtacagcgaaaaaagacatttgcgctctgattaaaataaatttatgtgctttatagaataagaattgatagatattcattattaattcctttttcgaaaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatggagcggcgcaaatatccgcggcgcaactgtctgcggcgcaaatggcgcggcgcaagtgtcgactttgctgagcggcgcaaatggcgcggcgcaaatgtctcatcacggcgacagcgagcaaatcgcactgacacaattattcatttttttatagaacatataaatataaattaattttattatgggatgtaaaatgagcgagggagaaatagatcagatgcactatttgctcaatgctcttgtttctttttcaacaaaaagaggcactgaactatttgtatttgttcaaaattacccaatcaacaaaaaacgttagttaattcctttttggacattttggaatttgaaaaattgaaagaagatgtttttatttagaatggtaaaagaaaaaattgttaaatacggcgtaataatcattgttaattttatatgctaaaaccctgaaatatgaaataaaatatatactaaaaattgctaaaaatatgtgctaaaaaccaaaaaaaaaatgcaaaaatatgtgcgaaaatatatgctaaaaattagaaaaagcaagtctatttatgcaaaaaaaaatcccagaaaaccatatttttttttatctttctcgccagcacagttgcaaatcaaatcaaatacatttcaaggttttcgggggtaaacaggtccttatcaaaaattattcggagaaaatgccatttttgggcttctctcgccataattaaatcgcaaaaaaatatgtaaaaacataaaaatcccagc

SEQ ID NO: 8378 - DNA, 4179 bp, Heterodera glycines
  misc_feature (2968)..(2968): n is a, c, g, or t
tttccttttttaggcacaaaaaatcgcaaaataggcattaaattggcacaaaaaccttaaaatgggcacaaaaataggcataaaaaatcgtaaaataggcacctaaaaaggcataaaaaaatcgtaaaataggcacctaaaaaggcataaaaaaatcgtaaaataggcaaaaaaatttttttattaacgcttttttggtattaaaacaagtaaaaacaaatatttcaattgcaaatgaaattattaaataaggacaaaattttaaacaaaaatttttattaagaaaaaaatatattaaattttgggatcatttttttgaaaattttttcaattcttaagggtgtattttctgaaatttttttgggtcatttcttaggggtgtgaaacgcgtttttcgtgcttatctttgcgtatttagtgcgcaaagttttaggcatttgcctaaaaaaggaagccctattaattattcatctttttttatcgtcaaattgcaaaaaatcggaaattttcattaaaaataactgtcaaagtggcaagaaggtgcttaagaaaatgtcttagattaaaaaaatgggattaaacaaaaacaaaccacataaaatcccttttgaatatccctcatttttagaattgcgggatttgcgtgattgaatgaaatttaataggattaatccggtagggccgtcacgcaaaaacttaagttccaaccccgaagcgggtgaattttcagtttgaaattttgaataaataatcaaacataagggattatgtaatactaaggaaatcaaaaatatgtacaagtggtcaaaatatataccaaatatgtaaattaaattttttaatggttattttttgtaaaaaaaattcttcgtaaatgctgaaataggtacaaaaataggcttagaatcatattttaatattttaaaaataatttttggtatttttttatttgaaaaaacctatttttaggcatacattttcaaaaaaatttttaatttttcaaaaaaatttttgtaacaaaaaaaaatgaaaatatgtacgaaaaaattgcgaaattttgggatttttgtaggcttctttggatttgaattgtgcattttgttgattcttcatatctgagaaaatatttttttttgcaaattaatttatatacctaaatgcaaaaaaaaaaattttttgcacgtctttttgttgaccgaagtttttttttctctatttatatgcaaaatttgtacaaattggtattgatggtaaaaaagttaattggagagaagaagcaaatgttgttttttacactgttaaaaatgaagggaattaattttcaattcattttattagaaaaaaagagattaattcaatccatcaaattcttttctggtcttagcctcttttttaggtcatcattttgccgtaattttttatttgtgccctcccctaaaaaaatgtctccatttttgtctctttttccaaatacacttttttagtatgtacttttatttgtatatttaccatttttaaaaattttatttttattaaaatatcgagattttcgaggagacaataaaagatgacataattgtcattattttttgaataatttttgaataatttatttattcaaaaataaaataaccaaaagaagggcatatgccacttacacttttgatgaaaatgaggaaaggtaaatgaatagatgaaaaaagacaattgaatttctagaagcatatagtcagacctccagcgagaaaaaaaaattttttttgaggaaaaaattttgttgagaaattggaagtactggaagaaaatgtttttttttttgtttagaggaaatattttggaggtctgacagaactatttattaaaaagatgagggtattgttttttgagcgattgaatttggtgaacaattttgtcggtgggtggcaatgatattaatgctgcataacatgcgaggattttttggtcaaaaacatccggtggtttggaaacgtcttcactggcctcgttctggtttggtcctttagcaacatcgggtgtctggtcatttgtcgtttttgggagctgggttggaggtgccggtggagctgggttttgttgacgttttcggagacgcgcttcgtattcctctttgagttgttctttggacagcgccggacggacgaacagacggttcaggttctgttgggaacggagccgagcacgctcgcgcttccatcctccgagtaccacatgttggtgtgtgggtgttggcatgaccaccttgagcgggcgtggtgttgttcgctgcgggtcgtatcgtccgagtcgaaagacggccgttggttgggcctcaacttcaagatggtccaggatttttgtgatggcttccctgtcttcctgaacacgctccgatgggcggatggcattgctttccgggaggccaatgaagaccagggtgcgttggcgttcttgctcttcgagtgtggcagtgttttggtccaggtccagtgcaggtggcattgcacgtttggcgcgaggtggagtgatgtttgatgcgttggttcgcttcatgtcgattaattaggaaagaaaatttgttgttttttgcgatcttatttggacaattaattgccatgtatcataatctaacaaatatttcagtttctcatgtccaaatcagtgattgatgggataaagttgatactgagcacagctgagcattcggatgtccactttttggtggacaaaatcttctaccaaatttcataaaaacaaaaaatatttctcttctcaattagttttttgaatcaagccttaaatcagcaataagttacatctttttatattcttcataaatttatttagcaaatgaacataaattttcagagttttcccggagcgcctattggccctccggacgcttgctttgtaaattggtttttgacgagaattcgttctttctcagatttttaattttaattttattttngaatttttctttgccagctaaaattaaacgatagtaatgtgttttactggtctcgaaatttttaaaacgtttcaaggcgcgttttagagttctgaataagaattaggctttctttttctgccaattccgaaccccgcatccgaacatattttcaaaaaaattattcttaccaaaatcatgaaagcgtatttcgaatggttttcagggtagctgatcatgaatccgggcaattctggaaaactcacatatttattgacattttttccaattttttggcaactattttggcatttttctgcattttagcaaatttttctgcctttttatcaactctttaggtatatatatttctcgatttttagcacataaaaatccatccctatcattgtaatatgttgctttatgaaaccaaaacactttacaaaacataaaaaaatataaaatttaagcaccaagaaaattttgtgccctccaagactctcttctcatcctgctgatttccttcctttcccttttcaatccttctcgaaatgtttacgctattcacatgtaaaatcaatggccaaggtgacgttgtcctcgtctttgttgtacaaccctttgcttgggtccattaattccttaatttaccattacaatattaaaatgtaaattaactaattaatttccactcaccacaaatgaaatgaaatagtgccaaccccaaatcagcgttgcattgttaaaaattctttttacagggaattcgttcttaaaatcatccacaccgttcttttgagagacaattcgaagtgttgccgaacatttgcggctccaatttccatcttaaagcaaattaaataataatcaaatttatattttcacgcatttcctttaaaaaatcacttctaattttatgttaaaaaattactgtttaagtcttttcaataattaattacaccaattttatgacaaaataattacatttctattatataatttgataagcaaaccttcttcagaagcatcgcacaaaaggaaaaagcccaaccatttctcattgtcagtgctttcatctttcttatttattagtgccacaattttccatggcattccctttatgtacacagcagtttcactgttacgttcacttccttcgatttctcgctcaaattccgatagcttttcaattaccgtagaaagtgtgccgttggatttgtttggatcggaaa

SEQ ID NO: 8379 - DNA, 4466 bp, Heterodera glycines
ctgtctaatcgtgaagtgattgagaatttcccacccccaactaatgtcaaagaaataaaaagattccttggaatggtttcattttttagaaaatttatcccaaactttgcacaaatagcatacccattaaacaaattaacccgaggaggagcaattgaatttgaatggggagagaacgaggaaaaagcaatgaatttgttaaaaaatcacttacttaagtcgccgagtcttcgggcgccaaattatgcactaccgttttacttattcacggatgcatcagctttggcttatggtggagcattaatgcaagccggaaatggagaaatgtttgcaatcgggtattggtctcgaaccttaactgacgtggaaagtcgtctcccccccacccatggtgagctagcagcaatagttcatgccgtgcataatttccgaccaattgtttatggaacagagcttgtaattctaacggatcatcgccctcttacttttcttttcaataaagcaagttcaaacccaaaattgaaccgttggcttatggccatacaagagtttgaaccgaaagtaatttatctcgagggacgagccaataaagttgctgatgcattgtcccgtgtccccattgcatggaatagtattgaggcacaatttaaggacgaaatacctcatttgctagcgatcgaagaagcaattgatagggaaaaattggaaagggagacgaaaagtgatcatttattatcaagagtgatcacaaaaataagggagaattggatagacccgattgaggaagaattattaccatattaccaatctcgagacagtctgtatatggaaggagggttaattaggaagcgaccaaacggattaattgttgtgccaaagacaatgcaaattcaaattttggaagttattcacaaagcacattttggtattgttcggagtaaggccaaagcgcggaagcatgtttggtggccaaaaattacggaagatatagaaaattttgttaaagaatgtgtaatttgtcaacggaatgcagcctctccaccaagaattgaccctgagcatcgttggcccgaatcgagatttccctttgaaagggtgcatgcagatttagcaggacctatttggggcgcgtattttttggtgatagttgacgcttattcaaaatttccttttgtgcatcaattaaattcaacaaattctttctccataataagtgttttctgcgaaatatttggcatctttgggtcaccccgtctttggtgacggataatggccctcaatttgtgtcagcagaaatggaagaatttttgtttgctgaaggggtaatacacaaaacatcggccccttaccaccctgccagtaatggggaggcggaaagatttgtgagaactgtgaaggatggactcaaaaagttgctggaggcgggaaataacctcaaaagggcccaatttatatttctacaggaataccgctcatccccgtgtcctacattagatgggaattgcccggcacaattgtttttaaaaagggaaatgcgcaccggcatggaccgaataaaaatgccgaaaatgaaagacactaatggggcagaccctcaagtgggggatgaaatgaggaatgttcaaaggaaaggcgcggagagtcgccacaattcaaagcgtaactttgagccaggggatgcggtgtgggcccaacaggcgggtgagaaaaacagatggggccctggagtactgcttgagccaataggcgaacggatgtggagaatggaattggaaggaggcggagagaagactgtgcatgtggaccagataaaagagcgaagaattgcgtccgctcgtcattgatgaagtccggcgctggggatgtctgcagaactcgcaggaaatgctgtttctttttttgcttatttttgtgtattttctctgaatccaatgtccattcctccttctttctttattatttttgatcaactaattttctttttttaagttccttttttcttctctcccctgtacattcactgtcaatcactttccccaatcaaacaaatggcaccggaggaccaagtcccgaaaatccaggcggagaaggaaaatgttgagccactggcgccactggcggaccccgagaaactgcgcaagcggcgatcaccaccggcaccaatcgttagcgagctgtctcggatgatggatcagttgaaggcctccatggttgcggaaatccagggctgtttggagcgtgtgcgaaatgcgatgatggatgaagtacagctggcgttggacaacttgtgggcaaaaatccaaccggtcatggtggatcatggccggtcgattacggccttggcggatgcatttgatgaaatgaccatgaaagaggccaaggataatatggaggaccccagggcgggaggtccgggggtaaatgacccaccggctaatagcccaccagagagtggaggccaaaataaccaggctgacaataacaacccattacaaagtggaagccagaatgatcagttggctagtcagtctgatcggcccgcccaatggcaaggccgaggttcgcgtggcacttggcgtggtcgtcgagagttcgagaacggggggcctggtcgagtgagctatttgcgacgccagcttgagcgtgagtgcggcggtcgagtgcgcatccagcacccctacatggaattccgccgtggccgtggttatggaccaagtggcacaactgaccgcgcatttggatcatatggaggacaaaactctggggggccaagccgtgtgcgccgtgggaactgatgttgccaaaaatctcatcaaggcggaaggaatgttggatctcgccgatgcctgtctgttttgccatttcttttttaagcattaatctctcttttcccagcctaatgttttccacttaatttataaacatataataataaacataggacaaaaatagaggcaatcaaaagaatagactattatagttgaggcgtgttttggtatgtatatactaaaagtttacatttatatctaaatttcatgaaagacctaagaaaaaacgcaaaaagcaagttgtaatttattatataaataattaacagatcaaaaatttaatatatcaattatcaaaatgcttgttccaacaaaaattaattattagatgtttttatttatgaaaataatacaaacaaataaacactatataattagcaaaataaagaaaaatgataaattaaatttttttttatatatactagaagattaataataataaaaaatgagcggttttaaatttaagtgaaacattacttgttagaaaattgaaagttatagaaagaagtttccatttctatttaatttacatatatgtaaaaattaattatttctatattggcaatatcaaaagtgctctagttattgaaaacagcaattattaatagatgattaaaaaattgaaattcttgaataatgataattacttcatgcacttactagtgaaaagttatttaaatcccttaaatattcattaatgtataaaaataacattatattttattacttaacttttgtttgggaaaactttttgttgctcaaaaaacataattctaataagtagttgcaaataagaaattttttttgattatattgaagtaaagacaatcaaatattttaaaattatttaataaagtttcttaataaatcttctataaaaaattatagaattaaagagataatcaaataataaaaaaataatttgaaaaattattcaacatttttaattctttctaaagaccaattaataatattaaactttttaatttatgcataattaagtttatgaaatctatatttaatataaaagctggtatgaaggaatgcgtcagaaaccctggatagtagcatgaaagaatctaaattagtcaactataaagtcaatacggcagaatctaatagcaaaggcacggtattcattttaattagctgattttatatttattattcaagtacatacaaataatttcctgtcctactaaatagactgtatttatgcatttgtttaaatcctcgaagagtaataaaataaaattaaaggtataacataggtacaatataaaatttcttatcataattcataggacaattatatttaaaaaaaaaatttagaaataatatatttaaaaaatattttaaaaataaaagtaaaagaaaaacattgaaataaatttaataataatttaaaaatgtaaaaaattaaataacaaaggaaatctatatttagagtaattacaaaaagcgttgaaaatttattaaaaattttttctaacaaatatttaatttgaaaaaaatataaatttaattaaacaaaaattttatggaattaaaaatataaatttaattaaacaaaaattttttggaataaataaaaagaaattgcaaaaatctgattttttaccaaattatacagaaata

SEQ ID NO: 8380 - DNA, 1953 bp, Heterodera glycines
ggattatataataaattaattattaaataaagaatgaaattaaattgacaaaatattaaccagttgcattacattaaaacaattggcccggatagaaccacagttgctataattgaaagcactcggacaagaattaaaatgagataaaaaaataatataaagctgaaaaaaatatttattaaaatatgcaattaaaaaataaatgataaataatatcaaaaaatattgtgtaaaggcgctaaagcgctaaaaattaaaagttaaaaatccaaagggagcaaaataaaatttgtaaatctaaacagtctgaaaagtgataaaattggtaaaccaaaaagacacaaaagtgccaaaaaattgtgtcggtaattctgaaggcttgaaaagatcaacagaacaaatttggtatcaaaaatttgctaaactggtcattctcaatcaccaaaaaagaggtacgaaagtacaaaattggtgaccggtcgtgttcattggtatttcgactccatttgctgaaaagctacggtggggagataagttatctaagcgataattaatgatctatttttttaattttgaaaagatttgaaaaaaattaaaaaataaaggaaaaagataatattgtaaattaaaataattagcgcttaaaattaaaaagaaaaccgggttttatgctacaaaatttgttattcctcgacatgagattaatatttaaaaaatctatcaaaaaattaaatatttaattgtataatcagtctctcaaaataaaaatgatgttgacaatccgatacatcaaatataaacaaaataaattctaacaaattaaatattattataaattttaaggatgtgccaaagcaatggtactacggttccgttggttcgctttataaaagaaaatataaaccagcaagaaattaagaaatttgtcaatgtatttattttttaaataatgggataaacgaaaagaaaatagaaatgaatttaaagaatgaataattacaataaaattctatacattgatcaaagattatatattattataacaaacattgaacaaagcattattaagaggaacaaaatacaaaataatatagcatcagcaaaataattatgaatttttaaaaaaatttaaatactataaataaacctaaaaagaatttattgctagcaacataatcagtatgcatcatgagtcactcagcacaaaacccaacttttaacccggacccgttatccgggcccagttttttgaaaatccattatcctttacccgacccggtaggtccgggtacccggataccaaaaataccctggtaataatggggcctgggtcaaattgttgatcaaagttgacggaaatttttttaaatataattaaatttaaaaacgaatgtttcggtgttcatgtggcttagtggttaatcttttggattcgatgcattcgttctcaggttcaatcctccttcctcattgctaactattttgtactttttaaatattttattgaaaactgttattatcatttacataaggaaagctccaaataactatccttattttaatagaattttataaaaatcttaaattttacaatatccccataagaaatttagaacaaattaaaaaacattctatttttcatgccttttcaaaagtataagcttttattctcttgaaaaaaaatttgaaaaaatggattttttaatacccggtttttccgggtacccgacccggtacccggtttcaaaactggtacccgacccggtacccggcatttcaatactcggtaatacccgggcccggtttttcccaaatacccggtaccgtgcaaccctaatttggaacaagagttttacttaattgaaatttccattttaataaaagaacgcattagaaaaaaacagaatataaaatgtaaatcaatcgacaaaaaggcgcttccaaatttataga

SEQ ID NO: 8381 - DNA, 4467 bp, Heterodera glycines
ttggaaatatttatttcattttgtacaactgctcatagtttgtttctttttctttctttctttctcttgtattgataaggggggaaaacgggcgcacgtcaaaaatcaaaatgacaggagtcaatttggggtaattactcataaaaaatttctatctaattgataataagtaaaataattaacttccatattctgtttaaatttcattaggcgtattgcttcccttccctcccatttttgcaaatttgatgcgatttcccttataaaattccctaaaaattggtggtgtgttcctgtttttttggtgctgatctgatttttttaaacctaaaatttcgctatagtgagattggctggttaaacttatcatccgaatttcattgggttttaatctttctacctcttttcctgctgaaggtctctctgtctaaaatcctaaaaatttgtttcaattaccataaaccatccttatttatctataatttaaataaacattgtaattccgattccattctttttttccattgcatttccttaggtttcaaacgaattccttcctttctattgcttggtttattccttttatgcctttttggctaattttatctttcaaatgcgattcaaaaggatgcgtcaaagtgccgttgttgttgatgatgccaaacccgtcgcaaaagatgaaaagtatttgaagaagtgcactctgtctgtggaggggatgacttgctcgtcttgtgtggccaccattgaaaagcaaatcggactcttggcgggtgagttggattttgttggctgccaattgcgatagtgctggagttcccaccccccccccccctccatttttaggaaaaaaagattttcgctaaaagaaaatgttcttgacattttttctagggtaaaaaatgtactgaattataaaaattgaaagcatatttctgtagttttttgagtcgctgattattaatcctgcacaaattttggcatattacgattattattccgttctcgaaatgtttcaaaaaaaaaatcttgaaaaattttaaatcctgggttcgggataagccaaaattgatgtgggatttgaaacatgctttcatgaaataattcttgaaataaaaaatcttttttgaagaattggagagtgataagctccggtattttgccaattgttgcttcatttgacaatttaggtgtccattccatcaatgtcgttctgatgtttctcaaggccaaagttgtgtatgacgacaccgtaattaccgcctcggatattgcccaagctatcgacgacctcggcttcccttgccaagtgatcgaagacgacaacgccggcgacaatgagcgagtccatcttctggtcagttggtatttggctttctccgaagtgctcttccgtttccgatcggtggaatgactcacgcggcatgtgttcggaggatagaatcgcatgtgttggccttgcgcggtgtcgacgcgtgctctctgtccctgcacacttccgttgcgaccattgaattttcgtctgcacttgttggactccgcgacatcatcgaccgtattcaggttcaaacacgcgttggttgacccactgacaatgaaactgtaaagagagcgggggggggggtgcaacaaatggcaaatgtatttatttatttaaaataaaaagaaccaaaagaagggcattgctgccgcttatacttttggtggaaataagggcaagttaatagtgaagaagtcaaatgtcatttggaaataagaaatgggataaaatgaatagttgtaacaaacgataattgaatttgagttgaagtggagaagtcagacctccaacaaaggtaaatcaagttttttttggaattggagagaaaaaaaatttttgtggagagttttgttgagaagatttgaagtttttagagaaattgttggaggtcatagcagaactatttattaaataattgagggaattgttttcggaaggattgcatttggctgattgctttgtctaagaggatttcttcttcaacggggttctgcggtttggaaatgtgttcgttctctgtccgattaatgccatcatttgacagtctctcggctacagtgctgagttggcctctcgcgacaatcgcctcaaacggatagggcacgaagaagacattgtgcggtggcgaacttcctttctgatttcgctgatttttgggatcccagtgatggctttgatgatttattaccattggatcctcaaaactccgatgaaccgcgaccagcaagtccacattttcgcccccgcactctctctggacaatttgatccttttccttttggccactcccgtccaggcgagtcgacaacaataattatttttcactgaccaatgtcaatttatttcatttgcaatattttttttcaagtttttcggaggacgaaatttttacatgcaaagttggaaagcgctcaaacatcggacggcaaatatgtaaattaaattggcaaaaaaagtttagttaatctccttaattttagggatgttttggtcgttttggccacttcgattgcttatgcttattccgtctccgttttgattcttgcctttctgttgcaatggtcgtccagtccaatgactttctttgatgttcccccaatgctttttgtatttatttccttgggccgatggttagaaaacaaagcaaaagtgagtctctctttgaaatgttttaaactttttaaattttattggtttcagggcaaaacctcagaggcattaagcaaactgatgtcaatgcaggcgaaagtggccattttgatcacccgagacgagaaaacgggtcaaatcacttcggagcgcggaattgacactgaattagtgcagagaggcgatctgatcaaagttatggctggggagaaaatccctgtggacgggattgtcgtggagggcaaatcatcggctgacgaatcactgatcacgggcgagtcaatgcacgtcgtgaagaagccaggtgggccggggtggtggcagtggggcaatcagttggattataaaatttctttactataaaaatgacgggggaatgcgggtacattaggtcccacttcagtgttagacaaagttattaatcaaaatgggctatttttgagtgatattcaaaaataaacagatcactgttttgttgttgttgtttcttttgattaaccttaactcgcttcatgccaaataaacagaagaattttgtattcattcgaaagtctgtttttttcaaattgtaagcaaatgtctgtcaatttgacgcacagaaagagttaagagcctttcaaatttgcatttgcttagattctcccgtcatcggcggctccctcaaccagtccggtctgctcatcatccgtgccactcacgtgggccaggactcgactctctcccaaattgtccgactcgtcgaagaagcacagtcgtccaaagtctgtttctcccccccccccccttattcatctttttgctaaggctcctctccaacaaacagcggacaaagtcgccggttatttcgtcccatgcgtcgtcgtcctctcacttttcacttttgtcgtttggctttttgttggagtcttccacaagggacaaacgaaccataaaatggcgacgaatgcttctcatcttcagtctgtctgctctctttttctccctaccttctcacttttcccttagttctcttccccaatccatcgaagggataagcgtggagcaatgggaattcattttgcgcaaggcctttgaatatgcgatcactgtgctgtccatcgcctgtccgtgttcgcttggactggcaacaccaacggccattatggtgggcacgggagtcggagctcggaatggcattctcatcaaaggcggagagccattggagcaggcgcggaaggtaaattgtttaatgttatcggaaacagtcaaaagcatcaattcataatattttaatcccgaaaatacaaagtcccacccccttttggcctaccaattataaggacggttgtggtcaaccctcgcccccccccccccctccatatatatgctacgaatttatagtttggttatttaaacaattctttttatacagattagaacagtagtgtttgataaaacgggcacaatcactgaaggaaagccgcgagttgtcaagctgttcacaactttgcctccgagccaactttcgatccatcggttggcacttttgatgggcagtgccgagtcgaacagtgaacatcccatcggcggcgcaattgtccgttttgcccagaaggtgcattgtccctccagcaatcgctttcattcactttcgttttgctcagtttctccacaatgaccgttgggcccgtgtctccaaattccgtggccagccgggtttggcctgtgctgtgaagtgtccgatctctcattcgtgctaaatgagtccatcgtcacggccactgagatggaatgggctc

SEQ ID NO: 8382 - DNA, 962 bp, Heterodera glycines
cagaattttcctcatgagattcttgcctgtttgaagtttaacatttcttacatatcacatatatatggatttgtgtcaaccataaaataatttttcattgttttgataaaaatattggttaatcgaaaatttttttttttgcgaattagagttttaaaatttaacttacctatataacttttagcggtgggggtcggtttagtctggccggtttagccggtttagtctggccgttttagtctggccggtttagtcagagggtcggtttagtcagagggtcgttttagtctggcaagctgtttttgtcctacattgatccaattctgatttgtttctcgaaaattctttaaaattaacaccataacagattatcaatgtgttaacaacaaaaaaataacaaaacattgaaaaatgaatacgggcatatttcataatttcgagaaataccaacgagaaaattgatgatattatcaggattaacattggcatggtaattttgatcattttggtgagcagggttaatgttgttgatggtattgtaaccctgtaagagtcgaagaattcgtatcaacggcacgatattttcgcgttttttgaggagggacttcaccagcgatgcatcgtgcgatgtctgcatcaattgacttttctcatatcgaattgtgttgatgaagcggaaaacagttggatataaacacagcggcccaattttggcctcccagttccaaaaagatttgcatgtgtggctcagtggtttttgtaagatagtaaagggacaaagggtgttggttcgagtccgttgtgcaacatgaatattttcatttatttttgtccaaaatattaaaaaatgacgaattttgggaattatttttggaggtatttgccaaccaacttggacaatcatggtatcattcgaaagctcttgatgaggagaagcttttcctaagcaaatgctaagcact

SEQ ID NO: 8383 - DNA, 5398 bp, Heterodera glycines
  misc_feature (12)..(12): n is a, c, g, or t
  misc_feature (2192)..(2192): n is a, c, g, or t
  misc_feature (2296)..(2296): n is a, c, g, or t
ggattgtccttntaaaattaaattgtaaataaatttcgtaactttccctgccaaatttcagggactcgacacgcatgacgtcggcggttacctcggggtcagtttttcggccatttgtcccctttttccgtcgcccgtctgtccctttccccaaattttccctcattttgtccatattcccaaaggacgcgttgccccggtcggataagcccggactaaagagtctgcgcaccacacggacactgaaggagcgcatgtgcatcaccattgagccgggctgttactttattgactcggtcaatggggagatggaaattcattttgctttttttgaaatttcagttgctggacaaagcactcgccgactccgagctgtccaagcacataaatgccgaccgattgaacgaatttcgggggaccggaggggtgagaaaataattgaccctttaattgctcaataatttaaataattaggatgtccaattaatgccttttaaggttcgcattgaggacgatgtgatcatttgggagaagggcaacgagaatatgaacgcggatgtgccaagaacggtggaagagattgagcagtttatggccaaagcaaagggactttagggacggagaaaacaaacggacaaatgacacttacttacaggggcaatgcaactataataattatattgtgcttttttttttgtttgtttttttaaatttaattcgcaatttttcatcgcgggattaatttaattgatatgtaatattcgaatgaaatgatatgtttttatgctcgagttcttatttaaatgcaaagtttttctacacaccagaaatgtgaattttaagtttttgaagaaatcacttattggcatggaaatcctacacctttctggattataaaaaaaaatattcggatttttcgaaaaaatcaagggcgctttcatatgacatagaattttcgttttgatcaatagattcatgattagcccactaccttaaaaaaagttttggtttgtcggaagggatcatgtaatttttaggaagttgcagcatagcggtttccatttcaaggacagataaagctaaaacatatttccgtttcaaaattccacaaaatgacgcatttgtcaaactgaacaaattgagggattaacgaaaaaaatgaaaatttaatttgcttagctgtgattctgtgatttgaatgggaaatgaaagcacataaaaggagcgaatgaatcagtgaaattattcaactttaatttgactgtgcttccgaattgtcaaaatcattaattaattatcgcaaataatggccaacaaatttttaattgctgcttttattttgacaattgccatttttgtcaatggacaaagtgaggcgccgaacaattcgtcggaaatggcatcggaggagagcaattcggaagagtcgggcagtgaggagcagcagttcaacccattcaaatttcggccattttttggtccttcgtcgtccaacagttcggcaccgccgcccttcggcttttggcccccttttggacgaatgccgccatttaaagtgccttttggcccctcttcgtccaatggttcggcaccgccgccctttgcctttttgcccttttttggacgaatgccgtcgccatttaaccgccccgccaaccgaccgccgtctgacaattgatcactttttgagtgatttgtgtccgtcgatcagtgcgaaatgaaaccgttgatgagcaaatgatttatttgccatttattgttcatttttgactttaaaagaaagaatatattgcataaatttattcaggcactaaccttccctaattatcatttttaaagaatttgaattatttttggctctccgtccccaacaaaacgtttctcgagatcaattttcggtctcagttctctagtcttggaaaattttgactctcgagcagccttatcacatcaacagtcccccttaattatctctaataaaattttgatgaatttaaaaaatgttctttccatttaccgtacttcttcgattatagcccccgggggctctattgttcaacccccctcaaaaggggggctttattcgagagggggttctaatcgaggggggggggatataatcgaagaaatacggtattctttccatcttttgctaagttatatgacagtaattctaattaataccaattccnaaattttggtttaattaatccaagaataattagtcgtacataattttttgcgaactaatcacatcacggaaagcatttgagcattgacatgagaccgaccgacntggttttggcatatccaaaatggatggaaagagacggacgagaacgaattggatcaaaagaacggatttaataaatttatccgatcagaaaaagaaaacgcgaagggatggaagggaaaatgatcaaaggatgaccctgtcgaggataaaggatgaacatgttgtgaaggatcaccatgttttatgagaaatgcccccggagacagcggaaaaattagcgaaaggaaatttaaaaaaaaatgaaagcgaaagcaaacgaaagaaaggcattaattcggagtataaaagcctaatgagcatcaacaaaaatcacatttgtccgatttcttctgctatcctcccaatgttcgcctccgcttgccgcttcgttctgccgcttttccttttcgcccttttggcacttcccccggccaatggcacgggacttcccatgcagaaaatggagtgctgccaacaacagcaaatgtgttgtgccgcaccaatgcaatgcacgccatcgtgcggagggtgcggacggcgccggcggagagaggcgagcgattggggggataactaacaattaacagttcgaatttttaggccgccgttcagccgctgctcagagggaaagaaacgccgtgcccacagacggagtggcaacagctgatggaaaatgtgggaaaaagtgctaaactcagcagctaacccggaaaaatgttaaggcaattgtgccactcgacgacgtccaatcggtgaactccgtccaaaaggcgctcctccgacgctttccggacaacaaatttttggtgatgtgcgcaatggcgggggagggacgcgcggaaggcaaagaagcgctgccaaatgaggtgagccgagggatttggaggatttaaacaaacaattgagcaacaattacaacaataataactcttgcctttccgtctcaaatccgtcgcttatttctaccgtatgcttaggtccacctcagctccagtggccacggctactgtaacgttgtcagcgaacgcatttggtgccaagcggccgcagtcgtcggctgatggcacttatttattattttttcttttatattatattgttttttgaataaaataaatatgatttgtatgggttttaataaattctaagcaaaacaattgttaaatttttgattaagggaaatttctcaactcgaccaacgaaattttatttttgtaatttattgtttgaatttttggttttttatttctgtcttttgtttttggtgcgcttttatcattttcactttaaatatttctcaattttatatttacataaagttacagttgtgtgataatattgagatttaaaatatatttggcgttttgttattttattaatttgaaataaataactgtcttcggcatttggcagtgttttgtgtttgctttgggctattgtctttgctgcgtgctgcaactacattattaaagcccccgacaacaatccctattcttttttacgactgttggccaaattgcaaattataggatttttgaaataaatgaaagatggctccgtattgtccgataaacgcgttcgaagaaattctggaaaatttgaaaaaaaaaaatatttgagactaaatgagcgtgaaaaaaagtaaattcaaaaattgtaacttcttttagggatttgatataaggcctgctcgagagtcaaggttttccgagactcgagagctgtgactgagaattgacccccgagaatcgattttttttttaaattttactaaaaacccagatggagaaggagaataatttaaaatgataattagggaaggttagtgcctgaataaatttatgcaacatattctttttaaattcaaaaatgaatagcaaatgtaaatcatcatccgtttcatttcgcactgatcgacggacaaaaatcactcaaaaagtgatcaattgtcagacggcggtcggttggcggggcggttaaatggcaatggcatttgtccaaaaaagggcaaaaaggcaaagggcggcggtgccgaaccattggacgaagaggggccaaaaggcactttaaatggcggcattcgtccaaaagggggccaaaagccgaagggcggcggtgccgaactgttggacgacgagggaccaaaaaagccgtggccaaaaaatggccgaaatttgaatgggttgaactgctgctcctcactgcccgactcttccgaattgctctcctccgatgccatttccgacgaattgttcggcgcctcactttgcccattgacaaaaatggccattgtcaaaataaaagcagcaattaaaaatttgttggccatttttgcgattaattaattaatgattttgacaattcggaagcacagtcaaattaaagttgaataatttcactgattcattcgctccttttatgtgctttcatttcccattcaaatcacagaatcacagctaagcaaattaaatttcatttttttcgttaatccctcaatttgttcagtttgacaaatgcgtcattttgtggaattttgaaacggaaatatgttttagctttatctgtccttgaaaaggggaataaaatactaaggctgcacgcaattacggattacggaaattacggcgttttggacgaagtaattacggatttggtaaagtgaagaatatgcatcttattgtatagaaattttataccattcggctcctctcggtctgtaataaaataatccgaaattttgcagcgaccactctttaaagagttattgacacgggactgaagtggccaaaacagtttctgagggccttgaaaactttcatttgattgtaactaaaatgttctccactaaattggcctattaaaagctcattttttgccaaatttttcaatggaaaattttacgaaaattgttagtgtccaattttgtgggactcaacaagtcgaagtccgcgttcggttccacctttttttgggacgacggtttaaatccagtccgttccatcattttcaattgaattttccacattaaaatgtccgtttcagatacattttttcttttttaattattgcactgtaacgttgtcagcgaacgcatttggtgccaggcggccgcagttgtcggct

SEQ ID NO: 8384 - DNA, 1119 bp, Heterodera glycines
  misc_feature (1064)..(1064): n is a, c, g, or t
cccccccccccccgctccctcttggcgatgttaatgatgatgggttgttgcgcgagtcttcttgcgagatttatttgtattgtgtgttttagggatttcctggaggaagttgccgagggatgacagcgacaaagcccggaggaaaagctttatcacagcaaaagagaagcgagagccaacggagtccccgtgggattgatcaccagcaaaaggccagttgataagcaaatccaccttgtgatcagagttatcactatcattagcagcagcatcagttcttttccgcttgaattaatccgctctatgaaaaaggcgctacaaaagtcaaagtcataatggacccaccaaatttccgccacttcgctgcatggacatcattttcgtcccaatttagggagaaaagcgatgctttaccacccaaatttgcgcatatgctttttgccaaataattaacatgaaaataaaataatttctgcttaagagattccggtccaatttgggaatctttctttttctgtccatttctatgacaaaacaaagtgaataattattattacaggcgaaaggagaaggcttttctattgtaaaatctcataattttatttaattaataaaattgtgatttttggcactgttttcattttggcattttccgccattctcccttctgcggactttcgctctctccgccgttccctcagtgacctttcgtcgtccttcaattaattttgtttataatctcgtagaccgcagtcaaaccggattttcggaagagatttactaaaaaatcattagcaaattcaccgatcggaacatttccatgcagcggcaacgaaaatttcgatcggtcgtcgttattctctcgctgtgcagcatccttttaaatgcaggtgagagaattattttttgattaaaaagaataacaattttaactctttttaaacaattcattggtattttcagtcggttgtaaagcagcggaaacagaacaaactcagcgacaaggccaacatcggcgggaaggggacggatgcgcgggcgatcaccggcaccaccaacacggngacggttccgacgacagccattctcatgaacattccccgcggggaaaacgaagtg

SEQ ID NO: 8385 - DNA, 4933 bp, Heterodera glycines
caattctattcaattttaatggaataaatcagtaaatgcttttgagaagtagaggccggcgtgataatgcttgaagacttttggaattgggtctaactaaattctggatgaataaaatttgagtaccatttggttaaagttttgtaaaaaatgacctattttgtgatttagagccaattttttaaagaaaaattaaaggttttggcagctctgacggggaaaattgtaattttgaaacagattttttgagaaaacaatccaagttttcaaaaaattttcatttaaatttgaatattcaaaaaagacaatcgcttcaaaaaatttctttataaatttaaaaatattttgaaataggcctcagaaacaaaattcaatacttaaatctgccttcaaattcttaaatctaataaatttcttagagactcacctttgagtttttaaaaattaatttttgaaattcttttaagaatgattttttaggaatacattaaaacaaaaaattttttccacaagaatttaatataaatctttaaaatcttcaaattttcaagatcatcatcatccggtaaagggcagaggctgcctcggccagtaagtccctcggaggattatgcagttttgccaaggccaatgaattcgagtgctgtggtagggttactcgggatttgtttgtccttttttgtttgaaacgaagggatgcctcttgttgaagcgatggaggtcttagctcttccaagccaataagacttttgattcttgaacatcattcaaagcatgctgtgccttccgttttctgttaagttgtggatgtataggaatagaaggctgtggggctggttgaaagggttcttcctgctgaatgtcagcgggaatttgttgttcttctcttcgccgtgagtctggaggcagttttcttcttctttgtctattagcaattttagaggaagaaggaaccggctcattttgatgaattaattgtcttttgaccccctcctcccatgaggaataaaattcatttgcttccgtttttgggccctagtgccagcttgaggagttggtgaaggtgggactggtggcatttctacatcatcgtcattgtaacggtgatgacggcgttgtcgttggcgactaagtgaagctggaggtttgggtccttcaggccccaaatcaataatttgctcatcatcatcgtcgctttcgttgcctctcagtgtcttcagaccttttgtaatttctacttttgctggtttattttggtgttcatctctcaggtggagataacgggacaattcctggttataatgaacattttttgctgttaaatttactaacatttctttttgtcctttgcaaagcgcgctgaacaaaatccaagttgatgtctcccgaatcactgtttgtgagaccgcgataaatttcatcaggcacaagaacaaattctgatgccatcttaactggttacttctcggaaattgcgcttgaatttatagcggagcgcgtcaaatctattaatattggagtgagcagagccgcaaagaccccgcctagtccgcctccggtttgaactaaaagtttgcgggctcctttctcggttcttcgtcgagcaagactccgaacaaaattggcatatggcaacagacgctttctctggcgagctgtcattttgaaacgttgacaaaggatgtttagacaaatttcaacgagtgttagcaattggtcagcatttgcgcgatttaaaattagttttctttttctgtacgatttagtttttccaatgtgcgaataaaatcaaaatttttatgaacaatatctccaattttataagagcccattttttggaatgaaaatgattttttctccttcttcttcgtcctctttaaatattccgcttcgaagtctcagcaatgggtttgaagcagcgtgcatatcaacgagcagatatccgtacggtctgctggttgcaatgcggtatgccgacagaaaataatccaatttccctggaaacagttgtactccaatgtttctgactgccaaagctgagttgggagcccgcataatcaccaaatattgagcattttgtctcgctactttaatccttttctcaaacaaattttgggtaacaaatacgacggcaaaattctgatgatgagattttttagtgaataatgcactaagatatgcttcgtcaatcgatagcaaaaggtcgtcgaggataagaagcaaaggtttgggtaaacgattaatcagttcctcaggcggaactcccgaatacacattaacgccacatttttggagcgttggcacaatgctagacatctcaccaaaggcataaagaattgaagcaggtttaggatgaataagttcggaagactcggcaataaatcttattaaaaaagtactttttccactccccgatggtccagaaatgagcatgccgaaaggcattttcaatttaagctctttatccgtataaaactgatttccaatcattctgattattaaatttcaaatacatcgcaagacttaaatagttttactgtttacgggaaatcgatgcaattgctgccgcttcttcatcttctgcttccttctttcctttcttctttggcttcttcttctgcgaaacatccaaataggtagttgcagccgaaacactctcaagaaattcatccagaatttcttcgtctgtctgttccttctgtttttcgatcggaggttgctgcttaggttgttcattgctcatacccattgttgcggcggaaatggcagaagcaaactcagaggcgaccccttgttgctgttgtatcatctttggcttgggttgttctgcaccaattcccatggttgccgctgaaataggtccaaagaaattcgaggcgtcggtttgctgctgtctcggctttggattggttttcttttgttccacatccattgccattgtcgctgcggcaattggcgaaaagaaatcagaagcttcggaacggttctgatgtgtcggttgttgagttgacatttgcccaaagtcgagccccgttgttgccgccgaaatagaagaagcgaaatttgactcttggggctgagtttgttgagctgaaggattgacggtagttgcgccaaattcaactcccaaagaggctgccgaaagagcggaaaagaacgccggggcgtccgcttgttgctgttcctgttttctttttgggagttttggtgggggtggtggaggcggtaagtggtagatcggtgcgggcgtctgagtgcaagcatcgctgcgactgccatggtcaacgttaaagactcggcccttgttacggatctacaaatttaaaaaatgtagtgtggtaagaaaaattgttgaaaataccttgaaaaaggtataaccgggaagctcgtaaatgacatcaaaaggcacaaaacgggggctgattttaaatcgagtgcaccaaattgtcacaccctcctttgagatacaccattccgtctcgcattcggttgccttgcactccttgcacttgccgacaatgtcgaaaggaattgttcttgccacggcaatgcgttcgctgctcacagtaattccattaatggtgtggctgatgtcgacagcgggcaaaatattttccataagggattttttgtcacgaaggttaatgctcatttttcaagaaaatagcaaaatgaatctatccaaaaattgccaccttttatatacctctttaatttatacatccgtaatttatttatttatttatcatttaataagatggtccctcttatttgtttcggtcgtaagtgtgacctacattcacattacatatgccattctcgaatgagtgaacagcagagaacgatggctctgttcgatcgactcatcatttgcctattttatgtatgtttgttttttctttatttttagcaaaatatgagccgcccgattttacctatttttaaaaaatcgagtagagcctataatcggcactacagcatcggaacggttgtttaattaaataatttttatattcattataatttatttatttttattcactatttagatgattttttatgaaaattccaagccgcagttctacaacaatttatggcagcgatcgttgatcgctgctgcattcattttcattttttggcttatttggtaatttaaattgtaatttttactattttttaaatgttggattaattttaatttttagggaatgaccaaactctggaaatgttgagatatgccaacattgaaagagaaggaccgaggaatattgataaaatttcaataataaattttgaacccttcgatttaactgtttatttaaatgaccttcaccaaattatttaaataaatggacaaacttataatgatccctgattatttcttttaaaaatttttcctttgtgctccttttctcttttcatattttcttctcctcttctcttctcttgttctcttcacttctcaattctcaacggcctcgtctgcctgtagaaataaaaaaatttttaatttacaaattgattttttttaatttgccacctcctcaattggggtcaatctaccaccgacaaattccgttgaagcctgtaaaaatttgtgattttatttatttgtttgtttgtcatcccctcccctccccctcccccaccgttacaattgggcgctctcgcccggcactcccggccggcaatcgatgatcaaacgaacgctgaattgccaaagattatccaaaaggaaggaaatgaaaaaatgggggggggggggtgcgttcacactcacctcacgacggacaagaaggcgaagcgtacgcgggtggccctcatcattgttggaaacaggcggacgacgcggacgaaggcgctcgatgcggcgcaagcgcgctggcacattgagcaaaattgcccaaaaaatacagacctcaaaattatagaa

SEQ ID NO: 8386 - DNA, 1320 bp, Heterodera glycines
agaattaaagaaaaaaaacttacgatttattaactgaaaattatgggggatcaccaagaaattcaccattggggattaaaattcggaagaaaagtcaatggtgcaatggttttcgggatttcctattagaaattaaaagaataaaactgacaacttattacgtgaaaattataggtggaatcacaagaaaattcaagcattcgggcttaaatccggagaaaagtcaattggtgcaatgtttttgggcagtttgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatggttttcgggatttacctatagaatataagataaaactgaaaacttattactgaaaatataggtga

SEQ ID NO: 8387 - DNA, 1257 bp, Heterodera glycines
  misc_feature (1222)..(1222): n is a, c, g, or t
aaatcgggagaaagttcaaatggtgcaaattttttggggatttccctatagaaataaagaataaaactggacactttattactggaaaattataggtgaatcacaaagaaaattcaacattcgggcttaaaatccggagaaaagtcaaatggtgcaaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgtatcacaagaaaattcaacattcgggcttaaaatccggagaaaagtcattggtgcaatgttttcgggatttacctatagaattaaagaataaaactgagaacttattactgaanaatataggtggatcacaagaaaattcatcattcgg

SEQ ID NO: 8388 - DNA, 1008 bp, Heterodera glycines
  misc_feature (977)..(977): n is a, c, g, or t
aatcgacccgaaaaaatttcagaaaatacacccctaagaattgaaattttttttcacaaaattgatccacaaatttaattattttttctgataaaaatttttagtttaaaaattgtatttattagaagaaaacactttaagacaattggaatataatcaaaattaagtttttcattaattttttacgtgttttgatacctaaaaagtgctaataaaaaattttatttgcctattttagtgcctatttgagggtttttgtgcctatttaatgcctattttgcgatttttttatgcctttttaggtgcctatttcgcgattttttgtgcctaaaaatggaagccctactgattataaataaattattataaaaatgtaaaaaatgaaaaagaattttgaataaatttgattctgatcattaataaattttttacaaataattttaaggtaaaatggaagaatatattatttattttgattctgatcacttaataatattataaaaatgtaaaaatgaaaaagaatattgaataaattttattctaaatcatttaaaaattattaagaaaatgtaaaagcggaaagaaaattgtgtaaatttggtgttgaaataaaaaacaaatttttttgaatattggcaccagaggcccttagccggaaaaaatttcttagaggaggggaatccgatgaccctgaaggaaaacattttttctcttctgtccaaaaaatgtgatcttcaatttttttttttcaaaattttctgcgccaaaattgtctattttcataattttttattgtttaattttccatgtcaatttttcacatattttgttcaattttaattttaaataaataacagtgccgtatatttaaaaaaagtcaatttgctttgagatacatattcttccttcattaattaccctaatgattgcaacattttgttcatcccccatctcctcaccccactgttccacacaanaaaaacaattaattagcggcacaaatttatg

SEQ ID NO: 8389 - DNA, 1592 bp, Heterodera glycines
  misc_feature (1575)..(1575): n is a, c, g, or t
ccgtcgattcttggtactgagttggcaatttaactgtaacttaacaaattctcaaggaaaaaatctgacaaaaaatgctgaaaattttctttttgaatattatacttgtaaaataaatgtgtgaaactcggactataattaaataactgaaacataaacaaaatgccgacaatttctgatttccgacacggccctcaaatgggataatcggcaaaaagtcggaaatagcccgccggtgttaaatcttaatttaatttgtttagcaaaaaaaaactgttcccgatcacaattattaaagtttaaatcatttaaaaaaatttatttttcggggtgaatttttccatttttactttccccccccccccccccttctgatgggcactgttttttgattgatgagttttttgatgatgtgccaagtagtggtggttgttttgggttttgtttacgcttttacgacttcctaatccgtcgaagaattctcggacaataagaaaaatgcatcttgcgcaatttttgatgagcttgtcaccatgaaaatataaatatttttttaaaaatccgatttttccaagcattttaaatctaaaaaataaatttaaattttatatatattttttgaaattctatttaactaatttatttttatgcaatttgggcctcagctttctataaacataaactctcataaaggatggttttttttaacagaaattactgtagttttactgtgccttccccaaaatgtcattcgtcaacaaaaatgccacaattcgcccacaggtgccctctgtgttggctcacaaaacttggcaaaactgtgcataattaaactgtgcagcggcccggaaaaaggtcattcattcattggcgattttagtcagtcgtcaccgaattttggcagaatacaacggtgggatttgctattttcgactcactctcgacactaattattttacacccgaaaatacaatgggaatgatgtggggaaactcagcggatttgcttggaaaaagtgccaatttgttcgcttcaccaatggcatatgacaatgctccggcatcacccgccggatttggccttccacatattgttttagtgattgataattattggattaatacttggagggtcccattttgtaatgggatctgctgtcgaaacaatatttagccgaaattaagagaagaaaatgggattaaaatgacctttcactgaataaaatttatttgttatttagtttttggatttttaaatctcgatgcaattaatcactctcattgccttggagtctcggtgccatttaattgtcgagtcttgcaatgccaaatgctaatgaacttggcgccattgaaactcttcagtctttgtgccaaaacctttttcattcaatgtctcttgaatgccacatacatcgaccggtctctcaattaattttaaaactttttaattttttataaaaaaaataattggataattaacttttcttgtaaaaaaaaatgtgtcaaaatgcgtaaataaaatgcaaaattgaataatcatattgccggcacaatatgcttctcatattacaangtggcacacctgctgcc

SEQ ID NO: 8390 - DNA, 4577 bp, Heterodera glycines
  misc_feature (9)..(9): n is a, c, g, or t
atccatgcncacttttgttaatcgtaggaattatttttgcccccccgccctccggcgctgctctgttgcactaattaatgcctctattcatccatccttcgggcgccaggtgaatgcgcaatttgttggctcccactgtttccaatacaattttgtcatccgtccgtcttcaatttttctcgacaaaatcctccccccccccccccggcgtgaccaattttgagtaaatttgtcacacattttctgtgggtgggttggtcaccataactcaactccgcacaaataatatgcatataattggcttgtcgccgcgaggcacacgccgtcgccgtccgtcgtcgccatcgttgttcagcaacaattcaacaaatgacgccaaattgcccggaaaatgtcatgtcatcatcatcgtcccgcccgcccgccgaggagggcaattttgggggtgggtggtcaccggcgacgggtgggcacgggaaacggtagcacccgcattccccgccccccccccgggggtgccctaccctaataaaaaggttaaaggtgcaccacaacaagtcactgttgcgccgctttttttatgatggaaggatttttttttggacgagacagaatgccaaattgtttgggaaatagtcgaatttagaataaatgaagaatgattaaagtattccatcaaatttattttcacaaatttggaaaacatagtaaaattgttatgggtagaatgccaaaatcaataaagttgctaaaaattaaaaaagccatgccgacagttaaaacggaaaaattcagtcagtatgtcctcttctgacatgttctattaacctttgattgttttctcagagaatcaatcacctattctcctaactattttctattctttagcttctgttaagaccattttatccctgaaacggaaatttcaaaattttcaccgttttacaaaatctccccccccccactctattttgggccaacaggtacacccccaaccaaatctataattcaagaagaatggccatttgggcacactgtgtgtctcgattgaggaagaaagcataagcaacaacaagagcaattaactctgcccccccccccaattggggtggtccttcccccgcggcgacattttccattccgccgaccccccaaaaatctcccaccaaattatccccaaatccctttaatccgctctttaagccgcctctggggggagcgggggaatcgggctgggaggggcggggggcttactaagaattttgtcccccccccccattccccggccccggcaccaccccaaaaaaggcattgttctcagctcagcaggtcaaacccctccggggcgagggtgtccgctttctgtccatcattggcgcggcatataatcggaggtttctgtcaggggggcggcgcggcagcggcggggcggagatgggcacggcgggagtccgcacggagaaaatgatggtgaaaagttggcggccgcgccggtggtggcggcggcgagtgcattattattaatatttagggagggggggtgacctacggacggacaatttgctgtttgattttgcgtgaaaattgaacgactttgacaccttaggtgctcttaattgtgctactatttatatttatttggaaaaaagaaaaattgaaaaataatggaaaaattggcaaagaaattaactattggtgaaaaataggaaaaagtgtgttaataaaattttggggattttaatgaaaattttattgcatgaaagtgaataaaataaaaatttgtaatttcatcaaagataaaaaaaatttatttttttctataaataaaaaaaaatttcttttacttttgaattattaaaattttcatttgctaactgtataatttggttgaaacaatgtagaactttaaaaaaccaatattttaaaatatattttttcattatttattttattttttcaaattttcatttgcctcattcattcgattgtcgtccttcacattttttttaacactcacttcatataaaacacctacagaatgatgtgagggatgtgacccatcataatccattgtaaatccattgtaaatcggtcactgttccaattatccacttgagggacaaagtgcttaaatggaaggaacagtaatacaaaatgaataataatggcatggcacaacggcttacatatttttgtacatatgtgatgtatattaggtggtgttaatgggtgccaaaaaagaaatgcttttgtcaagtgtttttgcataatttaaatattaaaattttacaaaaatgcacaagacaatttgttcaaaagtaattttttcgcctacagcgcctattgttttggaaaattacagtggcaaaaatttttcagaggccgaagaacaaaaaaaaaaaactttttggaccccccccccctaactccgaaaatttttctggttacgggcctggtcacgttggaatatggaaattcattaaaattgacgttcagcaattttgagacaattcttttaaatgatcttttgttttttaatccaatttttgtaaatttttctcatttgccgacatttaacacatcaaaaattcagtgatcaaaaagtttgatcaaaaaagtgcataaatttccctccctaatttcacttttttcacttccatcataaacattttccatgctcttcattttccaaaccaattaatttcatcttcatccagaagaaatgcttcgcttccgcctcttcccatttccatccacttctcacatcccatccacgacttatccttcccaccccgaacatgacgaacacagtaacaacatcatcacaaattttggctcaccaccaaaccaccaaaaccatcccgtcaccttccaagagacgggagcataagggggaaaacccctccatctttaagtgggaagaaaattttcttctttgagagggttcttccacccgcgcccgcgcccgccggcgccgatgccaatgcctcttcatcgccgggggggggggaggcgaggcgagtgagcaatttgtccgtcccgtccccctcccccctcccacttcagcgccatggggggcgagggtggaaagggcgaagaccaactaacccccaagcacctcatcagcattcaagcatggtcgagcatcatccagaaaatatggtgtactgctgatgggccccaccggtgtggggttgggcggggcctgaatcaatcgcactgaattgggtgggagcatcgagtggattttgcggggtacggcaccggccccccggacaacgggggaaggcacagatgagagagtgccaaatggaccgatgaaaattgcgggggacggggggaaatgagtggttggggaaatgaggggtacccaaattgctcagaaatgtttcttttccaagaaaatgcagtgccgtacgatgagtgtttaggtgtgccacatataaagatgtagtaatacagccacggattttcggggagaaagttttttttttgtattttaacccctcccccactgaaaattccaattaactcagtttcttccattgttttgtgattagcctttttgcgtggagagggagggcccccgcaccccccgctttgggaattctcaaggtgtgcctcacatatgcttgttggtccatttatgtgtgtgtgccaccacggcgaaatgccatgccacatttataggcaaccaacggtggcgttttgttgaaattacaatgaaatggccaagggctgcggcggcttaaagaagagatgtggccaactagggacgagtaaagggaacaaagaatgggaccgctaattggtctttcgcgcttctctttgggtggatgaagcggaagaataacaacaagcactgagtcctccaagcctgggggcacaacaaaggcttaatctctgtttagtaatcctttaagtgagtagtggtttcctctaagatgatgttgctcctatgtctttgagggattaaaatgggtcaaatgctcactcaattttgggcttatccctccgaccattcaaggtctcgggattttcaggatttatgatgggtggcatatattttagaggtcgctaatgccaaaataaaatcaatgggttgcaacattctcctgagtctcggtgtgtgatgccagaggaagcggagtgtgggagaaagtgggataaacgatatggctgatagctcagtcggttagagcattccactgaatggaaaggccatgggttcgagtcccatcgggtgagtttccttttctacatcggttagaaaaattctcgagtcatgaatagtttgtcagctgtccatcggcaacgactttcggagtcaaaattcggatttctcgtcacaaatcccattctcgaatagcacaaatggcggcgcaaccaaaattgaactaacaatggcattggcgcacgccggctaagcgcttgcttatccagcgcccatccatccccctttgtcgtcgtgtcatttcgttgtcctccttcgaccctgtcccgcccattttgttcatcatcatcttcattcatcatcacccgcctattcatcccgcccgcttcgcctccgcccatgc

SEQ ID NO: 8391 - DNA, 2305 bp, Heterodera glycines
  misc_feature (2298)..(2298): n is a, c, g, or t
ttcatatttaaatttattgtaaattatttttgtaaattttcataataaataaatcatttcagctaaatagtatcaatttcatttttacacaacaaacaacaaaggcagcaaatgttaacggaatggtgcataatataattgctaatttaatgacagtgagtcatgcttaatttaaattaaaaaacttttttttttgaattcatacaacaattttgccgatttcaattgagttttttaaaacaataaattttctttatgcatttcaggagaaaaaaattgcatttgcacttgcactaataggccaatcaatcagaaaaaaaaacacaaatgcagcaaaagagttgcacttttccccgtgccattcgaattaatggcgtttctttttgaacatttttttcagaaatccaaatgctttctttttcggccttcttttatcctcctcctcctcctcctcctcctcatcatcatcatcatcagcatcgtcttcttcttcgtcatcatcatcgtcttcttcttcgtcatcatcatccaaatggaaatcaatttcatctttctgtaatttgtagaattaaaaaggggggttttcaatattttattcgcatttttttctaatttacctccactaatggaaggcttttaaacatgatttgaaaaacttcgtacagtcgagatttgaagacaatttaatggtgcttaaattttcaaatgttgccttgcggctccacgcccaccaaattcccttggctttaaagcaaattattttcaaaaaattgatttataaaaaggtatgtttgtgtccctttttaaaattttttttatgccttatgctatgcagccaaataaaaaaaaatttcctaaaatatcggacaaagcgaaaactaatctttaattaaatcacttttggctaaaaataaataaattctaaatatttgtgaatttatatgattatataatatccaaattatgcagtattgtatatataataatgacaccagtagaatgatattcgtaatgatattaaaattttctaattttgtatatacaataatgacaccagtagagtgatgtttgtaaattataaatttgaataattttaaaaatgtatttgctaatatttttaaacgtaatattttgaatttctccttttaagatttgacaataaaaagtttttatggcaataaaattttgtaaaaaaaaatgggtaaaaattattaatggaacaggtcaagaatgaaaaaaagctcaatcaatggaatgcaaattttaagattagctaagcttacatttttctttgtaagttatttttttttgattacggaaccacccttggtacagagcctaagagaaaggtcttcattttctacttaataatgtttttgatcaaaaaaagtgaatatcaaattccacatcatttcaattattttattaagttttatccattttcagaattttgtctttctgtcaggtgttaattatagcctaattatcattttcaatacttctcatgaatggcatttttttaagtgcacatgtagtttgttttatataattatgtttccatggaaaatttgggccaattaatttcatttcgtccatttaaaatgaaaatggtgaaatggcttcctatgtggttagtttgtttaactaattgttagcaaaaatttttgtaagaaaatttttattttaaatttattaataattatgcaaataattttttttatcatttaaatttatggaaaattttatagggtttctttgtgatgaaataatttttaaaacatttaaagtttaattacatcaatttttgctttttaattataaaaaatataataatttttcagtaagttattcatttatttatttttaatacaagcatattttattttgattatatggaaaaatacaaaatatatctaaaattttcacaaattatgttcaaatttcttaaaaaggtataaataaatttcaaaatttttagaaaattatttttattaattaaatggccttccgattgaccatttatacgcttatattcatcgctgcaaattcaattgtttatgggcaaaataattcatcaaattcaactactggtggtggtagtccatcagcagcacaaaatggcatttcaacaatgtttctttttaaatgccatggtgggagtaatttttaaaaaatttaattaattaattattgattttaaatatataggcgtattgatgacattggcatggcttttgctcgcgccgtgcgcaattttatatgtgcgctttttacgagacccgctgaaacgcatattgngcgacca

SEQ ID NO: 8392 - DNA, 2986 bp, Heterodera glycines
atagtttcttattttctattctcttaattaaaaaataacttattatttttttcatattttctaaaatttattaattattttaattttatttttgaatttggatattgaatttatattatatacatttgaggttcatcgattgcttaacacattaaccttcatttgcgtgctaattgcatttatttgtgcaattggcgccaccggcggtgtatggaaaggtccaaccatatacaattcatgggaggaggtgccaaaaagaaaaatgtttaataatacaattttaaaagcattaattcatttataatagaaatttatttaattaaaatttttcattataattaaattggaaatgaattaaaaacaaaaaagagtcagtcaattaaatttattggagggttgggtcaaaatttataaaaatgtaaaacataatcatcatatttaactcgtttttcaataaattctgattcactgaatcattttccggtcacgcccggaaacgggcacatgacaaaaccgggggacggttgtttttcaaaaccgcttttttgcagtgtgctttttccaaaaaacttttggagtattggggggcaggtggtgccaataggcgccgccggtaaaatgtttttataatttttattgcgatttgccaacatatttttccaaaaaatgaccaagtttagcgattttgatttgtcaaaaattgctaattttttgaaaaaaaaaaattcaatagaaattccctatataaaatgccaatcacggatcaaaatcacgaaaaattgaaaaaaaactaataaaacgggggaaaacaatcgggggatcgcccccgcacccctgactggaactgaactcaaaaattggaaaagattttccaattgccagttgatttttttgaattttatttttaataattttttttttcatttttaaaattaatttatttttcaaaattgtcaatattttgtacttttttaaatgcttctttcacagaatttggcatggtcctccattcactcgctgttcggcttcatcgcttttctgttgaccattttccaaccaatttcggcactcttccggtgccatcccgattcgtcctcccgtgtgctgttcaatgttttacacgcattcaccggatacattggatggctttgtgcatgtaataaaattttatatatttaatttaatttttaaattaaattatttttattaaataatctaatctttgaaattgtagtgacaatttaattttggtaaataaaatttcaatttttatttgtccgtattaacagaataattacataaaaattccaaaatataattggattttatagaatccataaaaataagaaggaaaaaactaatattcgcttaattatcagcaactgaaaaacggttttttttcatactttttagagtttcctaggagttcaggaaaaaatcctttactttatttttaattgtattttttgggcaattaaattaattatgaatttttcttcgtatttatgccatattttccaataattattttccagtaattgccatttgcattgcctgcgtacattttggtctgttcgcaaatacaagcgcagcaacagtgctgatcattgtgttccttgtactgcttggcattgttgcactgataatgcaaattgttgcctttcggaagggtcatcaacagcagcaggaacagcacggaacggtgggaggagggggggggggagaacattaattaaaaacaacaataattttaaaaatgaattaattaatataaatgcaaataatttaattatggtttaatattaatgagaatcattttcattgttgataaatatgaaaaaagaatttttgtgcattttttgataattgaattctaaattttttcccgtaatgcgcttatttataatttgaaattcacttaaaaaaatttgaggatgaatcttcaaattccaccctccccctaagtggaaataaaatcataaaattgttgcaaaatcgttctttgtgtgcttgtgcaactatggcttttgaactaataatttttttttgaaattttatgggttaaaaaggaatccaagagccgtcgaatggcactaacaaataagcacctttttggtcgcttatgaatgagcgaaattatgaagaattaaatttcataaatattttatggtaaaaaaaaaatttttttaatttttttagagccgtctaaactgtaataaaggcaaacaatattggcatcattaagttacccattcgattctctctatttacccataaaatttcaaaagatttaatccggtttaaaaacgatcctttatttacccttggcggactttaagaaatggcctcttcacgttttctgattaggacctagttttcaaaaaattcttttctcaattagataatttacatcgtcaatgtggaaagaaaggataaacaaataaattgttttcatacaataataggtattaattgtcatttcttgtttaattaagggttgcattggccagtcccaattgttcttcatattggccctaatttgttgtgcaattgctgtctcaatttcattgctcattatttttgcgtagaaaataatgtttttttatgcttcaaaaagtccatttattatcaaattgtttaaaatcaattaatgggcattgtaacaaaataaattcacataagaattattcgtcattttaagaaaatttttgctttaaaaaagcaaaaatgaaggagaagagtagagattttcgagaatttagtctcgatttgagtttagggccaatttatcatttgcaattgtatatattccagaagtaaaaaccgattttttgttttatattcttatataaacacttttcacctattaatttaaatttagcattgtattcattttttgccgttttggaaaaattaaaattatgtaattcaatcaatttacaaattccattatttggtaaatttagtgcacattttgcgtttttgc

SEQ ID NO: 8393 - DNA, 2175 bp, Heterodera glycines
  misc_feature (393)..(393): n is a, c, g, or t
attttaaatgttgtttctaaaaattagaaataatatacaataagtacataaataatttttgtagctcgcctctagcgtcaccgagaaaggatggttgatggaggagcagatttataagtgagacttattatctattaactctcaatctttcaaaaattattcttagatatctggatcgccttcattgagtaaaaggacacacaatataaaaagtttcaattaataaaatagaataagataacctttttataaaaaattttaacgcgcaaaaatgaatgatcgaatttaaggcataactagagtaatatttatagttttttcaattttatttcatggcctccctgggacgagaattaaaggaataatgtgttttgtcccccctccccccccccnccccaccttagcaaaaaaaaaaaaattcaaaaatttaatgtcgtaaaaaagttactgggattttcaataccccattagcggtattacccctgctctatccatggtaccaaatttatatacgttttccggtttacaattttgggtggttaccttgttaatttcttaaataaacaatgttttggtatatttagaaaggcggggcttggtcccaaagaagcggagggctcgaagaaggaatggacgtcggagcagctgcgtgccggtgacgctatcatcggcttgcaaatgggctcaaacaaaggcgccaatcaaagcggggtatcgccacctaattttgagttgctaatcgcattttaaaaagatgattatgggaaacacgcgtcacatgtgaaaagaagggacagactgtgaaggaccggaattttgtgtaattacttcacttaaaagccttttgtttgtgatagtgctgaattgaccttaccacggataacacccttaatacattccttcttgccttgacacttttgcaattccatttaaaatccaagatgcatatttctaaattatcatagaataaattagtatgttttgtttacatgaaaaagtacaaaattatttgttacattacagttaatattttaatatttaagtcagacataatattacttcatttacttgagattctttgggattcattgtcattttcattaaacactacaaaatgcggttggtttttctctattcattctggagattgtttttctgacaggctccacatcgatggcctaagtgtactgtttccctatgaatatgtttatccggagcaacttttatacatggaacaactgaagaaagtgttggatgcgccagtaagcagttgggagtgttttcggtgctgtcctttgaatgggggagagatttgttttgagtcgataactgcgaatatgacatccattttgacattaaaactattggctaattaattataaagaaaatgtattttagggccattgtttgcttgaaatgccttccggaactggcaaaactgtttctctactggcgcttgtcgttgcttatatgagaaagtatccggtattttcacgatctcccatttaggctatttaaatttttacaggaaagactccacaagctgatttattgctcacggacaattcctgagatagagaaatgtgtcgaagagcttaaaaggctgtttcgctattataccaatgtcaccggagtgcgtttcacattttctcttttttaaattgttttctctaagtccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccgaagggtgtttacaatttggtgagttgattttctcatttctttcctaattgagtgctgatgcctaatcagtcagacttgcgggggtggggcaaagagcactgcatgtgtccgtatttcgtcgcgcggcacttggtaaatcgtgccgacatcatcgtctattcctaccattatctgttggacccgaaaatcgccgaattggtatcgcgtgaacttagaccccagtcttgcgttgtgttcgacgaggcgcataacatcgacaatgtgtgcatcgagtcgatgagtgtgac

SEQ ID NO: 8394 - DNA, 2224 bp, Heterodera glycines
cgaaattggtggaaaccttcggagagttgaaaagtccccccctgaggatgagagggcatggacaaaccctgtgcttccctcagaaattctgagagaagcggtgccggggaccattcgcacggcggaacattttttgacggttgtttggctgactgatcagccaaataatttgttatttcagttcatgaggaggataatggaatatgtgaagcatcgaatgcgggtgaagaatgtgcaaatcgaaagtccggccgcctttctcagagacattaagtccagggtttttgtcgaccgtaagccgatgaggttgttctgtcgtgccttccttcatttccctcttttcattcatacgctgttttaggttttgctctgagcgattcgcctccctctcaaaaacgcttgagttgtccgacatttctgacttcagtgcccttgtcaaactcacgactttcgcgaccattgtcagcacatattccgtcgggttttctctcgtttttgagcctcctgaagatggaagttccgttggtgactacgccattcatctcaattgtatggacgcctcaatcgcaattcgacccgttttggaacgttttcagtcagtcgttatcacttcaggggtaattctattctttatccagctgtttttactttacacatttttacaattagactctttctccgttggatatgtacccaaaaattttggactttgaccccgttgtaaaggcgagcctttcgatgactttggcgcgccaatgcatttcaccaatgattatttcaaaaggtaatgcaaaattggacctgtctaacaaaacatgaagagatttgcttgttcaattgagtgttagacagaaatttaatggtctataaaaaattttaacaatctgtttttataatttttaaactttaatttctcctttttttaagaaaacattttaaaatttaaatgacaaatgagtttatgtttcttcgttttccaggaaatgaccaagtcgaaataacaagtcgttttgagagtcgggaagatccttcggtagtacgaaattatggcactttggttttggagttggcctcaattgttccggacggaattgttgtctttttcaccagttacgtatatatggaaaatgtggttgctgcgtggtacgaacaggtgaattcaccaaaaatcattgctttaaattgttttctctgtccagcgaatgatcgacgaattggtgaagctgaaacttttgttcatcgaaacaaccgatgcactcgaaacatcggtggcattggaaaaatacgtcgaagcgtgtgaaagcggacggggggcaattctcttctcagtggcgaggggaaaagtgtctgagggaattgacttttcacatcatttgggtaggggaacaattcgtttattcactcctttcgctttgctaacacaggaagagcagtcgtaatgcttggcattccgtatgtttacacggagagtcgaattctcagggcacggctcgaatatttacgcgaccaattcggaataaggtgctgggggaggggcagaaaggaaagaatttcgtatttaaaggcattttttattactccaaaattcaagtcttttccccaatgtttctctgttgtatagagaaaacgactttctcacttttgatgcaatgcgccacgctgcgcaatgtgtgggccgagcaattagaggaaaaaccgattacggactgattatcttcgccgacaaagtctggacggaatggagaagactttttaattttttttcggtttttagcgcttttgtcgaaatgacaaacgtggaaaattacccaaatggatccaggaacatctgacggacgcgcaaaccaatctgagtatcgaagaggctgttatggcagcaaaacgatggtttccgttgatggcacaaccattcacgaaagagcatcagttgggagtttcgctgctgtccaaagaattgctcgggagtaaacaagacgacatattgagcaagtttcgaggaagtgttgttactgaaatggactgaccttacaagcaggttgcaaattggccgtcattgatctatttataccatttttaatttgcatttttaccatttattgttttttgatcacacaaatttttacctggaaaataatcttcaaatggtatttcttaacttgtttttttttcatttaaatattgtatggattgtcctattgtctcatcttttcattagtaaataaat

SEQ ID NO: 8395 - DNA, 1674 bp, Heterodera glycines
aaaaccgaggttggattgacaggcaatattttaatccatcactcattaattcaattaattgtaaggtaatcgaacagggcgaattaagcgctgtggtaaaaactgaggcggagagtcaaaactcaacggaagtgcaaaattatgctttggtggaccttgattgggtgaacaactcgcagaagagccatgtgctcttgcagatgatgaatgtgtgaagggatttgtgacatttgaacttcgcacttttcaggcgatgggctacgaacatggcaagggacttggcaaaagggggcagggcattgtggagccgatcaaagccaacccaaaccaggggaagaaagcatttggggccaaccacgacagccgtatgattcttactcaatgttgggccaaagaatgatgcttaattaattgcataggacgaaaagggaggcggaggcgaagaacgagggaaagcggacacatggaaggacaacaaacggacagcggaaaaaacgcaatcgccgaacagcagcaaaaggacgaatggaagagacggccgaatccgtcacggagggcgcaaatgcattacgaagacaatgtgagggacacgctgaggacggcggggctttccgaacaatcggcggaggaaatttggcaggcgcttggcattctcgcgaggcaccaaataatggtattggtcaatcagggaagtgtttggttatgcaatttgaatggttaattcagccacttggcatgggacttggacttgtaaaacggcgagcgggaagaagacgcattgaaatggaggccaaaaacgaagggaaggcagaattttgaagtgacatggacacattaattattctttgtgacaaattgtataaaagtgtaattaaatggacccatcccggataagaaaaagacaattgccaccatcggttgccctgtcggtttattgtattgccttttgtttgtcttgtatgtttctttcgaattatatcttttaagccttttcaatgccgttcttccccaatttgcctctttttcggtgttcgcctcaattgcataggtttcgtcctgcgccgctttctctctcattccgccgtgccatttcactgagtgtcgtccatcggaagggccattcgcattggcaaaacaccaaagacgtaaaggcaaagaatgacgcgattcgcgcgagtgggctgaacgaaatgatgaagcagacgaggaaggcggtcaaagatgggtacgacccgaaaaccaacagacggctccagaagataatggaagtgagattctcgccaaagggaccaaattcaaagcgcgaaataaatctttcccatcgttccaggacatgaagaaacagtcgctgcctttggataaattccgcacttttttggaaaagttaaaggtgataaatcacgggctaatttattacgaaaaggaagggcaacaaaagaatgtttgaaagaccaaattggcatttttacgcccttttaccgacgagaataaatctcccgttttagcaaaatgcaccaaaggaggacgaaaacaaggaataggtccgttttctgctgatagatcataaaatatttctcccttcaagtgttattcttttattatttttgttttggaaaatctgagcattttttgtccttttatttttcattaggataaattgcagcacttcacaca

SEQ ID NO: 8396 - DNA, 1585 bp, Heterodera glycines
aacgtgaagctaattctcgtgttcggaaaacattgaattattccgaagcaggggcgtcttcgtcttccattattgacacaagacaagaagagtccgaaactgcggttttctgtgacctggatcaggacaatttgaacaatacacccgcagaacttctgacaaaatgtgtgtgagaatttggttcgaaaaacattgacttcttccgcagtagggacgtcttcgtcttccaatattgacacaagacaagaagagtccgaagttgctgttttatgtgacctggagcaggacaatttgacaaatactccgacaacgccgatgacaaaaagccgaaaattggatcaaccattttcggcatcaatggcgccattgactcaagctcaaaatgagcaagtgcgcattgactctttatcaagtgacattttatcggaaggtgacaaaatttctgacatagcaaatgaagacgcccaacaaaacgacgaccttggtctgtttttatatgttgtcacgtgttttagtttaaaactgataaaaatcttaaggaccaagggccgggggacgaccatcaaaaaagatccgcggaccaggacggaagaccttaacaaatgatgttgggagaggagtcacccctttgtttgaagacagtccgtccggcaggggcgaaggtggcgttaacacgcgtcggattacggtgatttcggcgcttttatatgttacattgctaattaattcttaagcttcgaaacaagcatatttgtcaaatcgaaaaggccctttacaatgttttagaggattattcaaaacgtccttggccctcgaagaatcagagtctggattttcaattcataaatgaatttcaacatgttttcagctaagcaaacttggacccgttgcagtgaggggtgtgagtgtttgtctgctgctcaatgtcaacaaaatgcgcaggcttatattgccgtttcgaagtatgaccaagaatttactccaaagaagacaatgccacaaaaaatgaccaaaataaccaaaggctgtcatcataagcatgtttgcgcttccgcaggggcgcatcacagagtaaatgatcgctacgaccaacttttaaattccgctttacatttttcagattgattattatgacagcggtcaattcggcgatgccaactgcaaatattgtggtgctgttcttttggaaagcgaagccaatgcactaaacaagcaggggcgtgtgtcaccttgctgttccaatggccagtgtcacaccgagcaaatgaaggcagaattcgacgagttgcagaaccctccgcaattactgaaagatttggttgcggctccggatgaacgcattcgttttgagtttttggacaacacgatgccacttaacaacacctttgcgtttgcatctgtccatagtgagaaggcaccagcggagcaaatggctggcccgaatggataccgttaaatacaacggtagaattcgttttgttttattttttaaatctattttaaggcgaattttcgttcatgctcagcgaaccttatctctccgcaggggcgtcgtccaacgtttgctcaagtggataccctgatg

SEQ ID NO: 8397 - DNA, 3503 bp, Heterodera glycines
cgtgccacgccctcacatctaagcttaattgtgcgaatggtcgggttagcttttgaagtttgtcgtccattttgcgaaaaataaaatttcctttgaaatgccgaatgtttatttgcttaagcctaatttatagggtcaaattggggagtatagataattatttgcacttcacttgcattttcatcattttctcgaatcgatctcccaattcctttcgaccaaaaaaaaaacaaccaaatgaattacggtcccccaccgcgaaagcgcgctcgccttggcttcaccattgacgaactgcttgagcttcaagatcaacagcagagcggaagcggaccttctcacccctcagcatcaccaacagcacttggaaacggactcgacgcatacgtgatgaaattggatgaggaagtcgaacatgctccacgtttcacaatgacaaaggtgaagtcaaagtttatgatcaaggatttaccagccgacccggaggctctgttgtcacaaatctttcagaaatgccttgatgaagcggtggatgagagcaagcagcatggacacacaccggatcgactcggttgcatgatcagcagtgagctgttgaatcctgacatttggacacccatccgtgaaattaccgacaacacaacggacgtgatcttgaatcgactactgagtactgcccaaagcaaaaagaagaatggagtgtcgccacaaaaaataaccaaaggctgtcatcataagcatgtttgcgcttccgcaggggcgcatcacagagtaaatgatcgctacgacaaacttttaaattccgctttacatttttcagattgattattatgacagcggtcaattcggcgatgccaactgcaaatattgtggtgctgttcttttggaaagcgaagccaatgcaataaacaagcaggggcgtgtgtcaccttgctgttccaatggccagtgtcacaccgagcaaatgaaggcagaattcgacgagttgcagaaccctccgcaattactgaaagatttggttgcggctccggatgaacgcattcgttttgagtttttggacaacacgatgccacttaacaacacctttgcgtttgcatctgtccatagtgagaaggcaccagcggagcaaatggctggccgaatggataccgttaaatacaacggtagaattcgttttgttttattttttaaatctattttaaggcgaattttcgttcatgctcagcgaccttatctctccgcaggggcgtcgtccaacgtttgctcaagtgtatacactgatgccggaggatgctttgaagttgcgtacggaaaatattacacaagccttgtcaaaaaacattcggaatgagattcttgcaaaactggagcttctgatgcgagaaaaccctctcggacaaacatttgtcactgcaggggctaaaattgaagaagcagctaaacaaaatgatggaatactgccacattttcaagtggctgtagcttttttacttttgtatttttggctattaagattgtccttctgacaaatcgtgatctgaaagtagacgcgcttcgtacccgtactgattgtaccattatcgaacgtgctgatgctccaactgctcagcaagtcgcagttatatgggttcaagaggatggtctagcgccagaagtaaatggtaatgtgttgatcaaacatttatgcttttatgtttaatttttgaggtttttggatttgtgacaaggcaggaaaaatgcgggaattgaagagtggaatgccgcagctcgacccttgctgttttcctttgttacacccgaggggcacatttgggtggcgttggtttatgaagaagacaggagcgcaggggcgcccggtaattattttttctcattaaaaaaatctaaaaaacagactgtgcctatgtcttcgcattctaatatgcaaacaggcgaagggggacaacaaaatattgatgattcggtgactgaatttgacaatgatgatatatgtgacaatgagcaaaggcgagaatttgagtctgacgtaaatatttttgctttatttttgcttcataattccctatttaagcctattttttcgacaactgattctgtcattgaacttgcttatgaaacatttccaagaaaacgtcaacttggcattaagaaagttgggccgcaggaaaacatttctgaacgtcaattttaccgataccgtttggcaattcgggaaaacagcaggggcgccttccattggctttggttttcacgccgtctcgcggaatatttcctcattgctgtgctcaatcggattgaacgcaatgaaatggaccatgttaaggcgattcagcaaaaaaagaactatcgccaaacacttgctcgcgattacatcaaggctattgagcaaggactccagcagcaggggcgtaatgcaaaattaggctccgtctttatgatgcctcatacttttgctggatcaagacagtactatcagcaaaaatacgcagatttaatgacagttgttcgtcatttgggaaacccaacctggtatgtacattataagcaaattattttttaaatatttatataaaaggttcgtaacgtttacgggtaatcccagctggcccgagttaaaagaagctctgcaagggcgccaacaatatacccatcgtgcggatattgtgtgtcgtattttcatggacaaggcttctgaatttgtccgtgatttgatcgaaaagaatgtgcttggaaaagtggctgggtggtgttatagtgttgaacaccaaaagcggggttaagaattgttttgttgttttgtcttatttttagttttcaggtatgcctcacattcacatactgcttatacttgaggagcaggggcgtttaactacacccgagatggtagaccaatttgtatgtgcaagaataccaccactgccaccaatggaggatttatcacccgaagccaaccaacaacgtcgtttgtggcactatgttacaacaatgatgttgcatgattgtaatgcagcttgtattgagcttaatggacaaggacgaccaagttgccgcaaacactttccaaaaccatattcagagttgactgaactttccggttgattacagattgttgtactctaatttaatcacaaattcagaggtacgttacactaattatgtgcgtttacctgctgatatggttgatggaacatttcatgcaggggcttctaccatacaccctacagccgttccaaatcatgaaggccatttgctccctaccgatgaccccgaacgtgactggaatgaaatacgttacaagcgagttccaactgaatggcgtggaaagggcttaaaggggccccagagactttatgtttgtcaagctaaaattaaaatgtcaattcaaaattatccttaaggaagagtgtggcttgccatatatgaaaagaaacaaacgcggcaggggcgtatcaattctcgatgatagccgcgtaataccttacaattctttcttgcttctaaaa

SEQ ID NO: 8398 - DNA, 2326 bp, Heterodera glycines
  misc_feature (2100)..(2100): n is a, c, g, or t
  misc_feature (2128)..(2128): n is a, c, g, or t
  misc_feature (2175)..(2175): n is a, c, g, or t
  misc_feature (2185)..(2186): n is a, c, g, or t
  misc_feature (2212)..(2212): n is a, c, g, or t
  misc_feature (2216)..(2217): n is a, c, g, or t
  misc_feature (2242)..(2242): n is a, c, g, or t
aaaacccgggattgtcaattgattggactcataaaagtcgatcggactcataaagtgcattagagccgtaactttttttattttcaaccaattctaacgatcttggtttcttttttgtaaaatctacaaattatccgatggcttctaaaatccttataaaaaaattggtggaaaatcgcaaaattttgtcttttttggacaaaatcttgttaacaaattgcatttaaaattacaaattttttcccggcggcgcctaccggcaccgccggaccaccgtcccctcccctagttacccaaaaaattgtttttgaaaaaagcgcgcctttaaaaaaccaaaaaagtcattataagggatgtcaaaattatctacaaatatgtatgtaaataaaatatttaaattgttgttttttgggaaaaaaaatttttttggaggggttgaacaatagaaggcccgtgccttcaaatagcggatttacggtaatcatcttttagtattttaaaaatttatttatttatcgataaagaaaaaattgccatcagaagggcgggaaccacttactctgatgactgatcacagtaaaatagtcacagagtaagtgaataaatatcaagtgagatcacaggttaaagataaacaataacgaaaaatttatatgaaaataaaatcgaggtcaaagtcaataaaatgcctcaaaagttaataattctttatacattggtgctttcagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaatgacttatttcgagtatttaggttagttcttttaaacagagaatttgggtccaaatgtgtaaaaccatgtaaaattttgtaagtagttaggaggtcaaaaatttttcttcgtttttcaagagtagctaatttaaaaaattggagccgttggtcatagggaatatatggaagacaacattttctgaaagcaattcgagtaaaatatttttgacatttttcaattttaataatatgtgattttagttgcggattccacgattcaggggaatattctagaagtggacgaatataactaacataaatatttttccaaactgaaattttctttgatttaataacacggaaaagtaaacgcatacggtagtaggcgttacgggtaattttgcttatatgttcggaaaaagtaaatttattgtcaataagaatccctaagtcacgaatagtttcaacttcacaaattgcattatcattaattttatattgttccctggggttattctttccgaagtaaatgataaaagttttattaatagaaattttaatataccatttcttagaccaatcagagagaatatttaaagcatggtgcatagcaattctatcattttttgttttatgtacggaatataatttgacatcatccgcatataattttatagaaatttgtttaggaattaattcaggtaaatcattaatatatatcagaaacaaaagaggcccaagaacagaaccctggggaacgccagagctcattttatactcagaagagagagtattatcaacccgaaccctaaaggtacggtttgaaagaaagtcagatatccagtttaagattttacccctaataccgattctatgaaccttatataaaagtaaattatgggggataacatcaaatgctttcctaaaatctatatagacacaatcgatattcttattattataaataccatcataccaatttttaagggttgaaattaggtgtgttgtggttgatctgccctttataaatccaaattgatggtcggagaataaattgttctttaaaagaaaatcggaaatagcccaaacaataaatttttccataattttgcataaagaacaagttaaggcaataggcctatagttcatagggttacttttttccccttgtttatgcaaggggataataatcgattgtttccatatagtgggaagctttcctgtatcaagggagagtctganaatttcagtaacaaaaggagtaaacganagagaacaatttttttacagtctaaaggtaataccgtccggtgatgntgtatttctnngtaggtaagttttaagaactttaccnacanngaatatattaaatttcacttcgttnattgttggagaagaaaaagaagtatcaaaaatcagagaataattatttacagtaaagttttcagaaaaaatttttgcaaaaatt

SEQ ID NO: 8399 - DNA, 2306 bp, Heterodera glycines
  misc_feature (54)..(54): n is a, c, g, or t
aatgtcgtcacgtctacgaaatccttcggctgttccacaccaatatgaatgtcncggccgaaaggcagcaatataaaatggagttgctgaagcgcctgatgaagtcgatgatgagtcagagcaaagacggcggcaaactttcacgggcattgcagtcggatcaacagtccctatgctttgcactgaattctttaagcccggtatcacaaaaaaaaattgataattgaaaacaaaaaattcatttatacaggaacaacaagggcagcagttgatggcgctttatgagaatacgatggactgttacagaacggtcctcgctcggctcgctcgttatgaaaaagattttattcgatgaccccatctctggttgattgcattgatgggacttgctttttcttgtactgataaatcttatataataaagttgagtgtctgttgtgtgtgtccagtgtttgaatttgtgtggcgttttgtttgagttttgcgttaaaaatgaatttgaaaagagatgaaaagaaattgttttgaaaaagaagagaatataaagaaaagagacgaaaataaatagttaagaagaagaagaaggcaaaagaaatagcacagaaaaagaaggtaaaagatttctcctcctaggatgtagaggttagagggagggatggtgggaaatagtgcaatgtatgactgtctgtctatgcgggcagcggcagatgggaggggcagacaatgaacagacgcgtgctgctgtgcagcagcagtctgttggacgcgtgcgtgtgtgtgggagaaggagggagtgggaaaaaaagagagtaaattgcaatggaaaagaaaagagagtaaaagaaaggaaagggagagataatgggaaatttctctcgcatcccttccttatttataacccattttttattgtataaatatttaacaaaagaaagaggacaccccttagtttgttcactaagaaaatcctataatattaacattgtgttatgttgtataaatgctttgaaaaatgaaatgtttttgttttacatttttttcttttgtcattttgtgtaaaaaagtcttaaaatgtttctttttctttctttgttgtgtgtgttataaattgatttggttttgatatgaaagatattgttttgcttatgtaaatggtaatgaaattttaaatgaatgaatgagaatttgtttgaaaaatttgtatagaagaaaaatgttgtgcgtaagaaaaagtcaagaaacaaggaagaactgttatgccataagaaaatgccaaaagaagagtgcgaggccgctaagcggtcgagccgctgtcggttttatcattcatttccggttattgggtttcgaagaattggtgagattgaattttggtgactggaatggagccgaaggccccagttacgaggccgcgaagcggccgagtgagtacctttgacgcaaaaatttggtgagtggggccgaaggcccccgtacggttgagtcccattgattgaaatgttggggggttgagcccaagtgattgaaatgctggtgggttgagtcccagtgattgaaatgctgttgggttgagcccaagtgattgaaatgctggtggcttgagtcccagtgattgaaatgttggtgggttgtcccagtgattggaatgctggtgggttgagtcccagtgattgaaatgttgttgggttgagtccaagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtccaagtgattgaaatgttggtgggttgagtcccagtgattgaaatgctggtgggttgagtcccagtgattgaaatgctggtgggttgagtcccagtgattgaaatgttggtgggttgagtcccagtgattgaaatgcaggagaattgagtcccagtgattgaaatgctggtgggttgagtcccagtgattgcaatgctggtgggttgagtcccagtgattgaaatgctgttgggttgagtcccagtgattgaaatgctggtgggttgagtcccagtgattgaaatgctggtgggttgagtcccagtgattgaaatgctggtgggtagagtcccagtgattgaaatgttggtgggttgagtgccagtgattggaattatggtgggttgagtccccagtgattgaaatgctggtgggttgtgtagacagtgattgaaatgttggtgggttgagtccccagtgattg

SEQ ID NO: 8400 - DNA, 1259 bp, Heterodera glycines
caaattgacattttttaaatttttcagaattattacactcgcaaggctcgccggcgacacaacgaggagcaacagcaacaacagcaacaggtatcgttcaacaacggcaacaacaacaacagttgcatcgcaactggtgctgctgctgttgctgttgctggtggtggtctcctcagcgcaacaaatgccaacggcggccacaacatcggcggcggcgccggcaacaatttgagcgcctttttggtgccaactccgtccgctgctgctgctgctgcgattgctgcaggcatccaacagcaacaacaactacaacagaagcataataaacaggccaataatttgttggccgacattcaggttctaatgatggtggtggtggtgaatgggtttttttgttggcacatttaaaaaaattttttttttccaatcagtcacgaaatagggaaaacttaaattgtcagcaatttgttgccaaaaagaggggttgggtggtaaaaaatttggcgctatgtatgttaaaaagtgaacaattttgaattttatcaaaaagtaaaaacaaaagcaccatttttggcttttgcaaaattttttaaatttttgttctagttcgggttagggcttagaaattggtgaaaatagatgtcgtattcgtgattagcgacctctaaaaccttggataacaaattttcaaaaattgtgcaaaccaaaaggggggtccccccttttgtttttactttttgataaaattcaaaattgttcacttttaacatagcgccaaaattttatgaaaaaaaaaaatttttttttttgacttaccgatttttcccgggggggggtaataaaatttcatcatacagtttttttttgtgcatcatcaacaaaatttactctctgtcacccctttgtaaggacatttccatggttccctcgtgttcgtcgaccgctgtcgctgcttcgattgtcgctgcaacacaacaacagcaacaccccatgggtgttggaggagtacaacagcaacaacagttcatgcacgacgtgcagcagcagcaacacggcacaaacatggaggcagcagcagcaacgcaacacctccacaaccacggcaacagccaccacaacagacggacaattgcctacccgaaaaacagtgccaccgccaaacacaaaagtgccgcggtacgcgcaaaggcccaacaaatcctggcggcacaagcggtgaggagggagagagagagattatgaaatttgttttttaaaat

SEQ ID NO: 8401 - DNA, 4662 bp, Heterodera glycines
gatttttatccaacaatttattttattaccctttaaaatccccggttatagaccctccaaaacccaaaaaaaagagaggagaggaaacctccgccacttaaaaatacttccatactcggcaaattattttttttatttccctaaatctagaaaaaaaaaattttttttttgaaattgcaaatttaatcattttcagcaagcccaggcggcccagcaacagttgggactggtggacgatgaccaggaatgtgatgacgaaaacaacgactacatcatacggaatggcgaagtgttcaactaccggtaccgcattgagtccagcattggcaaaggctcgtttggccaagtgaccaaagcgtacgacatggtggaggaggagatggtggccatcaaaatcatcaagaacaagaaggcattctatgaccaggtgggggaaggggggagggggaatgggaaaaatgtcaacaattatctgaatgtgtgtccatgctttgtccgtgtcatttcggcacggaaccgaaaaaaaaattttttttttttgaaaatatggacttttttaaacttatcaaaaacaagaaaaaacaacaacaacaacaactgaatgttgtcggtgtgtgatttgtccgtatcattttgacatggcgcacgaaattgaaaagaaaattttttttttttttttgaattttggagttttttgaaacagtaagaaaatatttaaaaaaatttagtagaaaaaagctcaatgtaaagaacctagaaaacaatttaaaaaaaattcagaccgggaaaacgtgggggcaactggggttactcccccgaaaaattttaaaaaattcaaatttttttgcgatttttcaattcgaagatttttgaaaaaattaaaaaaataggggcaagcaaaaaaaaaacctaaattttatttgaaagggctcctcactaaactcagcttaaatttaatcctccatcaaaaaaaaaataaataaaaaaattgctaatttccatttccttacggtttcgtttttgtccaggcccaaattgaaatccgtctgctggaactgatgaacagccacaactccgagggtcgctattatgtggtgcagttgcgcaaccattttgtgtggcgccgccatctttgccttgtgttcgaactgctctcatacaatttgtgagaaatttcaaaaaaaatattttcaattttttttattatattttaatttaaaaaaaattaatttaattaagcatattcacagtttttcaattgtttccaggtatgatttgttgcgcaacacaaatttccacggagtgtcgttgaatttgacgcgcaaatttgggcaacaattggccgccactttgctgttcctctcccaacccgacctgaacattatccactggtggaattaaaattatttaaaaattatttaaattatattttcagcgatttaaaaccggaaaatgtgctgctctgcaatccaaaacgttcaacaattaaagtaattattgctcatcaatgcataattaagcaccaattacttaatttattcatttttttacaaatttctgatattacagtattctctctctctctcttcaaggattactatatttatatactgtattttcttatagataatcgactttggctcctcgtgtcagtacgacagtcgcatttaccattacatacagtcgcgtttctaccgttcccctgaagtgttgctgggcatttcctacgacacacaaattgacatgtggtcgttgggtccgtgaatgaattcaaaaaagaaaaactaattttatttaaaatatttgaaaattattaaaaatatatacatgattagtcgttacataaaaacgggcgctttttctacaaaaaaatattgctaaaatggtcgttgattgtgagagttttggatgcttttttcaaaagaattcgaaagcttgatccaaaataaacttttggttttttcttttctagaaaaacaaaaaaaaatgtgctttttcttgttaagcgcatcggttttcataaaatattccaaatttcaaattgttttacaattttaactgcctgaatttatggactttggtgtgagaaatagtggacaaattttgttgagttttgtctacttaaaaaactcataaaacatagataagattttgatagctcattttaaaatgaaaagttaggcctttcgaatgatatattaaattcaataaaattaattatataaaaacgaaaaaaactaatgcaacgacctgttaaaatgttttccccattttcaggctgcattttggtggaaatgcacaccggcgaaccgctgttcccaggccattccgagtttgatcaaatgatgaaaattgttgaggtgctcggcatgccgtcaagccaaatactgaattccgcctcaaaagccaacaaattctttgaattggatgaaagtaaaatccttaaaattaaatatcaataaaaaaaatagtttttttaaatgtatacatggctcagttggtagtaacgtgtgcttgcacgttcttagttccttggttcaattccttaatggtgccggatgattaaatttcaaaacttgtctgatttcggtgacgacaaatggaattcctcgttactgacggcactttttaattttatttcactttttttttctatgccattcatcccttctcgtgaaaattctggaaatcttaatggattttcttaacaaatcacaataaatcaatcccttcacgatgacaacagacaccaaaatgacgcaaaatccgtcattttttgtcgaaaaatttcacttaaattttataaaattaaattggagaaaacatcttggaactgataagcaaaaaagtttcctgcctcctgctgttggtactttccacgaaaagttttttctggatgcgggcctgggttttccggtcattattctgttcccgcaatcgctctattttttggagtgccaatttgaacgatttatctgggcgggcactccaatcattggcttcttttagggccgattgattcaaataaacaccgttaacttttttttgaaatcagatggccaatggcgctgcaagaaggcgcgtgacacaaagtcctacatggcgcctggttcacttcggttgtccgacgtgttgggcgtgtacacgggaggaccgttcgggcggcgacagggcgagcaaggccacaccgtggaggactacatgaaatttaaggtgggaggattccttcccctcgtatcgtttccaccctccgaaaaaaaaaattataatttctaaatttgtaaaaatcttaaaatttttataagaaattgcaagaaaatgttttttaaagcgatttgctcaaaatttttatgatggatagatactatgtttttgaaaatttctccaaaaattgctaaagatatcttatagaaaaatttctatgatttttaaaatttctaacaataagtttgaaaaaataattatttacatattataattagggatgggattcttaggtttttacttattttttctgcggctttaactcgacgagaaatgcacgaaaaacacattttttgttcggaaaactttcgttttcacgcccctatccgaccctagaaatacactcctaagaatcgacccaaaaattttcaaaaaaatacacccctgagaatcgacccttaaatcctgaaaatttctaaatgtacttcatttctaactgtaatcagtaaataaaattgtttgacttaattttaactaatttacatagagaaaacagtaattttgataaattcacccctacatttgaaatttttttgcccctattttcgcccctatttcttgaattttttgcctctatttaggtccctattttggactttttcgcccctaaaaatcccatccctaattataataaagctcattttttgatagggagcatgattttaaaaaagtctcctacctgggtttaatgaatatgccgtaattttaagtcccttctatgagtaattaacagcaatttaagtaattaaaaacttgaggaaaacaaacatttacactgtattttttctctttatatttttatttatacatttttaaatgccgcatttttgcacaggatctgatccagcgcatgttggagttggacccggccaagcggttgcatccgtactacgcggtgcggcacccattcctgcgcaagacgaaccctggcgatgatcaacaacaccagcagctacaacaaaatgttgttggaacagcgagcggcggagttgcggcgcaacaacaacaacagccgaaccgctcgcactcgtcggtggccatttccgccgcgtgccaacaaccccagcaacaacagcacccatcttcctcatcagcatttcacaatcatcatgcacaacagcagcagcaccagactatgccaccaacttttgtaaaaattaaaattaaaaaaattttttttttgtgaaatttgttaaaaattggtccctgtcatgagaggacgggaccttggttttggctttgtgccgaaaagtttgcatgagggagttatgggtgtacaataattttacagggatgtcccagtcctaggatatttgaaaaaaaaattaaaatataatttgtaggaaaatttctttccagcaaatttttcgaaaaaaaaattttttttttttttttcgt

SEQ ID NO: 8402 - DNA, 1737 bp, Heterodera glycines
cctatttttggccttcaattgttgggagccggaaccttctagtacggtaggcagggggggggggagaaatttttaactttaattaaaatttaaattttttttctcaaaaaaattcactaaaaaacataaaaaaatcttcattttttcttttcaaaattttgaaataaactgcaaaaattattagcagaagttagcaaaattttaaaagaagaaaaaaacaattctgattttttgagaaaaacttctaggttttttaattgaaaatttataaaatttttgtacgaattgccattgacctgccattttgccttagaaagcggggcatttggccgttttacagtgttccgattcaagctttcagcaggggttagctagccattttcatattttcgcattttcgctcaaattcagggctgctaacttcttaacaaatttcataaaaattcaaattttctccgccggcgcggcggcgcctgtcagcgacttatattttttgagtcaacattttgaaaaaatttactaattttgttgattcgatttttgaaaatttttgttcgtccacccgtttaaactcgcgcgcccgatttttggaaattttggcgatgaaaaatgcctggaaaattgcggttactgtaacattttttaaaatttttcttagcggtttatttgtgcaaacggacaatgcagaacaaggcgcacttggagctggaggattttgaagcggagaatctggccaagctgcaaaaaatgttcagccgaaaatgggaatttgtgttcatgcaggccgaggcacagtacaagtgggtgcagggagatgaacacggtccaaacatactgtagaaaaaccgaccggtacagtaggacctaatcctgtcaatgttttccactggttctgagatccaggtccggataattggtgggccaatacccaaaaaattggattacatcgtgaaatccggcccgggcccggtgcctgatcctggtgcttgattcggcatttttcaaaatatctgtctctagaatactgtggtgggcggcatactgtatttggggtagaacagtcgtttttaattcagtgtaaaaaaaatggaaaatgaaggacaaaatttctaaaccaaccaaaaaagtgcaatatattagtgaataattgtagataaattttcactagcatacagtaccctgggacaatggatcgtaactatcaatttttacttaattactctaataattaaacatttacattctcacagggtggacaagaagcgggatcggatggagcggcaaattttggacagccaagagagggcattttgggatgtacgattatttttttttgtggtgggggggggggggggtggagatttatggggataaattgggactaattagagcgattaatcggatttctatttccaagaaataatttaattgttattgtttagcttcatcgtccggtgccgggctgtgtgaacaccaccgagttaagtgccttttataggggctcttctgcttctggggcggcgactgatcatttccaatttgctcaccaaaattatggactgattttaatctttattgtgatcaaattttaatgtgaattgatttcaatttaagaggctaaaaatggtgaaaatcattttcagagctgtttttaggagggttgtattttttttttttgcagttttattaaggaattttgataaaacgccaaaattagttttgaatttatttttttca

SEQ ID NO: 8403 - DNA, 3680 bp, Heterodera glycines
taaaaatatcccagctctaattacaccggagaaattttaaagattaagaacgaattctgcaagaaaattacaaaatttgcaaaatttgccaaatttttcttttaattttttcgctggcagaaatcactcaaattttttatacatacatatttatctatcccgaaaaattgctaaattgatcaaaaaaatgtcattgcaccaatgtttggcattttgtttcactgcctccccctaatttcaggtggactttcgcaaattgtcccgctccggtcggcccaaatacagcgcgtccacctcattgttggcacaagcggctgctgcaagcagtagcagcagcagtaccaccacctgcagtaatgggcccgctgctgctgcacaacctacaccaacaaaaacaacagcaaaaactgtgccgacaaggacggcagatgaatgttcatcgacggcatgcacttcgtccgccagttgtgccggcggcggtgactcggccggcacctcgtctggcggtgctgaaacggcgacggcgcccaatcggacaacgtcaaatgccgcttcgagcagttccgtgcgggaagtgaagtaccaccagaggcccggcttccggcgccagacacggctccaggactcaattaagaccgaggtgggcgctgaggaggcggcgctgagttgggccatttgggaaatggtcgagactcattctcgagcgctgtcttgggtgttttttttaatttgttgaaaaaaagacgaaaaattttaaaattctaaaaaactttcatagatcactgatctgcacaatcggttggccaaaaatgtgctcaggacatccaaagtggtcgagaattacctccaatactatgatcaccggtcagtcagatattgtgattgtgtgtgcattgatcagacacaaaattagtgattaatggaacccacagtaatgcttaaagatagatacagtatagcaaacggagaaactcattatagaagagatcatcagcaggataatgttatcagtgatcgaaaatgtctaaatctttttctaaagagtgatttttttttatataagtgatcaaaagattattgattaatggatggaaccacagtagtgcgcagagagagagatagagatacagtaggaatcggtcagagtcattagaaattatcaaaaatgttaaaatctttttcggttcagctatttttttaaattatcgataaaaaatataatgaggtttaatagagtaattaatgattgattaactgtaattaacgaaaaaaacaatgatcagagggaggctgatattaatcatgattattagtcataatgaaggagtcattagggagcagttcgtccctctcctccaccatccgataaaaacttaaaaatcgaaatttcttatagtttgtttttccagtaaaaatatttttaaatcttcaaaagcctctttttaaagcaatttttagtttcgaaaattttaaggaaatctatttttaaaagattttttctaaaaaaaaaactaagaaattttgaaaatgaacgaaaaaaattccaatttttaaaaatttttcgtcaggggaaacttaaagaatatctccattagatgatcattcactaatttagtgtgtgattagcacaaattttccaggatactttttgacgctttcctcgtccaattgggcagtgccaccgacccgttccatggccaaccaaatccgtggatttcggacaccgtcgacttttgggaccacgacaaaatgtacgcggatgtgtccgcgcggcgcctcaaactgtgggaggaatcgttggaggagctgctgaccgatccgctgggccgtgaaacgttgcagaaattcctggacaaagtcggtgttttggcctcaaagcaaaaaaaaaattttcggaaaccccacaaaaattcacgaaaatcaaaagaaaaatttttggaaaacagcgaaatttagccaagccccatagacctgtggaatcgaatgattgcattttttacgcattctctggcactttttggcgccgaaattattatgcattccggcaattatttgtaatttattttttaatttaagaaatgcggaaaatttttatttattaaaaagtttaaaaaaatgtaggggtttcgctcgagtttcacaagaaatctccagaaaatgggttcaaccttatcgagtcgtatcattggattcttgcaattttatatatatttttaatttttaccaggaatactcgggtgaaaatttgcgcttttggatggaggtaaaaacccatttaatcaaaaatgcatatgctaattaattcattaatatttaattacccaaaaggcaaattctcgccaatttttctaggtgcaacggttacgcaaatgcagctgtcgttgtaagtttttgtctaaaaattaataagattcgccgcagggtcgtctcatgaattccgccaagggggcaaaattaaaaaaatatatatatttttaattttaccaattttgggtttgataaattaaaaaaaattatatgccgtattaaaaatgacttggtacggaaatggccccaacccgatttaggcatttggcattttggcgaaacttgcgccaaattggtattattcgatcggaaccgctcagttgggcgccggcacgtttgggcgccagcatgtttttagctataactttttttttatcaaccgaatccaacattgttgatatcattggaaagctcgctctaagtgtccttctattagcctgcaaaattttaaaaaatttagtttaggttcaaaaaagttatggccagaagaattcaaaaaaccaaattttccaacttttttggccataaattggttcaaaattaacaaatttttttggaattttgcaggctattagagcatctgaagagctctcgaatgataccaagattattggattaggatttcaaagaaaaaagttatagtggaaaaacatgtgctggcgcccaacgcctgcgcgcccaactgagttttagaccgcattcgatagctctaaatgtgcaatattaaaatattagcctgcaaaagttcaaaaaagttcgtcaattttctgaaaatttatggccattagaggtcggtcaaaagtcttggggttttcaaacatttgtggtaatatgtagcttttttgaaatttaatgaaatttttttttgaaattttatagcacctaatagagaatatttagggctatcgaatgatatcaagaaaataaaaataatatggttgcttatgagcaaaattagatcaaaaaaaaatttttttttattttgatggttctcccatcgaaaatttgaattttacgcaaaatttacgccccaaaatttgcacagttgtgcccgtgttggtcaccaaaatttacaacgaattcatcgatgccaatgccacctcacccgtgaacattgactgcaaagtgatggagattacggaggagaatctgcgcaacaacccaaatcgatggtcatttgacgacgcggccgatcacattttttgcctgatgaaaaatgattcgtatcagcgctttttgcgatcagaaatgtaccgggaaatggtaagtgtttgttaggtgatctgatctgatgatcaatcaatcaatcaataagtgtgagagagtgaaagtgatcagaatctgaaggtggtgatcggaaatccgccattgaa

SEQ ID NO: 8404 - DNA, 5810 bp, Heterodera glycines
atatcaaaaaaagggcctaaaccgctcttaaatattaaaataactcaagtaaaaaaaaaaaaaaatcaaaatttagtagaaaaaaacctaatatttcctgaaaataaaaaaagaaaattaaattaataaaaaaaaaattcattttttggtacggtcgaaatttaccccagtttcctcaagcagctgcttcacgtagaaaaagtcgggctgcactccgctggcctgaaaaaagtctttctgattcacacactccattgaattgtttgcttgcttccaccaccacccccacgaaaaaatttaaaaaaaaatctgtcaatcatagaattttttggacaatttttttttcgggcgatccaggggatttgatatgggagggggagtattgtgccgtgccgtgccgttcgcatctccaccaccattttcaccacaaccaccgcacctttgcctccgcaattgctttgtcgggcagcaaaaagcgtggaaatgcatacatggcgccctgcacctgttgacagtgcacaccctccacttggttgtacgccttggtgaccagctgtgcacgcttgtgcaacgagtcgagcacagccgttttttcctgaaaatgagaggacaaatccaattattattattattactttgctattttaggaaaataatattatccaaaaaaaacaaacaaacaactctgccagtgtcaaaatcactctaaaaccataaagttttttaaatccattatctgccgggcggatccgaacccatgagaattaaaaaagggaaaatagattaaaaagaattttttttttgctggttttttcctctcgagcacttttttctgatcagttttatggtcagggcaaagagccgaaaattttggttttttttaatttcattaaaaaattcttaggaatttcttaataaaaaaatttcaagaaaaaaattttttgaaagaaatttcagcgattttttttgaaaaacttattagttcataaaatttcaaaaaataaaaaaaatttttttcttgaaactttcttactaagaaattcctgtatttttttttatgaaaatcgaaaatttttttaatttttcggggagggggggggggggggaacgacatgctccgagtttttggttcggtttgggtgaaaatggaaaattaataattaacgcattttctgatatattttttttaaaaactttacaattttatagggcgaatgggaaggaatttttgcaaattaaaatggctgacaaatgaattcgtcctgtgtcaaatgcagtctgttggaaaagtgcattgaaagtaattaccttaagccactggtcgtaggacgggtcgcccggcttcggatggtcaaccacacagtccatggccacctgtcccaggacggtggagcacagtttggcggagatcattttctgcaaaaagaaaatggcaaaaaatttcggtccgaaaatttgcaaattttgagaaggtttcggtcgtttcccctccgaattttttttttaaattttcaaccttaaatttttgcaaaaaaatcttagaatattacacaaaaaaaaattgcaaaatttttttgttgttttggtttattaggaacaataattctgctgtttgaaaattaattattttttcataaatttgctgacgatcaaattatctcatacaatcactttcaatcgttcttcaaagctgtttaggctatcagggattgaaaaaatgtaagtttgaacccgattttggacatcggcacaaatgtggagtaaccttaattttccatacggatttttaaaaaaaggacagttcgccccccttacccattcgtttcccgacgaaattttttttttcaaaaaatttttggcagaaaaattaaaagttcgatttttttgtctcaatttttcaaaaatagcgcctcaattttttttcaaataaaaaagtgattgccttgaaatggacgtacaccgtcgggtcaatgttgtcaaactggacgtaaccaccgcgcagtccgcactcgcccatgtaacccttggaacaggagtagaagctggccaactcgagtctgaaaaatcgtttaaaatttaataaaattcaaataaaatttcataataccaccactcacttgtcaaatggcgcacccatttcgaacatcactttgcggaagctgtgaaattcggcaccctccgcgtacacattttcttggtacaccttaagggttatggaaaaatatttaattttttatttaaattatggagcaatttaatatttatacaaacagaaaacaatttttgtataaataaattgtgaaaatgaaaccaaaaatctcttgcttcaaaattgctaaatttcctttccaagactttctttttaaaaattttttctttttaaaatttccttataaacaatttctaatattttttttgaatgatttgattgaaatttcgaaaaaccgtccgccgatgggacttttgatatacataaaatttggatgagaaaaaaattttcaagaaaaaatggacaaaattttggaaattgtacattttctttagcaaaaactttttccggccggcctccattggaccatttattttttgaaaatttgaccacaaaacgggcaaaaatttgtcatttttggcgcaaaatcgctacaaactcctgctttttcgccgctacgcttgaaattttgaaaaataacacaaaaaaatttttggcccggaaagcaacaaaaaaaagaaaagaaaaaaagttcttcgagtggcctccccaaaattttttttctgggtacgggcctggtctcatgtgatcagctcacttcgtcagcgaagatgtacagtcggtgtttgtgcgcaaattggatgatgctttcaatgttggctcggctcagcacctgcccggttgggttgcccggattgatcaccacaatcgccttcacatcgtgctcactctgtgtatacaagggggaaaatgcgtgcaaaatgatggcaaatcggatttgttgtgttttgaaaatgttgaaatttacgtacgggcgaggcgaattagtgccaatttaggaggacaacgaataatttaaactaccgtcggacaaataccaagcttggacgaataagaataaataaaccaaatttatttttttgcaaactttttgggccaaaaaacgtgttaaaatttttatgtgggaaaacacatacaaaaatcctcagtctgtttaattttcagccgttagcccaaaatttaaaaaatggacaaaaaaaaattgaattgtttttccaactaaccaacctccttcaatgcccgttccaattcgtccatgtccagcgcccaattgttttcttcgtccaggtaatagcccacctggcccaggttgtactcctcaatcgatgctgaacatttgttgcatgtttaaagatttgcataaacaaatttaagcagaatcgcttcggacgagcgaacagaaaattttggcccgggccaaataatttgagaccgtatttttgtcaggatccatccattcaaatgctggcaataaagcggaacaaaagccagcaaaaatcggggatcaaagcggaagaaatcgaggtccggtgctttcttatgaaaaaattaattcaaatttttctaatgaattaaaaatgtttttttatttccattaaaaatcgcaaaaaaacttttaaaggattttttcgtgaaattttcttgttgttagaaatttttagtaaactttttttgaaaatttttaaattttcggagagaaaacgtacggggaggaggacttaggtcgctaatcacgaatctgacatgtattttgactaatttctaatccctaacccgaactcgaataaaaatcgaaattttgaatttttaaaattatgatttttttgttcaaatttagattaggaaatcggaattgatcaaaataattgaaggattcgtgatcggggaccccaaaaaccccagagaataaatttttatgactatcacaaaaaaaattttgcaaaacaaaagggtcccccccttttgaaaaaattttcaaaatctgtcactttgcatatagtgccaaaaaattaaagcaaaaaaaaagtaaataaaataaattttttcataaaaatccgggattcccatttaaaaaatcggcgatgaaacccatgtaaatttgtcgaacaatgtaggcttacccgagtaaagtgggtactgcggaatgggcaccagaatgccggccttttggccacccgtgccgatgttgggccggacgaacagcttgagcacgttgcgaatggactcggacgcaccgccggagatgcacacactttccggatcacaggggaaaccgtcacgtctaaagggggacggacggacattttgcactgaaacccgtcgcaggcgaaattttttttttttttaataaaattaacggcgaacccttaattccgttttttatgtatcgttcacaaacatatagaaaaaaattttcggtgggtcaaaccaatttttttttttttttgctccgggttaaaactttttttatccaatgtgtcatcattgttcggaaaattgagcgccgggaaaaaagtaagaaaatcttagccgttttcgttgaaaactgaccatttttgtctttttggagttaaatttccgaaaatatgacaaaattgggggtggtggccgataggaaacaaaaaaataattgatttttaaaaaattcaagatatatttattagaaaattgtttacttgattactttgaaatagtaaaaattctattttttctaaaataattttgttggaatgggggcaaaggaatgaagtgtttgttacatcccaaatctgagagtatttcaatagaattttgtcaatgcgaatttcaatttttcggtgccactacctttccacaaattgggccacatgctgccggatcaggtcaatgccggtgctctgtgtgtacgcgccggcactgccgccaccgcaggcgcgcaacagtgaggccaccttgcgctgcacgtcctccgggaacaggttgggctgttgctgcaaaaaatgttattttagtcaaggttttttccggaaatcagcaccgccgggcgggtagggaggggttttacccatatttgcggcccgagctaaatgggagattttcggcccggacatttacaccccattttcttaagggtcattatccgtgatactttgcagagtcccaaagtttttcgcatatgcttactaaatattcttcgtagtaaacatatccttaaaagagcgctataattataaaaatcgacgaaaatcatatgtgaagtaaacctacttaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaccaattttagcgcatccaatcaattccttctacaatcgcctttatacatcccattatgagcgctaaattatcagagtgccgaaaatcgcatgtgatctaagcctagcaaaaaatggtgtaagtaaaaatcgtaattacgctcaaaaagctcctcaaac

SEQ ID NO: 8405 - DNA, 2429 bp, Heterodera glycines
ccccccccccccccctccaaaccttgatcagtgcgggctccgtaatgccggcaatcacttggcgaatgaaagtgatcggcgtctgtcccatggcatgtgcgtcgccaatgttcgctctgatcacgctggggaacggcaacgactaaattggattgatttactataacaaactgatcaataaaataatttggaagaaaaggcgccgccgccaaaattctcatttttaaaaaatattttcggacaaattttttgcggagtcggctgaaataaacataacgagcccacattttttgttcgacaaaattgtaagtaaaaatcggtgcgtcaattcagtactaaatggctctcaacagcggactgggagaaatgggcgccagctcggtttttagagaataactcctttcattgttgtcctaattgaataaatttgatagcattcaaaagcaaactaattgttcctatttaccttcaaaattttgaaaaatttggttacgtttcaaaaaagttacgaccagaaaggttttgattaaagtttttttggtcatatgttttgggaaacttaccaaatttttcaaaatttcgtaggaaaaatagagaacattcagttctatagaatgatatcaaattcattcattcaaaacgttatttccttatgaaaatttgtaggccgatctctagcaatggtataaaaattaaattaaaaatttcatggcttcttatcacccctctcggatgaggaattaatattcgaaaaagcggaacctctttcttggccaactgcttctccaattcaaccgcacggataacaattgggccacggactgcgtattcctagaaaaaaaatcgaaatgtaaaagaatttcgattttttttttcattgaccatggtgataacgttggggttgatcgtgtccacggtgagcaccttttgctgctgcagtttgtcgctggacgacattgtccggttcgagccgaccacagaagcttggcacaatttggtcctgttcaatactgaaaaaaatggaaaaattcaatgaatgccacggtgttcgctttttcatttcgaaggatttgggtttaggtttcacgaactctccaaaaaatttcttaaaaaatatgccaggaaagcaaaaagcctaagggatttaattaattagttaattgccatttatttattcaaatgaaaagtccaatagaaaggacgcaaaaggccgcttactctttgggaaagacgtggatggtctgggaaacatagtgaaatgtcaggtctccaacaagaatctattcaaaaatttataaatagggttgtaaattatatggattaacatattttttctgcgcatatgctatgaagaaaggggcttaaaaatagcatttctacgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttgtcctttttagtccatatttcgggcttttttagtccatatttaatgtccatatttcgcgttttttagtccatataatttacaaccctactgatgatgaatatataaatcgctacagttgtatgtgttttctattcaaaaatttataaaacagtattttctttagaattttaaaaaataacaattttctaattattcctggcggattatttctttttttttaaattagaggaatataaacgtcggattcggcttcaaagaaaagctttttggaggatgtttgaaacatgttgcctgaaattcctatcccatttattagcacgagaaatttccgaaaattctattcatttttcatattaattgaacaaatgataccaagactattttaatttgattgtgtttaagaaaaatcatgaagagtttttatcgaaaaatttatgttcagaataatgcaaaaattttcaaatatatttccattttatacttaagaaacaatcaaaaaataatacatgtcagttatcg

SEQ ID NO: 8406 - DNA, 1666 bp, Heterodera glycines
  misc_feature (40)..(40): n is a, c, g, or t
  misc_feature (48)..(48): n is a, c, g, or t
taaatgcatggggaaagagttctattttcaacaaaaaatncggaattnttgggcaaaaaaaaagctccggaatttcggaattcaacattcttagtaaaaaaaacaaataaccaattttcacaatttatgtattttgtgtttgtaccaaaaagttcggctcattaagggatttgtttgaaaatttttataaattttatttaagaaattatagtgcgattggtgcatttgtagcagtcagggaaattattatttttttgaaaatttggtgcgattaaaacacacaagccatgcttattagtagataaattacatacatagcaacaaaaaataagttctatatcgcatttattataaaattattaaaaaacaaattttagtggacctacgaaaaaaaaaaattatttcgaaagtcaaaacatatatttccgaggacttttatgggtcgattatcaagaatcaggcatcctagacaaatactgaatcccgggctcgaattcgaacaaaaagtcgaaaatttgaatgctcgattttgtttggactaaaaataatttaaatattttttaagtatttgtgtgatttcaatttgtttccgtaatcctcttaaaaatatttcatgacttttgaaaacaaaaaagatttaaaaaatcggctcaattaaactgtaagcatcggattccagtaaattgttaaagtgccaaataattattttaatttttgtgcccaccttgcacagtccacgtggtcaccctgcgcggccatgtgcagcggggcaagtccattttttgttttggcagaaattggcgcaccacgttccagcaacagctccacaaccgtgtcatggcctgaatgttgttgtaatcggaatcacaaattcaggcaaaaatagctctattttgaggaccattgggtcaaaattttaagaaaatatatcagaaaaaatacggtgtcgaaatgcggcgatggtgaaaaatttatagagcgaaatttttttgattggtttacacaaattctcaaagtttccttaattttttgaatttttttaaaaattatttcgggggaagaaagtggcagagggatccctatttccctctggttagggcccggattataccagggatgtaatttagatgcctaaagtgttggaaaccgaaacacacaggctccaatgatttcgaatttgaaaattccgacacgaaaaatcgaaattcagattcttcaaaaaattcggacatcgaattccgacccaaaaatgttggaaatcgaatttcggtggtgttatatctctgagtcataataacattactatcaattcctggtaaaaacatttattacacatttatcttggtaacatttaccgctacgcgccgcgcagtgcagcggtgtgagcaggtcgcgcgtccgacagtcaatgatcgcgccacggtccaacaacagttcgaccagcttaacacgaccccatttggcggctacatgaagcggactgatgttgtgacgagccttacaaaatcatagtacatatacttgtaacaagattatgtattaagaatggtccaagaccatcgggcagaaatatcgggcttcgcgggtggggatgcaaatttccgaccaaatttgccggggattttttggggggatcatcaattttttgcaataccgtattttctct

SEQ ID NO: 8407 - DNA, 4306 bp, Heterodera glycines
gcggtatatatactcacgggttctttcttaatttgtaagaaatattcgtggtttcaaggcaatttttctttgtattccttataaagtattaatttaatagtttttttctggcatttctagtttttcttcctgggcccacctgaaagttcacattggcacccttttcgatcagcagctggccaatgttctcgttcccataatgcgccttcaatatttttttgtaattaatcatttaaattgtaaaaaaatagggattaaatgtttttagaagatgataaataagttgattttttaaaaagtataatttgttttatgaaaaatataattatcatataattatagaagaatgtcatttttttgcttctcatgtttaataaaaaaaaaattgtataaaagaaaccgagtatttatatatatatacaaaattttttccataaaattcgctctttaatgcattaaatccgtttttattaaaattaattgctaaattagttccattattttgtgtgattttgggctttttctagatgtaatttaaaaatgtaagaaaaaatcagagatatttatgtaaatttgaaacaaaaatttttcttcataaaattccttaaatagttacaatattttaatcaactattttttaaattaattccatattttgtgtgattttcggctttttctatatgataatttaaaaattgtgtaaaaaatcagagatatttatgtaaacaaaaaatttttcttcataaattccctcactaattttaaattcattttttaaaattaattgctaaattatttccattattttgtgtcattttgggcttattcatatgtgaataaaaaatgtataaaaatcaatttatttatataaatttaaatcattcgcataaatattccctctcaaatttatattaatttaataaatttaaattcatttttaaaattaattgctaaattaattccattaatttgtgtgattttggtaaaaaaaaaaatcaaaaaatagttatgtaaagaaactttataaagcaaaaatacatattttgcttcataatgtttgtctctctaattgcatcattttaatcactttaaatccattaaaaaaaattaattccattattttgtctcctaaataccgcaatgtgcagcggggtgaagccgctcttcgacgtcacgttcgggttctgctcgctttccagcagcagcgtggcggaccgcacatcgtcctttttggccgcaatgtgcagcgcgggcagcttcaccttgctggtgttgtcgttctccagcaacagcgccacaatacggtcatggccctgctgcagcgcaacggccaacggtgtgaagccatcctatggtgaaaaaaagggtaattagagagagattacggtggtggatttggcccgtgtccagcagcagcagcagcagcagttgaaaagggtggcacatacacccaaaaaattaattcgccattttgggcgcctattttcaggatttccggaaaaatccttaacaaaaaaaaacaataaaaaatgcttctaagtattgaaaaattttctcaaaaatttgattcccgaaaatatttgttttttcttgataaaaatttttggtttaaaatgtgtccttattcgaaaaaaaaaactttaaaatcttcaacaatttcatttaaaattgaaatataatcatgttaaattttttgattaagctttatctgttttgataaataaaaagggtttaatttttatttgcctatttagcgatttttctgcctttttaggtgtctatttcgtgttttttttttgtacctaaaaaacgaatcgctccctaatgatgagttactgaaaacaatatttgttggcaaaatcattttaaattttattccgcttaaaagttgtctaaattttccattgaaaatttttctctggatttgtggtgctaaatgccgacaaacagtaacattcccatttaattaaattataaaatgctattattttcttcaaaatattgcccacctctgtggccaatgcctggttggctccgtgggcgagcaggtagcgcaccaccacctcatggttctcctgggccgccatgtacaacggggtgaagccgttcaccgactgtgcattcacattggccccatgttcgaccaaaattgtgacaaccttaaccaacatttctcggttgaatcaaaggaagtgtctatttgaacagatgggctggcactcataaaaaagaagaatcgaatttgatcaatggcattgcaaaaggcagaaaaaaaaatattgtagatactaattgaatgcattgattaaggaacataatcagtggcacaaagaaatcttactgagtttgggcatataaaaattttatggattagcgttcgcgctccaaatttaacaaaaatggatagggataattttataaatttatttattttatttaaaaaggtatttaaattaaattttattcggccatgaaagtcccattattttcaaaccttctgaacgctttaatgtccccttttataggtttaacacaaaatataaattaggcaaaaaatttattccctttgcggggagggctacaaaattgtggaatcagctggataaagaaatcattaaaataaattctttaaatcaatttaaaactaaaattaaactccttaacgtataaaatgaccggaaaagtgaattatctctttaattcaagatattatatattttatatagtgatttggtttttattaatcattgacctcattcttatatttaattttgttgtgatttctttttttgtttaatttttaatccatattactcgaggacgatttaatctatgacacgtccgcagagtaagtggattactcccttttgtggacttttttctttttttgcataaaataaaaaagaattgaaacaataaatttatttgggtcattccaatcaaaaagtgatgccaaaatccaatcaaaatttgtggattaattttcggaaacaaatttattggttgagaaattttcttctcccccgccaccatattgttccggatatattcgccccaatcgcctcatcatttttcgacacacatcactttcatacaaaatcatcaaaaaaaattttgtttccattttttaaaacaaaaaataattcctgaaaaacgaaaaataaacatatttgatcaatttaaatcaatgaaaattgaggataaaacattgttttaaacatgataaaactaattcatttgactaaatttttaaaaaatctgcttccgtttttgaaaacacttcgtgaacagttaagaaaatgtaatgccgaaattaagcgctgatttttcaggaatagccatcctatattttgggtgtccgaacaatccatcactggacaatcaattagttagtggacaatcccgtcagcaaattttttttaaactattaacaaaattttgcgaaaaaaagtaagaaatgttataaattttttttacataaaaatatggcatttgcaaatacaaattatgctgacggattattgtccactgatggattgtccgagagctttagttttcaacagaaaaattttaacttttttcaccctccgcttctccaactttttttagtctttttttttacaattttctatccttattatatgcaaaatttctcgctcattttctgccttcaataaatgcctcattaatttctcacgaatttcagggaaaaaaaaagttttttacgggtgaaggtacacccaaccaaaacgggaaagtaaaagtgcctctgcgcccgtccgccgccgccaacgtcgtcatttagctgctggctgctctgctccaaccccaacaaatccaaccccaaacccatcacattagtgtgtgtagatggattatttggcggcggcgtcaaaatccggcgcaccaaaccaaacgcggatttcacccaccacagcaaacaacaacaaaaaaaaaagcgacgctgccgccgcgcagcggtgaaagtcatatcgccccggggcatcgccaccgcgcgggaatatatgcatttttttgttttgttttcgccatgcctttcttttgtcaccatttttgaccccctaggggggggaaataatgggcgagtgaaaggacttttttggggaattcactttcatccgtccaccgccgccgccgccgtgcctccgctatatccgcaaactgaaattccttccccatctgctgctctgacaatgagcagcaggtgattcgatttcttgggctttctttggcgtccgttttgtgcactacatatgtagcctagagctctagctacatacaacaa

SEQ ID NO: 8408 - DNA, 1986 bp, Heterodera glycines
ataatttgtcactttcttcacaatttctcatctgctgctgtctctttttatgttcatcactgacaaatgctgaagaagaaaacatggtgaagcaggaacagaagcaactggtgatgaacagaccggacattggtgaagggggacgaaacaattgaaaattatttaatttaaaaaagctaaaataaaaaaaaatatttttcaatttttagttaagcagtattattgtattgtaaaaaattttccaaaaataaccatcttttttagtttacataatagaaaaattccttaatttaccttaaaatattgctttttacccatgattttataatttaattaccattaatagaaaaattaaatttgaaaataaaattgttaaaattaaaaaatatcaaatcatttatttaaaatttaaaatcattaaaaaaaatttttagccttttgcgaagggtcaatcagtgcattttttgtaagcggtaagtcattatcatgaattaattatttaaattaactttaattatttaaattaaagcaaatgtcagcgtaagaggggcgaatgcatcggcaacaattctcgaaagcagtgaacaacaatgtgccaaatattgtgcagacaacagggacaatcggggcagaacattattgtgtaagttctgaatattattttttaattaatttctatgggtaattttttaattttcttttttaattattttttttttgattaaaataatttatcatagttcatagattaaaaaatttaattggctaaagcaaaattttaaatcagcactattttattattgaacaaaataataaaagtttaatttaattttaattttgttttttaatttaatagaaaaaagaaatataaattatttaaatttttaaaatttttttaggtggttccgcactttacgaaagtgacacgcgtcagtgcaaattgtaccgtaaatccaggcaaatttttagcaaaataattttgtcacaatttttaaataatttaaatttaagtgcacctgatggcgaattgaaacgctttgcagagaatggacggcgatattatgaaaaattttgtttgcccggtaagcaaaaataataattaataattttttgaaataattttgttctaagatgacgtgccaatggattgcgcattcacacattttgcccgtgtggatgaccacattttgaaggggtaaaaatgggatgggagtaaaccagggatggcacggaattccgaattccgacatttttagggtcggaattccgatttccgatatttttggggtcggaattgcgatttccgacatttttggggtcgtaattgcgatttccgaaaaaattttggacttcggaattccgatttccgacctttttgggagtcggaattccgatttccgacatttttggggtcgtaattgctatttccgaaaaaattttggacttcggaattccgatttccgacctttttgggagtcggaattccgatttccgacatttttggggtcggaattgcgatttccgacctttttggggtcggaattccgatttccgacatttttggggtcggaattccgatttccgacatttttggggtcgtaattgctatttccgaaaaaattttggacttcggaattccgatttccgacatttttggggtcggaattgcgattaccgacctttttgggagtcggaattccgatttcgacctttttggggtcggaattccgatttccgacatttttggagtcggaattccgatttcgacctttttggggtcggaattccgatttccgacatttttgggagtcggaattccgatttccgaaaaaaaatttggacttcggaattccgagttccgatttccgaaattttatataaaaagtcggaaatttacggaaattttttttttgaatttttttcaaaaaaattagcaattttgtacaaattctgttaatatattgcattgaagttttcaattttttt

SEQ ID NO: 8409 - DNA, 3323 bp, Heterodera glycines
gcagcggttagttgccaaaaacggaaacattttaactcaaacgagatcgtaattttgaaacccgggaacgggaactgatcttggatttttgacaagaaacgccgttctattgtaccatggccgcgccggaaatgtggattttaggattcgataaaatggccatcataatgaaacaaaattcgacgttccaaattattccttgttggaatccgcttaattaaaagatatatttatttgttaaatcctaacccaaagcataaattttcgaattgcttactccctccccaacgactgagcttttttagtgatagaaatatgaaaagggaaggaataaagtttttcgaagattcaattggatttcaaattatataaaaaaaaatattttttcaggaggagtcctttcgcgatccgaccaatttacaagcgaagatccagaagcatgatgcttttgttgcagaagttcaggtcggaaactggtgaagagaatttaattaattttggattgaattttcaagaaaataaatatttaaaaggcattcctttaatgattcatactatttaaaagtcagcccaaaattgtttttttcatcttggagaatttttttattgttcgaaatttttgactataaattttcatataaatttttcgtaatttatttttaattaataaaataatatttaacattttgtgggccaataaaaatttttgaatttaaattctttaagcttttctcttttttgtttatttaagaatttaacaattttttcttcgaaatttggtaaaagttcttttaaaaattgctttcttggcattttgtctaccgcctctttaaggcccattcgaacgcgatcaccaagctggacaagaccggcaacgacatgatccagcatgatcactacgagaaggaaaccattcgcaaacgtttggaccgtcttcatgagctgtgggaccgactgttcgccatgctggagaacaagggcatcaaactgcagcagacgctgaaactgctccaatttgtgcgcaaatgtgacgagatgctctactggatcaaggataaggtgaggggggaattgatcaatccaaggcttgatcaagaactgatcagattatggttgattgggttaaaaaattgattatacagaactcatgacatttccacagtgattaggttaagacttgattagaaatgactgatcagttttggcttgaccgttcaccgggggcttgatgaattgcgctaattctgatcagacacaatgaccaattaatttaatttcacaaaaaaaacatatcgataagtacactttttgatagaatatttgccaaatattaagactaatttatttgctaagttcagattcaattcgtttccacggacgacctgggcgccgacctcgaacatgtggaggtgatgcagcgcaaatttgacgagtttctaaaggagttgaaaagtcatgaggtatacgattgcctgcgcctttttaaggcatttttttatttttgtaaatttttaaaaatatttcagtcccgggtcttggacataaaccacgaggcaaatgcactcattgacgaaggccatccggaacaacagcaaatccatggcaaacgggacgaagtgaacgaggcatggcacaagctgggcacactgacatcaacaaggtgggggaagagagtgcacgacgtccccccgcccttcgaataagaaaattttaaaaaaatttcaaaactaaaaatagaaaatgaagaaaaatatgccaaaaatgcaaaagatcaaataaatttgatttttttgaatatgcgaaaataatttcaaaaggattacgaattgtatttttagctggacgtctttttatttccatatttttgtaatattttagtttttgtccatttttccgtacttgaaatccatattcggcattttcacaaaaaattcgaaaaatagacccttcaaaatggaaatttttcaattttttggaaataggcccctaaataggggactcaattatggaattcgaattaatcgtgtattaaaatgacttttttcattcatacaaattaccagggcttccttttttatgtaagaaaaatcgcgaaatatgtaaataaaatattataaaaatgctaaaatatgtatgaaatatgtacaaaaaccaagaaatatgtatgaaaatatgtaaataaaatttttttaatgtttattttttggaaaaatttctcgtaaaggggtcaaataggctcaaaatgccataacaatgacctaaataggcttagaaatcaccttttcatatcttaaaaattaatttttggtatctcacatttggaaaaaactgattttttggggtacattatcaaatttttttttaaaatttttacaaaaacttctataaattctcaaaaccccaattaaatatgtacaaaaaaatgaaaatatgtacgaaaaattgcgaaatatgtatgaaaagtccaaaatatatataaaaatatgtaaatatgtaataaatgccggtccctagtatcagccagcaaaaaattaatagagatattcctcaaattttcataataccaagcaatttaacatttatatggaactgttgttttagtttttaaagcggcaaaacttaattaaaaattccaaaaattaaaatgcatcgcttaaatttggcttaccagtcgaaaaaagccatgcgtaagtgccaacaatgatgtaggttttattgattctgacaaattgcattgagatgtaaattacggcggaaattgaatcgaacaaacttatgataagcacttggagaaacgactaaatattatttataagttaaattaaatttttttttgtaatagaattaaatgttattacaatggaaagccattttattagcaaattttcaagtaaaacttttttttgttcttcggtccctaaaatttttccaattgtattgttcaaaaataacatttattgagttttttaccaaaaattaattatttattcatttcgatcaggaggtggttggaatcacccgtttctacccccccccccccccccgctgattacgggcctgatgactttggcatttttcaaaaatatttatttaaggggagaagcgctgttcggtgcccagcaaattcagcgcttttaccgcgatatcgacgaaacattggcatggatgggcgagaaagagcttacgctggccaccgacgactttgggcgcgatctgaacaatgtgcaggcactgcagcgaaagcacgagggcaccgagcgcgacttggccgcattggagtcgaaggtggcacggcacggggaaatttgatcagtgacgatcag

SEQ ID NO: 8410 - DNA, 1697 bp, Heterodera glycines
ttattttcaaaaaaaataaataaataattttccgtttggtgagggagtggcgggaattttccacgctgttttccgcctgattacaggcctggtgattttggcaatttttcttaaatatttatttaggggcgaagcgttgttcggtgcccagcaaattcaacgcttttaccgcgatattgacgaaacgttggcatggatgggcgagaaagagcttacgttggccaccgacgactttgggcgcgatctgaataatgtgcaagcactgcagcgcaagcacgagggcaccgagcgcgacttggccgcattggagtcgaaggtggcacggcacggggaaatttgatcagtgacgatcagaacattgttaacttgaggacgtctgatcagtgcgatgagaaaatgattagtgcattattcagttagggatggtctgatccatacatggacaaggagggggggttagaaatttctaccaaaaaaaatatcccccacccccccccccctcagaggccaaaattttaacgaaatgcaattcaaaatcataaaaattttgggtttttggcacaaaattttgattatttttttcaatttcgtaaaaatttcccatctttaccagtgctttttaggttttggccgaaaattttacgaaattgcctcggacccccgtacgatttacgaaattgaccccccccccccttgtccacgtatgcgtatgttctgataggcacaatgatcagaaacatgatcaatgatgagctgttcagaataagtctctctgtattatataggaacggggaaggcaataaaatcacaaaagatggcactaaatgttttaggaaagggcaaagtaatttaatataattttcctacttttacccaagatggacaaactcggcacggagacgaaccacttgtgccaactgtacccggaaaagtcggaggacattgccgcgaaggtggacgaggcacgtggccggtgggaggcgctaaagctgagcgcagagcagcgcaagcggggccttgaccggtcgtacaacaggcaccgcttcatggccgactaccgcgagttggtcgagtggaccaagggcattcaggtgatcgggcacagtccgtgccaaatttgatttttactctggtattgtggtttttgaataaaaatggtataatgtaaattatctgttgagctgaatatttggcatacacaatgcatttttgtgatttggtttctggcaaagaaatcttttcacagatttacttaatctttaaatttttccggctgcgcttatcttttctgccattcaaatccttccattttcgaagaaattttgaaaaaatacccaggaaattttctgagatgaagaaaaataaacgtgttgagatgaattatggtgatgaatataaaaaatgtgagtattataaatgagttttttagttttcgaattagtttttttcaaaatttagagctgaaatttaaaatcatgttttaccttataaaatcaaacactttggttttaagaggatttataagcgttttccttatttattgtaattaatcattgttggtctaaatatatgaaatgttcatcttaaatttttccccatttggctatcgcacacctaagatttgtcgcatcggtaattttatcggtactttcctgttttgaggccacacccaaaaatttaaaaaaatcaacaaaagg

SEQ ID NO: 8411 - DNA, 5524 bp, Heterodera glycines
taattatattttctcaaatatgggtttaatccaatagtcccttaaagtgcctaattaagccaagaaaatgacccgcctttggtgtcggctaaatagtgctcaaagaaaaagcggccctttcgtttcagttcgatcagatcagccaaagggatggcacgcaaaatgaagtgcaattcgggaaaacgatcggccacaatttgaacggtggccaaacgccaatcgatgagacgggcaaagggaagcgccgccgggcgatgggaacagaggacggggacggaccatgaaagagaagaggacaaatggcaatgattaagcaggcaataaaatgataatgtaaatttatatggaagtagaaaagtgcaacaaaaccgtctgatttttaaaattaatttggtccataaatttaccggtcagcagagactcgtaaaacaattcttaaaatttaaaatatgttattaatgatgacgaggaattggaattcgtctttacgttggaacgatggcatttcggggaacaaaagaacggtgaagacggactgacggcccatgcgcaaccgatcatccgcagccgcgtaacagaggtgatcagcagaagaagcggaggaggaggaggagggacactccaagtcgatcagatgggagtcgcgggaagagtcccaaaatgagaggaaaaaggggaaaagatggaaacaaagggtgatcggaatgactgagtttgtgatcaaaataattaaaattcaactattatttcagaaaagtcaaatgatttgacagagaaagtctcaaaaattcctagcagtatccattgtttaaactcaaaagcaaagaccaaaaagcatttgctttactgcactaaaaagccaccatcgatgttttgagttgggccaaatcgtccatttggcgccggctgagcagtgccggattggccaccaaacaaacaaagtattttcgcatcaccggcaacagagggggcaactcgcgccaacggtcgacgctcggcgccggcacattcaaatggagcggaagcaggcgctgctcacttttgcgaaagagaagagaacggtcagacaatggcggagaaagaaaagtgtgccaaaaaacaaaatacggtacaaaattactgtaagacaatgttccaaatttcctttttgttctcccctaagcgatgctttttcctttttgcttttacagcccccccccccccgtgggggggaggtcgaccccattcagcagcactgttcgaccgacctgcggcgcattgccgcgtgagcagccggccgtggcgtgaccaccaccgccgcgcccagcagcgaacggtcgacggcgcccaaatgtccgtgcaagtcaaacaccttagaattaagccatgagcttataatccatcaaaaaacagcagagaaatgatcccactcaactcatacaaacagactgttaattttgcattcaaaactgcgaaaagatatttgcatatttcaaatattctctaaggagacaaacaacagaaccgcatcagaacgaatgaataagacccgtagattcatgttatgtgcgaagccgcaaatgttcgattttggcttgggccgtaaatgtttgaatcctttgaaaacggcactttcgtgccaaattatttttttaatttcgaaccgacgaggggcttagcccattttgccaaaatggcattttcaatgccccgtgccaccattcgtattcaccaaatggtttttgcctccactgatggcaaagtgttggcggaacaaagtgccttcaatgcgatgcttttccccttttgccgttgtttttgtgccgttttcgtccgccctcgccatttgtcctccatcgtcagcaacagtgtcaatgatcgaaacgaacagacatgcatttgctgggatggcggtgatcgacgcaatttgttggcccgaaacgaattggcgatggaattggtcggccaaggcggaggaaacgggggaattagcggtgccgttgatggacgacgacgacaaaggggggaaaacaaacaaaggcatcgaagggatggcaatggaacagcggctaaaaaggggaggggggaaaggatggcaaattgaaaaaagcaaaattcacaaaatcatttttaatttaaaaaaacactaatttattgttagcattgcccggcgccggtctgggcaaagataagtctggtgatagagaagtaggcccagatccgggaaacatttatttctcaaggaaaacggtgcattttttgaaaatttgcgcctataattttgaaaaaaatctgtaagaattcgaagagcaaaaaatcttcgttttccccttttcgagattattcgctcgttgcgacaaaaaattgtaaaaatattcatatgctttcatagcatttggtttttttttgtttttcaggtcctcaaaaaaatcccatcgcgttctgccgaaccatcaaaataaagagcagcatcaaatgatggcttacaattagctatgctatgctaatccctctccccctcggcacttaaaaattaaaaatggcacacctaaaatacgaatgggctttctgcgcgacattccgccgcctgtcagtcctctcgaaagtgttcgcctctctttggcggagagtgtggcaattgaacgcgtacagcgcgactgtcgctgtactctctctgcaacaacttcaactcctccactcgcagctccaatttggcaagttcggcctctgaaaagggcacattttgaaggaagaaaaggggaagaaatgaaatattttttttaattaaaaaatgtgaaaatttgtgaaaatgtttaaatttgcagctcattggcctcgaattggcaatgccaaaaagcgccgctagaaaaatcattattttagaaatttaaatttgtggtgcgatttgcaagatggacgaattatggaaaataaaaattttacaattggttgtgattttgttaaatacgttagggaaacttttgagtttttaattggattttaaagaggcacaaaaaagccaaaaaaaaaaatcgcacctttctcgcccattttcgcttcgattgcgtccattttcgcctgcgcttcgttcagtttggccagcaattcgatgtgctccctgcgcaccgattggaaaacgcgtgcctccgtctccgccggcacaaaatgcccgcgccaaccatcggcacattggcaacatttaggcggcaccgccaaaccattgccatcatcgccaaggccatcggagttggcataggacgaaaacttgctaagaaaatccacaaaattagaaaatattgatcgaaagagcgataaacttaggaaaaattcggtggcaatttctgttggtcataaaagttgaggaaatgcttttcgtttcccattttgtaattctctttttggccattccgttgaaaagcgtccagttttgaaatggaattgacaaatttgaataaaatcaattggcttgagacacactaaatccgaaccccaaatttaaaaaaatcacccgtccgacccatggccattaaaaatgagggcccatttcgacggaaattccaccaaaagtgccaaaacggtcagcaggagaaggcagaaaagcgtaagtgccaatcggacaaaaggccgtcggccgaagaggagtcttttgacgagtcggcagtggcctctgttttgttgcagcattgtgcacaataagccattatttgtgtacatattacaattaaattaagaacaggcgcggggtaatactttaccgtaaagtaaccaaaaattttatatatgactttcatcaagtacttgattttttccaaaatttttaattctttaagtattttctttccaatgagcagggctgccaaaaatatgcaaatgcatatttttttcctggcttttccatgctctaaatagtaggaaaaacactttcttttttgtgtttgcgtataaaagtctggacttttatttgcatatttgggtttttctgcatattttgccattttttgtgcatattttcagattttttgcttattttgccattttttgtgcatatttttagaattttttgcatattttgccattttttgtgcatattttcagattttttgcatattttgccatttttcgtcaaatattttccgatttgaatatcccttcggaaaaaaattgattgcctaaaattaaatccaaatctgaatgggtgcgcgagtgggtcaactgtgagcttcactgccgaaaaccttgagaaatttttgatttgaaattgcaaaaacaacctgtaaaattatgaggaataaaattttttaaattaatttacactagagtgcatcgggaccgggaattcccggtcctcagaggtcccggtcccgggttttgaaaatctcaggtcccggtagggcaaccaggaaccgggaaaaacaagcactggtaagaatgggggtctgagtgaaaaattagtgatgaatagggccgcaacttttagtgacgaaaaatctcgaaatagttaactaaaatagtgagtaaaaatgccaaaatagtgaagaaatagtgacaaatagtccgaagtagtgacataatttttagccaaaaattgagcaaaaataatttttattcactgattgcagttgcaaatgaggtactttccaaattttgaggcaaaaaaacgcatcagattaccgaataaaaaagttttgtaaatagagaaagtccgttcaacatcgcaagaagtcaggggcgcgaatttgtagaacggaattaaagtgggcggaacatcgcaatcaacactttttccggaaaggatttggcaaaatttggcaatttgatcaaatgagggattttttgagacaatgaaagagattttttggctgattatttctgctttctcgccggctgctttgtccaattggttgtgaacgtccgcaaaaatttccatcgattcgtttatcgacagtccatgtgactccaattttgcaatggcagggcataaattgccaaagttggtgtgaatgtacgcgaggtcttgccatgttgacaaagtgaagcacgactgactttctcttatgcatgatgcatcagttgggtcgaacgagttgaccacctaaatgcgtaatcctaaaaaagcttaatctttcacatacttccaccgagtccttcgttgacgaaccgagcaattgccgcgctatcaactttctccaagcatttgacggaaatcaaatgtggggtgtgccatttttgtccatccaattttccaatcagcaaattggccaccgctcttcccattttgtctgttgtttcgtccaccgaaatccaaacgaaagagtcgccaatattgttcttaattttctccattgtctaaaattaatttttgttattggtttgtttttggagtgacctggtcacaagttaaccgcaagtaatttttttgaagagtggttcgatggggcatttcacgcttacaatatttttccaaaaaaattttaaatttttcattctccaatttgtggaaaggaatgttagctgagacaaaggcttcacacaaatcaaggttgaa

SEQ ID NO: 8412 - DNA, 935 bp, Heterodera glycines
gaagcatactaatatggtctaaatacttttgatcggtcggttcatcactctgatcgaataccgttaccattcgtttaattgctgcatcattttgttttccggcctttttcatgtatgctgcggcgtccgtgacaagtagtaaaactcgatttttgtcaaacccattcgaaaaaaattatctaaagagataaaatttatttgcctcggtttggtttttaccgagtgcttcgttgacgaaccgagcaattgccgcgctatcaactttctccaagcatttgacggaaatcaaatgtgggttgtgcgatttttgtccatccaattttccaatcagcaattggccaccgttcttcccattttgtctgtcgtttcgtccaccgaaatccaaagaaagagtcgccaatatattttctaaaattaattactgtttttgttttttgaatgaccttgtcaaaagtcagccgcaagtaatttttttgaagtttgtaacgatggggcatttcccgtttacaatatttttccaaaaaaattttgaatttttcattctccaatttttgaaaggaatctttgctgagacaaaggcttcacacaaatcaaggttaaattggtttggaacattgtttggtgttgtcaaaaattgctgctgttgtcctccattgttccgttccaattttgctttgtgttttaccgtttcgttgtgttgtttgagatgcgcgaattgcgtgcaaggaatctgtgaattttttattaagttgtcgttgttacctgttgttcacataactgtcaataaattattttgccagttgttgaataaaagtcggttcctccgatccgtcgaatccatttacgaaagttggcctattttgatttaatttttggcatattttaagtctaaatttaagaatagaaaacatttattgcggtatttagttgttctt

SEQ ID NO: 8413 - DNA, 2603 bp, Heterodera glycines
caaaaaaaaccgacttaaaaccaaaaaattaaaaaaacatgttttggtcatttttgaaataaattctgttaccaatccgaaagccatttttcaaaattttttcggcggcgcctaccggcaccgcccgcccccaactgtcccggaagttttaaaaaacgcgccgcaaaaaaaaaaggtggaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctgcttggtatcattcaaaactatatgtttagaagattttataagcttttctaaataaaaagttaaagcttgaaaattgaaaaaaactcagaattttttaactatttttgttcttttcgaatcattacgaattttgcttatctgataatgtaaaggaactttcgaatgataccatgtttgtttgatttgtccaacaaagaaaaacagttatgtaaagttgtctctcagacgcagttggcccgttccgtcccgttcataatttaaatcgacctgaaatacattaattaaatgaaatttaattggtttttttaatccgggccaaagccattcgggactcaaccgtcggggcgcaaaaatttggtccgtcccttccgcattgtgtgaaatggttgctgttcggtgggacacatcttttttttcgtcacaggcggaagcgccaatttgaaagaaagggaacaccgaccgaacggcggagggacgaaagggcaaaatcgaaaaccaaaaattggtctcccgtccccaaaaaatttattattttttttcaaccactcgtaagtttctgcgttccattccattgctcatccgtacgtttttgtcccccgaaatatttgccgataagctaaaatatttttaaaatttagaaaatttatttttgctttagatttgcttattttaaagatatatttttgcttgcacataaaagggtgatttcagccttacaaatcacaattttttaacaaatccaagcatcctttagctataatagcttcttttctttaatttctttttttaaataatattctttatataatggaaaatgcggataggcgccgccggaaaattttgaaaatttgattgtgaagtgttaacagattttcaccaaaaaaagacaaaatttttgcgattttggtcaatttgttaagaaaaattgtgcgttattttttggggttgggcggtgccattggcgctgccgggagaaaaattataacttttgacccttttaaacagattttcattgaaaattgtctatttctaggttaaatttagtaaaaattaataattgttttgacaaaaggccaaaaaatttaattttttttttcataaaatctacatttttacttcatacgcaaaaatgcgatttccaagtacaatcttggaaaaaagtacagttaaacttttccaagcacaaaagccgaaatccaagtatgtacttggcattcaagtacgaatccgagccctgaactattataatgcgaaaaatactaatattttaataataaatttaataaatcagatttaagcaattgtttaattcatattcattcattatggattcatataatcactgattatttttaatcattttttggcaatttattaattaaagaattggccatccagaaacaaaaagtcacaaaatgaacgtttattcggcccaaacttattacaacaacgcatcgccagcagaagtgaaaaaggcaatccactggaattggattttgttcatcgccttttgctcggcatacaaaatgacaatttgtgggcaatcgaagcgaggcgaattcaaaattttgtaatttttgtgaaagcgccatattatccagttgcaaaaaagttattgccagatatgcacaaaaaagcgactttggaaaacttttacggacaagtttaatcttgattttcagtttggaaagaaagagcatttagtggtatcgaatatatcaagattttcaaattggttggttatgaaaaaatagacactgttaaaagtcaaaatgggtcaaaatatgaagctaattttaaagcagaagtcaatcgaatcaatggaaaattggcagcagaacagaactcattatacggagataattgacgaaagctcagagcaacagaacaataattatggacaggggcgatcaaaacgccaattggcaaattgtaaaatatgcggacgacaatgtcagtacattt

SEQ ID NO: 8414 - DNA, 3177 bp, Heterodera glycines
  misc_feature (54)..(54): n is a, c, g, or t
  misc_feature (60)..(63): n is a, c, g, or t
  misc_feature (65)..(65): n is a, c, g, or t
  misc_feature (69)..(69): n is a, c, g, or t
  misc_feature (74)..(74): n is a, c, g, or t
  misc_feature (90)..(90): n is a, c, g, or t
  misc_feature (95)..(96): n is a, c, g, or t
  misc_feature (106)..(107): n is a, c, g, or t
  misc_feature (109)..(110): n is a, c, g, or t
  misc_feature (119)..(119): n is a, c, g, or t
  misc_feature (135)..(137): n is a, c, g, or t
  misc_feature (145)..(148): n is a, c, g, or t
  misc_feature (158)..(158): n is a, c, g, or t
  misc_feature (163)..(163): n is a, c, g, or t
  misc_feature (169)..(171): n is a, c, g, or t
  misc_feature (176)..(176): n is a, c, g, or t
  misc_feature (193)..(195): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (219)..(221): n is a, c, g, or t
  misc_feature (226)..(227): n is a, c, g, or t
  misc_feature (230)..(231): n is a, c, g, or t
  misc_feature (234)..(234): n is a, c, g, or t
  misc_feature (237)..(237): n is a, c, g, or t
  misc_feature (254)..(255): n is a, c, g, or t
cttttgctcggcatacaaaatgacaatttgtgggcaaccctaaagaggcgcacncaaaannnngnaacncccgngaaagctttatagcanccagnngcaaaaaagnnanngccagaaangcacaaaaaagcgacnnnggaaaacnnnnacggacaagnggaanccggannnccagnggggaaagaaagagcannnagggggagcgaananancaagagnnncaaannggnnggngangaaaaaagagacacggnnaaaagtcaaaatgggtcaaaatatgaagctaattttaaagcagaagtcaatcgaatcaagggaaaatgggcagcagaacagaacccattatacggagataatggacgaaagctcagagcaacagaacaataattatggacaagggcgatcaaaacgccaattggcaaattgtaaaatatgcggacgacaatgtcagtacattttctacggtgtcaaaagctgtgaaagtgagcagatttgtttcaaaaatgagaaaatgcaataaaatttttaattgatttttttattattatattaatttaccagattaaatattaattaaattggaattgtcggatattgaaattaatttttgccaaaatcaattaaaatatttattttcataggtatggtaaaatgccgcggctgtcgcttggacaaatgccttgtggccggcatggacccgactcttatcaatgtgccaccctcggacaagttcaagcagttcttgaccgaattagagaagcgcaaattgagcgcaatgctgactcattcggaaaagaattaaaaaacaaaattatttgacaattgttttaagtttttgttttgaaaaactaagtttaacttaaaaacaaaaaaataatttttctatattttttgatagataattttttacccattctttattcagttatttatatttatttggctttatcaattatttattcttatttactagtattttattgcttaaacggcacttattgatcgcattttttggcaatgcttctccatagccttttctttttatgtttacgttcttttactcataaacaattcatgacaaaaaaacttcggccaatttttgttgaaatatttggcgaagaatgggcaaataaaataattggagaaaataaaaatgagactgtgatcaaaatgcaaattatcgcagaatgatcaaaatgaattaaaattttttcttgaaaattaagaaatttttgcccgagcccagctacctttggcaatgactatggcgctacttacaaagtggactattttgaaaatttttcaccttattttatacacattaaatgttttgctttaaagagccgtgaaaacatttactaggggttttttgtgtcgctaagcaccaaaatggcattcattttgacctctttcgaaccatggacccgaattcgaacaaattcgaaaattcaaaattttcaaatttaacttttgtgtttgaattcgggtcaggggtttcgaaatcactaacttacctctttagattaagctgtccaaatctttgcaatgttatggctacataaaattatgggtttttaaattacagattttttaaaaatgtgcaaagaacgtctttggacaacggatttccttaaatcttttgtaaccaagccaaattgaccaaacataattaatcatggaaaatccctgttttacttttcttgccgcagcccttttttgccatgtcaaaagctttttgccaacatttggtcatgcccaattatgcattggtaaatttcccgcaaaaattcataatcgcgcattatgcggaaatacaacaaattaaatgcctaaaaaagaatgcattttcgattcgcgtttcggtcttgcactaaaccttatttttttcttgaaaattttgacttttaatttttttaactgatatgaaaaattgtattcaaaaatcgctggaatcagtgaaaaattaattgattgtgttctgtgatattaatttttgcacaaattttgcactctggtcataaatgtttggtttatttaaattattagtttaagagtcaaatttattttgtcattcctcgatcccaacatctatgtaaaggtctaaaagttcaacaaaaatataaaatgaaatataaaaaagcaaaatattttttgtattaaaattaattttaagcactattttaaaattggacaagattatcgtgtaattttgatttataaaatatatacattaaaattataataaataatgatttactgtttgagcgttgtacgcttgctcaaaatatgttcgaggaaatggcgacggaaaaaacgtaattggacaacttggatgaaaagcctaaataggaatgaagcagaatttaatttggatttcaacaaaaaaaaatttccctaaataagaatttcaaaatggctcaaaatatcccaaaagttgaaattcttggacaaatgtaataataaattttaacaaaaaatcaatcgctgtttcaaccgacattacctttgatcaaagtcttctttaagcccattttgcacattttttatccattgttttgcttgtttaattaacttctccgtttgaaatctgcttaattgttttccgatgtcgaccgtataatcagttaccgtatattttccttaagttaatctattttttatgataaaaataatagataaatgaaattttacaaaaaatgtttttttggcagtgtgtattcgtaagcaaattacacaacataatttatattgtgcgcggagttttcagtaacaaattgtgaaattgttttgaaaattataattaaagaatttaattaaattaattttttattcaataatcatctgaacttgacgcgtcgacagtttcagcagatttatttttgggtggtgccgagtccgaaaaacttatgaataaaattaaaatcataagaatttcggggaaaattttttcaatatgcatatttactaaaatgaattaaatatgtaagaattggaattttatgaatattcttttttaaaaattctcaaaaatatacagtaaaaaatctaggttgaaaaaagaatttccattcgaaaatttattctaaataaaaataaatttataaatcgattttcttttatgctctttttataaggaaataaaattattagaccggaagcaatggcgcggaagccaac

SEQ ID NO: 8415 - DNA, 1491 bp, Heterodera glycines
ggtccccaaaggtcgggtcaccaaatgtcgggatccccaaatgtcgggatccccaaaggtcgggtccccaaatgtcggggtccccaaatgtcgggaaccctaagtgtcggatccccaaaagtcgggtccccaaatgtcgggatccccaaatgtcgggtccccaaatgtcgggatccccaaatgtcgggaaccctaagtgtcggatccccaaaagtcgggtccccaaatgtcgggatccccaaatgtcgggtccccaaatgacgggtccccaagttgcaaatccccaaaagtcgggtagccaaattcagcacattacatcaaacaagctaatgctaaaagcctatttttgtaatgtttgtgaattataagcaaaaaacattacgagaataatttttcaaattttgttagtgccggaattgtagcatttgcataatttttatttgcaatctcatcacttattttgatcattaaaatttaatataatcaattgaaaaaagctccgaaattttagatttaaagtgccttataaaattaaaatgaactttttaaataacttagttttttatgatagaataaaatttattgagtccaaaattttgtgtgaggggactctcattttttgcgggtttaccaagcgagagcggaactaaaaatttaattattgtaattaggaataaaatttatttatgataaaattttgaagaaaatccttttataaattaaaaacaataataaataaatttaataattgttcgtctcgctttctcgccttttcagcttctcgttatcgcatttttagcagaaaattgagacttttctgcactgttaagaaatgaagttcagaaataaaaattattagaaatcttgtaattattaattaaatgtatcactttaattcgtgtcaacgatattttggcaaacaatatactatgatgctttaacttaaatttcaaaatttttcccggcaatgcatatggcacagcctttccaaaaactctaaaaaaaagccattaattggccattttgggaaaatctgttaacaaatggcatttaattttcaaatttttccaccgactgcgcctatcggcaccgccgagtccatctcttcaattttcataaaaattgagtcagaagccaagaaactcgatcatttttcggacgaaatctgttggctgttctgttaagacataaaattttttgaacaaaaatagctaaatgatttcaaattgattgtaatcacatagcgctccaataattacaattcgcatcatttttggtttttttaaatttcaaaaaatttataatatggacaattgagttctgctagaaatgagcaccccagccctggtattttttttgccggaaagactgaatgcaaaccacaagctcggccataatcctattttagggatccattgttaaacctttttagatcactttataccattaagggaagagggaaaatttgaggttgatgacacatattaacga

SEQ ID NO: 8416 - DNA, 1175 bp, Heterodera glycines
acaactgttcacctttatccgattgatcgcctcccatgccaatttgtcaccggtgggacaactgagtgcaccgaacagagtaccgttcagtctgatcatgaagcagtgaatgatcgcaacaaatttcttattgttcattttaagcttgaagcggcgattaatcacaataatgtccaagtttagcaagtaaatgccacgggccaaccgaaggccttcgcttttcaccaattttgacgactaaatgagaatatttaaatagttagaccatttcaaggccatgtcataaaacgattttttgtgaaaaaatggcaaaaaaattaattggcatattaaaagcaattccttttttacccctggcagtgccacttcaaaatcagtgtctgtcccaattttgaagctcacttccgttctggtggcaccctctggagtaaaaaatggcataaattaatcaattagtaattaatgactcatttgaattaattaccctttttgacactcaatagttcaacaattacactttttatattggcatcggtaagtgcttcgatgctgatcatctgctgttccgtgttggtgaattttatcatgaaaatttggtcaacgtattttgtcggacaatttgattggccggcggatggcattttcagatcggatggtccaacggaatccgaaggttggataaactcaaaggaattaaatttaataaaatggaaacttttattaaaaattgaatttttattatttttcataaatctgggaccaaagggggaggccagggaaaacagaaaaattggcaaatccctaaaatatggtcccttattattggaatgcctttctttttacccatgcttcaatgaggcatttggagctgcggtggatgaacagctccatcttcagctgttctctttgttcttctgtttggtgtgccatcggcagcatgtcaagtccaagaagccaaaggtcggcataatccgacaaaaaagacggaccatttgaacgaaggaaatcattttgcatggcacgaccaccgaagtctgagaatggcattttgggaaagccgagaatgccaatttaaaatatatataataatttttcaccattttccaccgatgaaaagcgagtgaatggctcattacgagcagtttgattcaaagcaaaaagtacagaaaatttgt

SEQ ID NO: 8417 - DNA, 2457 bp, Heterodera glycines
atttccatatagcccagaaaaagataaataggtaaatccctaaaatatggtcccttattattggaatgcctttctttttacccatgcttcaatgaggcatttggagctgcggctgatgaacagctccatcttcagctgttctgtttgctcttctgtttggtgtgccatcggcagcatgtcaagtccaagaagccaaaggtcggcataatccgacaaaaaagacggaccatttgaacgaaggaaatcattttgcatggcacggccaccgaagtctgagaatggcattttgggaaagccgagaatgccaatttaaaatatataataatttttcaccattttccaccgatgaaaagcgagtgaatggctcattgtcagcagtttgattcaaagcaaaaagtacagaaaatttgtgttgtcctgcactcaaattatatcttaaaatatttaaaaaattattttaatacaaatttaattttataaaatgtaaaattaaaatacaaaaaaatttggtacttttgcttaaaatacttagtaacattaactgtttatttaaggaaattgatgtttccaaaataataattcttccattgttttggttattttgctttggcattgtgcgcagtttaattccacgccaaattattgtgccattttcgcggccattctttgccatattttgcacacattcttttccaagcgaattgtcctggggagaattaattaggtaatttattaattagctacccaaaatttaccattttagcttcaactataaattttcttgtaactttaaaatttctgcttttctccaaatgattattgcctcgttgaagaagtgccgggtaacagacgaggaggctattaattgaaaatataattatttgcattaattattttggagttttttcacccatcgtcacaatttccgccttcccgaggcatacgaaattcaattccgtaaggcttatttgcggtttcttttgatccattgttggcatggcattgtgccaaagtttgaatttgcacttctttgaatcctccgccgccatccgtcaaatggacacttaaattataatttgaaatgtaattgcttcaaaagtttacgaatgattagatgggaattgacaattgctgaacattaagcaaacctttaaaagcaaaattacattctcaattaaaaaagtcattgactctgaaaatatcaaatattttaaaagaaatatttattcaattatattaaattttgaaatgttttactttttaaattataaagcaaaattttattttattatagaacagaaaattgtttggaatattaatgaattctgtgatcatttaaaagtgatggcaatggatatcagcagatgattcagcattttttatggaaattaatgaaattttgtgtttttctctcgcactctctttttgttcgcacatatcttttttttcttgcatagtttttcgacctatgattactgatcatctttgatcactggtcatctgctgaatgtgccaactcagcaacaaatgacaatttgagaccattcggctgccatcccaagattcagaaatttattttatgcgcaaatcatattttgcgattttatgcgtatataataaattatatgtcctactaataaaaattatttccaaaaaatgaaaaaaaatggtttttcacccatcggcaaagccttcagagctgaggcaaacaaaattcaaattccgtgaggattctttgcggttttatggcaatttaaaaagccatttgtactattaaatactaaaaaataataattaaatatataataactaaatatttatttaatattaattgtttttcacattcaaaaatatttttacttttaacggaataaagcaaagttttattttattatacaacagcagaaaattgtttggaatattaatgaattctgccgatcagagaaattgatggatgggaatggacagcagcagatgattcaccattttgatataaattaaatgcaaaaataaaaatataattaaataaatcgtaaaaagaaaaaaacatttatgaatttaataactcaaaattaaacagtaattttaatttgcgagtcctgttaatgattgggttttaaattttcatggatacggttagtccgacaaaaccctgtaaatattgtttttcgggaaaattaaaatttcctggttggatacttgaaaaatctgttatataaatattatttacaaattaaaagaatttgcttacaaatagtcggaaaaaatggaaataaaattatgtgcttattaatgcttttcgagacaatctgtctcgaatctctccggcaatttatggctgagtgttaaatggcttataaacaattcctttcactcctaatcgattttgtatcaattttctaaatgttggatctgtcattcaaaaaacccaagatatatttaaaatatttaaataaa

SEQ ID NO: 8418 - DNA, 2073 bp, Heterodera glycines
  misc_feature (2029)..(2030): n is a, c, g, or t
cagggctggacgtaattacgaatgacggattccgtaattgaaaatccagttacgtccagccctgttgtacaggcgcacaatgtcctttcgcgtgagatatgcaaaaatagacataattaaaaattcatagttggcatttttaattcgtaggatctcactttttatcgactcgaaatgtcatttaatcttcaacatttctatttttaataaaaattatttaaaatttttaaattgagaaaaataattctcaaaaaaatgtttcctgcatttttaggacagatttttgcacttttgcaaattttctaaatacatatgccaactataaaaatagaacaaaatttttttgcgaattttttgtctttactggctattttgaagtttttaagcttatttcatccatattctgaaatttttcgtccattttttaatgcatttttggattttatttttgtccattcaaatccggtctgcgcgagaacctttcccaaatgaaactcgccaattttcgaggaaaattcaaattttaactgacaaactttgaaactttctattataatttcattaaaaaatccttccttttttcgttttatttttaaaattagacatttaacttgccttcgaatttactaaaataattttattggacataaatttgtgaaaattcacagtgtaaacattttaaaattataaatttgctttcataaatttttttatttaaaaattgaactcaatttttgagaaactttttgtctgcagttaggcgttaattgtttattctatgatcagcctgtcacctgatttcgttaaacagttgggggctgaacgaacgtgcgcgagaaccttccacaattgaagctcgccaattttcgaggaaatccaaattttaactgataaactttaaaactttgttttataattgcaattttttttttcgtttgttttaaaattttattttgttgtagtatttgttatgcataaattgaggtgaatttaaaaatgtttcttattttatttttgtataaatttcttttcaatttatttttgtgcttattcatcttttcattctttcttccgacattttaattatttttttcattctttggctttttcatcttgacattaacacattgttaaaataatgaacataaaaaatgttttcttcttttttgcttattcatcgctgtaaatcaactgcaaattgttcaaatttttaaagatgaataatttctgaatatatattttttctatttaacaaaaatcatttcaattatttgcaattaaataattataattttattataataaggaattaataatagattattttgtatttgtgtaaaaattatgcattgataaattaagtttatataaagtttgttaagtgtattatgtatttattatttattaatttcttcacattttttaccgtactattcaactccgtcaatggccaatgcttcttcccctctgaagagtaattttacattattaatttttattttaagtaatgttcaggtcgaatgccactcagacggaaaatcaatgctgcggtgaaaaagtaaattcaataataccgtatcactaggtttggtacggtcattcaagaaacgatttaagtgccaatatatgtcaaaatgttcaaattcaagatggcctacacgatgaaactgaatgagtcgtgtgcaattcttggcaaaaagttcgattgttcatttgcgtggcttttggagcggtacaaactgtcggacaaatacgcaatcaaagcgaacactgaggtaaaatacacaattaaattttaataattcatcaaaataataaaaatacttctctttaattgtaatatttatttaatttaataatccatttcaacagttatcatttctaataacttttttcttttcattttcaattactattccattttgagtgttttgtgcaaaaacctttctttttatttttcattaattattgcaaatgcaattagtaaataaacgaatcattcattttttaatatttaataattaagaannaatataaaaaatattttattgtaaaaatcaggtcaattccccg

SEQ ID NO: 8419 - DNA, 3758 bp, Heterodera glycines
tttttatggatactgacatgaacaaaaaaaaactgtgcttttacaaatttcggaatgcacccattggactgtgtcgtcttcatcccgctccctccctggcccaaaacacgaacaattttctgcagttcatctgccgccgaatcgatcagtgagccgagcgagctgatcaggaacggacaacgctggcgcaacacgtcgttcagtgcgccaaacaacaggtcccgaaaggcgatgatctcgccgatgatgataacccgttggaggagcgattcgatggcggacggtgccgccgttgcggtcgacgcacatgttgaagctgtacagacggaggaggagccgggcaacgaagtggacgaatttgcaactgacgaagaggtgaaggaggacgcataatgttggtggtgatgatggtggttcgtccgtcgattgttttccttgcaattcaaatcggaagaagacgaagcagtacaacaaccactgagttgggcaacaatctgtgaaatgtttttgtttaaaaacaaaaatttattgcacaaaaaagtttaaatttaattttaaaacttttttaaatttttgggtgttgtataactgcggcgatcagtcaaatcgctgaaaaactgatgagagcaaaaggagagagagagaaagtgagagaaagagaaagccaaaaaaagagcattgagaacgcacttctcgcagttttgccggcttgtcaaagttgacgcgtgccgcgtgcagtgtctccctgttctccctgaccagcttgaacagctccgtgatttggcttgcaatttgccacaccagccgctcctccatcgccttgatgccgtaagggccgatcagttgggcaagcgcgcgcaattcccgcgggtccgtgtaactttcggcgaacaatgcaccggcgccggtggcggcactcgtctgctgttgctgcggctgttcactggtcacaaatgcttgcaaatggtccgagtacagcaactgtccggtgctcgccttgcgcaacagcacctccaaatacctataaaatggcacgtgatttttttggcataatgtggaagagtgcagcgtcgcatggcattgtaatgctgcaatggcagaggaaatccaacaagtaccgcttctcgagaccacattatgacgagacacaaagaaaaaattcaatgaaagaaactgaaaaaccacccttgtgggttgtgattgtaagtagagtccgggactgggagttttttactgagggttgattttaaaaagtcgaaaaatttggcccccaaattctcatggcttacgacgagacgaaaatacgtcagttctcgatactaattgaatcaaaatccatttatagggaggacctctcgtctcaccattttgagtacacttcggccaatgtctcctgcccatgggcgtcctcccgctgcgattgttggagcatcgcgtcgcggaacagacacacaatgtcataggccactacaaaatgtgtaggggtgccaattttttccaccatgagtcaaaatgcggcacggaccccacaaaaacccggcaaacgcctttgttttccggcaaattatttgaaaaagtgtgaaataaaaataacccacaaaatgtgtccaagtcctgcagcgcgtgcatttgggcacagagaaatgccagcatttcggacgggcgccgaggatgcggtgacataggacaattggcggtggttgtgttgctgtcattctgtgccatcgccggcccggcgccgcctcctacgttcggtgccgtcccggacgttgtcgtcgctgttgcgaaacgtaaatgccggaccagcgacgtcttcagatgccgttccaagttttggtagaggaattcacggggcacaaaaatgtgcctgaaaatttttgggggaattaagcgatttgctttgttttttttctaacaaaaaactctttttcaaaattttcaattaaaaatgattgatttggcgaaatgtttatatgagtacgctgtagagtaaaacaaaaaatgcacttggaaatgtgaatttctttggcactgccaatggcatggcacagctcggccaagtaaagcgcggtggagtcgccggcggagacgggttggcccgcttcgcgaatgctctcgtggccgggcattcgttcgtccgccattttttgttgctgcgcaagctcacacttatctgtttatgaatagggcatatagtaaattaaataaggagtagttcaaagacaaatgccgacggaggaaaaaaagattttggctcaaatgacatacttttggggtgggccaaattttttaaaaatgtataatttttggctcaaaatgacaaaactttttgacattggggtcatatttttaaaaaaatcaagggaattcaagcttgtgccgtcataaaatgcttttgttttccaagaaatcactcattttcatttttaaaaaaaccatttttctgtctccccccccccgtcgttgaagaccaacccaccgtcattttcagctgctgccaacagtttgtaagtggcggccaaaatgcgtgcgcatgtgtgcggcgattggttcaactccatttggtgtttgtccgtgcacagtttgccaaacacttcgatgaccttcttggacagctcgtccaacgcgctgttgcacgtttttagtcctgaaaaacacaaaaaatgatgaaatatataaaagaaattttacgtaaaaaatttaattaattcttagaatttttgcaaaaaagaaacaaattctgaggtaaaagtcgctacatactttgagggtttttaattatttcaaatgatcgcggttaatcacgcgtaattttttcaaatttataaaattttcaaaaaaacagaaaattttttataaatttttgagcacctttctcaatgacaaggtcccgctcttccgggcacatttcgtgcaacgcattctcaaagtttgtggcaatgtgcgcaaaagcaatggagaagcgggactggacgggaaagtcgagcgcatggcgaagatgggcatcgaacaaatgggcatggaaactgaaagaaaatgttcactaatttttttaaataattttttagtttaagtactaaacgattttcagtgtttaattaagcattttactatatttcctatttttattttggaaatttgagtgctttttggattttttaaaagaaattttgcgaaattttttgagagattttgataggaaagccttggaggggatacgaacaaggaaagaaaatttagtcagggattcatgaaaaattgtgtaaattttaaattgccgccgggaaaatgcgttgaaaaacgtgccaataaatactgaggtcgctggtctcgcccagcaacgcgtgcaagtcgtcaatttgcttcaggtggaaaatggcggtgttcagcgccaccgccaaattggcatgggtgtgcagtttgaaggcggaccggctcacgctgctgttggcctggaagcggaaccagtcgagacggacagcacgcgagtccaccacaatgccatcgactggacaaaatttccatggactattgttctcggaattataatgtccaatccatgccatgcctttgacgctttccaacgcgtcggcacatgcacggaggagcagcgcctcgtagtcggacagttcagcaccatcggcactgagctggtggagctgttcagccaacaatggtgcgtcgtagccagcaacgtattcggcatggtaatgggcaatgatgtcggcatgtttcagcaccaagttgcgcagttcgca

SEQ ID NO: 8420 - DNA, 1587 bp, Heterodera glycines
ccgctttttttttttcaaatttttcaattttttttcctttttattgtcacaattgctttaaatatcaaataaacgagctttatgtgcttattgggtacaattccgcgatttgggtccacaaattataaaaaatatccggtcctccaaattgcttacgccacaaaaaatcagaaatgtatgtggaaacaacgtgatgctgtgagtgccaaatctcgctttatgttcttcgtctggtagagccaaaactttgaataaagcatcaagttttaaatttttaagtgtttccattaatctaaaagcaattgtgacaataaaaaggaaaaaaaattgaaaaatgcgaaaaaaaaaaagcggatacaaagtaaattagtacccaaaaaaaaaggtgaaaattaaaaatttgtaattttgtcaactcttaaatttttaatttcttatatttcttggtacaaatcttctctgattgtcataaccattacatacaatgttcaatttgcactgatttgcgtccattgcggtgaacagttgcaaaatggcgtccttcaagtcgagcaagtccgcaaaagtgtagtagtacagggacagcttcttcagaatgtcccctttcatttcattcacacatgaaaaagcggtctaaaattcgtttaaaaaatttttatgtctaaccaaaatttgaaaaatgcggatttagcggtgctagcatttaaaatttcggaaatttaagcgaaatcaaactcaaactaaattaaaaaatgcatttttttccataaaattgcgtaaaaaatttaaattaattaacacttccctctaacagagcattttttcacctaatggtaaaaaatttaaaatttataaaattcccctagtttttcgaaccgaattccgtttgatgtcaatgatcggaaagcgtttgacaatggtggaaatagccgagtcaagtgatttgtcattcaaaaactgtggccttgacttcgggtctgcacacgccttcttcatgttgtagaagcgggtcaacatgccgactgtacggtctgacaaacaatttgtaaggcattttgcttgctataagccaaactcaccgtttaaaatgaccaatttctccgcaaatttcagctgtgatgggtctgacccgatcttgtaggtcattttttgcttaaaacagtcactcataaaaatagataaaccgtaaataaaaaaataacgaaatcaaaagataggtaggctcattcattatttgaaggatttttggccttggaaacaaatatgcttgccgggcactcaaaaaaagtcgagaatccgcgacccatagcttttttgagatgttttggcgctatatgaaaagtggccgattttgaattttatcaaaaacaaaaggggggagagacccttttgttttgcaaaatttttttatgataacacggcgagtcaattttgggctccaagtacaattaagttggttttttcgtcttagtggtctgtgagttagtcaccaaaaagtgggtctcaggttcaaatcctccttatgttgtgtgttaatttcaatttcttcttttaaagaagaaggcagaattttttttcattaataaa

SEQ ID NO: 8421 - DNA, 538 bp, Heterodera glycines
  misc_feature (19)..(19): n is a, c, g, or t
gaataggcccctggtttantggtaaactcaccatcccaaattcccatcctccgttcttcaagtttatccgagtacatataaagccgaccaaatccctttccagtcatattcttcatcccattaattccattcacatttttttgataatttttttttcagttcacttcttcaattttctctgattaccaattgaaaaaatgtctgacaatccgaaggaagcggagaaagaaatggaaaaagcaatgtaacaattaaattttgaatttccatgttaatcattttgctgtttcagcttcatcgctgccgactgttggttggaagtgttcggtttgcttccacgctttcaacttggactgggaattgcgatgattagccaccgttttgaccgccgcgtggatgaacatttcaaaacgcgcaaatggacattgggacgaattgtaattcaacgcaaaattggagagaacggcgcaaaggaaatggaaattgtcaattccaatggaaaatgattgccaattccgcaaaatccgttccgaacaaa

SEQ ID NO: 8422 - DNA, 2539 bp, Heterodera glycines
tgcaggtcactttttcgttacaccaaaattaaaaaaactgaccaggttttcagttttattgtattttgatgctcatttttcttttgtttaggctcgcgaaatttggaacaaattgcttgagggggaacagtcgccctttccttggcttgaggcaattgctctcgaacgttcttacggcgatatttgtggctattttattttgcgtgttattccgcattattctgagctttttagggtacgcacgtcgtctctttttcaaggcacttgacgccgtcacttatcgtcaggatgaaatatttggccgatttgtacaatttgaacgggaggaggggacgagggaacaattggacttggcattggcacgagtgaacgccaaagcgacggaatacaacgcatggatggaacagcagaagtacagcaaaaccaaaccgaaaatgggacgaacgaacgaaatgaatgggcaaaaaacggcgaagaaaaaagaaaaaaaagaaaagggaaatgagacgtcaaaaagggcacagaaaaaggcaaatggacggcaggaagaaaaacgacaaaaggctcagaaggaggaaaaggaaggagaagaggaggaggaacaacgagaaaacatggaagaggagaggggggagacaagtcaaatggacgtcaacgaatgcacaaccgcaacatttgaggcaagtggaaaaaaacgaaaaatcgaagatttaacagtctttgattttgaaatcatatgacaattctgtggcagattcggaaatagtacctccgattttcctgctgaagtaaagttggctagaatgagaccaataaatcgaaaattatgccaattatttttaggcggtataaataattatgaaacgcctaatattttcagacttcttccatcccaatgggccccgttcttccgtgcattggccaaaacaataaaaagcacgaagtgatgaaaaagaaggagaaaaatgacgagaaaatgaccttggaaacgaacaaaatggcgggtgaaaagcgaaaaaggccgcagagtttgtccgagaaaagttttccatacaacgccggactggagaagaacaaattgtttgtgaagaaattggattggtcgtgtacgggcgaggaactcaaagtaactaagaaaaggggaaatggagtaagattatgctttttaagaaatttttcgagaaattcggaactgtagtggacgcgcgaattgtcaccaaatggaacggtcgctccaagggttgtgcttacgtcgattttgccgacgaacaaagcgcctccgccgctttgatgggggcggacggaacggagataaggggcagaaaaatatcagtttatttgagcaatcctccgcccacaaaacggatgaaaatggaagaggcaacattggacgaccacaatttgacaaccgataaaacgaatggagcgacaacctcaaagactgtggacgggaaaactgaacaaaaacaagcgaaacaacagacgaagccctcaaggctgatgccacgggcggcttttctgaccggcgctggacaaaggatcggaaaagcaagccgattgatgttgccgatgagcggcatttcgaagagaagcggaaatatcgcaacggaaggaaagagtgaatcgcccgtcggcgttgtcactgaatcaacgaaagatatgagcttatagaggcagaggcgaacggacaaatgatgaaaatgattaaatatccattcaattgtttcccaacgaagagtaaccaaaagactaaaatcgcaaaattcggtccttttttgacaaaatttgttaacaaattgcactaattcgaaaaactcccggccggaccccacccgccatttgaaagcacaaagactaaagaagctaacacataaaatctcagcgtttaggcttgccaaaaacatttgattaatttagtgattgttgattattttcgtttgcaactttcggtacttgtgtggtttacgggacagatttcatatacatttttcaaatgcctataaatgtattcattttttaatgaaaataggttttaagaggattttggggtcggtgatcacgaatccgggctcagatcagcgctaccgttcactacatgagctgtacagggacaaagaattgataggcttcctgaacaaataataccctcattggcaagatgcccatgaatataccataggtacgatatacatactatatgtatagcgaattacgggcaaccttttgcgtataaagccgatgaagaattctttattgtttaaaataaaaaatgtacattctatgatcagagtataatttttggaattctcttaaaacattttattttaaatttaattataagtttcgggcggagcctagcggcaccgctcttcattagatattataatatcgtttactaaaaatatttagtcaaaataaatgaagatctctggaagatgatggtattcctaaaaagtttgagatattatagccgaaaatgcccctgatatgtgccgccatcgagcaccaacttgacccttctgacaaaacttcttcagag

SEQ ID NO: 8423 - DNA, 2777 bp, Heterodera glycines
ataggcatttgaaaaatgtatgtgaaatctgtcaggtaaatcacacaagtacccaactttctctaaatgttagaattatcttgttttctcatattattacagtattcaaactttgtgctttcgaatgatactctaaaaatagggtttgttcaaacatgaaaaaattgttgttgaaaaaaccgagtattttcaattgattagactcataaaaatacctatctttgtcaagccccttaagtcaatatgagtcgtttgctgtaagacaaaaatacgggccaactttaccgctgtacgaatgatattacaaattaggataattaattgaataaattgggagttcccatcagtaagcactcattcattctgatagcatcatcgagcatttctttccctgaaacaataaagggctatactgtgactagttttgccaatttactttaacgagagcgagaacgacggctgtagctcggagatcggctgcgctcgcgaagcggaggagagcggcttcgggaacggcgaggagtgcgagaacgcgacctgaaaagattgaattggtagaaaattttcttggaggaatggaagaagagtgattttggaagggttttaaactatttcggcatttttccatccaagtttaaggaaaaaccataaaatgtttgggtggatggatgaatttttttgttcctcttgttgcgaaggaagagggtgccaagactgacaatgagaagagatggggtggatggcattatgtgagggttgagattggaagatggagtttgagggagaattgaggagaagggcaacaagatgggatggttgatgaagaaaagctaaatttgacaaattgaagtttataaacttcgaccactcatccgcgcaatgttcaagtttcgaaaaaagcttcaacgaattaatttcattaataccttgaacgataacgacggtcgcgatcacggtcataacgatcacgaccataacggtctgagagaaacaaatttgaagttttcggaagattacggcctttaccgtcataacgtccccctccgcctcgaaaaccgcgtccgccccctcttccgctcccatgagaaagctctacgcgggccttgacgccacaaatcctcctaaacacaattgagcgactgctatttaggaaatcacatacgttccgtcgagtgcacgcacagcatcttcagcgtctcgtgcatcctcaaactcgacaaaagcaaagccaggaggacgacgagcaacccagatttttcgtatgcgtccaaagcgatgaaacgcatcgtccaactataaaattaaaattcaattataaaaacaatatctagcttgtgcgtccaatacgactcaatcggaattacagcctatttttgttttagtttgatatatacagtttcagtcaataaataaactttactagcggattggacgcctaaaagacattggatgcgtaattggaatgagtaaaaacctcttcagaagttgcatcctcaggtaaaccaccaacataaatcttaactgttttttgaaaaattattgtagaaaaacctaaaaccttcgcatcgagatattcatttcttcgagaagacattattcatcaacaaataaaataatacgtagtaaaaatggcaacttgtgcctttctgttatatgtaaaagctatgaaaagatggaaaccgcgaaaataggtttttacgagtcttcctttatctcctctcttacttctctctttcttctccattctctttccctcctctctctctctccctcacttcatttctccctcactccctttctcttaatctcatctctctctctctccctctccccctctctcttaacctcttatctctctctcttcctttctcttttcgcattccactttcagtctctcaatcattttctctcttactcttcatcttttcctttctcaatccattctcttagtctctctttctctctcctctctcccccccccctctcactcattctctctctttatctctctctctctctcttaatctcatctctctcttccctttttctctcctcactgcacctcttaacaacgcccaaaaaaactcggttttcgtgcgtcaaattaattactttctttaattaatctactaggtattttaatttaattttaaatttttagtatacgaaagatggagacacaaaattcgtccaagagctttgatgattctgacgtaaaaatggaggaagttaaagaacagttggatgaaaaggtttgcttggattgaggattgtttcagcaataaataatttagacgaagcctgagttcgacaaattcctaaatgagatcgaaaatgaagtccaaaagcaagtttttcaagaaaaggtaatttgttaatttctttttgctatttcaaattagagaaattaaaggcggcaccgacagcaaaacgtgaaggggccttggtaaagtcggctgcgttaggggaccaccgccacagaatgaccgaaaaagaggaagacgagcaactgctgcaacagagcgttcgaagcgacgacagtccgttcatcttcgagaattccccacctttcatcaaaaacggggaaatgcgcgactaccaagtccgtggactgaattggttgattcaattggaacacaaccgaatcaacggcattttggcggacgaaatggggtaaaatgcttttgcttcctctaattttatgacctttccaatgcgttaagtcttggcaaaacccttcagacgatcgccgttcttggatttttgaagttttacag

SEQ ID NO: 8424 - DNA, 2569 bp, Heterodera glycines
tgaaatagaaaacaatgcttatgccttttcttccaagccaatacgcagtaatcatcgcccgaatctcaatcctctcgaaagtcatcttcactttccgaaaccatctttttgcctttcttagccgctatctggaaaaaattaataaaaatttaggattttcatagttcacctttgaagttgttttattggttttggtttttggaggagctctcgatttcttaataaatttgtttaaaatttaaaataaaaacaacgaatgcctttggtttaggttcatcttccttctctacaggatcatcatcagaaccctctaggtcaatttcgtcatcgtcttcactttccaaaaccttctttttgcctttcttggccgctatctggaaattaatgaataaaaatttaggcttttcatatttcacctttgaagttgttttattgattttggtttttggaggtgctctcgctttcttaataaatttgtttaaaatttaaaataaaaacaacgaatgcctttgcttttggtgcatcctcctcctctacatcatcatctccagaatgctcaaagtcaccttcgtcataatctagccctaaaccttcgtcttctccatcctttccctcttccatctccaattctctaattattgcatccatatctatgcctaaatcatcttcatcgttatcatccatattgccgtcattatcatctatgttgtcgtcgtcatcgcccatagaatcgtcatcttttaccaaattgtcgtcatcttcctcaatttccaattgtaatttctgttcttcgctatacttaattgtatggtcaccgcccttttttatcttctctccaatttttttcatttttggacgaattgatgataattcctatgtcaaaatgggatccaaattatcaaaaacatagattataaggtcaaaaccaaaaaggcataaatgtaaatggatcttaaactataaatttggtctttcctatcaattacaatttatacctccaaaaattcaacttctttgtccagtttgctcactgatatgtcaaattttgtacaggttttctcattcaatacaatttgcgtgtttccgtgcgtaaaagtcttgaatgtagacgaatcttcgcgactgcattttacttttacataataaattgggtctgcctcatggtccaacagtgggtcaatggttaaattgaagtaacttggaaatttgacttgtttatatgttgtgtcttttttaattgcaactccattgtctactacgaactcggtttgccggagctaaattttgtttttcagttatttcataaagcaaattaaaaatcattaccaaatttccccatttttttgatactaaattttcccattttgatttttcttttgacatttcttttgggtagtctacccatttctcgtatataggccatacgttgattttgtattttttgcatagttgtccttttatgtcgggcttcatcttttcgctcccaattggtgtaaaaactttgtaattggaatttatcactacatttgctaaggacttggtgtacgttttgaactcaaaatggttattgtcagcgcaataaacattcactcgataaacaatttccgaattttcatccaatttcggcgatatatccagcttgaaatagctgccaaattcaattcttttcgttgcgtcaacattgccatcaataaacacaattggtggttccagcataattggttttagctagaatttttatgaataattgtttaaaattaaatttattatatcatgcccaagggctccagatagtgtccttcttgatcaaagcaatgccaatttcgaaccctttttcgcaatcattattgccaagtcccaaagtgacaaagtcgctttcgtttcgatgcgtaaaggattcatgtgttatgtgtgttcgtgtggacacttcagttttggacccttcttcagttgcggactgtacagtttggcgacagaaggcttctgactaaaatgtgagaagctaaataaatgaatgcccatttctaattaacgacgacttacgaaatactcatattccccgagactagcaacgcccggtagcacatagagtgttgccatatatttattatcatcgttctcaacagcaaaacaaatgccgaagaacggaaggaaaagaagaagaggtagcattaatggaataatagttcctaaaaaaatttaaatgataattttgttgtaaatctttccttttatgttgcattgctttttcctcttcaattgcgacgcaaaacgcagaaaaaattatgtcagagggttggatttattgcgtggctattgacttttacaattggtagggcatatagaatatgcgaatacgtaagaattggcagagagtgggatttatttcgtggctattgacttttattaatggttattgccaaggcaaaaaaatattttacaaacgtaaaattgagtcaaattggattatataatataatgtttgaaaatataaatcatagtcctcaaagtcaaaaccgctcaaaaaggttggaatcggttttagaagggcccaaaacattgagaaaaa

SEQ ID NO: 8425 - DNA, 1588 bp, Heterodera glycines
  misc_feature (46)..(46): n is a, c, g, or t
  misc_feature (63)..(63): n is a, c, g, or t
  misc_feature (80)..(80): n is a, c, g, or t
  misc_feature (94)..(94): n is a, c, g, or t
  misc_feature (113)..(113): n is a, c, g, or t
  misc_feature (156)..(156): n is a, c, g, or t
  misc_feature (178)..(178): n is a, c, g, or t
aaagtcaaaccgctcaaaaaggtggatcgggtttagaagggccaanaacattgagaaaacgcnaattggggagcgcttgncattttcaggaaanaatcgggtgctgaattgtncactaggtggggcgtgcgttaaggtacttgcggcccggacatntgcgcctcagacaaatgcggcncatttcttaagggccattttcaggcacggaacgccaaattatcagcagttgactaattaattcatttaaccaataaattcttgaacaattcaataataatcgaattttaataatttcaacaaatttttcaattcttctttttaatttcgccaaaattttattgttttagttcaataatgtcgcaataatatttctccatttcttttaggttaggttattaactggtactcccggtgttcagttaggcatgttttcggcctcggttttcggttttggccaaaaaagccgtttttgatttcggttaaacgacagtgcactactatcttaatctttttcttcaagattatcatatcgttgaatcaagcctgttacagctctgtcattctcaacatattcttcaatcggtcttgactcaattctcttgtaagataaattcatagacgtgatcagaagcgccgcgctacgacagaaattgaaagaattttttaatttgcttaacaaacaaaagttatgctgcttcttgcaaagaagacttacaaaggaaggtccccaggtgtccgtgggatttccgaatgaaactttgtgggtgaatagagcacctatgggttcttaagaaaaatggtttcaatttctgccaaataagtacgggtgccgagttatgacgtgccaaactttttttatcccaataaattgaataatcaattgctccactttgtgctgttcggtggcgcaaaggttgtgcgctcgctttcactttttgccgcacaagttcgaatccctcttacgtaaatttatttttttaattttgccattgaataccctttttgaaatgcaattattttcattttttttagtacagaatattaaaattaaaatttatgcattttcacacatgtggtaatcgtgaaaaaatgagcaaaacataagaaaatctcacaataaccgcaatgaagtaaaacagtatcacaatttattttttggaaggtatctttatcttttggcacttcaaacaaaatttgaccagatgacaaactcagattgctagtcgtgatcaaagtaacctgcttttctccacgaaaatctttatattttgacaattttttgaagcaattggatgacatttaaaggatttacagaatttttaacggggaattttttcatacaaatttagaaaatatagtttttttaaaataattttatgcattttcgttcaaaaaatgtatttaaaaaaataaattgttatagtataaatgaaaataattgcatttcaaaaagggtattcaatggcaaaattaaaaaaaaataaatttacgtaagagggattcgaacttgaagggcaaaaaggaaaagcaagcgcacagcctttgcacctcaggacagcacaaagtgtgcaatgattattcaatttat

SEQ ID NO: 8426 - DNA, 1554 bp, Heterodera glycines
ccccccccctttctgctcgcccttgtagcagaggttaggtgagcgagacccaaaaaacacagagagccttttgagtcgggactctcgatttgctctaatctctcagccgaaccgacaaattggcacggtctttacattgaaatgtcggatgttatgaaatcattcatctaaatgaccgttcatgttcttctgccccttcttcttcttctccccctcttccgtgttgtccaattgttcctccgtttttgtctgttcgtgcattgcatttgcccttcccgatgggtcttcattgttttgccattttggcacccatttgagcactgtctgtgccgcggatttgctcgggaagtgctggtggaagattttgcgcatgaaaaatgcctctttcgttgttggagtgttgtgcgggaaaatggacgacgcatttgccatctataaaaaatatatcattttaactgtaatcttttcaaagattaataactgtaatcttttcaaagattaaccaaatcacaaaataggcattaaaaatgctcaaataggcactaaaatggcagaaattttttttattagccctttttaggtggaaaaacacgtaaaaaaaacaaacaaacaacttaattttggttatattccaattgtaaatgaaattagtaaatagtttaagcagaaaactcttttttcgtgcttatctgagcgtatcaagtgcgcaaaaattttaggcatttgcctaaaaaaaggaatccctaattattacctatgtctaaagttttatttcattcagaaataatctaatttaaaaaacaccaaaataatttagcaataaaatgggacggttcaaaaaatcagtcctcctttacctcttcgtcactgatctgtgccgaacaatggccgatcagttcatcaatccatccatagccaactccgtccgaaaattgctccttctgacgccaaaggatctcatcgggcagaaaagggtcttccttaaataataataaaaaaattgaaacattttataaatagttaataaacttaattatccaattaatttttcgatatttttaacaaatattcaaaaataaaattaaatatttaatttaatttataggaaattcaaaaatcgcattttgccaactttgtcctcaaatgccttgcgcaaaatccatttttccatgggccgcaccgttttgcccggctcaattttcgggcatttgtgttgtggtgcaattcccattgccagtgccaggaactgcttgtccaggaatggcacacgaacttccaacgagtttgccattgtcgatttgtccgctcgaaggcaatcggcggtggagaggagacggacccgacgaatggtctcctggagagaaagaaggatgaggcttatgattttggggagtacggtatcggattttcaaaatcgggattagaactgtaaccatcagtcaaatttgccttttgaacccctaaagagcgaaaaattttctggaaaaaaaatttagtaaattttctcgaaaaatatttagattttttttttattaaatataaataaaatttttt

SEQ ID NO: 8427 - DNA, 4906 bp, Heterodera glycines
  misc_feature (4827)..(4827): n is a, c, g, or t
agggctgctaagtttagtaagtaaatacctaaaatttttgcacacttaatacacggagataggcgcgaaaaacgagtttttagcttggtttggagcttctacacccacttttataatacctatttttacctatttgggggtttttctacctattacctagtacctatttttatacctatttcggcatttttgttacctattttaaggattttcaaaaaattcttaacaaaaatgcaataaaatcaaaaatatacccataagaatcgaccaaaaaaattttcaaaaatgcaccctaagaattggaaaaatttctcaaaaatttatcccaaaatttatttatttttttctattgacaaaatttttaatttaaaatgtcaatattacctaagaaaatattaatatatttaaattttcgtttttttatacctatttgatgcctattttgatatattttttaacctttttaagtacctattctgcgatttttcttacctaaaattagcagccctaacaataactcaaaaatttttaattaaaaataaaatttagtttgagcgatcggctgcaatttgtggctctggcgaaacgtcgccaatctttaagtgattcttttttccatattaaagctgataatttccatatttcaggcaagtgactttccgtgagcaggtaaaactgctaacctagactgatcgaagtcattttgaattcaattaaaaagttaaactgatcgcattaaaattcaaaattttagtatgaaaatcaatgtgtgcacaaaattaaaataaataaaatatatttaatagcaccttaaaataaccttttaaaaaaatttacttttcaaatatttgatttatttgtcaatcggcttatttgttaaggcaaacatcatcacaagttatttggatggttcacaaatttatggaagcactgaagtggacgctttggacttgcgagacttatttaggtcgtaaatttacattttttcaatgaaaaatgatttttatttaatttattcattttagtgatcatggcttactccgctttgacattgtcagcagtgcgcagaagccatatttgccatttgaaagggtaaaattcttccggcaaagtttccccgaaaaattttgcattttatgcaggactcagcaatggactgtcgtcgaaatttctccgttgaaaacccaatacggtgctttttgtcgggtgattttcgtgccaatgaacaggcgagaaaaaaacattcataatttaataaaacataatatttttggcatgtttttttggattctttgctttataatgttcattagaatccggaaatttcaattttgaatagagtagagcgggaccgggacctgttacggaaaaaacgggacaacttgtacctaagttccggttttgaccgggactagtccaggttttttcctgggtttcccagccagaaattttcgattttgtcccggttttgcccaaaattcccggtcccgctctactctaattttgagggatgaaaaattctttaaaaaaaaaactaaatgcctttagtctattatagttatttttgtcagaatgaattaaataataaaaaatctgaatcctttgaaagcggatccagtggattcccgcacagaaattaaaattttttcacatacgtacttcttcttataatttttgcaaattttcacaaatttgtaaattttgttagctcggtctgacagcgatgcacacgatttggttgcgtgaacacaatcgaattgcgacaaaattattggagcttaatccggactgggatggagaaaggatttatcaggaagtaagtaaaacaattaaaaaaaaacaaattaagatttttaaattttatttattaaaggctcgcaaaattgtgggcgcaatgttacaggtgaaaatggtgactgaacatttgcgcccctacatttgcgccccgcacatttgcgcccctacatttgcgccccgcacatttgcgcccctacatttgcgcccctacatttgcgccccacacatttgcgcccctacatttgcgccccgcacatttgcgccccaattatgaacaaaaaaaaatatttataaaattgcctttcccaagggctaacgggagattaatatgattgtttgtttattcaatccaattatcaattcctttcgttgtcagacgaaatgaaattgcgtggagatgtcgtagccaatgctgttcattgcgatcatttggatcttgctcatcaaaacggacaaccaagtctcgaatagcacggtcgttttcaagatatttttttcgaacgaggtacttcagatacaggtctagtttgatcaagttcatggggtctcatccggtttcgttggtactcatcttcatctttgattcgactaataaacctttaattgttttctgttttggtaatttaatgtttaaatacgttgccaaaggtggattaggagccgaaaatcgcttgttgaaactggcatgaaagccttccaggccattatttgtgcgccctaaatcaccaaggaccgaatcatgcatattccacgtttctggcacaaataaagcaggtcgtcgatttccatttccatcaacacggaagagatatgtactataaaaaacatcagaattatttaaaaacatgaccataacctacgatgcaaagtactcaaaaattggatgcgcttgtataggcgcatgatttctgagaatttgataaccttcttccacataaattaaaggtagaaacgaaatcgctgacaatgatctgacatactttctaaaatcgatatctactaagaattgtggtgctagtccttccctctgcactcttctgttgactgattgggccaagtgaaacagacaatgtctgatcattgtgttcggccaaacatcaagaaatgccgatctcgcagctaaatgatcaaatatttaaaataaaatcgattaaatatcaatataaccaggttcaaaatccagcataaaactgcttggtattacaccttcaacacgctgctgtataacagagaaggctcgacgatatgtttgttgcatccggtttgccattattatatatgcgcatggtatgcttgagtgttgtgcaataatgtttagggtatataattgcatgaaattcgatggccgagctacaaaactttagaaaatggtcacacccctgtcatatatcacttttgaaagtgccgtcgcccgcccaattttggtatgtccgtagccattcaatgcctttgtcacttgcaaagataaaaaaaattggctcctcaatatcgtgctcacgtgagtcccaaatcaaaaattggttccctcttttatccgtcgcgaaggcacccttgaaaaatgagttggaaaatgtcagagacagcgaggatatgagtaagcgtccaagtagggttgcgcgcggtcggttaaccgaaccgaaaccgaaaaccgggggtgggaaaacgggcctaaccgaaaaccgggggtaccggttaataaccggtcgtgcgcaacactacgttcaaggaaaaccattgtttaatttttggcacgatttttggtttttaatggctcgcttctatctctatttccaaaggatttgccgcatttacagcatctcgacccggtatttgacgttgcctttgtatttttattctacttgcgccataagttggcaatcgaacaagttgatcatcagagagtccttctcttgacgatccaattaaattgcgcggggcagcttcaggttgatccatagcagcgtcttttagctgttcctgacgctgccttttctataatttaataaaattaaataggaaatattccaattttaacaacagatttcaccacgttagactctgggtccggcaaatggttatgatttgttcttccaattaattttgtgctgtcgataggtgaatgggccctgcctgggcatgatttcttgacacatctccatacctatttaagataaaatatttaatatatacaaatactgaaaaatagcctgggtttggcctgctgctattattctatcagtacgcatttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgcccatttctcttgttattgccgtccgcccatttctcttgttattgccgtccgcccgcactttataactatttcttttatgaaacgtgaaaatattattgaactctaaatgaaaactttatttctattttctctgttatttttctcttcatatgaaaacccaattcgcaaacaacgagctgttcgcaatgaacgggcaatagctgggttagcacaattggcagcatcacttgcggccgtgaaagcatttattgccgcaaatgcagctttaacggcttctacagccgtagctttggcagcacttggaaccgatatctaccttgctattgagctcgtgagatgtaagtttatgataattgaaaaggcggttgtgactctaataactcatgttaagncctctgatcactatgaggaattgctcaatgacttcttcccattgacatatgcttaggacaattatagattcactgtctc

SEQ ID NO: 8428 - DNA, 955 bp, Heterodera glycines
tccacctccgaactgctggtgctgttgttgcagcaaatgttgttgttgttcaccgcccgtgaactgttggtgaccaaactcagtagcgccacccatttcctgctgctgttgctgaccaccaccacacattttttccatgttctcagcccaaaacgttgagtttggcagttgctgctgctgttgtgttgctgatatgtccagaaaaatgtgctcctgttgttgttgttgttgactgatgctgttgctgcagttgttaaatgccgttgctgatgaagatgatggtgacgatgctgctgctactgcttggtagtgctgtagcagctgctgctgatgtcgttgttgaacggccaatgccgacgtgcacagtgccgggtccccgccaccggcgaacaccagcggggactgcgaggaggacgcggcggagggcggagtcggattatttgttgccgccggactgcgctggtgttggtgtgttgcagcggcaacagtcacagcaatttgctcagctgcagcggtagtcgtcggtaccgagacggttggcagcagccaaagtcgctgctgctgttgctgctggaggtggtggtagtgattggatggcgagtgttccgcagctgtagccgaaattttgaactgtgaatgcggcacaacacgcgacggcgctgtgctcagaatggggaaatgaagagaagttcaagcagtacacaccaaataaataaacagaactgaggcagtttgatgaacgtgtcgaggtcggcggagaggtgttgctggcgtcgttcaaatgtgtgaaaataggtaaaataattatttttgttgctgttgttgtccctgaggctttcgggagtttaaccgggattttgggagaaagcaatgttttgtgccaaaaaaggacttgaagctaaatttgagcgggaatataattaggcacatatttataaattaatgtatttgaaca

SEQ ID NO: 8429 - DNA, 1183 bp, Heterodera glycines
aattcggaccaaaaaaaaaaagattttaatttattttcaaggaaaaagaatacaaaagaaaattcacgccattttttggaaatttcgcaactattttaccatattgcgcccttatttcggcattttttgcccccatttaggcccctacttggaatttttcgcctctgaaaatccgctccctacttatcatctctaatacatattcacaatgttctccatttttttttaaattaagcaattatgtaacgcgaaaagccaggcaatttttggaaaattgaaaagtatgtaaaatctctcaaaataccgccgccaatccccgcgacagaacgaaagtgaaaatgtttcgtaaaggaatttggaaaaaatacatatgggataaagtaataaaaaaaaaattttttctcgaagaggtggttttcgcgctcaattacgtaaaatgtgcttggattacgaccggcgacggcgacgacagcaaattcccatcccctggggggagattttgtgaaaaaagaggaggaggaaggggcacgtgtaatgtgtgtaaaatatgtactacttagaaggaattaagggaattaagatggctaatgaggatgacgaccgctgctgctgctgatggcgggcggatgagtgcacgttggcacttttgtgtcatcatatttacaacattggcatatatacaccagggataggccaaattgaaaaataaaaagcgaaatgcgaaaagcgaaacgccaaaaaatgcaaataatgcgaaaggcgaaatgcgaaaagcgaatccttggctcatccctgatatacacataaagatttggaactgttaaaaaatgtacgaaattcatttgaattgcgtaaattgtgagttaggggcgaaaaattcctatttagtggcctaaatagggacgaaaaaatcgcgaaaatggtaatatagaggcgaaaaatccagaatagggattcttgagcgcctttggccccactttcggtcttcggttgagctttttgtttgtgacaacaacaacagaaacgaatgaatgaatgtgaactctgtcgagaagcttttgctggccaatgtggcggcaacaaatgtgctttttctgccggcggtggcacccacggggggccggccacgggggaacggaacatggcacgaaaagggtaaaaaagcgcaagtaaaaaaaaaggg

SEQ ID NO: 8430 - DNA, 3379 bp, Heterodera glycines
ggaaatggggaacccttcggtcggggggggggggggttgggaaacattccaattttgtgacaaaaattatttatttaatttaattgatagtcggttgtctttttttctatttttgatgggtgaaatgggatttgtttccaattttccatgaaaagaaaagtgcaaaatgaaaagcgaaggcctgaggcaacataattagttactaattaagtgtgcgattaattacaattattgcagtttgcaggtgatttgatgttaatggaccaagacataattaattggaagggacttaattaattatcagaaaatgaaataaagaaaaatgccactttttaataaacagaaaggttttgtaaggactgctgattttcatagtttaaatttgagccttggcctaattaattcattaattagagaaatgtttccacgcctcaaggcatatcgttagttatttaaagaaaattactttaaaaaaatctttttttgccatggttctctgatagtcagagggttaattacacactaattagtatgaggaatcattccacccccgaaagcatttggataattcatctttgattatttattttaaaaaggacagttggccttgtcaggtttctctttttttcaaaaaaaagaaaaaagaaattcataaataaattttgtttttaaataaatggccaatttttgcgatgcgatttcatttgcaaaaaagaattggcccaaaattgtcttaattttgcgacataaaattttgtccttttatcgtcggaaaatgagaggagaatatcaataaaaaaagtgataagagacggaacaatgaaagaaaatggagaaaatgagagaagggccaaaagtgcggcggaggaattaattcagaaaaatgaaaaatgaatttataatggcggcggaaaatttgtcaccatcagtcgacgacgaagaccgctttcaaataacacacattaagcaagaagaagcataagcatgtaaaagggcatgtaaaacgtgtgatgagagggggagagacaaatggataaaatgaatggggaggggagcggaagagaaaaaaatggggagagagagaggggaaggaaagaggagagtgggtggaggggaggagtaaaagagacaagtgagaagaggaaggaagaagtgatagaaaaggggatggaaaaaagagcaggaaggaagagagagagaagagagagggaaaagagagttagtgaagaataatgatgatgatgatgatgatgatgattatgaaaagggaagaaggaaaggctgaatgaaaaggaaaaggaagggaaggtaagggaagagagcaaaaagaattaaggaaaagtgaaaaaacaggaagaaagagagtgaaagacaaagacaaaaaggaaatgagtggttaaaatgaaaaagtggagtcaaaaagaaaaaaatatgtaataatatggagcgaccggcattgcgcagaaaatttaatgggaattggagggagggggcggcacgccaaattaatttgtattaatgggggattagtgtgtgcgcgagctttggtgtgtgtgtctcttttcttttctcgagactttcgaggagtgtgaatttgtgccgcgagagagtgcccaccacaccgccataacaatgtctttggcctcgcgcctggcgcttgatgggcgcggaaaggagaattagaaaatgggatcagagatttttgatcagttgcgtaaagtaacataggccactttgatgccatgccaaaaatagaccaaagtggtgatgttggcaaggattttgcagcagggcactgccaataaataccgtaatggcgggggagcggtgccgtaatgataattagccccaggaaaaggggtgggggaagagattttaattatgccatcaaaagctacttttgggtgatgatgaaatatgacacattttttggttataactgttttacttctcaaccaaatccaacgttattggtatcattcgattgcctaagtgttctctattagcctgcaaaaatttggaaaaatttcgttaaggttcaaaaaagttacggtcagaagagttcaaaaaaccaaattttccaacttttttggctcgaactttttttgatcttgacgaaattttttgtaattttgcaggctaatagagcatatgaagagctttcgaatgataccaataatgttggatttgtttggcaaagaaaaaagttataatccaataacatgtgttcgtacgaaaacgacctggccccctttatttggccttctaacaattcaaaaagtgaggcatttcacatgtttttgtcataagtcacaagggtattataaaaaatagcccctgggggcggggtaagagtgccggaaatgggtgagtgagaggtgttggaatgtcatgccatgcgcattcatgtgattggcatgtcatggtttttggccaaagtggacgagatgctgcttggatttgttgaattatatgtgctggggattatcgacctcaatcgaatcataaattaagcgagaggatgacgtgccttaattacctctattttatttatttaggacgagccttcgggggacgaattatcggggatgggtgggtaggtagctaaatttctaaatttgtccattttggcactgccatttttgcccggcagagcacataaaacaggcccgtagccaaggggggaattcccacccctaaatgaaaaattaaaaatgtttcaagaaaaaatgggtatttttttgaaaatttacataaattcctaaaatattccattcatttgtaaaaagggccccatgttttttcattcttttttttgaaatttgaccatcaaatagcaaaaacttgccattttttgcgcaaaaccgataaaaattcctgctttttcatcaaagcgtgaaattttgaaaaataatactggagaaagtttttatggatggcctgaaaagcgaaaaaaggtctttcccctctgaaattaatttctggctacgggcctgaccttaaatctcatacaacttattcaataataattaattgctcattaatatattaatggattttcggaaatttaaaatatatgcatattatagctgttaaatgctattgtaggttatagccaattacaagcaattataaagccaaaatataatattctatgaatgagaaagcaaattgtaagaagagctcgtcattggatttgcttccaaatgatgccaaattagaagaagcattggcaaagggaaaaaaagttttggcgatgtgttcggcatcaaaacgggaatgcaaaacaccacaccacaaaaatggggggggggaaatgaaattgaataaaataaatcaaaaataaaacatttttaatgcaaattgacaaattaaaaaa

SEQ ID NO: 8431 - DNA, 2921 bp, Heterodera glycines
  misc_feature (2889)..(2889): n is a, c, g, or t
ctatgggtacgctccactgtgcagagaaaaacctagtgtactatctcgtcgtttctctttttctttattatttctctcacttttgcgtactatctcttcattttaattatgtaaaaaacaatatttacttcgtgacttttaattttttttttctacacgttaaatccacaccaaattttgcataccgatagagaaaaaaattctgcatcgattaatatgtcaagttaatattaaaataggtcaaataggaaagttacataacaaaacataaaatgtatttcttttcctctcattttggcgtactattttcacgtctctaacacatgaaaaacacaaaatttgcaaatgctcacaattttgattttttggttacaaaagcactttagatttttattaccaatagaaaaatgaaatgttttagcattttggttttaataagtggtccaagcgagttatggctgatcaaaataaaaaaaaaaaatacaaaaataggcattttccagtgtaaattttgaattagcgctcaaaaaattactgccaattacgctatttggcgttatgacgacacctggggcgtacccatagtgctagaagtatacagacgaaatccaaaatatctttagggggtgggggtgataattagagcatatacggtaattgttcaaggttgtcaatcgcctttagagagaacagtaatcccaaggtacgtatcaggggtggcattccgaggccttttggaaatcggaattccgaccccaaatttccgactttttatcaaaaatttcggaaatcggaattccgagacccaaaaatttttcggaagtcggaaatcggaattccgaccccaaaaatgtcggaactcggaatttcgtgccatccctgaaataaatcatatttatgtataagaaaatttcaaaaattattaaataattgatgttattattagggatgcgatttttaggcaaatgcctaaaatttttgcgcacttaatacgcacagataagcacgaaaaaagccctttccgcatggtttggggtgtctacgatgacatttataatgcctatttttgcctatttcggggtttttgtgcctaaagtgcctattttagggtttttgaaaaaatccttaacaaaaatgcaataaaaacaaaaaatacacccctaagaaatgacccaaaaaaaatttcagaaaatacaccgctaagaattgtaaaatttttcaaaaaaattttccctaaatttaatatttttttcttaataaaaattttttggtttaatttgttcatattcgaaaaaaactttaaaacatttaataatttcatttacaattgaaatatttaaagttttaacgtgttttgttacctaaaaagcgttataaaaaattttatttgcctatttttgtgcctattcgggcttttttgtgcctatttagtgcctattttgcgatttttttctgcctttttaggtgcctatttcgcgattttttgtgcctaaaaatcgcatccctagttatcaccgtgggaaaatgaatttaatatgttttgagaaattcaatcccacgtcttaattcaaaatcatgcaattgaaactaaaaatattgaatatatttatactcattttcgaattcatttttaggaattatacttgataggttaatctggtgattaacagcagcggaagccttcccatggacagccccaaaatcgaactgttcaaaagtatctatcggagaagatctgtcttccaaattgacaagtgagagaggttcaatgatgttgctaatctcttcagaaactgctcaaaaaatgtggtgaaaggaaattgaataaatttgtatttattttaaactttgttgattgactggtttaaatttggtatgtatttgttagatttggtctgtatttggttttcacaaatttgaattaatatgcatcctgcggtgccgaaaggcgcattcaagagattaaaatttaatgacattatttcaggcccgtatccagaagaaaaaaaaattcggggagggcagcctttttttatttttttgctcttcgggccagattattttcttctccatattatttcaaaaaaatttcagcgcaggggcgaaaaagcagaaattgtagaaatttttttgccgttttgggggtgaaataaaataaaaaatttatttgtaaaggcccttaggcacataatattcactaaattgcccatttttgtgccacctttctctccaacggttggtgtttcagtaattccgcttatctttttccaattcttaaatgaccaatcatcaacctcaaacagttgcgcaatttgttcgtcattcattgtcttagaaagttctgcatatgaatttttgaacctttcagagaaatttttgtctaaattatttttaatgactaaaaaatttttattgttgatcatttaattttttattttcataatatgataatatatgaatgtcatttgataaattttaattgttttttttaaatttgtacatgaatttgctcatatgtaattgtgtaaaattaaataaaattaatataaatttttgcctgttaatggcccaaatttttttaaggaagaaggttcaaattcctccatttcttgctcatgatacacaaattcatttccactctcaaatggtcttccttaaggttttacaaaatttaaaaaaatatttaagaattcctataaatattggcacaaaaacactcatttctatctatttaaatgtgcttggtattaaaaaacgaattctcagttgaacttttcgacatttagtgccacggtaatttaaaaatattttcatccgttataaaaagtgtgtaatttgcgatcttcttgaaaattttggagtctaaaaaataatgttataatattctanaatatttaagctgcatccaatgggagccggat

SEQ ID NO: 8432 - DNA, 2435 bp, Heterodera glycines
  misc_feature (8)..(8): n is a, c, g, or t
taataaanagtagtgaaaaataattctatagaaatacactctcctatatttaattaatcattcggaataaagtaagaagcataaattatttaataaaactaaatttcaacaaaataaataataacaaatgaaactattaaaataaattcataatttacataaaaaatttttcaattaaagcaatacgacctcaattcaatgattcaaaatgctcaaaaactccaacttttattaaattattaaaatacttctactttcaaatcaagactaaattaaggactgggaaggaattaagatttttagaagagaaaaaataaaattatttataataatggctttgaaaaatggaaaattaatgtactcaaataattgaattgaacaattggataagaatttttcaaattttatatataaaaatcttattgggtcttttaatagacaaaaaattttcttattagatagaacataaattgaaagaaaaaatgtaaaaagaaaacaaaaaacttttttttcaagaaagtgaaaaaaatttaaaatattgcttacaaaaaaattctatagattttaaattaagaaatagttaaaatatgaagtagtaaaatgaatcatatacataattttataataattaaatagaataaatcaatgtcttggacaatcatatgtcaccgataaactttttgcaacagactaaaaataaaaatattcattatatcgttaaaatctgaataggaaattaattttatgaaggagacgccctcaattaataataatttatataaaagaaatatataatgaaggaaaaaagaaattggtattaaaatcaaaaaaaatttaaataatatttttacagttgaaatcaaatatgaaaataaatgaattggttaagtaattctcaatgtaaaataagattatataaattacataacttttagtttttaaagagattaaatttataaatatttttattagaaacaataataaagtcaattctacaattaagtaaaaatgctcaaattaaaaaaaatgctgcaataataaattataatgtagcttaaagaagacatgtgtattaaaataaataaaaaaataaaatgttattaaaaatttattccatagaattagttcaattaattattttatattttaaaataaatctttggttttataaattttttaataacatatcttttttgttgtgaatgagtcgttgaccattggatcaaattgtctacgactcggcccacaacaaaaaggaacttttagtttttttctatgaactgagcactcacgcgctattcataatgctaacgatctgcagataaatttctagcgcagataagttccatattcataatgctaaggattaaaatccgtattcataatgttgctctcttcacaaaaaaatccgtatcttcagctgcagatacccttggtattcataatgctaaggatagggtagcggctgcctagctgcagctaaaattccctatcctcatcgaggtgaggatagttgcgatggaaatgtcaattaaaatcacaaaaaattataaattgaaaaattgtactaaataatacctctaaaaatttgttggtttaaattttatgatgattgaacaaaaattcaaagttcgaaattttcgacctttatagttcggggttaggggttggtttaaataaatgacagattcaagacagcgaccccgaaaaccctcaagaataagtttttacagacttttatgacaaaaatttttttaaccaaatttgacttggaaaatttctctttaaagatgtgtgacgagagagaagctgcggataggttatctgcagataaaaaatcgtcagctacagataattagcactagccttatgaatacggattttatctgcagttacactatccgcatatccttagctgcagataactatccttagcattatgaataccagcatcagtcaaaaacgaatagcagaatttgtatccacccgacgactgatggggatattggctcgaccttgttgaataaaagaccgcactaattattgatcatattttcccgttctctccctctcttattgtctctcctcccgccctttgaccagtccataaatatgtctccctttctcacactccgggcattgtcccattcatttctccatttcatttattgtattcctgctgtccttctccacatttatttgttaataagttatttattatttatttgacaacatttggatttggttaaaaaccaaaaattttatttttgtagtaaatatacaataatttggcgcagtcacaaacaatgggcctgctgtacatcttcgggtgagaaaaaggcaccaaatcttgtattcagaagtaaaagctgaaaagacaaaacaaattcatcgaaagagccgggattggctgtgaattgttctaaagcctttag

SEQ ID NO: 8433 - DNA, 1419 bp, Heterodera glycines
  misc_feature (1291)..(1291): n is a, c, g, or t
agaaaatcatgggggaaaatatcagatttagcttacattgttttccacagcacatctaaccaaatccgagtacttggctgctaaactctgaatttaaaaataaaagagaaattcggagatgaaaaccttaataaaaggtttgcagcttaaatttatgtcccaaagttcatcatcatttccatttaagtgagaaattgtagcaaaaataaaaaagaaaattaatgaaaacatttgacaagctaaaaaaacatacatacatataacaggggtggagcgcaaccgcgaagcgcggcattttttggataaatttttaaaagaaaattattaatgaagcgattgttttattataatttctgcaaatccaaattttaaagcactgggaggaaaaaaaattttggcccgaagagcaaaaaaaaaaaaattgcccctcccgaattcttttctggttaaggtcctgcccccccccactcatctgttccccaaaaatttttttagaaaaagcgccgagaaaaagcggttgaaaagcaacaaaatatcatagggtttgcatgactggaagctcttcgcaaattcccccccccccttcagtcccgtctcaaatttagtatacatcgggcttttaattaatttttatgtaagaaaagtaaaaaaaaaaactaaaaaattggaaaattttggtaatgcgcgatcgcaattcgcggcaatttttttgcgcgatccgcaccgcggcaaattgaatccgcggatcatgactatataactcggatttttaagcgcgaaaaggcttgattctttcccacatctatttaaatttaaaaacgtcaacaaaaagcgcacgccatgcggatccattcgattatattttggcccaaagtgttgtttttatgactcccaattccttgcagtgattccgacataattggaaaaacaaatcctaagaaatgaaaaatttatccaaaatttatttatttatttcttgacaagaatttgttattttaaaatttttttagctcaatactgatttgacctaatttttttacttttttgaataaattttgtcttttacacccctaaattcggaactttttggcacctattttgggggttttttagaacctaaaacttacctattttggcagtttttagcacctataaatatcatccctagtgacaacgtttttctttgtcagttaaactgcaaatctgtcatcataaagaaagcgattataaattttagataattgtttggccacgatttatgtttccaattatgtcggaatcactggcaggnaattctggaactattccgaggaaaacccacaaaaatggagctgaagaaagtaattacaaatttagttttctttcggaaaatagctcattatttggcacgattatgtttccaatatgtcggatcactgc

SEQ ID NO: 8434 - DNA, 3880 bp, Heterodera glycines
  misc_feature (3000)..(3000): n is a, c, g, or t
ggtcaggggttcgaaattggtcgaaatgcatgtcatattcgtgctcagcgcatcaaataacccttaaaaatgtgttttttggatttttattcctttttttttgtgggaccaatgatctgcacaattgcccacatgtttctgcgatatgtttaaaattgattggaagcacaaaagtcacaggaaataatttaaaaaaaattaatgtgaggtgaaaaaacgaaaaatctttatgtatcgttggcgtaaaaagggagcattaaaaaagttttttttcaaaaaaaaagttttaaatttttgcaaaccaaaatgttaatcttggatcattcgaaagctcatgaagaggaaaaatttttaaatgcaaagcaattggatggatgtgttgtgactgagatgtaggctcagtcacaacaggatgcattcaaaaaaagataccaggcgttctaaattattaatttttttgagtaattttttaagaacaccttaattgctttcaaaaacccttagaaaatcagtgattgccttccttttttttgtacagtcatgataaaacatttttaaaaccaatcaaaaaattatgtttctttatcagcattgtagcattttttccctctttcttattcaatgacatttatcttaaattagacatttttcaatatttttgtgagtcaataattctgaaaaaagcatcctacataccataacttattaagatcaaaaagccgtacagtaacttgatcagtagatcactcttcatagtgattgggaaatcctaaaattgcggaaagttaatgttaatatttgtacagaaactgggtaattaaataaatgataatgaataatgagcaacgtacatacaaaggaaggaaagaaagaaaaaagaaagtggagggaagaaaaacgaatggccaagaagcgacagagaaattattaattgttgacattagaaaaaattattggggaaatataaaacaatttaataattaataagaaaaagagaggaatctcataatcagtagaaaaactccattattttcacgaattttaatgtttttggcatgccataatgtgaacaatgaatgtcattcaattaattacctattatacgtactatacaattggcaacgggacgggcaatgtatacatatgtacataatataggcatgttgtgtattaactattacccgatttttgattaatacataaaagagatgacagccatgatcaaaaaataatggcccttttatgtctatttttctgttattttgcgatcaaaataagcactaattactttttgcgtctccgctgctgcattttaatgcatttaaaagtcgttttttcgcttttttattattatttggatgatcgtttcgtttttgttttgtatttttggaaatttctccccccttcaaaatgtttacttcgcccacccaccccctcttttttttggtgctgcgtcaatgcttctctttctgcgtcctgcctttcccatcattcccaattcccatttgctatttgtttgtggtacaaaaaagacaaaataaatttcgcttttactgcttgcattgcataactcccatttcccccccccccctctccctttcatttgtctgttgatttttataaattagtgaacactttcctccacacacactgaccttgctgtgctttctcccaatcccccctccttttctgttgtacaatattttcacatagccaaatttatcaaaatgatgtcttattcaaaaaaataaaattctcgttaataaatcttttttacggtagggaagggaggagcagagacgcgggattgttaaacttcttttgttatatatttcatttctctattttttagccgacattaaaaaacggacttgtctatgaaggaacaacaaaaatctgacgaagtgttgtcagaggacgatgaatccaaagaacccactgagttgccggtcacaaccttcgaatttttctctgaactcagcaattgggaacatcacaaatctgagaaagcaccacagcaggaagtggaggaccagcagcaagagcccgttgaacagaagcacaaaattgatgacaaaaaagtggagacgcacgggggcattgagcgcaaggaaggactgtcgtgagtggcgccggtttcggtggtgtccaacaatttctcgacacttttctagtttagtggctccgatgcaaacccatgagggtggaggaccctctgatttcaaatttgttcagttatatttaattaagcataaaccaaagggtccctccccttttgggttttctgaaaaaaacgtcccactaaattagaaaagtgccaatttctcttttcatgcgtaatcttcagctacttcgccgttctggtcaacttcctcaaatccatcattggcgccggtgtcctttcacttccgatggcattcaaagatgccggcatttgggtgtgttcagcaattttcgccatcctttctaatgattcgttcatctttagggtgcgttggttctgctcaacgtcgccgccatcctcaattgttactgtatgatgcaactcgtggagaccactcagttccattacaaacggtgcgtttcgccataatgagaaatttttttaccttttgcgtctcccttcagcctcaacgtcacttacctcagctacggcaacttggcgaaagaagcgtgcaagtacagctttccgtggatgcgaaagtttaaacttatggccaagtcagtcccatccattcgaatccgaattcacaatttgttttatggccatctcttttttcaggagacttgtcaatgggtccgttcttttgctcgagtttggcttctgcagcacttactatctgttaatctccacaaacttgagagaggtgttcaacttcttgacggtttcggacacatcaatcaaagtttggcttgtgctcatttacgtccctatggtcttcatggtaacttttgcctcattttgtatttgagactgaaatgacacaaaaattaagactntcatccgttccatgcgcattttgtccttcttcagtttggctgggaatgtgctgatgttcatgagtttgttctacatactctatgtgcgtttattcaatttttggaatgcaaatttggtgtaatttttgcctcatcttcaggcattggcctaccgactgctcagtgaggaggaaaagccagaaattcacgcaatcggcagcttttccgggatgttactcgcttcgagcacaatgattttttcctacgaagctcaaactttggtgtgtcgtccattgtttttactgaccatttcgcttttcgtcaggtccttccgctggagaagaaattgaagaaacctcagcaaatgttgggtttgtctggcattctgtctgtcggcatttccatctccacgcttatttacgccagtttgggctttctcggatactacgcctacggttcttgcgtaaagggcgctatcactcagaatttgggagaaactaggtgagtgagtggcaaagaatggctgacaactgtttgagtacgttcggctgttcatctcctttccttgcctttcagaatgagtgccgtggtcaaattggctctctctgtgtccatttgctcttccttccttctgcaaatgtacgtcatcgtcgatggtacggtattccaattggtagaaatggtacggtatttcctccccctcccccaacttttaagtgctttggtcgcgaaccgcccggatgataattgaaggggaaaatttcaagaagacaaatgatgagaaggacagaaagaagaagtggtggcaatttccttccggctgcaaattattcgctgaacttttcttccgcgcttcgatggtcgccgtgtgttgtgagtgctttgcttcattctgcctttt

SEQ ID NO: 8435 - DNA, 5335 bp, Heterodera glycines
attattagcagggaacgtatttatatgtgctaaaaaacgccaaatatgtacatatatatgtgccaaaaaactccccaaaatatttgctaaaactcaaaaaaaaaaaaagccaaaatatgtgccaaaaactggagaaaaactgtaataaaaacgtgaatttctcaaaaaagtctcccttttttattaattcgctagcacaatgctaataaaagcattttaatgctttttggcataaattttttttcttgctctcaaagatttatttattttcggaattatcttcgctaaaattcaaattttgcatcttaaacacagcggcccaattttgggctccaagtagaattatgctggatttttcgtcttagtggtctgtgagttagtcaccaaaaggggggtcccaggcagagctgtgcgaaaatcacaaaaaaactttttcgtatacgaaaacgaaacgaaaacgtgcattcgatacgaaaacgaaacacgaaacgaaaaaaaatattttgaaaaccgaaaacgaaacacgaaacgaaaaaattttgacggacgaaaacgaaacacgaaaacgaaaaaataaccattttcgtacgaaacgaaacgaaaaaaccgaaaattttttgaacttatttcaatcataattaagaaacataaaactttaaaattgtatcctctaactgaaggaatgaagatcctagtaggtggaaaagctaatgtggctctaggacaggggtgtgcccaaacaatttttaaaataaagaacatcaatgacaaaataaggtttagggtcaaaaaagacaatcttgcaaaattggttcgaatcagttaatatataattttttcgataaaaaatgtattaaaatgttatgttttcacatcctattatggattttaacaatttttggggaagaaattagcaactgctgaaaaaaaagattttcaaacgttttttttgcagtgtatttttttttacaagttgatgaatgggaagtgggtccggcggagccgataggcgacgccgggaaaatttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttgtaaaatattgctctgacgaaaacgaaaacgaaacgaaaatccaaaattttaaaaaccgaaaacgaaacacgaaacgaaaaacaaaattttgaaaaccgaaaccgaaaacgaaacgaaaaaactttagcggacgaaaacgaaacacgaaaacgaaactcaaaaagtaccgaaaatttaggacgaaacgaaaacgacacgaaatttcgtccagccctgcttcagactgcttccacatgtccatcatcgaaccatcatttcgaacaattttttttggcacagatattacacgtgcaataatacatatagactttttgttaaaatatttccaaatttccaacattttttttggtttattaaagcataaaaaatcgttgtagaatttagttacaaagaaagagatggataaagacaatttttgttacagtttctttattgtgggctttttggtgtaacgacggataaatgccgacactcgcccaaaatgacaatgtgcaaaaaatgcaaatgcacatattcttttttctaaaacaatctcaaatataattttacttaaaatttctattttttgaaataataaagtgaataaaaattaggttagtttcaatcatcaacaaaaaattataaattgtttattctgtcctccatctccaattttggtcttaatggcaattaattacttttttttattagcatttaatttggaccttcttttggagcatcgcacaaaaggaaaatgattttaggtgctaaaaactgccaaaaatgtagtttttaggttctaaaaaccccccaaaataggtgctaaaaattttgctaaaaactttcaaatttaggggggtgtaaaatcgaaattttttttaaaaagcaacaaaattaggccaaatcataaattagaaaatcataatttttttaaatcaaaattcttgtcaagaaagtaaataaataaatttaagaaatgaatttcgagaaattttcatttcttagggatatatttttaaaaaagataaaaacctaaaaattacattcataattataatttatttttttttttgatttctttacatcagacaaataaataaatgaacttcaatattggctggtccacgaatgtcaaattaaaatatttgtttgaattggcacttaccgcaaacgaaacgaaattagggaatccccaattatttgattttttgtcaaaaacatgatcacaaaatgtcccaatcgaattctccgtcccatttttttgcgagataattcgaaaagttgccgaacgaacgtagcaacgccaaagcgaatcttaatggggtattaattattgctgttaattagtactaattaacagttaatttgcaccttttttcgaagtatcgcatcaaatgaaaatgcccaaccatttctcattattgtcagtgcttccaattttcgtttttattttcgccattattctccatggaagtccatttatgtacacttttttgctgtaccgactgcttccaactttctctagtgcaaattccgacactttttcaatgtcaattaaaagtgtgccttttttccgatcggaaatccgtccattagtcggaaatggcattgggaaaaatccgtcggaaatcccatgacaatttggaagggatttgaactggtaaacggcgatcacttcatcttttgacaaaacaccgaagggaactgtaaatattggttcttatcctttttgtcacccccccccctttaactaaaataaatggataaaaattaaaattattgaaaaaattttaattaataatttgatattagttattttaccaattttgttcgaaaattcttcaattgagaaaagcggaaagcgaattttgaacagtgctgggccgagaacggcacgacgattctttgccgagcattcaattccattttgatggcattttgcatcggcccaacggagtgccgaaaaataaataggaaataatggttaatttaaaaaataaataaattaataataaaatttagagttttaatttatttgtaaaataattacagcgttccaaattgaaatttctccattgatttgcaattcgtcacgcgacaaaatttcgcacaatgttttttggtcaatttgtaaaaattcctccgatttgagcaaagtgtcggcattttcatacaaaaaaaagtctctaaagtcaagagtttttcgatctcacaatcagacagcaacaattaattggtcttaaagtagcttggttccacggtcctcactagggctgggatttttaggcaaaagcctattttttcctgagctccccgtggcctgaaacgcactaaaaacatggttttttgggatgttgttaagctacttttcgagttattagagcctattttctaggtttttatttttagagcctaaaagcctaaaaattttttgaaagaacctatttttgccttttgtccaaaattataataattcaaaaaatacacccctaagaatcgacctaaaaatttcttcaaaaaatacacccctaagaatcgacccaaaaaagcaaaattttaaatttttacaaaatgcaaaaatttacggcattccatatggcaatttcttggcttacaaccaactgatcccggcacagaattttgaacaataatttctggtcaatttgcaaaaatgcctctgatttgaacaaggtgtccgcattccgatcaatgtaagccaaacaacggtcggcaaaatcatgaaatgagggaaaaaattgaactgtaaatttgttagtttatgttatactttttcggtcagaagcgagctttggcaaaagagatgaacacattgcccagcttcgcaataggaatgccaacacacgctttgaccaatggttggggtaaaacagatttatgaggtgaggcacaagtttatcttcgttaacttcctgacaatgactctcctaaaagttacagagcaacatccaattgaaaggagtattaaagaagaatttgctaatccaaatattttttaaacttactttaactataataatattttaataatttttttaggtttattaataatttcatttaatttactcattttttatgaatatttattatttttggatttatttctcaatgtttttaatcaattttttcaatattttgatgacgcaaacaattttatgaatatggaaaatttccattttaggtttaaaactatgaaaattaaactatagaaacatttagaaaatgcttatttgtgaagaataattattaaataaccttttttcactttggcagaattttgtgaattctaaatgattatcacaatgatcatttgagcagagtatttattttacaatcatttttatgcataaaatacaaattataaattcagcctttataagcgcatttgtttatgctgacaatcattcactcaatttccagagatggaaaatacaactgtaggcgacgtgaagccttaattaataaattattttaattaaaataatacatatacggtatttcctaaaataaaccccctgggcttctgctgttttttaattcctctccaaggggctccttttcaggggcttctaatttgggggggggggggtgagtagtattagggtaaaaatctgggcccccccctaggcgagagagatgcgcattcatcataggagagatgagagaattagagaaaaagagtaattgcaaaaccaaagaaaagcgattaaaatgtaaagagaccccggccaagcaaaacccccagcctaatggtattcccgggtacatttcggaccgatgcgcgcgtcgctttttttgcggataccaaaatattgatccaagtgaaagttatcaatttgtgattaatgcacatataattatgaatcgaaaaaagtttaggaaaatgatttggttaaacctccccccccatatctatgagccaaataaaatcacattttagaaaaattaatcgaattatctcttttcttttgaccaagttagtgcggtaaatatgaaattgcgcgaataatgattttgtgttaatatttatatttttctctattttctatcatagaattatagaaaaaatgatagaattttaccctt

SEQ ID NO: 8436 - DNA, 2562 bp, Heterodera glycines
  misc_feature (107)..(107): n is a, c, g, or t
aattaaattcatatgcgatacatgtttttcagtatcataaaaaaggctaaactactaaataaaaatacctatgtaaaattatgctcggacatttgtttataacattntaaataattctcatcaaactatattgagccgaataaacaactacaaaagtaaaacggataaggaaaacaataaaataaaatttaccaatgtcatgtgaaaaatatcgacaaatactcatcatttttgaataaataatgttttaaagaattatataacgaatgtaaatatatcgtgctattatattttaattataatttcaaaattaataaatactaagtaaacaaattttttacctaaaaatccttgttataatttttttattaagaaattaagctatgtcaattcaaaatgatttaaatatgttttcatttatctctaaagttgactaaaaatataatagagccagtgtgcccgttcaaaataatgattaccgtttatgaacatgaaaaataaaatctaaataattaataaaaatttaatacattttaaagtaattatttatatgatgacattaaaaagttcatataattttcagaaatgagtgtttaatgaaaacctgaaaccttatctcgaaataatagaaataatcattatttaaatatattaaaatttataaacaaccgaaaaatcattcaaacatgcatttaaaaataaataaattattttttaattgtatgacgaaattaccctgattattaaaaacaaaaattaaaaaacgatgacttagcaaagtgaagaatattttgaattttaggaaaaggtataacaccacaaaagccacatatgcgcaacatatgaagtgactaagttgaaattctgaggtatttaaagaaaaagacatttgtataaatattaataaaatactactgagaagaattaaaaataataaaaaggaacacaatgaaattattgtacattatttaattcaccgagtgctgaaatttcaaaaaaatatgtgttcgaatatgcaagatcgaatttttgtatttttaaaaaacaaaaaaaaagtttgcatgatataagacttttaatttatagagaatgaataatattttatcttttacaaatataaacgtaaccaagataaaattgcaagaaataaattagtaaaaattagatataaataaatttattgtagaaatgttgagaaataattcaaaatcccgaattcatttgacgcataaaatgaaactatttctcaatgattaaaaacttaaaatctttaattaaatacaaaaaacttactgattattttatttactaaacaacaaattggtatataaaaacattggaaaaatcaagaataaggtatttccaacactttaaaaaaattaatgaataaaaataaatagtttattaataattcaacaaattgtattattgagttaatcttgttatcaaggttttaatggatccatagtttttggaccttttaatttttgataatttttaataaatatttaattcaataagtttaataaagaaaattttgggttttttaaatattttatataaaattttcataaaattaataattatttatacaaattttatatttgtcatttattttttaatttcttactattggcagctcctccaaatatttacacatttaaatttatattttttaaattttatttattaaaaaattattattttcattttattaaattgtgtttctagacccatctgattattttaaggagtctaggtatttaatgttcacaatattattatttataaaacaatttatttttttaagtttgtcctataaattttaacgaggaaattaatttatttaatacaaattaaacaaaattttatagaattaatttaaaaaaacataaagtagaattaaattatttgttaaattttaaaaattaaactaaatttatgaataaatccgcgttcattgtgatgtcatgacaattgacggtcgatgcattcggcaagcttaaccttaaacaaattttcatccttaaataaatgctttgcttcattgaattaaatctcagaagtaattttataattattttctattttatgcttttacaattatattttaattttaaataattttactgataaaaaaatagaattattttgcagctatagttattcataattattgggttaaggctagtaaacaaatatattttgagagattttaaagttatgtttttgctattgtgtagttttgggtttccgggcttgatttaatatttgggagtatattgttatgaatattttatatataaaaatgtcacccccttctccaaactcatttcactagcacttcaagggcgttttttatatcggttatttttcaacgggtcgtcgcgaatctatgcccccttcccacaccatctctcaaataaagagttattagattgacacttaatttgggggtgttttcacgcgtcaaaaagggggctgtaccctatcaccccgaaattttagaggcttttaactaaaaaatccaacaaatttttcaacttatttcttttattttta

SEQ ID NO: 8437 - DNA, 1211 bp, Heterodera glycines
  misc_feature (1169)..(1169): n is a, c, g, or t
  misc_feature (1199)..(1200): n is a, c, g, or t
aaagatctaacgaaaaatagtaaaatagctaataaaacatatataaaataaaatcgttaaattaaaaaacattcaaaattacgaaaaatatacttatatatttaaagcaaaaaagcagacaagaaataagtaataaaattataatcgtatatttttaaaaaaacattcaaaattatttaagttgtcttcaactttttttcggtgccgtccaatgccatgcacaggaaattgcgaaattagtcacatgactacgtcaaaaaattcgaaataggcgtgtcgcgtgacaatcgtgcttggcaccataagtcacgctccattttcgcctgctatttaaaccgagaaaattaatgcaaatgttttcacttaatgcaaattttaaaaactttttttctaacccaaacatttccgcaaattctattccataatttttgtggcaaaacgattttttgtcacccccttccccaaactcatttcactagcacttcaagggcgttttttatatcggttatttttcaacggtcgttcgcgaatctatgcccccttccccacccatctctcaaataaagagttattagattgacacttaaattggggtttttcaacgcgtcaaaaaggggctgtaccctatgaccccgaaattttagaggcttttaactaagaaatccaacaaattttcaacttattcatttatttttagtgcctggcgccgtgatgttatgggacaaaacatggttgctacatcagcagatgtaaagatttagccgccggatgagaaattggtgtgcactgaccacccgatgccgggtaatcgtttaaaaatgtttttacagtcgaatttccgcttctgatattttaatgagggccccagcggtctccttgttattcttgttatttgacagaatttttggcatagcttttagacttttattaggctaaatacataattttatagataaccgacagctccctgactttctggatgggcctggtgtgcctccgccttttgcggccggaatggggcctggtgcgcctccgcatatcggagcttgaatggggccgggaatgcaccctcatatcggcattggattgggtcctggcgcacccccgcctttgatggctagagtagggctgggagcgcccccaccttttatggccggacattggccctnggagtgcccccaccattttgtcgccggaannttggacctgca

SEQ ID NO: 8438 - DNA, 1362 bp, Heterodera glycines
  misc_feature (1348)..(1348): n is a, c, g, or t
ttttactcaaatttggccgcccgccggccaccaccacccgcccgtcccaatggggacagccgcggggggtgaacaaaagaaaaacaaaataaatatgctgggggagggtatatagcgaataaaaaacaaagaaatgagtaaattccggtggttaatgcagcggcccgccctaattttgggacacgcagcggcccgcctcatttgtatttgtaggttgagagcggcggctccccagtgggcaccagggggccgtggaggacagggcggtgggtgaggcagcggaattttccggccactaaagttatgaacattagatacatttacattggtacccatgtaaatgtacattttgtatttaagattataaaaatttaaaaaattggctaaacgtacatgcaaagcagtgcctgcgcaaggccatggcgcttgtacatttcctccgcctttgttgccggcacgaagtcgtagccggcaaccggtggcttaacaaaaaaaaagttttttttttaattttgtgaataattttgaaaagcattttacctccttcttcggtttctccgtggaagtacaatagtcaacgccggagcgcactcgatgggccacatctgccagttcgtcccagcgttgctgcacagcagcggcccggccgcagttgttcaacatgaagtctgtaaggaccatccgcaaatttgggcgaactggaaaaaagtttttaatatttcagtttttcacccttttccccacctatcggtacatttacgggggtacccatgtaaatgtaccgataggtggggaaaagggttaagcggcaaagggtgtagcgcgtacgttctttttcacgtacgtccaccaattctttataccgaaatccttaccaaatttgcgctgggtatgcgatatgcagctgccctggtcactggtggtgaccatgtcggtccagcgactttttgagtcggagtggcgctgcactgtgtggttaagcgtctacaaaaaaatagatgaagcagctgttgctttttctgtcagcaacacgattgaagtgctccatgaacgggccctccagctgtaggaaggcagcggcccattccattgcaaagagaaaaaatatatattacaaaaaaaaattaagaaccccaagcttccaaaatccaacactccgccggcctgtggccgatacccaggcagcacacgcatgccacccgggtaccgccatttggccctgtcgctttgtaagacgggcatttcggaaggcccggtgccgcccttcgttgcagaccttgcacaaattcatgtgcccggtctcccaaatgctggtggcagcggcccaacgccgttgatatgctgctgntgttgacataaaaa

SEQ ID NO: 8439 - DNA, 1785 bp, Heterodera glycines
  misc_feature (68)..(68): n is a, c, g, or t
  misc_feature (133)..(133): n is a, c, g, or t
ttttgtagcgggcatgggggcgccttggggaaaagacaaaaataaacagaatgccagatcaaagtcanaatttaaatgataaaacattaattatcacataaaaaaatttttgtaatatatcatttaattcatntaatattttatataatttcgatagattaagtaattttcatatttttttattaatataaagttaaatttgtttgtctcatatatttattaaaatgattaaaacatatttattctagtattttagctttttgttgaaaaggaatccatcttcggttatgtcattttaaattttttattccaaaaaggaccaatgaatataaataatacatattagttatttttctgttaacttttaaataacaagtgaaaatttatatttattgtaatttattaagttatgtcttctttatgtatttaaaatatttgccaatataattagattttagtaattttcagaatatatttataacttctataaataatttatgttttaataaattgctaataatgaatagtttaaaggtaatttctacgactttcatatcgacgattcttttttaaaattatttcaaaattgttgcgatgcgattaataatattaatatttaaagatttttcaaaatcatcgaataattctattccatccatattgagttactgtctctacaccaaaaagtttattatttatttttaagtagttatttataaaaaaatggttttgtgtctttaagtaatattttctttaaaaactgctgtatttgtattatgattgatctaatttttccaaaatgttgcgcctagatggaattgttcaataaaaaaaatttatttatattagaaatatgccttagtttaatagttcattttatttcattaaatgtaaccttttttataataaatatctgatcaagtgtctttgatatcgtttaaatttttaccacggctccctaaaacaaaagctattctgtctgcaacccgcgttgtgactgatttcatatttgtttatttttgctttaactaatgagcgatatattattatttttaactattattattattatttttaactatttaataatataatatacgtatttaaatgctaatgttattttacgatctaatttctgttttaaatgatctatatatttttgattattttattttaaatagaaaaatatttggtgagtagtatatagcgtcaaaagcgagcgggttccgagcgggtgtttaccgcacaaacccaaacctacgggaggggtgttttcttttgaaggtgccgccggctcacaaacccgtaacctattggactacatctgaagctgccgccaagaaccaaaccctatgggaggggcgcagccctttgaagttgccgccccatcaaaacccaggaggggaggggggtgtgtgccaagccaaacctattgtaatccctgtgaagttgccgcacagaatcgaaacctattggaccactttgaagttgccgcccgctcacatcctgagcctatcggattttctttgaactctgccgctttgtggattttaatttacccaaatccgtgcgggtgttttttttcacccgcgccgcgcagcgccgcgggaaagtcatcaatcatccttcctgtcaccaaaagtgacaggtgaaagaaattcaatttttttcttttgccaatttaatcctaatttctaaaggctaaatccaaactacttaaactttacattattcccaatcctgaaattttttttttgtgatgctttttctgatcctgaaattaaa

SEQ ID NO: 8440 - DNA, 2803 bp, Heterodera glycines
  misc_feature (2496)..(2496): n is a, c, g, or t
  misc_feature (2608)..(2608): n is a, c, g, or t
  misc_feature (2676)..(2676): n is a, c, g, or t
ataaaatatttttgcactatttatctatttgccaacattaaatattttaataaaaatgataaaacaaaaaatgtctgtattattgagatttaaaaacattataaaataaacggattaattaattagattattattattattatttaaatttattaaaataattatcctttgatcagtgtgcagccaagtacggcaaggcccgtgacatttttgtaattaatatgaaaatttgatgggttagccattaaaaaaaattgctttttttcatttttgctgaattcattctcttttgtagtttattccgattaaagttgcctatcagctaataaaagtaacaaaatgccagaatgttgaatttggtcgtttctcggatttgacagaattgcgaacaatttgtttttgctagaaattttttttttaaatttttggaaaaaatttttggtcccattttcaaggtattacggaataaatttttttctgaatttattccatctttttccgatattctccaactttgtgccgcgttgaaattgtgccggcacgtaactatggcacttcccacgatttgtcttccacaaaaagttggcacgaattctcgagcgattgtgccgtgttcaccgtttgtcccgttcagctgcacttttagcagccttttggcattttgtgtgtcgtttcctcaggcaatattttcaattaatttatttagcaaattgcctgtttttgaatattgaacaaactctgtggaacttcagcgacactgtcattgtgaaaacatttcagtgggaaattacgagttggggaccaacagttggagtccgcaaggacattgggttgcccaactaattttgctttgagcgatttgaaattactaatttagaattgaaagcatttacatattaacaacaaatcattccgcttcaggcacattgatattattctgtcaaaagtgtgaaaatggtttttccgagtcgcctccaacaattaaaaaagcattttacatgttggcacttttcttaaagacggtcattttagcagcataccaccaatgcaattgttgccgcaattaagtcaaagatcttatttgtgttttttcttcaattttttgtatttttcttagcaaaaatatgtgcgatatgtttttatatgccaaaacaccaaatcgaagaatttttttttataaaagaaaaaatatttacatatttagtacgtacttttttggaggtttttaatattttgtgtaaatgcatatttttatcatttttcaaaaataaaaaaatttctttgtcctattgatcagcatcaaaatttaggaaagcatgaattcttttaagcgaattgattttaattcatttctctcccactttcattgatgaataacaaaaaaaagaaaaactctccgccacgaccaccgcttaatgtaaaaaacaaaagtgggttcatttatacttaactgctgcacttgaaaaagggcgaagttcgacgtctcgccgatttgggatgtttttatccgtgaaatttagcccatttttacgacaacaattcacttttccgtcactagaagacggaaaataatgttaattgtcgcaaaaatgaaccggtggtatttagtttcactcgacgcagcggcactgccattggagagaaagccgatgaaaaatttggccggtcgagaaacgaaatgaatattattgatctgggaccccgagtatagcatttaaatggacttattccgacctctttgcaattgttgactcattactcttcgtcggactcattataaaaatcgcaacaagaatcgctttggctgtccatcggttgtcggagtgtgcaaccattgggacaacgcgtagccagcagttgtatttggcccatcatcatcagcaagcacatcgggaaacggaccaagtgaactgcttgaattcaggttcagatcagagagaattgttggcaaaatgagtcgggcaatttgtccaaatgatcagcattatgaaaatctaagcggcaaatgcttgacgcgaaaagatgccaaatttctcgggccaaaacatcaatttgttgaccaattaaaattcaaatcggcaacagacgaccgggatggactgagttggtattgggcgaaatgaaatgaatttaattgtccaaaagatcactattgggaaagaacaaatggtgattttttgtcgtaaaatggggctaaattttacagaaaaaaagattctaaatcggatggacatcgattttgaatgataaaggcaatacaaaaacatttgtgttcttgtgcttatgcaaagtttcaaaaaattcgtctggcttcaaacaatgtgaccaaaatgtctcaaaattgatttctgtttatttgtgcctcttttcctatatttccaatcacattccattaatttcattggtcaatttcttcaaaatttgtcgttgtaaattatttttgaattatttaaattttgaataaagaatggtgatctgatcacgatgtaacaattngattggttgtgaaaaatcaatattatcaagtcgaaaataacttttctattaaattatcgttaaaaacaaaaatgtggcgggtaagtctcacgtcaaaaaagcggtgccgtcngtttagcggcccatggcccatctgatctcgtgccgttctccccgctttcctttaatggtgataatggntgaagtgatgtattatccctaattggcgaataatagaataatgatctttattgcgtaaggacaaagaatacatcattgtgatcccccactcgtaacgggaaaaggggaggttggtcgggatccggat

SEQ ID NO: 8441 - DNA, 3506 bp, Heterodera glycines
tggtttaataattttttgattaataaaattgttttcttattattattattatttttttttaaatattaaatattaaccatcatcactattctatggtcggtatttattcgaatcatctttaaattgatctttggtaaacggttaaatgcgccacttgttgatggttctgattgtgaatgatcatttctggcccatccttcattcccgcgccaattgtggtggtatgggcgctgtcgcccgcgtccacggctgttgttgacccatctgccgaccgtcccacgattacggtagcggaactcgtcatgttgtcgccaagtcgacgtatttgtgttggcaaatcggttcgaattcggatgaaattcttccgctttttccatttcttttttggcgattttcgtcagttcatccatttctttggctaattcctttaatcctccaaaagcctttgtcatttgttgttgaatttggtttattttttggcaaatgctgttctcaattttcttcattttctcctcttttgtattttgtgctgtttcctcccaaacacaattggcaaactgcccttgagttgccggtgtttttgctgcgaagcgttttcttcgctccaactcttcttctgtttcttttgcctccaattcgttccggactggaatttgtttcctcattccttcaggttgaatgatctctgactgcaaaatgctcttttccgcacttcttatgcaattctcggccatacgtcggccgttaaatccaagtccgacttttccaatgacgcttaatcgatcttcctttcttatgtccagggttgtaacattctcagttcttggctcaaatatttcggttttttccattgtgactttaattgttttaggaacatgcgcatcgataaccgatacaatattagtccatatttctcccaatcgtactttccgttctccaaaagcaataattccttttaagtcagataataatggtaatcccaaaagtaaaggtccgggacagtgcttgtcaggagaaacaagtaaagttaattcccattcaccagtttttcccgtggtttgatcttctattcttatctttgcatttgtttttcccaaaatttgtatttgtgaatcatttgctgctgttaaatttgaatttctctcactcaattcgctaatttttaatcccgcttttcgggctgttgattcacgacagtatgatacacttgcgcatgagtccaccaatgcggatgttaataaaccattaaaatgtacacgaattgagggaagccttcttggatcatttgtgattactgccactcttcgtggtggcaaatagtccaaaacatatgcatcttcatcaattgagtccaaatccggtgctgttggcacagccacaatttgtgttcttttcctttttagaccaataatgctccgaataatccttgccaaaaatgtacccgctcgaaagcctgctgaaattactgtccaatatttcactacaatatatataactattgcgataagtataaataatgggataataattaatgcatatgaaatgccctttaaataattaaccgcctcttttgcttttttggggatgtccctcatcatttcaagccaacttcccgttttccctaggacaacatccaatttttcagttgcttcatctttgattaatttaatgacatcagttaaatttggtctttgaattaatcgtaaggcggatgatggtaaattgttcgcttttcttctgtattccaacattgtctcttcaattcttatggtttcagactcgaaaagtgctcccgattttaatattaaagggttttgcatatttctatattttggacgaattttttctaaatttttatttaatttatgtatgatttctttttgtgtagcattttggacattttcaaggtcttcaatttttccgcactcaattcttctccccaagatgcttaattccctagtgccggcttgcacaaaaaaggttgtgttttcagcaaaaatgggtgtctgttcgtaacaatcagctccgattttcttgtcccaaatgattttttcgggaataatcggtacacaaaatccgacctctaatgtttgacccttccatcgagcgaccaaatcgtctctatcaaaaatccgtctgactccttcatttgggcttatttgcaaaattgcttttgccaattgaagttgaaaatttgagttttcacaagcttgagtaaatatatggtcatattgacgctttctctcttcatttagccggtataatgcataattaactcgtgtattcatattcttattttcttgtccgcccttttttcgtaatttgcttccttcaactttctttatccaccttgcgtccggagttgttactgttgtccttttcctcctatccacatcataaatttcaaactcttcctcattttcataactcattccattattttcctccaaattttcatcctcaatttccaagctttcgccttggtcggccacaatttcattttccaaactttttgggagattttcgactatttccttctcaattttgatgtttcctgttaattttggttcactaacattcttaacttctttttgggttttgtttgttccttccatttctatttctacttttttaataatctcagtttcagtccgcatttttcccgatgttgtgtttatattttcctcattttttatttcctgcttgagaattgttgtcggttttgcgctctgactttttaaagtgttttgcggcgtaatgtttttgtttaatttttttgggctggaagattttacttccaatttttgaggaatttttttttcttttattaattcagttctatttttttggttagtgtttgtggttgtgtttagtttccctaaggcattaatagttagctttggttttggtgtggttaaagttaatttaatttttggagaagtggtcgtgctgattattttttgtgtaattggaaattgagtcgtgaccaccatgggctttggagtggttttaaactgtttttgagccgattttccttttattcctggagatttgtatatttgttgtgcaggagtcgtttgtacctgaattctatcaatgagaatgtttttctcattagaagcattggctttttgttttgtcggcggcggccttttaattttgggtggtaccgttgtttttaaattggttaaaattctaggaatcatcgttgttttggggctttgggtttgcaaattttcatttgtttgtggtgacgcggtacttaaaacgattgttgtggacactgtaatgttttccagaccaaaactattattaaagttcagatttggctccacttttttagcgtttgaattattttggttattaaggatttgaaaaatttcctgattttttaagaaaacttcttgtttaattggtctattttttctcatgggttcggttttcttttttagttcccttttttcttttttatttatgttatgaattgtgataaaaacatcattcga

SEQ ID NO: 8442 - DNA, 5230 bp, Heterodera glycines
  misc_feature (354)..(354): n is a, c, g, or t
ggcctggcagggtcctggtcgaagggcaagaaatcgccgtcaaattcgtcgaccgccccgagatcgccgtcaaatccgtcgatggccaagaaatcgcctccaaatccgtcgaaggccaagcgctcgccgtcaaagcaatcgccgccaaatccgtcgaaggccaagcgctcgccgtcaaagcaatcgccgccaaatccgtcgaaggccaaacgatcgccgccaaatctttccaaagccaagcggtcgccgtcaaagtaatcgccgccaaatccgtcgaaggccaaacgatcgccgcaaaatctgtagaaggccaagcgatcgcaacgatcactggcaaaatctggtgacgctcanacggtggctggcaaatccgtggacggaggggtattggcggctaaatctggtggctggaagaagcagttcgctaccaagtcggtggcgacagctggaactgggaaaggcgtaaacgaacgtgcaaccgctaaaaaagcagttgcaatgaaagccgtggcgggcggatgcgcggtggccaccaaatgtgtggtcggacgtgcggcggccatcaaaacggtggagggatgaagcaatgatcaatttgatgggataattagctatgagtgctaccaaatttgactggcttaatttgttattgataagaatatttttggggaacattcaatcaaatcattttggtgttttatcattatttaaattggctgttgcattcaattttatcatactattttttaaaatttgattaatgaactcattaagtgcaattaagcaattaaatcaattttttaaatttaatattccaagatatttttcttcgcaaaatttaatttttctaatagaaaaagtaacaaaaaataattatgaatgtatcatttttatacatattttaaatcagcgcattcagttatatattcctttgattcacggatgcttaaaagggaattaaattaatacaatacattttaaaaaagttctaattaattatgtgtaattgattagtcaattacgtttttgatgtgttaatatgctgtgacgatgtgccgctgcaaatgaaaaaacgcatagcacagaatagcaaatttgatcggcctaaatttgttaaatgaacctaatttcaaaaagtttaatggttgttttttgtaattttataaaattcaaaaaatttagatagaaatttattgataagcacaacaaacaatggatcacaacgacagcaaaaatataagtacaaaaatatttgtataagcataaaatgagtgccaaaacaaaaataatataataataaatgtgtaattaaagcacttaaagcacacagcagaaaagaaggttatgtaattattatttttggctctattgcagtctacaggattcacaaaaatttcaaagaatttcgttatcttttaaaaaagttatgatcagaaaattcaaaaaaaaaaaaactttctgagcatttttgaccataagtttttggatcttaaggtaattttttttaaatcttggtaaaccaatagagaactctttgggctatcaaatgataccatgaatgtttaatttggatgattatagaaaaatgcattacatttattttattatcttgtaaactgcgacgaacagagccatttattttttttcgtcagggaccaggggtgtgcgaaatttcgtgtcgttttcgtgtcgtccccttttttcgtcactttttgagtttcgttttcgtccgtaaaaaattttcgtttcgttttcgagttttgaaattttaaattttcgtttcgtgtttcgttttcgtgaaaaataaatattttcgtttcgttttcgaaaattattttttttggttttcgcacacccctgtcagggacagggcttcaatttttaatactaatttttacggttttcgcatttttgaaatgaagtcctgtttttcttattgtcttaattataagaaaattgcaaatttttttttgctccacccaaaatttaaatcattggaaatagaattggtcctttgtattttggttctcgatgaattcggaggtctgaaagtgtgttcgaccttggcctttcaaaaactgatgcagtttcgtcattttcagaatacgaaccacacaaacattctaaattgacaggataattaataaaaaaaagtatcgattttttaaacaatttagactaattaccatcaatttgtggggccttcataggaaggattatcctagactcattagggtcttgtggagagcgataaagagttacctgaacagaaattgaaaaaaatatatgagtatattgtataaaaaaggtcagggatgtgtatttattaggataaaaagttatataagtaaacatttttatcattcattttttgcccacttcccattttcagcaaaaaaattttaattctgaaaagttgtcaaatacatatctgggtttttcggatgaatatgacttttagttttgacaatctcgactctaacccgaattcgaaggaaaaggaaaaaactaaaattttttacaactgcatgggaaagacagctgctgttgaaaaccttctaatgaatttttactaattttctagcgtttaaatcatttatagttacttataaatgaaagcaaaaaaaaagtgggggcaaactacagaaactattaaattttaataaatcatttttttgaaattttaaattttgttggaccataaaaaggctttttgaattgaatttacatccctgacaaagacaccacacacaacaacaacaaacagaacacaaacattgttgtccagcttttcacgaagctgttcattgcactcctcgtccagagtttggtgcacagaaaaaacacgatgaagtgaccatgaaattgaggctgccttaagcaacacaaacactggtggcacaacacttccaattaaaaaacattggcaacaaaaaaaaaagtgacaaaatcggcacaaaaaattgtttattggaaaatatatcgaatttttaaaaaaaatgcaaataaaatagaaaaaagaaataattttaatcattaaaaaaataaaattttcgaatcattaaaaaaaattttttaaagttataaattttttttaatcattagaaaaagttgaatcattaaattttgaaaagtcattctttattttatttttagatttatttttacaagtaagatttgttttataatataattttataagaattttaacccataaatacaaagtttttgaattaaaaaaggaataaataaaactgaccaccgaagaaatgtatcggcgctgtataagctgattgttggcacgatctgtttaatttcaattaaaatatttcaatattaattaaaatattttactaaattcttccaggatgaaaatgttgccgccttaaaatatttcaaaatttttaaaattaatattgtccctccaatttaccgatagtgttacattttttgatgttgcttagttcaataaattcctaaatttaaaatttaaaaaaaattggggtttttaaaattttgtgcctgcgaattcacaaattgcaatgcgatgccatcaatgcgaactttgagcagaccaccttcatttcgttccacgtcatggattggaaattcgccgcccaactctcggccagccacttgcacttttccttcaaattaattaaataattttagctatattgtcaatttaaataatgtaattagggctataaattgtatgcctttgcatattttttctgcgcatatgtgatgaaaaaaggatctcaaaaaaacactatttctacgtaaaaaatttttaatttgttaaagggttttagtgcatataaatgcatattttgccattttgaggagtttagggcttattttggtcattttggcaaatttttgaagaaaaatgtaataaaaacgaaaaattacccatgaggatcgactttttgggaatttaaaaaaatacacctttgaaaatcgagcaaagtttatgaataacaaaatttttttcatttgacgatttctgactaacgtcataaaatatgaaacgacctaacatcatacacttattcaattgtcataaattcaattattattattagtttttttttttttgcctcttgatgctgcccgttccattgctgttttcatactgttgtacaaatgacggcacttaaattttaattatgtttgatacatatacataattatttattttttaatcccagatattcattcaccttttttgtatggaatttatgcatgtaaacttggtcatcatgacgacgccataagcaaagcactcgcgttttctaattaaattttccaatttattaattatatttttatggagacccaaaaaacgtagaaacacaccggtgaatatgtcatgttcacaagcctctcataccaccaccgttcttgcacaacaccattagcatcacgcaaaatcagcgcatcatcacaaaccttttttgaaattaattctatttttgtaagtatcgtacaaaaaaatggttattgatttttgtatctaccgtacaaacttaaaaatttgggactaccagattttctgtaccttattcctcggttttagtttatttttttttattcggttatttatgaatcgtaattacatcccaaccaaattgatgaaaattttcatggaattttgttaggaaattggtaaaaaaaaaattttttttaaataagctacttccaaaaagcacattggcccatcaggggaagagccggtgtgcactgtaaacacttctttctgaatgagccgactgccgagtggtttcaatgggattttagcgccgaaaggctaaaaaaatttaaaaaaaatttaattaaaattcaaaaaaataaattcacaaggttcgaaagttcgtccaacaacagattgatgcgtttggaataaatcagcccaatgtgtgccttgccaagcagacgacgaattttttgttgtataactctgatcggcacatggcaaaggtgcatcttgaaaaatataaataaaattgaaaatttcacaaaatgactataaattcctgcttttttctgcccggcgcggaaaatttaaaaaaaaaataccttgaaaaatataaataaaattgaaaatttcacaaaatgactataaattcctgcttttttctgcccggcgcggaaaatttaaaaaaaatacatgtcataaattatttttcccaatgatcaaaataaggggtcttcgaattcccgcctc

SEQ ID NO: 8443 - DNA, 1385 bp, Heterodera glycines
caaaaatgtaaaattagagtgtctttaaacaatgttatgccaagttttgtggaaaaattcgctaaaatggcggattttacgaaacgcccaaggtggcggattttacaaaacgacctagcaccggttcgacctagcacagctggtataacgcagtccaataaaatattccttacaatagctgtcatattatgcagaaggacagccaaaatgcggtcttcttcaagctccaaccgttttctttcaccatcaccaagctgactgtaacggtcaatcatttcggacggctcctggtccatctggaaaacggggaattttcaaaattccatttcatttcaaattactccaattttgtccctctcctgtgcaaccatgtccagaaaggcggtttcccacaacggcatctgttgccataacacatttgacgaatgatttggcgcttaaaaatgcgcgaaataaatctggcattgtgttaatttgtaaaaattagaaattaatttacatggccctattaaatcatagaacaagaaatttctcggtggaatttgttcatcaacaaaagatgtagaaggcaacattgcttcaagtgagttcaaattcaaatgttgaggcacttggatttttggcgcttcctcaaaaaatttcaatttaatttatttattaaattttaaaaataaaaataataatattttataataatcgcctttttgtttgccaattcatctttaaacagttgttgatccttcactgaaattttgtgaacatttttctgaatttgagcttgatcattttcgcacagcagctcaggcgttgtagaatttggtaaaatttccttaaattcaataaaataattatttttgaataaataaaattttaaaattcacagaagcagcagtcaatgacggctttttatcggttgttggaaggcttggcctttttggcactggtggaggcgcgtccatagtgaatgacaatggtggtggttgtggtggtggcatttctcgtgatggaactcgtggtggtaatggcttaaaatttcgaattaaaatatattaatttaaaaaatgattcgactggtggtggtctagttggaagtggtggtggtggacatgatggtgccggaattgtataaatcggtgccactggaggaggaggctcaatgggcagtggaatttctgctggttgcggtgcgtcatgggttgaatcgtcgtcatattttgaattcttgaaaaaaaaaatagaatttttacctattttttattcgatacgaatcaagtttaagaaaattttgaacaaaaaatggacataaacttaaccagtttcatttattcattatgattctaaaatagattcacttttgctggacttggcatgccattcgttatatg

SEQ ID NO: 8444 - DNA, 5364 bp, Heterodera glycines
  misc_feature (59)..(60): n is a, c, g, or t
  misc_feature (5350)..(5350): n is a, c, g, or t
gagcgcgtttcatcacatttttgttggcttttttgtcctttttcttttgcccagactgnnaaaaatggtaattaaattgcttgaatctttataaaaaattgaattttttaaaatttttgtcaaattaaaattcatttaattatttcccattttctgcttctcacatcatcgccgcctcgtccgtttggctcggctccaaaatgtgcacttcgaatgggctgcccctcaccacttctttgttgaacctggcaaagtgccaaactcaaaaattgaaatgcttaatcattaaaatttatattaaaaattaattagttattcaaattttacgttatgtgcacagtgtgtgttccggcagtggctgggttgaaagtgaccagaaatttggcggttccgctttcgatttggctgacatgtgatgggattataatgccgtcgtggtcctggcaaaaaaaataaattaatattttagagttaaataaatagaaagtggtgtatttgttaattaataatttttataatcgttaagaattggttgccacaaaaacatattatttttattttttaaagtttttacaacttcaaaataatttcattttttggtggtattgtaaaaatggtttatcaattaattaattatttttaataataaatgtgtaaagtctattcaaatttgttttaaattatcaaatttctaattaatatattggaaatagaattattttttgtgcaaaatattgaaatatttctcaattcctccacctttatggccatctccaagtttccaaatccggccctgccagcgtccacagtaaattccaccgtatcattgacagtcgcttcggtgacaatgtcttccaccacaatttggccagcatcataaacccgaattgggaacggagtttggggatggggctaaacattttaaaaatttattaaatttaatctaaaaattatttccaaaatgccaccatgttgttcacgaacaccaacactttgtgcgttccgacctgaaaatgacacatttgttcagaaaccttttaaattttttgaaataaaaattcgtcatttaaatagtttcttggtataattcggtgtttaaatgttctataacaattttgaaaattaacaaaaaaaaattttttctttggttttaccagtacaaaaacacttctggcggaatttaaaaaatgacctaaaaccaattctttccaaataatgaaatattaaatgtcttaatatggcacatttttattgttccatttttattgttccatttttaaaatttgtgtttaagttccaattgacaaatgcccattttcacctccgttggtttgaagctgatctcccacgttttgctgcccgtcttgcggagtcggtgaacaatctcaacggcttgcggttgtgctgcagttggttctgccacgcgttgttcgcctgcaatttgagcgctggcggcactcgtggcgggaggagttacaagcaaaaatggcaaatttattaattaagtttttaaattaattatttgtttaaattaccactcgcaaaacgtcttctttgcccaacttgagcccgtccagcttcacctccacctctttaccacgacggacgacctgagacaaagagacaaaatattttccaatttttattgcaattaaataattgttcaaattaattgttattataattaaataattattccttttaaatgaaaattatttcgcttttctcaccgaatgtttgctgctcagtttcgattttccccactcaaaaacgccgtccgttttgtctttgccccggaatttcaagctcagccgcggcgttgttgcttttgaagaatgccttgaactaaaaattgaatattataattaattgctatatttttttaaatttttccgctaacctcgaatgtttcataaacattgtaattaatgaaattattatttattattttttaatttctccacttgcctcggtgtttccgactcagcctcgtgatccgttgttgtggctgagcctcgtccttcgactggtgaaggtaacgtttcctgaattttggtgtgattgaggggggaggggagcagttcacgcggtacaaccatttccccaattgagaaagttttcaaaaaaattaatacaataattataaagataaaaagtgaaaaaaaagtatttgaatattaagtcaaatggattgggctttccttttgagacaaacggtgaaaatttattatggtccaataaaaattcaaattttcggcctaaatgggacttatatcccccaaaaccagttatggtacgaaataaattaaaaaccaattacaaattataaatttttctacattggtctcgttagcaccagagccccggtatttgcgcctatgtccaaaagcggattcaaaattgaattttttcaagccttgatagcctaaacagcatttaaattaagaaaacccagttttctagtttattaggaaacttaattcagctgtttgaataattataatttttttcaaaaatttaataactatcaaattatcagacataacaactctctatcacttaaataatgctatttaagctttcatttgtcagggattgaaaatacttaattttgaacccgattttggacaaaggcgcaaatgtcgggacaaccatagggactttttttgagttacacatttaaccaaacccagttacaaatcaaccatttgcagtaagcgctagtgttttggccccattactgtattcggcaaacgcacctttaagtcgtgcgctttgtgcacgccgtgctcctgcaagcggtgtcgcgtgccgggtgtcatcggcggtggcccgccggcatcaacaatggtggacgaaaaagggtccacaatgtgtgttggcattgccgctggacgccgttggtctaccataacggtttctacggtaggctgtggcgatacggtgacagtctcagtgacgacgcccactgtctccaagccgtgctgctggtgctgttgggcacgcaacatttccacagtgcgacgcgctaattgaataacaaattgactaattaaaaattggaaacggaaaaaagggggggaaatggattttttttgaaaagtatggtcatttcttaaaaaaatgtttaaagaagaaagcttttgatatcctttacaataaaaaaagaaattttccaattaaaaaaatctttttttataatttaatatttggcgaaattttaattttaaatggactatttcaataaaaaattattgcataatgttttgtttaatattttcggttttattgttgtgttttttgcttttaattagcacctctttggtcgagtggcgcatacggaacttcgcgcgctttgtgaaactcggcgactgattgtgaagatggcttaattaattatcacattcataaaaaataagatttagcaaaataaattaattcaaaatttaaaaattgcaaataaatatttatttggcgtatttgaaattttgcagaaaatagtaaaagcataaagctatcgaacaattctggaaattctcttaatttggttaataattaaaaaaagttatggtccaaaatatcatccagcgatattttggagtgcaccaatatttgtccacctctttctgttcactggtcgatgggtgttctttgagcaaagtgagttcagctgatctggtcatctcaaattgggccgcctcagagtcagcctcaaaattcgttttttaaaataatttgaatttttaaattaataaatattaaattcatgtcaaaccaacccccggcggtggcggcggttttttcacgtcagtttcagtgccaaaatatttgtgtggtggcgaaacagcagctttaggtgacggtgatggaatacggccaccaaattgctggaattaataacagtatttaaattgctttttaattttttaatttgattgaataaaatttaccgtctctcgtgggggtggcaacggggacatacgacgctccacagtatgtgttgtggttgttgttttgtcatactgtgccacctttatttgtagattttggatgttttgaaagagcatattttccaataattaactgtcactatatgttattttatttgctaattgcttttgataaaaatacaaaagttcctcctaccgtataaccgagtagcccccgcggcggttcactcttctcccgctgtcgcatcgcggactgcagcagtgaggtgctgcgcaagtcgccggcagtcgtcacaggctcagcggacagatcgtggcgacgctgctcgacgggcgacgcgtgctgcgaatgctgataaaattaaaaaacaataacgatatttaatatttaaagcaaaatattagttaattttcgttaaaaatgccataaaagtactaataaataagggtttaatttatgatgaatcaaaaaattattgtgtttcaaattaaaattattttatttgtccattttgaagataacatttttttacgtaccgcgcgcgcaatatacgccggcgatgacggagaaggcgcgtaagaagaggcggtgtccgcgtggggcgacacggacgaatggtaagcggaggacgggccacgctccagcggcacggaggcgccgcgaggggtcggcggagagccatagacagccgctaaatcaaataaattgaaattttttaaaatttaatttttcataaatattatgtttaaatggtaacttattaatgtattaacttataaggataattgaaaaagaaaattataaaaattaatttgcatttgtcatttaataatttcgttattgaaaaatgggacaaaaaatattgatttataatttaaattttttagtcaaaaaagattaaactaaaaagagaggtgagtggtgttttaccttggaaaaaagtcaaacagaaccaaaaaactaatttattttctgttaaaaataataaataaatggaaaatacaactcggaatttagtatgaagagaataaaaaattaggaatcaaattttattattaattaatgtaattaaaaaggaattggttgtcacttgttcccgccggacgtgcatagactggtgccgagactggtttgcccacctgccgttctcgcacatcgacttcgatggggcagcctttgcaaaaaaataaattaattaaaatttttgaaaattaaaaaatatatattatgagaggcaaattgcgttaattttcaaaggaaaaagaaagccgcctctgaccatgcacttgaagcccgttgaaagtgacatcgatcacgtaagtgccagaatgttggggaatgaaagtgaccagacaacggccggcatctgtaaaggaatattttattaaacgcaaaaaantatataatttaatt

SEQ ID NO: 8445 - DNA, 1943 bp, Heterodera glycines
  misc_feature (1932)..(1932): n is a, c, g, or t
ttcgttattgaaaaatgggacaaaaaatattgatttatctttaaattttttagtcaaaaaagattaaactaaaaagagacgtgagtggtgttttaccttggaaaaaagtcaaacagaaccaaaaaactaatttattttctgttaaaaataataaataaataaacaaatggaaaatacaactcggaatttagtatgaagagaataaaaaattaggaatcaaattttattattaattaatgtaattaaaaaagaattggttgtcacttgttcccgccggacgtgcatagactggtgccgagactggtttgcccacctgccgttctcgcacatcgacttcgatggggcagcctttgcaaaaaaattaattaattaaaatttttgaaaattaaaaaatatatattatgagaggcaaattgcgttaattttcaaaggaaaaagaaagccgcctctgaccatgcacttgaagcccgttgaaagtgacatcgatcacataagtgccggaatgttggggaatgaaagtgaccagacaacggccggcatctgtgacggaatattttattaaacgcaaaaaatataatttaattaaaaattttataaattaaaaaaagtcattaattaataattaattattatattcaagcaacaaaaaaacaggatttgataaaaatgataaatttttcattttaaaataaattgaaatattggccaaattcaccctgcatttgcacgttgttcggcacttggccttggttgaccgaaatttccaactgtcccttgcccgcctcggtcgcgtcaactgcagggataacgtacaattgggacacatagcgcggggaggacaacggagggccgaggccatcgccggaggacattttcaacgaattcagaaaacaaaaacaatttttgcgatttggaggcctagcaaatgaggccttggcactgattattctataaaaaaataaaattggggagggaagaaaaacaaataaaatgtgttgcataaactaaatgctggggggggattaatgaaaatgaaaaatttaatttaaaattttattagaaatgagcgaataaaaaatatattcaaaaacttttatgaaaatgagtggatgtaattcttctgccacaaagagtaaattgagaaggtttttcaatttgtttcttctcatcgatattttcagcggaaagcaaacaaaaaaataagtaataaaaagaacgttgtgattggcccatacaaaactcacaacaaatccattgatattcgctgaatggacggccaatttattgaacagaaaaaaacaacaaaaagaaaaataataaaaaaatgaaatggactaattgaaaatgaaaaataaaatgaataaataaaaattaaaaaataatgacagtgaattgtaaaaaatgcgtgaagagacaaggacaaaactatcatttgatagcgaaaattatgcaaattctccgcgcacgaaaatattaaaaatgtccccggggggaatttgtgctgcaaatattcccccgcccccgccccatatcattttgtcaaattgtcagcagacaataaccaatcattacgcttcgcttcgccaaattccccaacaaattcgtcatgtcatacaaactctgctcggcttctgttgtttaaatacagtagcacaaaccatcgctaatgctatttttggagttttatagtgccataatgcgaaatgtcactagaaagaggaaatggttactttttaaagcttaagaaacttaacagctgactcatctcggcacccactccacaattaatggaaatagaatttaatttatggcattatttattctcggcacaatttgccctttcttggtcctcaatatgtgaatttgtcgcccacttttttaatcagccaattcgaaaagggaccgtgttaatctaaaatattgcatggtctntatttgacctg

SEQ ID NO: 8446 - DNA, 1172 bp, Heterodera glycines
  misc_feature (1155)..(1156): n is a, c, g, or t
  misc_feature (1164)..(1165): n is a, c, g, or t
tttacatatttcggggtttttatacatatttacatatttcgggattttcttacatatttgtacagattttggattttttttatatatattttcattttttttacatattttgagtattttttacggaaatttttggaaatcctcaaaaaaaaaatccaaaatttcggtaaatatttttgtacatatattttcatttttttacatattttgaagatttataaagaaaaaataagttgaaaatgttgcctaaaaataccaaaaaaaaagtaatttttatgtcatttgtggctatttcatattttacggggattttctttcccaaaaaataccattaaaaaaaaatttatttacatatttgggtttttttgtacatattttgggatttttcttacatattttgcgaaaaatgatattttttcaaatcacttttctctaattacaaatatggtcattaaatatccatttccaagaaacaattgatttttgccacaaatttttcctttaatttgcatatattttattattaataatcaaacttttataaaaaaaataaaatttaatttttgcatttctttagtcacatttttattgtttttaattaatttatttcttttactttaaaatctgactaacattttttaatttatttctcataaataaatattaaaaaaaaatttcatattacaattttttattttattaatttgcacttatttttattataattaatgaatattaaataacgaaaacaaacaattaatatattgtgttttgccatattaaaaaaaatttctaattaatttgttttctttgaaggttccgccaatgtccacaatggtgaaaagccacgggttaacttgtgacaaaagtcagttgaacttccgcgcaacattttatttcgtcccttattaattgcaagtctcaaaatggcacttggttttaacctgatccatatttatatgaaataaaattaacaaccttaactaattaacatttaattttacaatttaaaattttatcagggttccaaattgtctcccagactcgtgcactctgccagtggccatgttttaacgtcatgtgattcgtctttttcacaactcagttgaaagaaaattagattgttattggcactaaagtttttcggactgaccnntgcaggcnnatgcaag

SEQ ID NO: 8447 - DNA, 1350 bp, Heterodera glycines
aatcgcatcattcgtcatgtcgaaatccaggaggaacaagaacgttcccgtttcggacaaaaggcactgacattggaggaagagatgtcgggcgatgacgaggactttgttgtgatggtttgtctgtttttatgttgcaattcaaaaatataaatacattctagaacacttgccaatcggtgtttgaccaagtcaatcagccgcaacaaatggtggtgcatcaccatcactacgagaagaagaagaagaagggtagcaaaaagaagcgcagttcgtccacctcctcttcatcttcctcttcttccgaggaatcgtccgtttcaaggaggagaaagaaagagaagaagaagagcaaaaaggagaagaagagggaacgaaagcgaaaacactcggacgaattggcggagagttcggcagacgaaggtgagagggattcgggatttacaacaaatagttaaataattgacacgttcaaggacgatcgacgtcaaaaaaacagcccattgtttactccgaattcgaccacaagcgaaacccatggaaattattgcgcaaaaacgagtgggtccacaaaccgatgcacatggtcgtggacacgttcggtgacccggagaatgcgaaatatgacaactcgcaccggtttgtatttgccatttctatttgtgttaactaaaaaaagtacaaaaatttaattctattgctaaatttgttgaaattctttttccattatagttttacatttgttccccttctcagtggcgatgtgcccgactatcgcgcgcccaattcggaggacagtcccttctggcgagttttttccgaactctacaaagggctgctcagtaaccccgagagcggtgcggtgggaaaagaacagcgcgcgttttccgcccgtgtcatgaagcagtggggcaaatgtgcgcccgagcgcgttttccgcaatcgcgccaacgacaaattcgaaaattatgtgaaaatttcgcatgctccgtgtccaccggatgaagaaggggtaaagaacagaaatgggaaaagcgtttttcaacttgcgattttatccccatttttaggcagtctctttgggtgttataaaacatgagatggacccgcagatgctcaacaccattaacattgaagactttgagcacattatgcgcagtcaaaatgcatcgtatgaagaagcgctcgagtcggacgtgcaaacacggtacagcattctacaggcaatggttcttcgagagccggacaatgttgacgcgtggctcaagttcgtggacattcaggtaaaactgtaaattgggaaaatgaatccaatttattggattttagcgtgaaatgcaagccaaaaat

SEQ ID NO: 8448 - DNA, 4240 bp, Heterodera glycines
gtcaattgtataacaatgtggcgggaaaacatcaaaatgcggcagaatgatcgtgcagtcttcgatttgagaaaaatggtaggcgaaatgtctaacaataaaccaatttaaaaaaatgtttctatgtaaggtattgatggactccgctcggacggagtcgcgacttccactgattgaccattgcatcaaaaaacttgtcgaaattaaaaatggaacaatcaaaaggtgacgtttttcctcctaattgtattgtgatttttcatcatttgctcttttccttcagtcacgcgatgatggaagggactgaacaggtgacgcatttttgtttgaatttatttgagtgtttaaattctgtaacagtttcttgtcgacctgttggtgcaacggtgccgcctccaagtggtcgctggacacgtcgcaaaagctgtggctgtgctgcaggtccgattgacactcaccatacgcttaaattaaaatctagatgtcatattgccaccttattttccaggccttggccgaattccacttcttccgtcccgaggtgtacaaaaacttcaggccggacaccaaacctcacgtgatgcaacaagaattgaagaagggcttcaaaactttttggactagtggactgcctcgaatcggagagccgagcgccaatgggtttttatatcgttaaaagtagcgaaaacccaccaaagttctgtccttaagatggcttcgctttgagagaagtgacgtggactcgcaacatccgaaacatgacgaggcggaagtgttggagcagaaatggagttgcatgcacgaggaggagaaggctttgatggccaagtacaagggccttggcttgtcgtctgtggaaatacgccgtcgcttggagaagtttcgggcaaaagttcgttatcctcagatcatttgcattggcaatggtctcaaatcaaacatgcattaatggtaataaattattcagtggttttggttcccggtgcacttcaaacatgacgacgagaaactttatgaggtgaaattcgttgaactaatttaaaattacgtaaatattgcctaacccaactttcagcacaaagcacgcattgtcagttttgaggagttggagccgttacttttctcattcaatgacaccaactgtgtgaaggatctgatcttcaaactgttgcacatatttggcgttccaattccggatatagtgggtttttttattattcgacagaacattacctaattaatcgtttttcgttcattaaaccgtttgcttttttagtttattgaaacccaagagaatattcttcggcagttttcccgttcttatttccactccaactcaccaatttcgttggatttaaatgggtttagcaaatttattgactgttttgtcactcaaattgcggaatccccaatgatggattcgcctcgcatttacacggcattgatcacatcgtacgcagcaaaatatttcctttttttgttattcccttttttaagaatttcgaattctccgctttccactcaaaagaaatacaacacattgaggcagctcgtcaggggcaaaattcagactttaaaacggcatggaaaggaaacaaaattgagcagagaagtgcaattgtcgctttacctcaccgcctttgaagaggtttttaaatcaatttactgacaaattttcaatttcatgtcgaatattttgatataaattgtttcgtttagatgatcaaaattaaacaagagcacaatgacgagtgtactgacgcaactgatgagtcaaatccgccaattactgagtccgaggagtgcaaaatgtgtttggcggtgttgcgcatgaatttggacgccaaagaccgttccctttgggagattggggagacgggcgacgtggacaaacgcaaggaaaaattggtaagaaaaatcgaaaagaataaagctataaaacccccactcattgtcagttcttcatgcgttttgctgtgtttttggttcgtcaattgcctttttcgacagatccggacgaaagaaagaaggagaaccgagcagtcatagctaggaatggaacaataattgggtatttggccaccaaacgtgaatttttgctcagtctgttctaccacgggcgtgttttgcaggtcacaatcaaattgagtccccttttcaaatgtttttttaggtggcggaaaatgcggagacaaaacaaaaggcatataaaaattttgttgaacgcttatcgcacccggcagcactaattttggacgaccctttgcgttggatcggtgacgaaaatgaattggtgaaactgtgcaaaaaaaaaaagaatttctgttccattttcaggtgttcgaactttgtgcctactacaactatgaatttcccattagtccattagttcgtattagctcttttgtgcgcgttgacagccccttttacacgacgaaactcgccgaattattgaaggaaaggccgtgtgtgcaggagacgcgcattgccattctccaggttctttcattcccatggacaatgtgctcataaccttacttataattaaacgtatatttttttactaatatttaaacgtttgcgttggtttcattattggcttttttccttttcagcacattgtggccacaagtgcattctttacaccgggcgaattgcgcgaacagctcagccaattggtgcagcgttttccgcacaacatcccaattttgcaagcacttctgcgtgttggcagcgattttcacaggcgccgctttttggcacaacatcctggtacaggtgagtgataagagttggacctcaatttgggaaaagcattagcaatggtttggcttaatcagatgatcgttctcgtctgatccgcacctgtggtcgtattttcgccgctcatcatcactacttggccgagcacaaacgatattatgagcagaaattcgacaaccaagcctttcgaactttgctctaccaatatgtgcacctcttacgcaaggctgccgaggaaaattggtcctttttagtgatttgaatatttactttatacaaattaattggaaaagttcaaaattctagtggtagtgcgcttcccgacgactatatttgggttttcttgatgcaacacatcacatcggagaggacaatgttaccaaggcgcgttattgacgaggttctgcagccccacagcttcttttgcgtattaattttcttcttcaggtgtttacaattggccaaggtcgttgcccctggagtaagcagtttctcatggagtcgttgcgcggctgttgcgaccgcaccgacccatcggtgacaatggtaaacgccacaatgaaaacgcatggcatcagtgtgtactgcacggacccggaagtccaactgctgcttgagaagtacagcaataacaacacttttcgccttccaagcaatgatttccacttttctgttttagcgtgtgattttggccttcgtacgaacgacgcattcattgcctgggggtgaacaaaaacagatggcacaatctttttcataggtgatatgtggatggatgaacacacagatttcttgcgattctatcaatatgttaatataatactagaaataccatgttttctttccgtttatataaatttcttacttaaaagggaattagtaaatttgtttcatttaataattgttaaattaatgctgtaaaagtgtcttcaggcgtcttaaaataggaatgggatccgaatttttttaaaatcttggtcggaagtctgatcagccctataagtatgatgccttttaccgtttttgcaattagaaaactgggttttgcggtaaagggcaagtgtttaacacatcccctacggggacaactgtttctttcttctcgccgcttcgattgattcggttgtccccgtggcgcctttcgatgggttcgatcggcggaagttaaagcatttcaaattttggttcggatggccaaaagtcatcgcatcgcattaaaactaataacagatggaagtgaaagtccagcagctcttatacaaatcccgagtgggtgggggggggctggacataaaaaatggaatagtgaccgaaaatcgctgaaaaatattcatttggatgatttggccgggacactttgtccgtccctccaatttcgaccctttgtccgtccctccaatttcgaccctttgtccgtccctccaatttcgacactttgtccgttccttcaatttcgaccctttgtccgtccctccaa

SEQ ID NO: 8449 - DNA, 4649 bp, Heterodera glycines
tggaatactgtatttgttttttttaaacatactgtatcactgacgctttttattttaggtataccagacggttggaataccgtatttggtttttttaaacatactgtatcactgacgctttttattttaggtataccagacggttggaataccgtatttgttttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgcatcactgacgctttttattttaggtataccagacggttggaataccgtatttggtttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgtatcactgacgctttttattttaggtataccagacggttggaataccgtatttggtttttttaaacatactgtatcactgacgctttttattttaggtataccagacggttggaataccgtatttggttttttattaaacatattgtatcactgacgctttttattttaggtataccagacggttggaataccgtatttggtttttttaaacatattgtatcactgactgttttttgcgatggcattgaatttgccatttttagcataaaatttgaaaatttggatgtgagaatggtgtttttggtgctcatatgtttggcgctcagtcggctctgttcaccaaaatgcccataaaaatggggaagtggcgcgaagctaataggtggtgggcattcataattactgcaattatatgttctttatcatttgcatcgaatcggagaaacgctccgccgtcgccggagggcaaaatgagagaattaatggggccgtggaaaaatggcgaacgtttgccttgcccaacaaacaacagcagcagaagggcaaaagtcattttctgttgcatttatggcgccgtctccataataattttttgataattaatagcccaaaaattggaatttgtaaaaaatgattcttttttcattttgccattccattctttaataataattatgttgttgttgttgttgttgttgtatatcttcggtttttaaaaaacattgtaatgaaaaataaaattgctgaaaacaaattgctgatgctttttattgtgcgtaattattggaaaatctttgatgttcaaacaaagacaaggatcagatcagtgatcgaaaaagcattggccttcaagccaagaccagggtcagagcagcggtgaacaatttgaaaagcattgatcaccccggcgggtgaaatgtgataatgaaatgcttttatcactagggttgggaattatatgcacataaaatcgcaaaaaatgcgcataaaaagtgaaaatattcatgtaattttttttacaaattgagggctaaattttccaaaattcttcagattcgttaaatttaggctaaaaaatctcgaaaatagctaaatagggttgaaaaatcacttttgaagaagaaaaaaataccaaataaagctaaaatgttattaatattgtcgagaaaatacccaaaaaaaggtcattaaaaaaatttcggttcatagagatcaaacgggccgctgtaatagaggggccgctttaatagaggatttttttgaaaatgcccaattatgcaaaatatgcatatggtatcatcgtagaagcttcaaaccaagctaataacattttttgtacgtttaaggccttttatataatccataaaaaaaagcatatgcatataatacccaaccctatttatcactgagtttacactatgcaatcatttttaaaaagcggaagactttctgtcaggggccgttctgttaaagggttttaaaaactcctgaaatttattttatcatttaaaatgggtttgcatattccatataatttagttacatttgcaatgacgtttggttcgatgtgtttgagttccttagccgtgccgaactcggtaatttaatggcacagatcagcgaacggttcgatgcattggtggacaatcactattcgacgattaaatggtcggaacaattattattattttggaatttttcaacttttacatacctattctcaatttttgaggattttttaatgaatttttgaaaatgtacattaaaatcgttttttccaaaaaatgacttagaaaccaatttttttaaatagatataatcttattctaagcctaattaggtcatttttatgacagtgcttatccgtgcttttctaaaaattttcgtcaaaaaaataatatacaaaaaaacagaacccccggggctcgaactcagtaggtacggtgtttggggatttttgtacatattttttattcgagattttcttattttgagattttttagatatattttacatccctaagaataataattattaaaaacaattcatttaatgcttaaggatgccccctaatttgatattcacttctctgcattttaaacgcgcaaaggacggcaccggtgccgtactcgaaacaagcaaagattgggcgcaaaaaatggaagtggagctggtgccaatgaatagcattccatttcagcgcagaatcaaacaattcggcactttggccataacgtaagtttggatgcaaaattttgatcaatttgttaaaattagttagttttttttaacaccggaatgatggcccgttgagcctttctaagttcatttaaaaaaatccgggggctaaaagtgatcaaaatttgctaattttaattaatgttattatgaaaattacggttttgaaaatcaaaaaaaaaatcgctcagttgacacaacccggccttttagtgccttaagaaaatttcgccataaaaaaatttcccgttcagttacattgaccgaactgtcatcgcctttctacacagcattaagcatgtgtttagcctggataactcgcgcagaaattctttgatgggtagggctgggattttatgtgctaaatggccaagaaaaatgtaaaaatatgtactaaaacatgttctattaaaaagtgcaaaaacatttcttaatattagcgacattttctcaattattctcatgccccttaaattttaggcctttgcctaaaaatgcaaatcccgttaaatgttttttaattttaaattttcatgatcttttttgcttatattataattatttaaaaattattttatatatttaaataaaaaacataaaaatcccaggcgtggtgatgggcaatgatggtgaccagtggaaaagctgggatgtgttcatcaaagaaatttgtccgctattgtaagcaagaattaaaatgagcgaaaagttactcttttttttgaatcttgatatttataaaatgatcgaatcatgaaaacattggaatcattcgaaagcctttgatcagttaagtctaaaaatcaaaggataaaggtgattcgaagctatttgcgcgttttacaacggcaagaacagaaaatgatcgctcaaggtcacaagaaatgatcgggcgcagaatttttcaagacatacatggaaaagggggggggggggtcaggggtcaaccgaaatttttgcgaaggggtcacggccatgtaaatcgacgactttttttttgttgctttttaataccgctttttttgcggcgcgctttttccaaaaaattttggggaacatgggggcaggcggtgccgataagtgccgccgggaaaaatttttaaaatgccaaaatttttcgattttttagccaggtgacgattttttgtttttaaaaaacgcttatttttgcggcgcactttttaataaaactttttggggggacaggggggagggtccggcggcgccgggaaaattttttgtaattttaatgctatttgttagcagattttgtctaaaaatgaccaaattttgagatttttggctaattttttaagagaaaataggttttttgtgggttcggcagtgccgatagggcgccgccggggaaaattttttgaaaactttattaagaaaatagccaaatttttaagaaatttctcttttccccttcgctacgacccccccccccccaagagctttcgagtggtactacatttatcggagtcgattattttaaaaattcaccatatatcgaaaagcgctatttgaaggtactctctccaaataagacctttaattggaggggggggggggggccttcagagagcgaattaacgttaagtaagaatggcctccttttttttgtagtaacttaaaattagggattatttcttccatgacatttatttttgacaggtcaatgcccaattgccactttaacttgcgcaaacataacaatagaag

SEQ ID NO: 8450 - DNA, 1841 bp, Heterodera glycines
ttttacatggcgcgatcattacaatagcaggtgcagcagcagcagcatcatttctgttggctttcccgcttttgtgttggactgtgctgagttttgcaagatttcgaccgcccattgtccaatggcttattgctctgttggttatgattagggcgtaaaatttatatacctatctgcataaatacatagtggtgcggaataatatgtagtacgggcattttgaagaaacccggacaaaggcccggatttccgaaatggaccctgcctgaccatgggtggagcgcgaccgcaatccgcaacgcgcgatcgcggttacgacccctggctttttgggactaaatcggggtgtatcggcaccgtagacccaacattttcctaaaaattttcaaaatttgatttaaattacaattatttattaaaatcttttttatcggaccaaaaatttctcaaaaaaatttttgcgacaggcctatcgccggaccacaaaaattcctggattttcttattctttaaaaccttgctaaaaatagcaaaattggctcattttgggataaatatgtgctacttttcggttatgcagccacatctccaaatttaaaaaagagaacgcaacaatattgaagtggcagggagtgcaggcgaaatttaagtcttggcgaaaacatggacagaaaattatcatacgctctaactaactaaatccaggatacggattatgctcagcgccaagccgctataaatttggcactgttcaattggcttcatttgccacgagcggatggccgcccgaaggagtataggtggtgctccgagcggaacgctaacgaaagcatcaaccaattgaaggaggtgggcaattagtaattaattttaccatcgttcacatttcccagaaatttagtcccgtaaatattgggtgaaaagtgccgaaagcctataaatgaaattttgaaattacaatataaaaattgcactttcggggtcgctgagtcagattcatgatcagtgatgatcccgaaaaccactataaacgatttattgtttttgaaaacaaagtctcccctttgtttttccgggacccatcgcaacttcaaaatttgggaactctgaattaaattgaaattggtttcacattcgtgatcagtgatcctgaaaatctatgtgaacgagtgttttcactgtatttaaactgcataaatgccaaaaaattattattattattatttattaagaaatttgtcaacgacacatcgccagctaattattttgtgctcatatcaaagtcacgttatcacgcagcatcattgtcagaggatgaacacatgaacaacaacaatagcaagcagcctgtcctcatgttctccatggaaaatgaaaagaccaacgaatttctgagactttatgcacggagaaaatgtttgacattgattcggaatcaagcatgttgggactggcaaaagcccatgaaagaactccaaggcctaatgcgcaaaaaatttctatttttcatagatgataagcgtatcgatttggattaatgattatagttgcggaatgtttgttttgaacgtgtttttctattaaaccgtgtccagacattagggcctctggcatttgtgccccggacatatgcgtcccaggatttgcgcgtgcaaaacggatttaaattttagctttctcaatcctagaggtcattaacccgattaaactaagtaatagaatgttttgtgtccgatgatttgatcgtcattaaattaaaaaatatataattattaaaacgcataattaatattttggttttcggctctagtgcactttatgagtccaatcgacttttatga

SEQ ID NO: 8451 - DNA, 1712 bp, Heterodera glycines
aaaagaaagcatttgaactcccctgctttatcacaaattcaccccgggatagatccgatataataaaaggtctaatcgttacattattcagctaatggatttatgaggacaatttaaaacaattgatttattaatttgataatcacatgaaaacgctgcaaaaatacacttttaatgaaatatcgctaaattggcatgttgcatgttacaaaagagattttatgcaggttaaacctaacaagcgaaccatagcacatagtctcaagtccacctgttttgatacaaagcactagggatggatagaaatcgctatttctttgctacgaaacctgtaaagatccgtttccatttcaaataacagcctttctatgcaaattctaacggctttgagaatttcagttgctaaaagcctgaatccacggttgcccgactgggtcggaggaagccacgcgatattctgaaaatcggtattcccttcattttctatgatgtttgcgcaacatttcggaattagcttgcctaggagatgcattcctctgtaagttcctgtccatctatatggagagaaaatttgggttccttcctagaccttgtttttgttccggaaatattcaaattttgtgagcgatactgttgataaaacgaaaataaaagaaagcatttgaactcccctgctttatcacaaattcaccccgggatagatcagatataataaaaggtctaatcgttacattattcagctaatggatttatgaggacaatttaaaacaattgatttattaatttgataatcacatgaaaacgctgcaaaaatacacttttaatgaaatatcgctaaattggcatgttgcatgttacaaaagagattttatgcaggttaaacctaacaagcgaaccatagcacatagtctcaagtccacctgttttgatacaaagcactagggatggatagaaatcgctattctttgctacgaaacctgtaaagatccgtttccatttcaaataacagcctttctatgcaaattctaacggctttgagaatttcagttgctaaaagcctgaatccacagttgcccgactggatcggaggaagccacgcgatattctgaaaatcggtattcccttcattttctatgatgtttgcgcaacatttcggaattagcttgcctaggagctgcattcctctgtaagttcctgcccatctatatggacagaaaatttgggttccttcctagaccttgtttttgttccggaaatattcaaattttgtgagcgatactgttgataaaacgaaaataaaagaaagcatttgaactcccctgctttatcacaaattcaccccgggatagatcagatataataaaaggtctaatcgttacattattcagctaatggatttatgaggacaatttaaaacaattgatttattaatttgataatcacatgaaaacgctgcaaaaatacacttttaatgaaatatcgctaaattggcatgttgcatgttacaaaagagattttatgcaggttaaacctaacaagcgaaccatagcacatagtctcaagtccacctgttttgataaaaatcactagggatggatagaaatcgctatttctttgctacgaaacctgtaaagatccgtttccatttcaaataacagcctttctatgcaagatgtaacggctttgagaatttcagttgctaaaagcctgaa

SEQ ID NO: 8452 - DNA, 1132 bp, Heterodera glycines
ctaatggatttatgaggacaatttaaaacaattgatctattaatttgataatcacatgaaaacgctgcaaaaatacacttttattaatgaaatatcgctaaattggcatgttgcatgttacaaaagagattttatgcaggttaaacctaacaagcgaaccatagcacatagtctcaagtccacctgttttgatacaaagcactagggatggatagaaatcgctattctttgctacgaaacctgtaaactccgtttccatttcaaataacagcctttctatgcaaattctaacggctttgagaatttcagttgctaaaagcctgaatccacagttgcccgactggatcggaggaagccacgcgatattctgaaaatcggtattcccttcattttctatgatgtttgcgcaacatttcggaattagcttgcctaggagatgcattcctctgtaagttcctgcccatctatatggagagaaaatttgggttccttcctagaccttgtttttgttccggaaatattcaaattttgtgagcgatagtgttgataaaacgaaaataaaagaaagcatttgaactcccctgctttatcacaaattcaccccgggatagatcggatataataaaaggtctaatcgttacattattcagctaatggatttatgaggacaatttaaaacaattgatttattaatttgataatcacatgaaaacgctgcaaaaatacacttttaatgaaatatcgctaaattggcatgttgcatgttacaaaagagattttatgcaggttaaacctaacaagcgaaccatagcacatagtctcaagtccacctgttttgatacaaagcactagggatggatagaaatcgctattctttgatacgaaacctgtaaagatccgtttccatttcaaataacagcctttctaggcaaattctaacggctttgagaatttcagttgctaaaagcctgaatccacagttgcccgactggatcggaggaagccacgcgatattctgaaaatcggtattcccttcattttctatgagcaacatttcggaattagcttgcctaggagatgcattcctctgtaagatcctgcccatctatatggacagaaaatttgggttcct

SEQ ID NO: 8453 - DNA, 4436 bp, Heterodera glycines
atgctttatgcataatttctgtgtcggttcttgctctttaacaaatatataatttaacatcatcagcatataattttatttttgaaagaatgacaaatttgaaagaatgacaaatttgaaagaatgacaaatttgaaagaatgacaaatttgaaagaatgacaaatttgaaagaatgacaaatttgaaagaatgacaaatttgaaatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggaggaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaagcattgattaacaaaagtattgcccaagtttaggtagcctgggtcaacatcagaattgttaaacgaatttgcaaataagttggcaaataattcacatttttcatcaccatcatgatagcatttgttttcaaagactaaattcggtatttcaaagggattaacatcgtatttttgtaggtatttaaaaatggaatttcttccctttgaaatagcctttttctcaatttgcgagtgaaatttatttgtttgtatttttatgtgtaaactaatgctatcataaagtgctttttttgttgggtcagttttacattgcctatacagtctggctttctctttgatggaggccaataaatgcgttggatatttaggggtcaaatcttttttggtaatttttttcattggaatacactcgtttaaggtttctagcaatgtattattaaaggcgttgtatttttcgttcacactaaaatgctcgttagataaagcgctaattctagaagaaaccataatattaaaaagagaaacattcgacggaaaaaaccgtcgattgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaagtttccggcgtaaatgatccaatcggcgttgggttcggccttccttcgctctgtgcattctttttgcatcgccctgcgctcctccagttctgccggactgagcgatggtcgaatgttcaggtgttgccacttcccactttgcttgatgtgggcccgttttttgttccattccgccagcagctgcctttggaattttgaggccgggagaatgattttgattaaaattcgccttgaagcatatcgccaggctcacaataaaccattcttttaattggtaaaatttattattaattgatcaattagttaattaattagttacatttgagatgttgtagatcaaatataaacgacaaagaaacaacataaaaaataattgacaaggaaaacacattggcaattatcacatattttccggatgatgttgagatgttacgaaaacttaaaaaggaagtgattaattttctggaaaattaaactattttaaattacaaaacgggaaatgccaatgccacaaaactatcaacgcttatccaaaacaaatttagtgaagaatctaaacatgaaagtggtgcaataaattgcgcataaacacaagtcaacagaggaatccgtaaacaaagaaaaacgaggactaaaaatttaaaaaataataataaaaataaaattatttaattattttaccggtagccaatggagtggccaattcagtgagtgcatcacaaaaagaacagatggccaacagaaagccgaaacttcggtggagtttcctaatttcataattaaaaatgcatttttataatatccaaaagtaaagtcaaaacaaaattaaaattcaaaacaattcctatgcaattttcaaatcttctcttttacttgtgcttgatggtgatgtaaacgatggcactgtttagggcaatgccaaaaagtgacaaaatttgctgaatgattgtcacccaaactggtgtacacgtaaatttggtcggactctccaaattcattaacggacgaagatgaattaacgttattactcatattattagtcgatttatttggaatattatttaatcaaaaaattggcgcaattcaacgcgaattaaatttaaaaaaatgcaaggaaatgaagaatccaatcaaataattaattaaatgatataatattgagacttaattaaggtcaaaaattcttttactgatgagttcagagtataattggcctttttagacgtttcacctgttttttggcacattaaacattagtaattttgttatttaataagcgagaaaagcacacaagaaaaattgatggcaaaagtaaaaattaagcaatagacgttaaatttggggactagacatttggggattttaataaaacaaaaaaaaattttttatttaattttatgcccaaaattaatcaaatttatgtctgctttagccagagttaatttcattgcaagaaaagacaaaataatatttttttcaaattaactctcaaatctttgcaatacagatttatgcgcaatgattttgaaaattgggacgactctaatggtgattaattctttttcataaaaataatataaaagccacattaaatgttattcaataaaattaaaaatgcgcataaaaatatttgtaagcgatttgttttacgatttggtggatatagattttgtatctttttgtgattttagaaaaaaaatttaatatgaaaaggcacaaataaattttgtttaataaaatgagttggtgtgcaaagacaaaacggtcactcagctggacggcgtgctggaggagtacaagaaggtgtgcggacatttcacctgctggacatcttgcctactgacatttcgcctactaagccagacgtttcgcctacaagccaaatcggacgtttcgcctactcacctaaaactgacatttcgcctattaacctaaaatagatagtttgacaacaaattttaccataatattttctagaattgaattatatttagctataaataaggaaaagggaaatttggtactttcccgttttggggccgcacccaaaaatttaaaaaaatcaacaaaagagcgcgcaaattcacattcgcataaattaaccattcgaaaaacgtcgccgcttccccactcgctgtatgcataaattatcgcactatgggccttggttttgggccaaaacattttcacctccacatccataccaaaatgttccttaattttatttccctcatcaaaattacacccaatgaaaattgtgcagcaacatttctaaaagaaaaaggattttgtctgaaattgctgcatttatgccccctcattagtgttacgcgcgccttgtttattttgcgcgcccttttgttgattttttaaaatttttgggtgcttggtttcaagcttctagcttgaactttttggtgccttttttttttttgccttttttgcaattttggtgccttatgccgggcacgtaattttggtgccttttttcaaaaaaacgccaaaaagtcaagaaaaaatgccaaaaaaacacgaaataaatccaaaaaagtcctgaaaaattaagcaaaacgattaattttaacaaaaaacaagaaacatttcgaaaatgggtccactgcgtttcgagctggcgtttcggcgccagcatgtttttccactataacttttttctttgtcaaccaatccaacattattggtatcattcgaaagcctaaactgtttagaagctttttctaagctattgcttcgcgattagacaaagacaaaaaaagttatacatgaaaaatgcgaaaagacgaa

SEQ ID NO: 8454 - DNA, 3180 bp, Heterodera glycines
aagtgccacttccttaaattttaaatgaaaaattatggggggttctaatgtcggatgaactaagtatagaaactttagttaatggaatgaagtacggaccaaaaactggtaaggaatcattgcaataaaattaacaataaaataaaattataaatggaatgtgaaaatttaatatgaatttaaatttagacccaaacttttgtgaaaattttaaaagggcgtatgcagaatattcaaaaacaatgaaagataaccaaattgcggcacaaatttacaaagtctgccagtctaaaattagttattggaaaaagatatgcggaattgagtttaaactaaagaaaaagatgacgaacaattaaaaaagcattgactttcgctatcgtgataaattatttgtaaaaaaagatttgtttttaggggtaattagaatattgcatgctttggtttttgtaaaaaaaatttaaaaaaaatttttcaataaaaaaaatcaaaactcatttcagatataattttatagactccttcaaagtgacaattagagatataaattaattccgatgcctatagatagtatttatccttcaagtggatatttgattatgaattttgaaaatttgtatttttttattaaaaaaccacaaaacatctttttttatacaatccagaaaattttttgaactaaataaaaaaaacctatcgagtctcccttctaacaattttacagcaaacaaacgtaaaattttttaatttaaaataattacaaaatgttaaacggtaatccgaaactgctcggcctgcacactctgccggtttagcagcaacaaattaaaaggaataaattaaaatttaattaatcaattaatcaaaagaaaatgttcttctttatattcgattttgattttttgggtttttgtttgactttccttttcactgcgcaaaaacttctattcattccattgttattctatgtttgtcataaagggaagaatgaaaagatatgtgttgtattcagaaaatcctgtatttatttgtcatttttattgggatttatttattcaattattttgggatgttttttattgttattaattttattgtatggcacttgagaaagaaattggcagaaaaaattgtttttgttacaccaaaaattggaagtatttaagggcatggaactgttgttgtggcacattcgaaacatttttcaacagcaaattccatctcgaaaattcaattaattccattctaaaatggcttcatcatcgattaaattgtaaattttcttttattaattacccaattattaaaaacccctttagggtttcggtttcaatgtttctgctcgtcctttgcattggcatggccattgagcagacccaagcttattatgtacaaaatattttcaaaattccccttctcgttcttaaaactttcattttttcattttctttttaagggctggggtggctacggctatgtctatccttacggattttatggcaaacggcaagccggttttggtccatccgaaaatgctggcacttttggtggcggtggagaaggaaattccaacggaggaggaagaagaggaggaggaccatcatcaccaaacaatttttgagagaaaaaaggaattacaaaaccaaaattgagcttttcccattttgtaattgatgatcaatcggataaaaaaaatggccaaaagaattttctatttattttttgccaattattaataattttatgcatttttgcaatatgaatatttttaaatgaagcttcaaaacaagaagaagaataaatgctcattcttttttcagtgccaaaatcttaaaactattacaaggaattttcatgacctctaaatgtcattttcgactaattcaacaaatggagatttaacactaacagatgaaggtaatgagaaaagatatattttttagaagcgatcaaaaaaatgttgtgaaaatcaacaaaaaaatcaggatttaaatgcaggattttgcgagattaatccctctagatccagtcccgaaaaaattttgaattccaataccacggcgggatccgcaaattttaaattcccggctctaagcttattgcaaaaattagaaatacttgaaaaaaaatcaatcgaaattaaaagaaaatttaataattttaattaaaattcagcaatattttttattttgttggttcaataaattgtggctgtctaatttcgttgaataagcaatgaatttgtgaatctgctgtccttcttcaacacattgccaaattttgctcgtatttgtgcagatttttgagttgacgatggatgtgaaacatttcgcctaattattatttttttaaattaattattttaattagttaatttgccgatttatttgctccatcactttctcaacagttaaacggtcttcagtgtcaatgtccccagttttgaacacattatattgccaaccattttcaacttgaaggcaaaaagcagcagaaccatcacgatggctttaaatttaaaatataataacaaataaaatgagatgctaaaacttatttcaacaacaagttaaacctctgtccttaactttaaattcattttcaaattaaatattgaaaaatttttcgcaggaaaaatttataaagtttcgtaattttgtttattcaatttaaaaagcattttagttacaattttattaaaacatcgagtcaaagaataatgtcgattaggctttaagatgtattttaaatagagtagagcgggaccgggaccgggccgggaattcccggtcatccgaggtccaggattttgaaaagctcaggtcccgggcccggtcccggacaaaaatcgaggtcccgtcccggtcccggttttgctcaaaattcccggtcccgctctactctaattttaaccccctcgcccgcccacatcctaccataacacataccgatggtcaggaaatgtccagtggattatggtggaaatcaaatcaggctcttttataatcaaaacaccccaattgccaccgtaaatgtcctccattatacgacgaattaccttcaaattgaattcactccaaaataattataattaaatttaattaatttgtttaatttattgtaattccctacttgcataaagtagaggcgcatccatcgttgctaactatctcattagtc

SEQ ID NO: 8455 - DNA, 1132 bp, Heterodera glycines
  misc_feature (18)..(18): n is a, c, g, or t
  misc_feature (57)..(57): n is a, c, g, or t
gcacagccgcgctgtgcncaaaaagtcaaacttagttgggtaaatttcgaagttttntaaaattattttaaataaaaacagatgtttgcgaactgttgcacattgttactcataaatacatcggcgctgactgcgcactgcgcccgggcgaacgtttggtggtggtggacaacggagacaaggattggaagcacaggttcaaggagtataaaattttaaattttaaggatttttaatagttattgaaggctcattttatgagttgtctctaaaattgctcatttttataattgataaaacaaaattataaattaaaaaacatatataataattagggttcgaagttgtatgattaaaaatgctcactagccattgttttggtgttttaaaagtcaattcttaatttaaacacaatttttggcattttttgagggttaaaagccattttgggtaatttttaaggcatattttactgcatatttggggtttttagggcatatttgggggatttttagtgcatattttatgcgcatgtttggcattttttagtgcatacaacttcgaaccctaataataattgggtttattgtatttttcccgcttattgagtctattcatgatacggagtgaaaatttttaaataacaaaaattttgttaattaaaaaaatattttagctgaatgattacatggaactgatggtcacattccctatcacttgcgttgcaccttatctgcttaaagaacggccaatgcgtttgttgcgcaattgcaatttggtggaccagaaaatacgattataccgcgatcaggtcgaaaaaatttaagatgactcttataaaatgataagggcatttaaattaaattaataattataatataaaacaattattgtattaaagattgtcttcgttcaagcaaattcgttggaaagcaatggacgtgtggcgatcagaaatgagcaacaataaaatcatgcactgttcaatacaattttgacaaatctagcgtgaaaatttactattgatgcacaacaagatttattaattaattaggcaattagtgtcatttgttatttaattttgtataaacaaataaacgcctttgaaatgagaatttttattaaaggaaaa

SEQ ID NO: 8456 - DNA, 3380 bp, Heterodera glycines
atctccaattatcccccagtctaggaggggtttgaaaaataatcagcccagtctccatttatcccccagggggataaatagaatttggtcataacatttttaggggatgcataataacggaaaagtacctccaatttgtgaaaattttggcctaggaattccgttttttgttaatttgaataaattaggtataatatttcttctgtagcaattggtgaaaattagcagcaattcgccgcgttcatgtgtgaaaatcaatcaaatttttaattccttatatcattcgatagttctagatgttttctattagcctacagaatttcaaaaagtttcgttaagtttcaagaaagttatgagctaaaatgttgtaaaaaacttgggtttttgagcttctcaagttataacttttttgaaacttaacgaaactttttgaaattttataggctaataaaaaacggtttggcctttttatgtcaaaatgtttccgcgccttccgtttttatcaatgatttttcgcctcccattggccattggcaacaatttaagacgaacaaaattcaaaaattgttggataaaatgtgattttcgttaaaatttttggttttccgcttttctcattatataaaaataaagattccaacgcaattaattcttctgctatttgtgtgacatcattcgggactcgtccaaattgtgctaattgctgccaaaaatgaaccgacggtaatgaattttaaaagtcacacaaattcgtcatttatttcactaacaataaactgttttccataatttcagttggatttgcaacgacgtttggatggacattttgccctgttttgatcgtcctcaactcggcctcaaattggcacttctttcgccacgtttcaatgcgttggtggacaaacatttcaatggcaaaagcgaattgacaatttggagaccaatcgaaattagcaagggcattggaacaaaaccgaagctatctgtgattaccatcaattatggcacttctgcgtattttccgttgcccgatcgtccgctgcccaaaaaaattcgctttaagcaccttcagattaagtaattcattaatagggcttaggtatgtgtatttttaggctccaaatgccaaaaaataggcactaaaaaacctcatttttacgggtataaaatgacaaaattttagtcaaaaagcaacaaattaagcaaaatcagtattgagtctacacaatttctaatatctttaattttggaggatgaatttttcatttcttagctgagtcgctctcagttgggccggcacggttgggccccagcatgcttttctactattttttctttgtcatccaaatccaacaatcttggtatcattcgaaagctcttcagctctattagccttacaaaaagcgaatagattttcaagccttgaaaaaattttattaagaaaaatttcgactttttcgcaattttcatgcataatttttgtctactcgcgaaacaatagcttaaaaaaagcttctaaaatgttaagctttcgatggatttggatgataaacaaaaaaattatagaggaaaagcatgctggagcctaaacgtgccggcccaactgaggtgtaccgtttcttaggggtatatttttgaaaattttggcgttttgaacagtaaaaccgcatttttgtagatacatcgaccattccgtcgtcgcatttctccgtgccaacaagcaaatttgggacaaaggcaccaaattcaatttgtacatatcctcaactgacaacgactctgtccagccgctttggaatgtttttgtccgtgaaatttgcggtcggggtcggtttagtacggccggtttagtacgagggtcggtttagtacggctgttttagtacggccgttttagtacgagggtcggtttagtacggcaagctgtttttgtccataactgttacaaatgttttttttgtcaattataaagaaggaaaaacttataatatctattctcacaaagtaaaagcctatgttttcacgttttttgttggtgtctttttagacgtgataaatgggtttttccaattgcgtactgccttctcacttcaaaatgtgaaatgatttacacacggatgcttcagctaattgtccaaaaatggccgaattttgcacctgaaaccatatcgttggacttcgagcaggccatggttgctgctgtccgtacaatgttgccaaaatgaccacaattaccatgccaatgtcaatgttaatcccgataacatcaatcatttgctcgttggtgtttctcgcaattataaaatgcgcccgtaatttttcaatgcttgctattttttttgttgttgttaacacattgataaatatgttatgttattaattttaaaattttttcggaaaaaatcagtagaatctatttttgacaaaaacagcttgccgtactaaactgaccctcgtactaaaccgacccctcgtactaaaccggccgtactaaaccggccgtactaaaacggccgtactaaaccggccgtactaaactgacccggtccgaattattaacaagtacccaaaaatgacagcaaaaatgaataaatatcgcatgataatggtgccatgtgatttcgtcagaagtgatttcgtcagtaagtgatttcgtcagtaattgatttcgtcagtgagaaataatttttaaaaaaaatttacctatcaaaaattaaaataaattcaaaaacgcaagtgatatgaactaattataatttcatatgaactataatacatttgtatgcaataaataatgaaaatatattcatacattaaaatacgaaactttatttgcctcttcactctctattggtcactcttatcagagaaaagaattctttttgagggttgcctctgccgttttgtatcttgtgtgttcgtctttcgagaaaaaattatttgtttgccctttcattgcctattggtcactcttatcagtgataatgggtcgcttttgcggttttgtctcttagttgttcgtttttcgagactcgccagtggtcatttccattgacctcgagacttcgtttccgaatttctccccattaattgatcttttttttgtcttcaatggccttaatccgtttttctgtatgcaaatccaatcgtggccgtgagctgatcactcatggcgactatgagtatctttacgaagtgaaatcttttaaatggaaaaaattaatagttttctaaggccgattcccgaactgaagacggctggagttactggaaatgccctcggcgtcctccctattgccctgggagggcaatcgtgcagtcaaatttattagtcggtggtgagagttcaaattacagaatgggtcgtgtaactgcgcaaca

SEQ ID NO: 8457 - DNA, 5815 bp, Heterodera glycines
  misc_feature (5682)..(5682): n is a, c, g, or t
  misc_feature (5685)..(5685): n is a, c, g, or t
  misc_feature (5688)..(5688): n is a, c, g, or t
  misc_feature (5691)..(5691): n is a, c, g, or t
ctagtataacttttgaagctgatcaaaaaagtccattcttctacagtaatcatatccatcctgactagctgaattttttcagattttttcttgccatataaaaaaagttataattttggaacagactgtaaggaagtaaattaagttttattattgaatacttatttgagcaccattacatcttggattccccttatcttgtaagttggataacaaagctgaacaaaatattcttgtaatttagtgcaaaaagtttaataaaagtgggtttaaaagagctttaacataaaatgacacgaattaataaaataattattatgaattaatataccataaatatgtcagccgaattgacctaaagaactgtattatatggaagggattatacattaatcttgtcaaaataattaaaaataaataaaatagaaaaataaaaataaagtgttagcctatatactcaaaattgtaatttcaataaccttacaaaattataaaggaaaagcaaatatactttgtttataataccgaaagatgaaaataattttgtgctattaaaaactatatagcaatatcatttgttcataaagtgagggaggcgtgtgggtcccccagtcgatacaccgttcgaagaataaaaggggaggacgatttggggaataaatcccaggcccaggattggtggcgaaattcccaaaaaagcctcgatgttaatagactaatttattctctccggataaaatggtgattgaaatgttacatcgacgaacgactgatcgaatagcctttacggctcggttgactaacgactgactaaccaacctgcgcacctgcacaatttatgaacatacttggcctgaggggctggagagaatcaaccagagttcaatccgtcccagagtgatgcgaagaaacggtgaaaaagacgaagtgccgagttggaagagctgtacagggttggttgcccaaaattttgaggggtggaataaagaaaagagcagccgaaaattccagtacaaaaagaggatattgagaagaaacaattgagaaggaacaaaagaaaagaaaaaagaaaatggggggaataaacgtgtacagaattgaaggaaggggaagggaggaatggaaatgccaatgccaccgaatcatccgtccgttcgaacgaagtccttatttaatcgtcgattggccgatgctcaccgccggctcaggtgtctcatttagaaatgatggaagtttgaaggaaatctctgtcatgtgaatctgaattggttgaaattaatgctgttcctctttaaacatgacttacctaatacatatccctgaactgcgcagaattttgcagtatcctccgatcaccaacgcaagacgtccccgtcttgctgtgcgaatagttgaccattgactagcgtgggtgacgagatgatgtttcgcggtcggcatttggtggtccaagttggaaggaacgatcccatccacgattcgcttcctccacagggttccagttgcgtgagcacatccgaattgccatttcaatgcatgtttcaatgtaatgctgttgattgtgaattaggctattttgatggtccattggtttagtgtaaaaaaaatttttatcgttcgacaaaattataaaattttcagggatgttgatccaaaacccagtgatgtgaatccatgaatcaaacgtaaacagataatgatcgagcccagacttgatttggtgagggtagaagcgttgtaatacttctatgtctccatatacgtcgattccaacatcaattgtttggattgcatctgttatttcacaccgctgagttgcaaagacggtgccatcttcgcgttcgaatggagcatttaggcagtctgagctgatattgtccccaaaacctgccccgccgtcttcccgttgggcaacaacatgttatcgattggataacatttcttgcatccgtgccatgtacagccctaaaatattgattttttatgcaataacaataataatcaataccgtgcacttcaattgcacgtccctctgcctcaatccatccgtcaaccgagtaggggccgattcgcttctctcctccagcagaatgggcggtctgcacttccacacctactcctccgagtaccagtggaagaaccgtaaggcgagaaggctttgattttgagcgttgtcgtaaccgcgctctgagacgatggcaagatggtcgtccggcagatggttagtgcgaaagtgtcgcatgcacgcgccggcgatggtcatgcactcacgcagtacgtcgatgccatcatggttctctctgtcgtcgatcccgtccacgtactcctggcgacgcgaaatctcaaagaattaccgacggaatgcgacaagggcagcgatcagaatctcgaaatcattcgtgcaataactgaaataggcgcacttaatttatacattttaaaaatagcttttacctggcaagcgcctcatcgagcctaaaaggctcatgacggtgctcggagtaccactcgtcgaattggcgcctcttcccgggcatcataccgtttgccaaatagtcgtccggcattgggtgaatttctctgccgtagttttctggtctattggccaaatgcgggaagaagggcttgtcctccacgtcaagaccataagaagggatgagcgcagctaacgaacacggtatcaggttgaacgaatcccggaatactatgtttgggttgcgccttttctgcttcctcactttcatttcgtacattttatttccctgaaaatttaaatttttgacacaaattcgtaattgagtacccgtcgcagcatttcggggttaaagccaatccggaacagctcgaggaaaacaagcaccatgtcgaagcgaccgccaaaatgcgagtaggcataggtgtcgcatttttttggcagttcaaacacgagccaattcacgaatggctcaagcgggttctcagcgatcacttgcttgtccacttgtgtgtccatgaatcggtgttgacagaacacaacggtccgacgtggcccacatatttgacatcctgcagttgccctcttccatttgccgttttgaatgcagtcggggcatgcaacccgggcagcaatgaagtttggctgatgttccttcttttcaggttgttgggggtccaacgcttggtgttgcatagtctccaagtcaaaggccacaatgctgtaagggtcttgttccttcggctcaattgattggatgaaacagccccgctcgggattgtggtaagtgttgcacaattggcaatacgtctcgtggcattggtgaccctaaaagaattattttttttaaaaatttttaaattattttacttttcttccattacggttgttgtcacgaacattccaaataactccgcactctttgcattgttttgactctgcacaaaaattggatctcaagctttacaagaatttggatgtcttgatggtcgctggtatggcttctcacattctaggcagtagtgttgtccaaataagccatactccttctgcacaccatcaaaatggccgttgtttaggtagagtgagattggtgtgtcgtaatagttgttgatgtatttgtacagcggcttgtactgaccagttgatccaaaaataaacacagcaaaacgatgtcgttgctggctgttgttccaatgatccaccactcggggcacaacaatttcagcatcatacgcattaagtccaggccgtgcgccaatttgttgcataagttgcaaagcatccctttgaagacagccctgttgaccgtgttggctgtgcacgtagcggcggaacttccaacttgcccagccacggcttttagccaccattgttgcttgtaaggcataaaataacaatagctgcgctcatcaggattgtttatcttaaaacaacccatcaaaactgttgctttaacatggaccggaccttaatcaaactccgatcattaatacgatggtgaacaggtgccagagctcgtcgtgcgcctcccttcagcgttcttttggtcggcagtccaggtcgattaactgtcgtcacaactacggtaaacggttcaccccacagtgtgacgttctgttgcttcttgctctgtgccactttgacgaattgatttaagatggtgttgaccgtgttgtccgtgatttgccggataggaatggggatgtccccgccagtcagcagcggactactgatgaggcaaccgaggtgtgtcggatgaattccccgctcacggctgtccgccacagccgcatcaatgctgtactggaaatgccagcaagaagtccttcgggattggctgctgctggtacgtcctaatactgaaccgcgacttggctttgctgtattggaagcgcggcacgtgctcgatagtgctgttcagctttcgaacgtagtcttttgcagtttttgatgtagatgagggggtcccagcaccttcttggaccatttctccaaataattcgttgatgagaaagccgcgccgcggctttttattagcattgatagaagataatcaatagaaaaattagagggccgtttgggaggttgattttgcattattcaaaatctaattaaaggaatgaaatgagtgtgaatgataaatgaatggacaatcgagccaatttatagcgatttattgtattacctcaaggcctaaaagacattaaaataattgtgtccggacgtgcttataaagcctcccagaaatcgacaagctcctcccatcaatcgataattttcgacgccatcgcgaaaggcggctttttcaaattttcctttgaagtaattccctcgtgaattgagagtgcaatgagcatttatgaataattaacgacacctaagcaacataaaaattatacatttattgatttaacatttttcgtaataaaacaatcgcgtacatgtccggacttgcacaattattagaaattgtgtaaaggaattcccttgggacatgtggtaaataaaaacaattaaaaattatacatttattgatttaacatttttcgtaataaaacaatagcgtacatgtccggacttgcacaattattaagaatagttagaaattgtgtaaaggaatcccttgggacatgtggtaaataaaaacaatacaatgggcagcacaagtagagagtaaaggggactggtaagggtgagcattccttcttgttccctcacgaaattcgcacaaaaaagatgacgtaatggtgggcgggatgggctgggcaaggctgtcataataaagcgctggtgcttccattcccctcgcgtaaatggcgcaccaatgagaacccttcttgtgtcgggggtccctgttcacaacaagcgccgccgggtactgtagtgtggaaggaggcggcaattggtcactggcgaagcagccctgaaacactcgcccggtcagaaggttttcgctcattatttttgcgatttgaagactgtccattcttcaaccaaaagattgagcatgggtgatgcagtacaagactgattattagcattaaataaagagcgaaaagtgcccagcaaatggcttgctgcgcaatgtttctttcctctggcatgtccttacacaattggataagcggtggaagaacagcagaaacatgttcatcaattaacttgtcactttttggagggattttggttgttgttgttgttgttgntgntgntgntgttgtgggggggatttggttttggaaaaaaataaaatttttgaaaaaacaaccttctcaaatattcagtgtaggaatatgacggctcgtgttgttgtcgagataaagtcaaattttttatata

SEQ ID NO: 8458 - DNA, 2270 bp, Heterodera glycines
caattttggaaatgtgatttttcgatatgttgtttttgcacaaaagtgatttaagtgtgccaaagaaaaaaaaattatattatctatctattaatataaattttacaattttttcatttctttttgcatttaattttttgcaaatgtttttaaataatttttcttaaattgcaataaaatcgcaacgcaaaattttcagtcctgttttaaagcatgaaatttcattttttttttaaacatagcaaatcccataaaaaaatttatataacagaaacagcaggaaataatttgaccaatggaaataaaaaagcacaaataatatgaaacaacttgtcaattagcaaaataatgcaaacaaataaaaaaaaggaaaatcgtatttttttgctggacttttttatgtttttctctagaaattttttagtaaatggataaattttctaaattcttagctcacaaaacctttcaaatttaaatttttagatttcatatttttctgattttgtatgattaaactttttttttgaaaaattttaatttccaataaaaatttttctgcttatgctgttatcgatcattttgaatttttgggaatttaaaatagtttttttttgggttaaacgatccttggccaaattttgaattcaattttgatcagtttcaaaataaaataaaaaaatgctaccccatcccaatcccataacgagttttcttctaatcccatctttgccatcatcaattcgtcctcaacttcatctgctgtatgatggttttaaatcagcaaattttttcatcattttttcgacactttctttggaatgttccaacagcttcaccactttgttttccttcggcattgacttcttaagttcttcaagctgttcaattattttggacaattcagtgaacaaatgatggtacatggccaaattgtgcaattggatgctagaccaatttttgaaggtttccggtgttaaatcagcgggtgaaaatttggtgattatctcctaaaattttaattaggtaaaagtttttaaaaatggaaataaatcagtaaattaaatttgttgtcttatctatgaattaataaatctattgtttaaagtataatttaaatagtataccaatgctcgtgcaaaatattatttcgattatattttgttgaaatattcaaaaaatacaaatatagaaaaaaaaaataaaattgaaaaaccaaaaatttaaggataacctatcgactatttgaattaaaaaaacaaaaaaaaatatgttaatttaatatttggctatattaaaatatttattaaatgttaaaaaaaatcttaagataatttttcattcataaaatttttttgaatataaaaataactaattcatcaattcagatatctttacgggttagtccaagttatcatatttatctacttttctaatttttattattaatttttttttgggtttttggcccaaaatctaactataaaataatttaatctttttttcatttttattcaaaaattaatgaatttttaaatattataaaaataaaagaaatgccttcagagtgtttgcctgtgcttcaatcagttgttcattgccttcaaattcgaccattaaacgatgttttgttatatccaaaaaatccaacattttcttatcaattcgctccgttacaaattccaactttgaataaatcgtattaaaattgtttacggtggtataaacatccatttccaaatgttttgtctcaacaggcaatggtaaaattgtcaatttgattgctaaaaaatgtgagcccatgtaattgagtttttaatatgactattaataaatgaaaaaatgaaattaaaatcctgaagtctttcttaatttttatttttaatatttttacaagaaaaatttttttgagtttttaaaacttttatttaccaaattcaaaaattttagatttttagaaaatttttttttgccataaatcatatcgccactaaatgtttttgaggcatttttaaaattaaaaaaaaatcctcggctttgaagttaatgttcaatactaagaacgatctatgtccggatttttggtgtatgatgttactgaaaacccattaaaatgggcgttactcaaaaaaccatcaaaataaaatttttttgatataacttcgcccaaaaaaggatcaaatttttataagcttgctattattcgatagccctaacttttttctattatttagaaaaatttcaagaaagaacgaatatttttatatttaaaa

SEQ ID NO: 8459 - DNA, 3690 bp, Heterodera glycines
atcctcatcatcatcttcttcatcatcatcattatctccatctcgtttttccttttgcctttttccatctccaccagcaccatctttagaatcatgctccatattgctcgattccaccagtttatcaagatcgatgtcgtcaaggtcgacgtctaaaatgagggagtgtcttaaaggaaattaattaatccattttttaaaaaattgaaaatgggaaagcaatgtgcaattttaaaaaattttaacatttttccaaaaaagggtgtaaaaataaaatagtgacgttttttgtaaggctaaaacgttttgagtatactctaaaaaaatttctgaaataattcatttaacataatttttggctttacaaaattgttttaaatctcatggttatatctcaccgaaaattaacttatagacagaccaaaaggtgcggaaatggcatttttttcaaaaaatgccaacaaaccttttgtcctatataaaaaatcgcaatctattgccgatttttcgataaaaattagccaaaaatttaaaaaaataatattaccagtatacctacaacataaaattgtaattttaccgagttcgtccgttggacagtctgacaacgtttcgtcggaatctttctcctgctcgccgtgctttttctcggccgattctttctcgtccgccgacgagtcggagctgatctcaacaatcactgggttccttctttcttcctcctcagcgtcggttgccttttggagcagtacatggaatttggccaacaatttgtcgataattgccgcaacacttttcaacacgtcaaccaaatttgcgggcgaagcattggcattattgccgatggccaagcttcggatttgggtttgctgatgggtcaaattgaccttcatgtcggcgtacaaattgatgtaaaaattgatgtttttaaacaattcttttttgtttggcaccttttgttcaacagcttgtaaaaaaccctaaaaaatattaaataaaattctaataaagccaataatattgaaaatatttaaaaaaatctaaatcattttaaatattttgataaacaaattaaactttatttacggaagataaattttgaaatttgtaaaattacttttcagatattaagaattttatctttttaaaatgagttagtataacccaaaatttagtttagaagataaaattttttttttatatacatttttaaaaatttcgatgacttagaagaatctcagaaaaatataaatacccatattttgaattagagccctagggcttttatttttatgcccccctcgaaagagggctttatttcagggaggggttctaattcgtggggggggggttcgaattaaataaatatggtttgtaaaatttttattgtttctttttacaaaagaaatcgcattttttctgagataaaaatgaaatttatagcattaaaatatattttataattatacctccatatttttaatcagctcattttttggcaaaaattgtccattttctttcaactgacgatattttatttcgtcaacatattttttcaatttgtcgttgaccaatcctttatgcctgttcaatgcatcaccaatgccttcaaccatttgtggtgaaatttcactcaaaacattcaatttgtcatcaccattataaattgcaatgaaagacaaataaacgcctaaaaattaattaaatttaaaaatttaaaaatattttttagttgagtaacagtttttgcagcttattaattggccattaaaagtggaaaaattcgcacataatcttgagatcactccaaagctctattagtctgcaaaatgaaaaatgatttttccattataaagcaatgcccaacaaaatccaaaaaaaaataataattttttttaatttaaaactttttgagatttaaaaactactaaaaacaattaggcaagctccaggaaatgataccaacaattttaaattttttaatatttaaatagtttgcttttaaatattacattttttaaatttttccatatgagttccctgttgaaaacccttccttaataatcatttgaaaactgaatacatgcaatttacgtggcccgagtgctaatgaattgcctaattgccattccaatggaaaccgaactttaccaaccaagtatggccatgtatatcgtgtcgccagccatattcaaatattttttggcactttcgctgctaatcttcatcatccttgcttttgttttgctctttggaccagtggaggaagaagcatcggttttgttcgcactggcaatcatctgatcaacgatctgttgcgttccgtgcagcgtttcccgcatttggctaattgtcgcatcgattttggccacttttttgcattcttcgcattcatccggttcatcatcatcagactcctggcacagaaactaaaaagtttagggtaacaaaatctcaaaaataaatcgataaaatactttcttttttgaataatcctgatttattattataattaatttaatattagtttatattaaaattattatttgaaataaccttataaaagcactttaaaaatcaaatatttttagtccggtaaaatgtttaaaaaatagttgttatttcatttttatttacttgttttctctttgtgtaacggtcttttaagttcatgaatttttctacagtttcttctttatctttatcttcatcatcatcaatattaattgggtcggcaatttgcttacctttatcttttatcagttttctaaaaatgggctttatcaattttagttggtgttttggctttttcactaaagccgtttctcgccaaaaattactcatttttgccactttgaggtcaattttgcaaaaaaaataaataaataaataaaaatgggggtccgaatttgagaattaatcgtgatttgataacagattttgtacgtaaaatgattattttcaatttttgaattcaaatgttaattagtggattgtatgtccggttttttgagttcctcgggtcataactttttttttttaaacttaacgaatttttttgagattttgaaggataaaagaacacatagagctaccgaaatatatcaagaacttaatatttgcttaattttgggcgaagttatgaataattttatgtcaaaaattttccatttgatgttttttgactaacgatttttcaaaaatatttactgaatgtataattccgcgccagcgccagggaatttaaatttttattcatttaattgtgatttattgaaatatttttgtcaaaaaaagtctatttttcacgttagtctcgcttaactttctctaatatacttattttggcgaacttttttttaaagaatttcttaagcattttccttgtgacgtagctcattgttttgtgtttaccgtagaccttttactaagtacagtatgccctaatctctcattagttgatcatttctgctccgcccactttaagtcttttgctgccctccagcacattgtaccattcactctttcgggagggggaattggctaatcccgaactcttccaattccacctctcccccaatttgccccggacgaatcggttcacccttccccaactaatcaatcacatatttgtatgatccaccttcggaataaaggttattattccatcccactcgtgaattatgggga

SEQ ID NO: 8460 - DNA, 2625 bp, Heterodera glycines
  misc_feature (2577)..(2577): n is a, c, g, or t
agctttcgagtgcgcatctccaggccctcaatgtcttcaaccaagcgcattttgatctgtgtgaacgccgccagtgcaagagctgccacttcttaaaaattattaatttgtattatatttttcacattaattataccccggtcatcttccgagaccaattttggctttttggctgatgttgctgctgatgatgatgaggaagccatagtacgttttaaggacgaaactgctatggtggccacctcctcatttccatattgcagaactcgattggccattgcttcatgttgtttttcctgctgatttagcagttcaaacgtctcacgcaacatggctggcgacactaccgtagcccggtttgatgtgtatggagaatagcgctaaaatttacagaaaaataaataaaatcagtaaaatgtaattgaatttctcacttcattattagcccaattctccattaattcgatgcgtgatgtacagttgagcgtcatatttttgaggtcactgaagaggtaccgtagaaagcggtactttccccccaagtccttcatttgtgagccaatgtcagaattcatttttattcttaaatttaattataaaaatgtaaggtcaataagcagaaaaggaatgaatgctttggctttgttatgcgcatgccgccggttattaattaattaatttccgcaaccacccagcccgccccctccaccgcgaatcagttgtgacagtttcaaatgcaaagagacgctaattaattattactcaagcgctacggttaagcattggtaaaaggcaaacaataattccgagggatgttctcaatgaatttatttaagaaaaaataaaataaaattacgataagtgatttaaaaataataagaaaagcatcataaaccaaaatttgcttcattcattgtttggctttttcttcatgggtgcaattaagtcagtcgctcggcaattgacccgcacgcattcctgacatagctcaaagttgatagaaaagcggtcgtcgtccaggcgcttcaccttctgctgattgtgatacaatcggttccagtcgtcttaaaatattaattaaaataaaaaattgtctattgttaatttacccgggcagaggtatgtagtaagcaaatattttcccttcgctaatttccacaaatctcggtcctccaccgcgcgcttttttgttggcggtccctttgtctcatgatctggctcagcttccacatgtgtcggaatgggttcaattttattctcatgctgatttggagcggcagcagcagcagtagaaagagtagcagcggatctcttcattttgtataaaataattttggtgtttggaattaatgaaggatgattttgggtttggacagacaaattaaaatgatttcggtttttagtcaggtgaattatttaggtgagagtgggcggggctaatcagtaactaaatgatgggcgtggcccaacttttgagtatataaaagtgaaattagtcgttataacattcattcttggtgaaatggtactcgtcagcgttttctgtgctcagcttcttaactgccctgtcaaatcattgcgtgatcgactcaatcaccccgaggatcggagcattgtaatgaaacatctgattggacgaaaagtgcgtacaacatacaacgaccgtaatgggatgcggaaaacatttttcgtcagtggaatttcagaccaaggggcagccttccttcccgcatacggtcatttgcgccgaccatttaacatcaatgtagctgctcatttttatgcgcgacaccgtataaagctacactttccttatactccatgcataattgagagattttcggggtgaggcaaagatcggcattttccattggaactccttgaaattgttgatgatcaagaccatgaatgctggtcggggcgtctgttctcagaaattggcgagactgatcagaaaccctcaaagtcatcatcctcatcatcatcaactcaaactttgcgcctgcccgatgatgaagagatgacagaaaatatagggcgcaatgagtgcagtcaaatgtctccatcattttggtgaaattttaaattatgttatgttaattatgcgttttcaatcataaaacgatcactttaattttttaattaaaaattgtttttttcgaattcattaactttaattttttaattaaaaattgcttttttcaaattcattaattttttgacaattgtatcttctttggcctaattatgcacttttctacctaaaaatgccttcttcgtttgtttaattattttaaaatttcatcttccattcattaattatgcattaattttatttgaaaagcgaataaatacaatttatggtgtattgatgagaaagagagatacatcagaaaacaaaaacattacaaagtgtggccaaaattcttcacattgaaatcgttgcctataattcccttcccaacatatggtcggtaacatttctgtaggggatgggatacgaccctcccctccctccgaatgttaggtcggaggaaagtaggataagtgacaatgattggctcatagtcaccccgntggtgcgtaccgcaccacttcttctttggacgtctcgtaacgcatgcc

SEQ ID NO: 8461 - DNA, 2604 bp, Heterodera glycines
agtgtctggaacagaccgaaatttcgaagcgaaaaacgtttcccctgaaaattacattttttgtcaaaattcatatgtcaaaactcacataaattgttcaggcacagctttgccagggaccgtttccccttgttgaccaccatttttgccgggtcaatgttgatgccaaactgctcagcacactctcggacaaattgttcttccttctcagcgtcccctcttatgctgctgtcaaaaccgcttgcctggattttttgagccatgaattccgcaatgtaggggcggaatagcttgtcgtcgctctgttcgtactccagaacgcggaacaccctcgtgacgcggtaaccctcgtctagcgcgacgttgagctcaattgatgtacaggtgctgacccatccgcgttgttgatcagtgtgctgacagtggtagtcgtagtccacgcctccagttggatattctttagcacaggtgatgcacagcggaaagcacagtcggtcgtccactttgaccgttaacaccgcaacgtcaattttacggggcggcacaacccagactttgatcagcgccagcgggaaaggattgtccgatgcgcttgtccactgcacttgttggtttaaaacatgcactttcgggtgcccaacaggatatcgagtggtgaagcttaagatttacaatttatttgtcaaatggagaaaaagaactgactttatgtaagggtataacgacgtgaaatcgtaataggagatcttctctcccggtcccgctttgcgcaacaatttcagtggcccggtccgtcctcccgtaaatgcgtccctgatcaccagtggcccgtcatccacgtagttcgcgaaggatttcctcatggctttgctccgctctactatggacgtgattttgcactcccagtacacgtccacacgattcactcgggcccggatgtattccatccgctttgcgtcgcgctcgcgtacctgccccgatgtctttccgttgggcaacaacatgttatcgattggataacatttcttgcatccgtgccaagtacagtcttaaaatattgattttttatggaataacaataataatcaataccgtgcacttcaattgcacgcccctctgcctcaatccatccgtcaaccgagtaggggccgattctcttctctcctccggcagagtgggcggtctgcacttccaccccgtactcctccgagtaccagtggaagaaccgtaaggcgagaaggctttgattttgagcgttgtcgtaaccgcgctcagggacgatggccagatgttcatcaggcagatggttagtgcgaaagtgtcgcatgcacgcgccggcgatggtcatgcaaacagtggactactgatgaggcagccgaggtgtgttggatgaattccccgctcacggctgtccgccacagccgcatcaatgctgtactggaattctaatcacagttgtacctcttctaatcactgttgtacctctcctaatcactgttgtgcctttcccttccgtggttgcacctcttctaatcacagttgaacctgttctaatcactgttgtacctcttttaatcacttttgacatcttttaatcactgttgtacttcttttaatcacttttgtacgtcttttaatcactgttgtttaaaattgataaactaaagaatttatttgttttttttaattagaatttgtcaacaaattaatatacaataaataaccaatcattgtacattttagaattttttaaaaattcgaaaatattttcaaactttttttggcccttgggaatttgggcgaatatttgaaaaatctcaaggggtattttaaattatttaatttttttatttaaattgttttattaatttattttaaattattttctgatgaataactgttttatttaatttgaattttcgagaaattaattcctttcaatttcaataaatattctatattataaatttcgaacttttcatagttgtacttcttttaatcactgttgtgcctcttttaatcccttttatatctcttaatccctgtgtgattgcccgtctgagttcaactaaattttaaaaacgggcgcgaagcgcccgcccaagcccaataaaatttgaaaaacgggcgcgaagcgcccgtccaagcccaacaaaattttaaaaacgggcgcgaagcgcccgttcgaggccgcgaagcggcctaaaagtcccagataattttttaaaaattcaaaatctccacaaccagagctaaaataaaagtgattttgtgcttcgggtccaaaggggggagcacatgatttttgagtgggaaaatttttccatcaaaaaccatccaaaaacatgtctttaggtctatttgagggtgctgatcaccaatctgacatcagatttcagttattacaacgttaagccctcagaatccctgtgtgattggggattctgaggcattattttgaggggggggggaagttcgaatccgggcggtgtacaatatttttgctatgcatttttggctatttttaatgtttttaattcatttaaaagagtgtttgttttataataaaaaataaattttttaatttaaattaaattttttttg

SEQ ID NO: 8462 - DNA, 1755 bp, Heterodera glycines
tttttaaaaattccaaacttaacaatccatagcttgtcttggtagcgaagctcccaaagcgcgaagcgcttttttccagctaaatagccgacggttcacgcacccgctagttaaattgtatagttactattaattaccaaaaaaattcttggaaagattgcgtaaaattcgccattttaagtgggtttattaaatgtttttttctcagtcttgagtctcatgccttggaaaattctcgatctcgaggcacgaatattcatttttttgtccttccgtttcaccggcgccagtttttctaaattgtggggaaaaaagatttttaatttgtaatttccaaagcgatttcccaaattctcatgctatttgaaagcaagggctcattatttgtattcattcattgacgcaatggcaaaagttttaataaaaatttttgttaatgagcacaaaaagaaatttagagaaaataattcatttaacaaatatttctcttggttttaaacataatgacatcaattaataccagctcagaacatccggtatgaataaagtgcaaaatatcattttattaattttgtaatattttggaattgttcgagttcatttttaaactttaaattggttttttattaaataaatatgcttttgagatttaaaaaattataattagctctcatgttttgcattaattatataattttttagatttttttttgctaattttccactggccttattaaacgcccaatttattagcaaattaagccctgaataatgaattttgcgagacatatttaaaagtaatacaattttggctagatggaaaatcgtactaaatttagaaaaatcactcaacaatgttcattaaaaatttccatttcattaatcaaatgaaaaatgtaacaatgccaaatttctgtgtaaatttaacaagacacaaaagcatttgttagccattcatcataaacccggcggaaatttcacaaatttagccaaattaagcacaaaaatggcaacaattaacaccagctcagacgaccaggtaaaagaaattaataattttttaaatttttaaataaaatttaaaaaattaacttttatgcttattttgcttttctgtgcttgatttcaatgctatttaacgaagattttttatatcctatcaaaaacaaaaataaacatagaacgtaattaaaaagctaaataaaatttattatgatttatttgtctctttatttttattttaaattaaaataaaataggaaatcaaattaaataattttactttctcagatttatttggcctaccgtttcgccggtccatccgccgatttgattgtgccggccgttgcattgaatttggttgcgttggttggcattgtgttgaacggcacagttttggtggtcactgtcaaatccaggcaaatgccatggcattttaaaattttttaaattatatttcccatttttcagttccctccgcggctccgccaattttctgatggcattgatttgtttttgtgaattggtccaccaaattgggcacacttttttcctggttgttgtcatttcgggcacaaattttgtcagtttactcaccgcttatttaattatgacggtaaaacttggaattttatttattttttcatttttaaaaattttcagccttcaatttttgctttcaattgcggctcaatgacaatgttttgtgctgcttttgaccgactttttgctgtagctttgccatttaagtatgga

SEQ ID NO: 8463 - DNA, 4666 bp, Heterodera glycines
ggtcgacttttcgtattcagagacgatcgaatagccggagatgaccttagaaccatcgagaatttatgacaaaacacaatggaacccgaaatttattagtaaccgatcggacccaatgccatcggcatacaccgattttcctaataattgaggggtaaatttatctaagtaaagagaaggaaatatacaaagatcgatttgactcaaatgagatacttcccaaatatgtgtcagacaaagatagtgaattttttaattttgtcgtgttcaaagaatttgagaaattagtgtctcaaatcctaatatttgggtgtattttttgtcaattttagatttggtagtggtcatcatttgtatttcagttctcagaattttgaaattaaagagaaaagaaaaaaattcatcatacggcggtgaggtaacggtatataaggatttgcaacgaatatgaaaatgcctactcgtgctcaaaaatgaattctcattgaaattctatgcgattttaacgaatgcgaacctcacgaattatcagaaattctacgacagcggaagaaacagaatttgaaatttttgagaagacacgccctaataacgagacaccttaggcccaatcagtttatctcaccggatgacatcgcatttatcggttctaatcgactttttgcctaccgaggtttcctcggggttactgtagagcaacacctctactcaagacaccgggtcaagctacaattccctcagctcccatgtataactacgtataagaataacggtcataggtgctatttttccctggaacttttagattttttataaaaaatataacggctaacaggaatgggccttcactttagaccgttccacccccgctagtcataatattactttaatttatattcaactttatttaacaaaaaaacaataaaatacaaaaaaaaaaaattaacaaaatccaaatggcatcacattaagttcttcatcgattatccccttctggcagaccggcttgtacattttgtgcttctcctcgtcaccaccttcgaatcccgcgttggccttaatattgggttattaatgagtcaaaatttttttaaaacgtacccaaaatcatttttgtagacgaagaatgccgggtctacctcccctttcccataattcaaaaccatctccctgaatgtatcgtagtgcaatgttttcctgttgtccaatcgaacgtaatccctctaattttcataacatattcagtctcccccgtctgcttgcttctcatcttcagtgcgtactgcttcgcccctccacagcaatattcttcaatctcatagccgccgtattcctcgctcatctctcccaaatattttcccgttgtgatcggctccacatcccgatcgtgcaaaacaaaaatactgtcagtgtccgtatacaaaatttcccctccgttgctttcagcctccctcatacgccatactcgtcgtcctgaaaaattttaaataaaaaattaaaaaaaattttttgaactcaccataaactaatgactatgttgctcgacttgtgctccatcacaaactcctccttgtccctgtatatcaatctaatcgcctcttccgaatattcaacaatatcacataattcaattttatgatcacacgcaattttataaaattccgacgccctatcaatcaccgcattcttattcaaataatttctcatcgaaaactttccctaaaattttaagttaaaattttcgcaaaaccctaaatcttacccataagctatttagcatcaacttgcttatgtaccgcaatgctggattcttcttcactttagccaattcaatgtcgattccatatttttccttatactcttctctccacatatccttctgctcccccgtctcaacccccttcgggaaaccgcttgcctcctccttcagcttcaaaaataatcgcacgtatcccttgaataaattatccgcctcctcttcttagtgccacgctctataaaatctgtccacagtataaccgcattccaacgcctttgcctgaaaatgtcaaaattttcttaaaattttcccacataagttcttaccaattcaacgctagtatatgtcgccacgtatctccgctgtgcctcatcatgggggcaattgtaatcacatctcgtagtttccttcttaaatgttgacgcacatctccaacacaacgggaataataatctctcatcgcacttcaactgaagaaccggaatccgcaaccctcgcggcgggtggaccctcactttatacaatccattaaacttcaaatcctccggtctcgtccaatttacattaatctcatcgctcttcggtataataatcttcggaaaaccaatcgggtaagctgtaccataattcaccgatggatacagactcacaatatcataaacactaatttttttcttctcattcgatttcgcaaacaatttcatcggtccggtcctccctcccgcatatgccaatcgaatagacgagattgacattagtacaatagagaatttatggacacatcataatggcaccgaaattattactaaaccgatcggatctatgccatcatcatttaccgacttactaataattgagggacaaatttatctaattaaagagaagaaaatatacaaagatcgatttgactcaaacgagatacttcccaaatatgtggcagacacaaatagtgaattctttaattttgtcgtgttcaaagaatttgagaaaattaaagtttcaagttcaaatatttgggtatattttttgtcaattttagatttgatagtggtcttcatctgtatttcagttctcaaaattttaaaaataaagagaaaaggtaaaaattcatcatacggcggtgaggtaacggtatataaggatttgcaacgaatatgaaaatgcctactggtgttcaaaaatgtattctctcgttgaaattttatgcgattttaacgattgcgaacctcacgaattatcagaaattctacgacagcggaagaaacaaaatttgaaatttttgagaagacacgccctaataacgagacaccttaggcacaatcagtttatctcaccggatgacatcgcatttaacggttctaataggctttttgcctaccgaggtttcctcggagttactgttgaacagcacctctattcaagacaccgtgtcaagctacaattccctcaactcccatgtataactatgtaccagaataacggtcatagatgctattttccccttgaactgctggattttttataaaaatattacggctaacaggagtgggccttcactttagaccgttccaccccgctagtcctaatatcactttaatttttattcaactttatttaacaaaaaaaaacaacaataaaatacaaaattaacaaaatccaaatggcatcacattaagctcctcatcgatgatacccttctgacagaccggcctgtacattttatgcttctccctcgtcaccactttcgaatcccttgtcggcctaaatattgatttattaatgaagcaaataatttgtaaaaaactcacccaaaatcattcttatagacgaagaatgccgggtccacctcccctttcccataattcagaaccatctccctgaatgtatcgtagtgcaatgttttcctgttgtccacgtcgaacgtaatccctctaatcttcataacgtattcgatctcccccgtctgtttgtttctcatcttcagtgcgtactgcttcgcccctccacagcaatattcttcaatctcatagccgccgtattcctcgctcatctctcccaaatatttccccgtcgtgatcggctccacatcccgatcgtgcctaacaaaaatactgtccgtgtccgtgtacaaaatctccccgccatggctctccgcttctctcatgaattccaataattttaacctcgccatactcgtcgtcctaaaaattaggttatatacaaatttataatttttttgaactcaccataaactgatgactatgttgctcgacttgtgctccatcacaaagtcctccttgtccctgtatatcaatctaatcgcctcttccgaatattcaacaatatcacataattcaattttatgatcacacataattttataaaattccgacgccctatcaattaccgcattcttattcaaacaatttctcatcgaaaactttccctaaaattttaagttaaaactctttcgcaaaaccctaaatcttacccataaactatttagcatcaacttgcttatgtaccgcaatcctggattcttcttcactttagccaattcaatgtcgattccatatttttccttatactcttctctccacatatcctatcgtgctcctccgtctcaactcccttcggaaaaccgcttgactcctccttcagcttcaaaaataatcgcacgtatgccttgaataaatcatccggctcctcttcttagagccacgctctataaaatctgtccacagtataaccggattccaacgcctttggctgaaaatgtctaaattttattacaatggtcccacataagttcttaccaattataggctggtatatgtcaccacgtatctccgcagtgactcatgcagggggcaattggaatcacataatcgcagcttccttcttaaa

SEQ ID NO: 8464 - DNA, 1199 bp, Heterodera glycines
  misc_feature (18)..(18): n is a, c, g, or t
  misc_feature (25)..(25): n is a, c, g, or t
  misc_feature (48)..(48): n is a, c, g, or t
  misc_feature (88)..(88): n is a, c, g, or t
  misc_feature (97)..(97): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (161)..(161): n is a, c, g, or t
  misc_feature (164)..(164): n is a, c, g, or t
  misc_feature (168)..(168): n is a, c, g, or t
gtcatagatgctatttcncctgacntgctggatttttataaaatatancggctacagggagtggccttcacttagacccgttccaccncgctagtcntaatatcactttaatttttattcacttattttaacaaaaaaancancantaaaatacaaantancanaatnccaaatggcatcacataagttcttcatcgattatccccttctggcagaccggcttgtacattttgtgcttctccctcgtcaccactttcgaatccctcgttggcctaaatattggtttattaatgagtcaaaattttttaaaaacgtacccaaaatcatttttgtagacgaagaatgccgggtctacctcccctttcccatagttcagaaccatctccctgaatgtgtcgtaatgtaaagtcttcttattatccacatcgaacgtaatccctctaatcttcataacgtattcgatctcccccgtctgtttgttcctcatcttcagtgcgtactgcttcgcctctccacagcaatattcttcaatctcatagccgccgtattcctcgctcatctctcccaaatatttccccgtcgtgatcggctccacatcccgatcgtgcaaaacaaaaatactgtccgtgtccgtatacaaaatttcccctccgttgctttcagcctccctcataaattccaataattttaacctcgccatactcgtagtcctaaaaattaggttatatacaaatttataattttttgaactcaccataaactgatgactatgttgctcgacttgtgctccatcacaaagtcctccttgtccctgtatatcaatctaatcgcctcttccgaatattcaacaatatcacataattcaattttatgatgatcacacgcaattttataaaattccgacgccctatcaatcaccgcattcttgttcaaacaatttctcatcgaaaactttccccgaaagtgaaaattacctatcgtaaatttattttcaattttcttacccataagctatttagcatcaacttgcttatgtaccgcaatcctggattcttcttcactttagccaattcaatgtcgattccatatttttccttatactcttctctccacatatccttctgctcccctgtctcaactcccttcgggaaaccgcttgcctcctccttcagcttcaaaaataatcgcacgtatccctt

SEQ ID NO: 8465 - DNA, 5748 bp, Heterodera glycines
  misc_feature (2573)..(2573): n is a, c, g, or t
  misc_feature (4796)..(4796): n is a, c, g, or t
gttccggaggaagagggggcacggacgaggacccctcccaaagacttggactttgacgcgttggccaaacgctttctggagctgaagaagagactgtgaggactgaggacacgacagacgaaagaaacgacgacatttgacgggccaaaagaatgcttcgaagacgttttctccgaaaaatggaaattctaattcatctttgtgtttcatttcttcgctattcgctcatatcgctttttttttacttacgcacaacggcactcttttatgaaagttttaaaactttaactgagaaaaatgaatttacctcgtgacgtttaacttttttttctacacgttaaatctacttcaaattttgcataccaatagagaagaattttctgcatcgaaaaattagaagatttttcaaaaataaggctcattaaaaagtcattcaaaaaacaaattttcaaacgcccatatctttttttctaacgcatcaaatagcttagaatttgcttataaaaatcttctcctcatcaaaagcgtttgaatgataccaagtttgtccaatttgttggcaaaaacctccaaaaaataattttagaaaatggaccagggatgggccgaggtttcccctttcgcattttttggcgtttcgctttttggcgcaaaaagcgacttttacccccctaagaattggattaaattcccataaaatttttcaaaattttacctataaattggctaaatttcagtgaaaaactgtttataaatgatcaaaatttccaattttttccccggcggcgcctatcggcatccccgcgcccccaaaactcctattttttcttagaaaatggcccaaaatcgcaaaatttggtaatttgatgaaaaactgttctcagcggcgcgccaaaactcttatttctccttagaaaaattatataaaaatcacaaaatttgatcattttttagtgaaatctgtcaacaaattttaatcaaattttcaaaaattttcccggcggcgcctgcctgccccctcttcccaaaaagtttttttggaaaaagcgcgcctcaaaaaagcgttttattgctttttaaatttggaataaaattttaaaaaatgatttttgctttatgattttaactattaaaaagttgtagaacaaatttcgcatttcgcctttctcatattttagcttttcgcatttcgctttttttcatttcgcttttttttcagtttcgcaaatttcgctttttatttttcaatttggcccatccctgctgtatagtgatcgggtcaccctaaaatacactgaaaattgggaattttttgaaaaaaattcttaaggggttaggaaaatttttcagcaaaaatgagtaggcctgtcagaaagagcataaaatgctctacaatatgcaaaagggctctatgacgtatatccgctaatttatgggcatttaatttcggtttcgatcattctactgtaaaatgcatagatttattgtcttttgcatattgtagagcatttacattctttctgacaggccactcatttttacagaaaaactttcccaaccccctagggtttttttcgaaaatttccccgatttttagtgtgtgttctggggtgtctcggtcaccatgaaaagatctgatagtttcttaaaagaataaattttttgtaattagagaccgcaaaaaaggcactataataggcaacaaaaaattgaaaaaaaggcatgaaaggcacggaaatgccgaaaattcttcctttttgttttatctctctctccccattcttgccgttatattttttgccgggccttaaggaaaaatttgcgggacgatattcccgtctttttcctgctcccgtaaaaccccgtccgaacgaaaaagacgggatttccgggctctccccacgggaatcccatttcggctctactttttgtggattaattaatccatttctgccaatttttagtccaacagtcgccccctttgatgacttttggtacccaaaactgccagccctaagcaattagtcttttttcggttctctgccggcacaaacgaaggccatgaataactgaaaacaagattaaattaatattaaattgtacgaatacaattcgtttaaacctttcaaatgaactgcgattgtaaattccatgccgggacaattctcaacaaaagcctattgattcacattgaaaatctttggcatttttgccaatttttacccgttttgttttgaaacttttgttggattgccaaatattctaagatgcgctgactcatggaaaaccccttaaatttacaacattcatttccaatggttttcatcgaaaagatttccattttttagttttggtaattttagaacatatttgaacaaggtcgcagctcttgttgacattaatcggacaaagtctccgccttttattttgtgacatcttcctgaaccatcacaagagggggaggggcctgtctggtgccatgacgcccaatataccatcatttaattaaaaagtgccagcaataattcacgccaaatttaaacaatccgatcgcccccccccacacccgccgncccacaatcccttaccgtaaacaaaaaataattatcataacaaaaaagaaagaaagaaacgaacaaagagagaaatttgaaagggaaataatgtgcgtttgagtgggggagagatgggattgagccgggagagaatgcgttgcgagagaatttgcacggcatttgctggcgattgatgtgatttcggtgcgatgaatgcatgatgcacatggtcatctgctgttgttgctgtacccattctgtcgtgccgatgcgaatgcgctgccgccgttgttgttcagtgacggactgttgttactcgtcaccgacgcgtccaccggtcgctgctgccgttgcaaatgctgtccgatcatttcgcacagcttcgcccgcttgaaccgtcgcgcctcctcaattcccagctcgagcagctcgcgggcgcgcttccgtgacgacggcgaagtgctggccgccaccgcagcgacgcgttccgccagaagagaattcgctacaaagttgcaatgaatgaatgaatgaattgcatggattattatggaggaagagagaataccgtaaaatgagtgaaagtgaattaggttactgtaacgataagcaaaaaaccgaaaggatccaacaatgagacacagttcggcatctttttgtttaattacaatttgttttctcaaaatatttatgtatacagatttatttataccccacccctactgtctcgttctctttctgcaactttctttctctaactgtgacaatgtctcgttttctctacttgtacgctgtcccttacgctgactgtaacacactctctctcttttgtagactgtctcgttctcttcctgtattatcttctctgatcgaagcactctcgttctctgactgtaacacacattctctctctctgtaccatgtctcgttgtctgaccgtaacacactctctgttttttctttctccgacttttgtgtgcgctttttgtgaaagaaataactcaaaaataaaggaaatagaggctgaaagaagtgcacgaacaagggcctttctgtcgaacaatgtgtcgaatttggcgctgcttctccaaaagttggcactcggccagcgcaaacggagcggcaccgttggagggtggtggcaacgacgacgacgacggaggaggaggagacgccgctgccggagtgatttgtgcgatgccaaagcgcagttcggcctcttccggcactgcaattggtccttcgtccgctgccgttggtgctgctactgcttcgtccctccactgaattccgccgtcgctttcctcttcgtcttcctcgtccgccatgcgcaacggtgccaactcttcgtctaagaatcctgacgccgtctccgctggtggcggtgtgccgagggtgttggttgccaccgtgccgtcaatggtcgacgtccgcagcaaagcagtggtggtcggcatttcgttagactctaaaaaagggaaggtaattggggaataattgttgcaaatggatggattccaatgaatcggcccgatttatgcaaaaattatttctttccgctaattatttggtcatccccaatttatgaccattggctgttgatgttccttctgtcgtttccgcagttacagccaccgcttcgtctggacaagaagcaatcgaagaggagcgtcgacggcgcctattaaaaaaaaaagggaatttgtgccgaaatgttatggcaccactaaccgccacatggccaaacggtttgcgtcgattgggccgggccgtcgacggggcggtcggacgctaccggccgttgttgccatggtgccaacttcggacactgctcgacgccgtcgcccactcccaccgcttgaagcgccacctccgttggaggacgacgaagacggcacatcggaggagggcaatgccgaagtgctggcaccggcgttcatttcgcccacctaaaaggaaagcgccggcgagttaagcgttgcattccccagttgcaatttccgcacctcgtccgcaatgtacaggttgctcttcttgtccagcttgaatgggttgccgaacgcgtgcggtcgcgccgcctgcggctccaactcgcgctttgggcccagtccgatggcgatcagcgacttcacatagtcctcgtagacgcccattttgctgatcggcaagcaggccaaatcctcttaaattttccagaaatcaccggattcaaatcgacaggggtgggacaactcaccgacnatgttgcagtttgactttctgtcccgggggtccgccttggaacacgtgtacgtccgccccgcacccgttgccgctgctgcgcacttgctgctcgaagttgatccgcattttgtccagctgggcgcacagattggttcgtgggatgtcaaaagggtttttgaacagttgcgagggcggcacggcgacggatgccccaggcgatgaccaagccgaggacggacacgcggaggcggacggcacgaaaatggtcagatcagcaccgacgggaagcggcagcatttgctgcggggactgctgttgttgttgttgcggctgttgtggggacgggagaagaccgagcgcaggccgaaacgacggcaatggcaaagccttgccgagcagtgcacgcgcccgagacaatttgacctgtgcgggggggggggggttaaattggctaaatgaaattgtggcatggaaggaaggaatttgaatttggcaaaaatggaaagccaagtcaaatgcatgaaaaagtcacttacaaatgaggcggggttggcaccgaacaaattgacatttgtcggatcgctcagacacttttgcaccacaacgctggcaaactcaagttcctgatgagaaaagaatacaaattgcaacagaatggagcatagggaagagaatggtcggatggaaaacggacggagagaacaaaaagagagaccgaaccaatggagggaaaggcacaataagccataatttagcgacattttgaagagttaccgcatgacaaatgtaattttgttgtctgactaattagaccgacttggttaattattgcccccaattccgtggttcggaccaaaccgtccccttgcgtcctcctcctcccctcccccacctgatcgccttgctgcttcatcttcgcgtgatgggtgcccaagttgatgtagccgtaccgtttggtgttcgcctcctt

SEQ ID NO: 8466 - DNA, 872 bp, Heterodera glycines
tcattttacaaaaatgttttttttaaatttccaaaacttttttgaaattttcaaagccttcagttttttttttaaatttcagtcttcaatttttttttaattaaccccaccaatttggtcggctggcacagtgcagttgtagcgaacgtaacgaacaccgcccccttcgtagtcaacatcttttttgttcagcgccacatcaatgctgtacgtgctggcgtcgtggtggggacggagtgaggccttgggaaaaaaatttttaaaaattatataagtgggggggtatttccacctgttcatcaggccgatagcgtaccacgaacatcatgttggcatggataggctaaaaaatgaggttttttttgttgtaaaatttcactcggtgtttaatttagtaatcaaattatttccatcctttcccttacccgttgatagaaaccgatgaacaccttctcctgcattggagcaacataattgtccagaatttgcaaccagtgatgttcaaagccaaccttaaacgaacaaaaaaaaaatgaaaaaattataaaaaaagggggaaaagcactctgttattcttcgattaaaaggtttgtcggtatctttttttagaatagaaattgtattccaaatacacaattgaacgcttacgaagacaaattaccaaaaattttaatttaaaaatttttctaattacgacgaaatttttgatattttgaccgatcaaacgcttagggatattttttagttaattaattttattttttttaaaccttttttgctatagcctctcaatcaaaaatgaaaattttttgaaaaagcataacaattaggacaaataaaagagcaaaacaaacaattcatcgctaatcatt

SEQ ID NO: 8467 - DNA, 2234 bp, Heterodera glycines
ttgaaaatgtcactttttagcattcaaaaacagattgttaacaaataataatgcacctggtgtttgccctcggaccattggccaaactcctccatcacttcgatgagctcctcgcaaaagcgttcggacaaaaacggaaaatcgtacacatccggacaggccaacggcacatcagtgccgggtttgagcacagtgaaatattccgggtgaatgtaacgactttcccacagctgaaaaaaggggtggtggtgattcgaagttcaattttatttttttgtagtattagaagcaatataattttttaataaaatttttcttcggaaaaaattatagaaaaaaaataattatatttttatgaaaaaaagcattttgaaaaatatacgaattcttaatttaaatttaaaaaggctagatagttttttttctataactttctggattttttcagaattataaaaattaaaattaaaaaaatatgcccacttaacttcggcggatattttattaaaaaagcgtggaagtcggcaaaaaaaatttcattccaaaataaaattgttaaaataataatttttaatattttatttgtaagataacggttccaattcaaatattttttttcactttttcatatagttttcccacaaaattatgaaaaattattataatttcgtataaatgttagccgacctttttgttgttcggataatcgtacagctccaaattgagtcgcgcctcctttggcagttgtgaaaatgagtccgaattgaccaaaaagccaaaatattggatgcctttggacgaatccacaaacataaaatggcccttaaaatttgaaattaagaataaatttatttaaattccgatacattttcccggcaaaattgtgccatcgaaatgtcagcatcgacgccacccttcaaaacgaacgctttggatagcgcttcaaatttgcgttttgagacaaaaattgccgccccaatgaatggcacattccaaacatgggcaggcgatttgccgtggatgatgtccaaataatctgaaaaacggggaggaaaaaatgccatgaaaaattggacaaaatttctttggcataaaatgaatgtaccaaatgaacgcgcataataaccggactcggaaacagcaccccaaaagttactgtacacagtgtcgggacgaagcagaagaggggcaagaattgcactgaaaaaagatgaatcaacatttgtatttatcatggcaaaaaaagttttattttttgcaatttttttgaattacgaattagattttaaaaaattcttatgttaaaaaaagttaggttttttgatgaaacccacccattttccagaaaataatatcataaatcaaaattttttataaaaaaaagacgagtcattgcctcaccgtattaaatcgaaaattgtttaaattctcaattttataagatttttggcttataaattaaatagaaaaatgcaagccgaatagaaaaaaaaacggtaaaaaatacataaaatttatgttctctcatgtgaaacggaccgataattgttgtcttcgcgtgccttttggacaagaatgttgagtgtgtctggtgccgtaatgtgcgcttcggcgtcaatcaaaaacaaaaaatcggcatttatttcgattgcccattgcctaaaaaacgaaaaaaaaacacttttttttcaagtttaagaccgactcaggccccgttggaatttcaaaatttaacaagatttgttccaaaaatgctatacaattaaaaaggattccccccaaaaatttgggcttttctcctctcaaatttatttatattccaaatttcactgacactgcttccgctcgaattttgtgttcgcccattgccgtgccattcaaaatttgcacaatgccaaaatcgtcgttttttttgccgcttcgccgttttgcccatgtttcaatgtgttgtttgttgtacatttggttgttgtaaatgcgcagattgacacgactgtttttgtccggatattccaacaaagacaaacggtgcaaaaattcttcaatgtatggcgtcggcttcaacacaaatgcgacaattgcaatggcatcggcgggcgaagataacggcattccgagggccggcaaattcgaaaaaaagggaggggaaaaaaaattttgtgggtgcaaaatagggggaaaattgtcaagaggactataacaaaaaatttttcaaacatgtaaggcattaacaa

SEQ ID NO: 8468 - DNA, 3685 bp, Heterodera glycines
gataatgccaaatttaaaatggacaaataaggcaagactcaatttttgttttagacgaaattgaaaaaaaataaataaatcgaaaagtgttgggacaatgtccaaaaatttttataaaattgctcaccaatttataagaattaaacataatgtataaacatgtaatcaattcatcttctgtctcctccgaattaaaaaaaacaaatttttcaattaagtgaattttatttttccaatttaaaaaaaaaatttttgatttaaaaaaaacgaattttaaattattttgttgaaattgtaaaaaagaataaaaaaataagaaacccactcgattgtctgtgtcgagaaacactcgcgtataaaagagttggtcgtcatcaccgtcttgcaaattcaaatccccggcaatggccaacaatgcgtaaatttcgcgagcaaaaccgatgaacatgccggaattgaggtacctggatggagaatggaaacatatttgaattgggatatgaaattttgctacaattatgcaagtggacaaacatttcatttactccctgccgtttcccccgagaatttaattttttttttttcttaaaaacgttcaaatataaatttttcaaaaaaaaacagtggaattttttttataaaaaactttcgagaaaggggctgcaattgtaagaaaattgtttgggttaagcattttgacaatttggtttggcattcaaaaataaaaaactgcttgtgcgtggatcgggaaacactggaaaaatgtcccccagaaaatttgcggccctaaatttgcgcctgtgctcaaatttgaaagaaaaaaattattcaagaaaattataaacattattgttttttgtaattttaaatggtatttaggactgtaaaatggtggttttgaaaaattgatttgagcataaaaattaagcacatttccacgtttttttccaaaattttttgtgacacaaacctttcgccaaaaaccacgggcggatactgtggggcgagggtacggtccggccaacagaacggttcagcaccaaacacaatacgattgtccgggaaaagggacaaaaatttgcgaaggattatgtcggagtcggcattcaaaatgacatcataactgaaaaatgagggcaaaaatttttaaattatttatcgaaaagcgcaaaaaaaaaaatggaaaaactgacgcatcaatgaacagcaaaatcaaatccttccggtctttgaatggctccaaatattcacggagcagtcgaattttttgtgcaccaccctaaaaatgttttcaattttttgatacattactgtcaatgttatatcaacaatttgtgcatgcaattcatgcgttaaataaattttcggtttattatcgccttttggattttttttaattgaaaaatgggggggggcaataaaaagaggaaaatgtccaatttttaattgtacaagagcactctgatttcacagattgtggcaggtttgcatgtttaatgtgtgaattcaaattttgcctaatacaatagaattcaggacaggatcagcaagaacatgctcacaatccgtcattctttttgtttcataattctaataaatgactcatttttcaatgacaaaattttcaaattgttcgagtctgtctgtacagaatgtccattttttaatgctcaatggtcggcaatttttgttgtttcgaccaattttagaccaagtgtaaatttagaaaaaataaattgaattttcctttcgggctcgggatttgccagaaaaaaaaaattagtctcacctgttcgcgcatgtccccgccattccacggttcgcccatcccaaccacaaacaattggtgcccaaatgcatttgccgaccgattcagccgacacaatccgtccgtattttcagtggccaccgttacaattcgaagttcaaaattaacgtcttgtgccaaactgttgatgaacaatgatggcacaaccaaaattggcaagacaaaaaattttgcaatgggagaacgaataattttttgtaccgtgttttgttgggcgattctcagagccaaaaaatcgtcattatatcgacataaaaatcaaataaaatgaatagcttattaataaaattgaaaaacatttaaaaaagtaaaaaatacgagggcacaaaaattaacgaattagatgaaaaaaatattgtaattacgcgagctaattttctctaaaatctcaaaggaaaataaacaaaaaataagaatagaaaacagaaattgatcaaaatcggaaaactaattaagctgatcaggctgctgctgttgttgctgatcaagctcatacttcggttcttcgttgcgcatctccagcaatttcttgcttaaaatagtgaaatttatagggggaagaagtagaaaagttaattgaaaacaataaagttaggtattttagaaaaaaaatttagatttgccgaggcatatgggtctaggaaaaatccaggcatgtgtccaccaggtcaagggcagttaaaaaaatgaaaaacccaaaaaatgatggaagaggccataaatcaaccgaaaaatcagattaaaaattgattttttcgcaaattctgacaactaagagaaatatgaaaatagcgaaaaaaatcaaaatttttgaatttttttctttataacttttttatgaaattctttgtaatttttgtaaggctaaagagaattagatgagctttcgaatgacgacaccaagattgttggtaaatgaaagaatttacgctctgataaggtcctcttggtagaaaatttgtggcaacggttcgtcacgcttcggcattttgatgtcccattttggctcgtaatgcggtgaatgggcgacataagcgtcgaaccaaagcggccgttgttcccatttcaaatggccagcaatgatcaagccgagaatcctggaaagcaaatttaaatgtaaattttaaaaggctcttattcagtttgtcccccataaaaatttttttttaatttctaagtaaaaaagtcaaaatataggttttcggggtcgctgatcactgatcacgaatccgacatccatttagacccatttcgaaccccgaacccaaattcgaacaaaaagtctaaaactcaattgtcaacaaaatcaacatttattgctcaaaatcgattcaaatgcacgatttttccgtatgttggccgtcgccagcctcttcaatcaaaatctgctgtcttttgtccgttgctctgcattttctgtggcggaagcattttggggattataatgttgtgttttttaactttttgtctcaagtaagtgccatatatccatgtgaacgagtcccgtaaatctattgtttttcttattcgatatgaaaatcgtgcatttgaatcgattttgagcaataatgtgaattttgttgacaattgagtttttgacattattttttactaaataaaaatttttttttgtacgaaacgccaaattgaaacgttgtacgaaccggcttttgtacgaaactccattgtacgaactgctattgacccatcttcagacctgtgcttattaagtatttttaaaaacataattcaatgacgaaattgtccactgaccaattcgtttgatagtaaaaagttactttaatatttaagcaccatatatattgaatgaaagaattatcgctatttgagtttaaa

SEQ ID NO: 8469 - DNA, 4542 bp, Heterodera glycines
acgaacttttgcgggactttcaaaatttgaaaaatttaatctcaaaattctggcacagaaatctctcttcctatgtggctataagttgaagacccatggtcaaatcatatttgttaaggcctcccgttattatgaggaggcaaggaagtgattctaacagagaatagaatacttgaccgtaggactgatgtaggtggcatgccattctctaccacttgtctacttaaatttttgaatttaccatttgtatcatctaaacgtagaaatcgcttccaatttctgaagtcattctgaagcgatgcgtttccttttgagagagaacacaagaggaacgcagttattttaagggcgaacacccaaaaaaggatttcttaggttgaagattagtttttgcgaaatgaaatatattttttttctgctgtcattttctccattactttacatgtgcactattttgcggcgcgcttttttttcaaaaaacttggcaaagcgaggtgtccgggggaaaaaaattggatccttgccattcatggacgaatgcgagccttgaattagttgaattacctatattcgttatcagcgatcccaaaacgccaagtacatcgcagaaccgcttaagacgaacttttgcgggactttcaaaatttgaaaaatttaatctcaaaattctggcacagaaatctctcttcctatgtggctataagttgaagacccatggtcaaatcatatttgttaaggcctcccgttattatgaggaggcaaggaagtgattctaacagagaatagaatacttgaccgtaggactgatgtaggtggcatgctattctctaccacttgtctacttaaatttttgaattaccatttgtatcatctaaacgtagaaatcgcttccaatttttgaagtcattctgaagcgatgcgtttccttgtgagagagaacacaagaggaacgcagttgtacacatactgtagacccgacccccacattttgaggataattcctattaaatttgatgttatatttctcaataaagattatcacctttaatgctttatttcaaaaaataagtaatttacaataatatcttatcactcatttactttttatagcacgcaaatgaacaacgacttacttccggaacgagcccaagctggggcagttcaggacgacgacgcccggctgggctgcgtctcaaaagtttgcttttaaattttgtaaaacaggatattggcgtttgcaatggtagattttgttccgaaatatacatatatttttttgattatgtaaataaccaagagataatctgagatgttgactggcatttgctcaatcttgaaattgaatattttttaagatttaacattttattgcaaatattgctgtggaatgattgagttgtagcagcaatatgaaaggattcagaagcagggtcgacattgtcctcccccaaaaataaaaattttaaagaaaaggacaaattttttaaattttgaatgtttttcttatcataaaatcccaaaaattttcccgtcgacacttatcgacaccgccggagcccaatataatatttttatcgaaaaattgatctcgcatggcaaaagattgtcattttttggtgcaaaacctaacaaattcctgttttcgcctcggcgatcataatttaaaaaaacatactgaaaataattttagccccagaaaactctttgggtggggcctaatcgtgttaactcggtactagcaatatttgtaacaacaaaaaaacaatgattatattttctaaaaaattcgaattctggttagggattcgagatgagctaacagaatgacagatcgggcacttgtaatgttgagatacccatattttggtaaattgatgaaaatatatatacctattttcgacatttaaaggtaactcaatttatgaataactattttgatacaataaagttaaataagtgccaaaattggctatcaaaaagagtgccaaaattggctatcgtatgataaaaaacaaataaattgaaaaaaacagttaattggggggaaggtggcaatgggcatgactgggccctacgaattatgcaagtatgctgaggcggcaaccgcccatcaggtttccttctcctgctcgtcctgatcatcatcatcaccgttctcgttgtccaccaacagacccccatcagcgagtcagaggcgacggagtcttgagtctcgtcgtcctcctgctccaaactgtccgcgtcgggcctgtaggtaggagcatcttcggcggtggttgacgcttcagtcgacacgtccgctgccgccgcaaccgcccgcgcttcggttgcacgacgctcgtgctcacaactaggaattatatatatattatacctttatcggcattaggcgtttttaacttactcatcgtacatccaagtgctctttgcttgcgcagaagctcggtgataacttgggcaatagccccacgattttgctttgtgaaaggaattaaaattatcaaaacaaaatataaacattctcatatcccaatggggaattgaacccaaaggacagacaacgaaagaaagaaggcttaaccaccagacacatatatgtgtccttcattaacagaaatgaatttattaatttaatttttctcaaataaattatatattacggaaatctacgctgtttttggacccgtgtaataatgttatcccaaatttaaatctagtaaaatccagactgctatcgaaacaaccggcccctaccttttcagaaatttaaaaacattaaaaataaaaattttcccctatcttaatcctgtgacgcttaaataaatgttgatttatattacggatgccaataatacgcacatgaatattttttccaaatttatgtgcatatttgggaattttttcaaaaaatcttattacattaaaacggccccctctgttaaagactttttgacctctaaggatcgaaaaattttcattattttgggtattttcagcaaaaaatttaatagaaatggtaattggaagtttttgtattttttcttctaaaataattttacataacatatttagcgattcaagatattagcttaaatttaacgaatttgaagattttttggaaaatttagccctgaatttgaaaaaaatgtatgcacatattttgcaatttttaagcatatttattttatgtccatataattggcgtttatattcattataaaggttctattttttaaattttggattaaaaaattggttttttgaaattattgaagatgaaataatttaaaaagttttggatgaaatttacttccttgctagatattgcaccgataactaaaaaaaatcagtttttttctcgactcggtaccagttatttcgcaagcaactcttcttcttatcttttctatgtaaatttatatatgttatttaattttttctcattcttttaaaataataaaatttaaatctaattttccgatgtataatttaccgtttgtagtgattttcgatctctttaatcgttgcacattatcttcaatacatatataaattgaatttttaattaaaggactttgcccatgactgttaatcgctcattgacaaaaatggggacactttgatcaaatcgtaggaatttttgcaaattgaattgcaaatccgtgaaatttcaacttggtaagcagtaatttagttcaaaaaagtttatggctaattaattcatttgattattctccattaattttaattgcatttttcggcagaatgaatttcgacatttgggacaatttcgattgagtgccaattgaacattgccttaattaacgtaattattgttaattaagcaattgatggacccgagcaaaggctttcattgaaaaaagtgttggttttttatgagaaatcgatgggagcgaacttagaagcgaaactgttcacatcaaaggatttccgtggaaatatgggcacaaatagaaaagaaagataaaggcactgattgggctttttcctttgtgcattgcttcagaggaaggtgctattaatgttaatttaaatgataatcaatttcacttttgtgatcagagaaaacattacacttatcactgatgtccaaaattctctatcactagaaatattttgccaatttttttttattgatcagcattttgttaagcaggggcctttcagaattacgaacaatagagacaaacaaaataattgtcgtaaaacttatcattttctcgcgaaattcttgccgggaattaggcgtttctcgttcgtaattgtgatcgaactcaatgacaaacgcaaaatttcagacgacaaatatttaaggtacgctcaacccctaattgagttcactgatcaagaatccgattcaagttttcattttctgtgctttgtttatgatttttcatcaattatttagtataatgaaatttttcagattacacacaacattttaaaacagaaaataaataataatttttttttaaattataaatgaatacgcttcaaattcaagaaaagcaaaagagtcaa

SEQ ID NO: 8470 - DNA, 1530 bp, Heterodera glycines
gaaatatgatcgataagatgatctttcaccatatttttggggggtaaaatttgtaagtttttgaaaaccagcatcatctatcagcactggcggacgaataaattcactttaaatttaaaaaatgatatttaaaatctcaaaaataaactgattttgtgcggaaaaatatgctaaactggttttttgtttttagcacggtaaataaaaattgttagaaattaaactgaaaaaaaattggaacgaagagaaatatttctcttaattacccatacaaaactttttatgttcggcttaaatgcccgccccttccattcacctcaattgccataaactcggagaaaccccaggggttctctttttcggagcaaaatgactgatcaaatgttttgctggtgccattgtaatgggtgttttcctcattttttggaacaacacataatgttgcagaacaagtacagctccaattcgagccttaacatcaaaaacaacacataatgttgcagaacaagtacagctccaattcgagccttaacatcaaaataactaaattattagtttatgaaaaacttttttttccaccaaaatatctatcagagaaatttaagtaaaatattcgagaaatatacaaaaaaagtcaaaaataaaaatacattactaaatatttttgcgaaacctctaaatatttgtaaagaaaatgatttatagttattatttttcgacaaatttgaataaaatagaaaaccagtatgtatttaaaaatgttttttatagctattccattgaaattttttaaagaaataaaaattttcatttgctcttccatgacccaccataatcgtccgcgttgcattggatgaaaaatcccatgtatttggtgccagattttgattgaagttgtgcaaagattttccactggaatccatcaatgtaaatggcatcactgtattttcggcttaattccttctgccgtgcaaattcagaaaatttttcaattttcaacgtaagttttcccgtggatttggcggatcgttcatggacgggaaacggcaagggataaagggtggacaaaacagcggacgaatggtaaagtagcacactgactaactcatcactggtcaacacgccggacgaaactgttgaaagcgtaaaaattacagcccggacgggagcggaaccccgccaggggttttccagggatccaaatcccgacttttttttttttgaaaaaacgggatgccgaaaccggggtcggagttccaaatcccgacaaaatcgatttcaatcacgcgatcgagattcaatcccgacaaactcagtattaaaatctcgtggatctgaattcaaatccccgcaaaagcggaatttccggtaatcctaccccggccatggattccttcgcattttaggtttgcatgatctttatttttattagtttgtcatacttttttatagtaccaaatgtcttaccaatcaattccaaaaaatacttatgaatgatcggaaaccgaattttgtacagtccgggccaag

SEQ ID NO: 8471 - DNA, 1441 bp, Heterodera glycines
  misc_feature (48)..(48): n is a, c, g, or t
tgcgattttctgcttgttttacgttttgagtcggggctatatgaattngggtttttatcattgctcatccccaattgagctaaaaaaaaattttgattaaatagttcaccaaggtgatcagctgatcactctttcttggtctctgactgagtttaataaagttttagtagccccaggggatttgttggtcatctccaacaattgtcaaacaaacatatgaacactgctctccaattaaaaggatcataatacacgaaatcaacatccatatttgattaaataaacccaggcaaattgaattttaatcgtttggtttttaatcgcattaattttctttgcctattttaattttttaaatataaaaatgtaacctttgaaacataattctgttggaggataaattttctccatttttcacttttcaatatcgtcccattgtttgccagccaaaatgaaaagctttcgaagtaacaaattttcctcagtttttctccgatgctctcctcgcccaattcttcctcggatttgtccctttttgtgtgtattaatcccaaattggccaattccgtcgccgcttcgcttacaatccaaattaattgcctttcattttcggcatttaaatttgacacaaatttgagcagattggccaccacaatttcgttgtttgctttatacgtttcgatgttgaatttttgcttttcctcctctgaaattggctcatccgaagttcgaatcaaaagcagaaaatactttttcaacaatttgtacatattcttttcctctgaaaaccaaaattactctctaaaatgagtccctttttagggtggctaaaattgagtaacaaaaaactttttctattcaatataaaaatagtatttttaaagaattggagagatctttcaaacgcttcccttaccgtctgagtacagtacaccaaggcaaagttctttgataattgaaaacactgctgaattttcatgcaattctccacctattctctccgtgtcaatgtaaatttcttaaaaaagtaaaataattctaattatgtgaaatataaaaataaaaatttaatggccgagactctcgacctgcccattacccttcatggcgttgttattcagcaaaaataccaaaaacaaaaaatacacctttcaatttttgccgaaattggttgaccaatagcaatggcttcagactttgttcgtgcattgcaaaaacgcttttcaaaatgctcttttggccatctgtggacgaaccaccgtaatcaccaaaaaagaatgtttttttgcctaaaaaattaattcgccaaattttgttcattcgttgcaaaaattctagacggatttcttctaagatttccaaattcgtaaatgtgttggccgaatccatacaaatttccattttcgcataattttcttccatgtctttctgttcgctttct

SEQ ID NO: 8472 - DNA, 4432 bp, Heterodera glycines
taaataaataaatatagtatcctccatttgtattaccatatataatacgcgagattgtccagcaaaaactgtgactgtttccaatggggagcagctgtatcgaagtcgaacaatgagatgtaatttaccatttggagttgcattatttcaacagtgttcagccctaaaatggcaataaaaaaattaaaaaatatttttatttgtatttttaaattgggatttaaatgactcaattaagcgacaaattgggcaaattaactccggcagaattctcaaaaaaaagaagcccaaaggacagttaaatgagtgcagtatgccgtgctggtgacataagccactgatcggtcgagtggttactgtcacagtaagtcgttgtcttaagtattcactttttgttcccaattactcacttcgtctgagtatctctttcagttgcgggtacttttgcgtcagttgtccaaatgaaacgaatttttccatttgttttgggcacagaaattttttgagtcggtacaaagcgccggtgctttcaaaaagcgaattttgcaaatgctgcgccaaaaattccgcgtagaatctgagcacattttgggcatgttcatcgaccagttccatccgtgcaaaaagaatctttaaatggctttcgttgtgccaaactttcgcattttcctccacccgttggattttttcgtgcgcctccaacattggcattttgttgtacaaaagtgccaatttttgccaaaagtcaaagatttccacaatgtcacttatgtctttaactttgttctccttgaaaaggacagaaaacatatttatgttttcctcccatttctcttcaatttctttaaaaatgttgctgatttttgcatccgtcttatgcaaatattttcgttgcagtaaataaaatttttggaatatttcaaaaattcgagaaaaataaatgcgcgaggaaattcgaaattcgccaatgcccgcaacaattgtctcttttgataaaatgagcaaatattcgtccgcccatttcgcattagtcaccaaatcttgagaagtaaaatattaaataaaacaaaataataatactattatcaatttttaaatattgtgcgattattcgaaaaattgttttataattttgagagcgctttgattgccatggaccaaaagctttttaagttttgttttaaattctctgggtttttattctttttagtttttattttgtttctattgtaagttaaaattaattatttattttatgcaaacaattttcgaaaagcataaaattttgttgttttgtgcctttttggcatttttagtgcctactgtccgctctcttttcatcaaatggatttcccattaccgaatgccattaaaaatggatgccgattttcaatttgactcagcaaaatgggtccaattagctgttcaaccgcacttttaaattcaagaattgccttttcattattctcaatgcgcatttttcgtaattggaatgcaacatttgactcaaacttcagtttcttattttcaaaaaaatttgaattgtcatacctaagaaaaatagctttatatttattatcagggctgtccgtccaaaatatgcaaatgcatatttttttcctggattctacgtagtcggatataggaaaaacattttcttttgggttacttagggtggaacataatttttgatacccaaattttttccaatttttaaaaattcataactccgttatttctgcgcctatttaaatgattctttttttattttgttcttcatggtgtcctcttttatatctcttactatcgtttcactttttatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatggccttaaatgggacctatcttttcaacctgagcttgtactgctccaactccatgcatgaagttcgagctgtacaggtttgttgcgatcccagagaccaaatctaagaccatattcgaactcaacatacccgatttaccttgtttaattaaatccagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactaattctctggctctgtatctcttttatttttctttaaatcagccatcaaaaatacctaactctaaaatgaccatttttacttacttaactctaactccctaactccctttccattggtattgattgatctcttgccagaataatggcaacatattattgataataatggcgggtattttgaatcatgattgtgttttgttgaaattaaaaaaaaattttattaaaaaaaatttgggtatcaaaaattatgttccaccctaagtatttgcatataaaagtcgggacttttatttgcatatttaggtttttatgcatatttcatgcatattttgccattttttgtgcatattttaagatgttttgcatattttgccatttttcgtcaaatttttccgatttgcccttggggaaaaatttgattatccttaaattaaatataaatctgaatggatgcgcgagtggatcaacactaataagcttcactgacgaaaatgttgagaaatttttgatttgcaattgcaaaaataaccgataaaatttatgaggaataaaattttttaattaatttacacccctaatttcaagttttttgtgcatatttggtgtatattttacgatttttgttcatatttggtgcgtatttcacgattttatttgcatatttttgcaatttttcgtgtatatttttgacagccctgtttattataaaaaatagtataaatatttcttatattttattttaattaaaaataatataataataatttcttctttttaaaagtccttgccaatgccatttcccctcattttgccaattctctccctttttttggccttccattagtgccatcagtgctttgaaatgcgttgcgctttttgtgtcctccaaatatttttttattatttcaatttgttcgtcgctaccaattccattctcatcatttttagacaacatttgctcaatttgttcacagtcaatcattttttgggccgtattttcactctccaaaatcattcgtccaaattcttcgcctaatatttccgctaaaataaaaatgtgtttaaatgaaaatgggcacttcaatttcaggggcaatgcctttatgcataataattctttgccttttctttttaaaataaaaaattaggaaaaataaataaatgatgacagactgaaaaatggactaattctcttaacattttttgtatgccgaaagcgctttaaaaatgcaatgagttattaattacccaaaaaaatcttcaaatgatgccaaaatttccataatttgcattttccgatttccgccgtccattcgtccgttttttcaattctttccgccaactcagaaaattccactcttttttcttcaattaatttttgttgaacatttgttaatttcttgtttttcatcgaaacaaatatttgatgagaaacgtcgtaaaaaagtgccaattccaattttaatttcatttcctttttcggcagctcattttctaaggctttctgttcatttggcaaattcaaaagctgagaataaagcgcgtcaatttctttgattgttaaaactaaaataatttaggaattttgtttaaaaattggggttaaacaaaccaaaactaatgcaattggcacgatcaaatgaaaaaaggacgaaaaaggcgaaaattgcgcttgtcaaatgacaaaaaggcattaatttaaattcttcaataaaacgcataacaaatatatatatatttttaatgaattaaaatgaatgaattatttgaaaaagaatacattaataattaattttattgcagcatttaaaaacgaaacaagcggaaggaagtgctgggagaagcttattcttcatttgctaacaacgaaaatcaaatgaaatgcacgtgatttggttaaaaaataatatgtttcctgttttgttggacattttgatattttattggtgagattgatttaatgttgcgcagtatttgtctccctttttcccacttttaagtgccacgtctgtcttcaacatttttataaagacgttttcgcgtgagtgcctgtttaggacagaaattggtcggatgtgtgccgaacatccattttgacctatttcgcatcccgaacccgaattcgaacaatttttt

SEQ ID NO: 8473 - DNA, 897 bp, Heterodera glycines
gctcaaacaaaaaatgtttttttttgctttcaggcgacatctattaagcattttgcataaattatcagccataacacattgaaaagagatacaaaactatcaatgtctactttcaaattaggaaatttctcgtttttttgtgtcgtggtctcggttttcataggtcaatctcaattctcgagttatttgttctctaattaccccccccccccccctctccttccgcttattttttttttatcattgatgtctgtctctacactaaagcaagcattagaaaagcagacagagaaaatagagcaatagtgtgagcacgaatgagacaaataaggaaaagaaagaaagtaaacagaaaatagaaggcaaataaggaaataggagaatgaagaaatagtgtggcatgcattcctagataaagaaacaaagataaaagaaagatgagagaaattagaaaagggataacggagaaataaaagagacagatagaaagaaatagacaacgaggaaaagatgaaaataaaagaaaatagtgtagagaagagaaatgagatggaaacagaaatgtggaacagtggaaggcaggcattttactctctctgtcaatccctcccatttcattcctcccccccccccatacaaatccacaacacaatgcaaaccattcaaatacacttaccaaatcgataaaaatgtaacaaaatggatataaaaagggaatatttagacttccaagcttggaattgtcccataaatttaaatttcaatatgtattaaaacaaaattaaaaaccataaatggatgtatatatcaatcaaagagcagtgcaagaataatttttgctgctaattcctcgtaaattcatttttttttaatttttccctttttttgtttattttg

SEQ ID NO: 8474 - DNA, 1935 bp, Heterodera glycines
  misc_feature (48)..(48): n is a, c, g, or t
  misc_feature (72)..(72): n is a, c, g, or t
  misc_feature (1819)..(1819): n is a, c, g, or t
agtaagagtagacgacggacggacgaccctcgaccccacaaaaaaatnaattaggactcgctaccgaaaatngattattaattattataaataattaatacacgacacaaaacgatgacgaatggatgtgctgagtcatccaatccccttttccctgtcccatagaagagaaaataaggggcaaacgacgaacgaatataatcatcctcctcatccatcaccattcttcattcattccattcattcttcggccgcccgttttcttatgcttacattcactcatccatccgtgtctatttgtttattgtacatgtgatcgatcagtggtggtatttttctccctcctcatactactcgacaccattctctcaccactatatgtgttgatcagtgatgatcatattgattgatcggggcgggggcaaaaagattacacagacaaatttttttgtcgcccattattttcctcatttgttgcaaacaaaatgcattagcattagctatcaatctatttaatgggaggggatgataagcaatctctcgtcgatctcgaagaatgaaaatctcgattttgtttttttctaactacaaattcgactgtgatctctaattgtagggtgagaattcggctaactaattaaccgggcggggggggggtcatttacaatcgtttaattgatccagttttacaccgtgagaggtatttaacactcccaatcgaatcaatgtgtcaccaccactgactaaggtattaatcgctacttaatgaccttgctgtcagagagggtacttaacacctctaattgaaccaacacggtaattaaactcaaatgttttatgtttaattgacccaatttcgtcccggcggaaacacacaccctaaagcacattttatgtgcaccattcaattaataaaacatggcctggagcccaaaattagcgcgcgcacacttcaaacacaactttcagaactagcaaaaacaaaaaaacaatttcctcctgtgaacattttgccacccgttcttcaacacatttccacattcattaattcacaacatcattctccgccaatgaaaaattgttgttgccaaaatgccatcgtcgtcgccgccgtcgcctggtgagtcccatcggtgcccggtatgtcgccgaacactgcagcgctcgtacactttgcggggcctcctctgggcaatggtgtgcttcccgtgcgggatgtactgctgcatgaggaggctgaggaggcgttgcaccgcttgtgaaagcgatgtgagtgcgacggaagggcgggcgccaggggatttaatgcaattttacgtagaaaaaactaggattcggtattaaaccttgtcctggattccatgaaaaacaggttgccaaaaatggcttggacctctggatccaggcctgggtccggacaaagccaaaaaaataggcaaaatttttttttaatttccctacgtttgtgcaggccataaaaattctgaaaaacgatctttttgttatacaatacagttaccatagtatacataattgtgtatgagaaacatttcctctcccattggcaggtgatcatctcggacggcggtgtgccaaccgttgcccaaacgtacaacacatttgccgagttcaaatggcaatttccaccttcggcacttcgcagaaaaagtgccaaccccaagcatgacaaggaccatgatgatgacgatggtgatgatcaacatcacggcagcaatgatcaggagacggaaatccaacggctgtgccctgctacccgtccgtccaatcaacagcagcagtgatcagcagaaatgcatgngtatgatgacattactgtacacacaaactgatcagagtctataatgatgactcactcgctcactttttcatacccatcaaaaaactcagccaatcaatcagtcaccctccttttat

SEQ ID NO: 8475 - DNA, 3270 bp, Heterodera glycines
  misc_feature (94)..(94): n is a, c, g, or t
ccctaaaatttaaaagtataaactttttgaaaaaaattttcgttgcctgctctggtacaataccgtgcacagtgtgtacatgcgtgccacattntcgtccaatcggcgtcgaataatggcactagtctccaggctggcgtccagttcggcgtgcgaatcgccgacatttttgtctaaaattttttccaagagatatatttttcaagaaatttgtgctgcaaaagcatataggataaaactcgtgcaccctaaaacgtcgcgggacaaaaagttgacggaaaacaaaaatcaaaaaattacatttttcatgaattttaactctaaagaaattactaaatttcagaaaaaaagaaaacccattgaaaaatctttgttttgtttttgtttccttgaaattttcattttcttaataaatttttttcgaattgaataaggaccgaaaactttttgaaaattcattgaattcattcgtttttacgccgatgttaatgtcctgctccgggtaaaactatatacaattttcgtttttgaattttttgtcccacttggccactcccagctgttgcaacagtttgccattctcctccagtgcccattctctgctttcctgcagctgatcaatggctgattgcagctcaactctctaaaaaaaaaagattggaattttcaaaaacgaattttttgtgagattgagtcatgagtgtcgccagaacataatttcagcttttttcattaaagccatgaaattctcaaaaacatggagactctaatgccaggaatcgggtggtccactaaaatgccgacctccgtctcggcttggcgctgattttgcgccagtgcggcttccaattcgcgaattttcgcctgtgctgccgctttggccttcaaaatgagcaccgacgagggcaacggctcctttaaaaatgtcggtacactgcattaattactcctttttcctaaaattttcaaaaaaaaaaaatttttttttccgaccccaacagtggtggtgttgctgatagcctgctgctgtttctccatgtcggaaatggtccgtctcagctgatcattctcggccaaaagttcgtcaacatcggccacaccaccagcagcgcctccactgtcattttttggtgacgaccctttgtcatcaataagcggcggcggagtgccaatccggcgaaccttgacagaggggcacagggcacattaattgatttgtagagccaagagccgggaatttggggaaaaggcttggactggaaatccaggcaaaagaagacttacaatccagaaatccaggatcgtcatttccaggttccgttcattacaaaattcccgggctttattatttattttgctttttgaaattttattaaaaaaatttgtaaataaatttataaggaattattttttgttggtgaattcctttaaaaaaatttaaaaaaagaaattttataatttttgttaaactcgtttgattttttgtcgatagatcataaaaaaaatcagaaaaactcgaagcattcagcctccattttgattacaaacggctaaaaaacaaaatctttcaaaaactcctcctattctcgggacaatttctcgtaatccacccctaaaatttccggaattttcgaattaacaacaaatttatgaaattccacatttaccatgccgtccacatgttggtggtgccgtctttgttgttccaccaattgctgttgctggtgttcttgcggtcccagtcgcgtgccataatcgtcgccggtgccgaaaaaggtcacttttttcctgccgccactggcacttttcttgcggcccggcaccgaatcaccgccgccgatgtccatggcacccaacaaaaggttgtcagttgttgtgtacgaagagcagccgtcctcgccggttgggtccagcggtgggggcgacccattggcaccgcatgaaattttattcaaatttaaaaaatggtattttaaaatttatctcgttacaggcctgtagttaggggggagagaatttttcgaaaaccgggaattttgagaaattttagtaataaaaccaaaattttcttggcctgatgcttgtctcttaccaatggagagcgggaagggtgtcagaaatttttaaaaaatggccaattttcgtgccaaaattttttgatttttttgaattttttaccaaattcatggcaaattctagggtctgcaaccaattatagggccccctgactcgcactaaccggcacgcaacagttgcgggatggcacgtcctggcgatgcgttgcgctgcgggctgcgcgcccttgatgaacagccgtcacgctttgttggcatcgcccagcgcgaggcgccggccgctgcacgtgcgccgcctgcagcgccgctgtcgtcggtcgtggtgccaacatctttacgctcgcgtggtggcgcgtccaactcctgcaaccgtttgccgagcagcaacacagcaagctgtttagagcgtgccacctgcagtaaggaggggaggggaggtggctaaaaaaggcaaagcaacaataaaattttcgtaattttttttaggaaaatttttatggcaggttttataaaactttgcaaattcccctttaaagcattaaaatttgcgcccgattttcaaagccaatggagagaaaaaaaaatcccaaacgaaaattcgtaaattttcagaattcaaggcgtgtctaactctcgaaccaaataaaaaattgcaagacatttttaaccgattttaaatgaacggcttaaattaaaaatgaatgtttggaaatgctgatgttttataaaatcgattttaaaaaaattgattaaattttaaaaattccgtttcggactggcaatgagaaacctggccttgctcactgaacgcctcctgcaagtcgatgatgcgccgttcgcgttccattataatctaaaaattaaaaaaatcatttttagtaagaatttaatctaaacatttaaaaatgacttaaaaacgggtaaatcactgtatcagaaattaaaaacaaaaaaaaattttttagtatagaattcccatgcccatgataaacaaagaccaattgtaaactaaattttacttcgacaaaaatgaaaacattttgttgctgaaaaaaattgcatttagaattgggttttctcggacatttgcgccccagacatttgcgcttatgtcctaaatcggagtaaaacttaagtttttttcaatccctgataaaaagaacagctttaaagaagcgattagaagtgattaatg

SEQ ID NO: 8476 - DNA, 1656 bp, Heterodera glycines
tattatttccaattcgggcgcgcttctccttttgttggcacttgcccattgcttagcgaatgaagggtctttttgacgaggatacttttgttgaggatgactctgaagacgttttggctccacagtccgacattgtttgttgttaccattttcggcgctttacaaaatagcgcctttgaattttatcaaaaaattaaagggggacccttttgttttgcgagatttttttgtgataaaaatcgtaaaaattaagttctctggggttttgggttcgcggtcacacatttgacacaccattttggcaattttcgattcccgaactcgacaaaagttcaaaaattatttgctttttgataaaattcatagaggcgctatttcgtaatagcgccccattttctcttcaacaaactctaataacttaactttgtttgtttagctgtccagcaaaaaatacgttccgccgacttatcagacgccaatcatcgaccaaaatgctttctttttcttggaattatttgaggaaacgcaaagcattggcaaaaaatggctgaaatcggagtccaaaaaggaaggcgctgaggaggcaatttccaaatacaacggttaatttttgcatcgttttgtttgtttcgttgttcgcgcaaatgtttatcactatcgaaattttgaccaacgattttcaaaaattggattggggtcgaaaattcagaattttctttacctcaaatttaaattactatcttaaaaaggcttatttttttacgttttgttaaggcgaatggcaaattgggtcgcccactgatgaaattttggccaatgattatggactcattgtacggactaaggctcgacaccacgccatttctgcgcgacttcgaaagcctttcaaattcgatgggagtgcattggtcgtccagtgagtggaagacttttgttttgttatcgcatgaacaatttgtttgacagatacgaagtgaaatatgagcagggtcaagaatgtggcggtggttatttgaaactgttgcgggacgacgcctcaaaggatttgaagcagttcaacgacaaaacaccctatgtgatcatgttcggtaggtcaaaataattttgttgcagcaaagcttaataaaaaaatcatgtttcaggaccagacaagtgcggtatgacaagcaaagtgagttggggaggggtaggggttgagtaaatccattacgtaaaagggaggaatatggttgtttatgcgattctcactcccgtgaaacatctcaaatttcacaacccgagaatatttttttgctcgctcttcacttaaatttccataggaaccttattcttaagaaatttaaaaaacagagaattagtggtcgatacgcaatgttgtacaaattatttcgttaaatcgaacaccactttcaggttcacctgattctgaagcacaaaaacccgaagaacggaacaatcagtgtatgctttttccatcgattgccttttcacaatttctgtttgaatgaatgtttttttttttgcctttttctcaggaacaccatgctatacagcctaacaaatcgctcaggaattactttgaggacaaaaataatcatctttaccctcttgagacccgacccgacaacgcattaaagcctgtctggagaccacacg

SEQ ID NO: 8477 - DNA, 3871 bp, Heterodera glycines
tgtggcaagaaaaatgtgccttttgttcaactgtttcccgccagcttcttttttccttaccacggttgcccgtttgacaaagtgcgactccatgttgaaggcgatgttttccgggcgaatggaggtaccgtggaatcatttttcgtcctaacgatgcaaattgtttttcgaaattgcctattttaaacatcgtccttgttcaattcaaccccaatttgatgtgatcgtccgtttttcaggttcgtcgtgacacggacggctatgtgctgatcgaccgatgtggcaaacattttgggctcattttgaactttttgcgcgaggggacgctgccgttgcccgactgtcggacggaagtgctcgaaattctcattgaggccaaatactatctgctgcaggtgttgtcgtacgaaagctaaaaaatgctcaagattaaaaaataaatttaaacaaaatattaaaaaaaataaaattttttgatgaaaaatctttactggtcggacagagtcagattgaatcttggaaaacgctacaatttaatggactttgatcctttttggtcataaaatactcgacatttctttcatagtttatttttaattagaatgaagcatttagttgcaaaattagcaccaaaaaataaattaaaacttttttgcatttaaacaacaggaattggtggacctttgctattcgtcccttaaagcccttcatcatgaccaactcgtgtccacgcttggcatttgccgtgtccctgtagttgtgtccaaaaagcaagttgaacaaattgtgcagagttgtgctggaaaggtgatgaattgaatgaaaaagccacatttatttatgcaatgcaacttttagccggtcatcgagctgttgatgaaccgtcaaaacaacaaatactcctacaatgcgtcgtccgacgagaacttcttgcgcaaccaggaactgttcgacaaactgatccttcgcttcaacaaccgcgtgctcttcatcaaaagtcactccattcacaatgccaagaagaacttatgttatcaaatccaaaaacttatttgcagatattggcattggcagttcggagatttgccaatggaccttctatgggaagacaaatcgtaaaatcgaagttggtgtcaaagacggggcacccttttgggaagcttcttttttgtgtgggtgggtgttccgggtttccgacttttgttcgtacttacgaatttgaactatttttttcttccttatattttttgttcagatttgttgcacttcgattgtgtacgccacggataaaaagcaaacaaaagtatgatactgtcttattgaggcactgagttaacgataaaaaaatattcaaaatctttattttttatttgatattccatcgctttgtgttcaggtggagtttccggaagcgcgtatttatgaggaagcactgaacgtactgctgacctttgatcagggcgaactgtctggtggtgccggagtttgcacgcgttgccggggtcaaaatgacgacaactttttggtcgaatttcccgccgagctcggccaaactggcgcaaaaacgctgtcctcggcccaacaacaggaaaacacagcacttggcggtggtgcagttggttcggtgatgtgcaacggacgaattgactggcgattggtgcccgccctcccccgcccatcttttatttatattttgttgaatttaaggaacaattggcactcaacagcaccctttttgcgacatcatccaccaccaccaacagtggcacttccgccgatgaaggggcatattctggccaccaaatgaggagaaaaggagcggcggcttccatggcaataggcgagacgacttcgacggcggcgagcagtgcaactgtgacgactactggaggcggtggtggtccttcctcaactgtgccgatgagccacaggggaacggcgggacaacggaaaatgagcgaatgcgacgattgacggaagaaaacccaaagacattccaattgcaattttttccaattattgtgtagctcccctttccctaagcttggcagtaactttattgtacagaaactccaaaaaagagaaaacaaaattttacttggactaattaaagaaaaaagggggtggggacaacacaatgacatgacggagtgacgatgaaagagttgcaacaacaacaatcagatgaatcgatcgtaaaagaatttattgcttcaaaaatgctcatcattcattccctgttcccttctccacatcagtcctgacgacgagggcgactacgacggaccggctgctgcggcgaggccttaggcatggacgaggacgggccctcctcatggtcatcatcaacttcgacagcatccgcctcctgctgctgcacatcgtccgtggcaggctgagacgccttacgaacacggcgggagggactgcgcgaccgggacggcgactcactcttcttcgacgaggacgactgggaagccgaagcgtgcacatcatttttggcctcatctgtgattatatttgaggtttgatcaaactcaaaataccagacaattttgaattaattactttacgaaataactctaatttatacctaatgaaaataaatgcattcaaatgaactattgtaccatagaggataaaaactgtcagagtccgatactttcgaatagcacagtaactcattctttacctggacgaaggtcggttggcctctcttcctccccctcttcttcctcgccttggtcaaggccctcaaactgaaaacaaagggaaattgatgaaatttctcatttcattccgatgtcaaaaaccttaatttttacaaaaaaaacgtcatcaccttctcgtcatcttcggttggttcgtcagttttcttacgatgcattggacgcgcttttcgattgaagcagaagatgcaaatcagaatgattgggaccagcacagcgaaaatgacaacaacccaaagcctggaggaaaggattaaatttggtcgatattttaactcgcaattcgaaagccaaactttaaaaaatcccacacccacagaaaataagccctaattccatcccattatcttacaattaattaaacccccgcttctgaccatggcttttcctccaaagtgtccattgccgaacgaagggcactcttcgcgtcgcccgtgctgctcaggaacagcttctcctgctcatgtttcaggtcgaaagtctgtgtggccaactcgcggacactgtccacgtcgttggccaacgcaatgttatcgaacacaatttgttcgctaaaagcacgagaaaagtcgaatttacatgatcccaaatgcccaccaacctcatggtccaaagctcaatgccgacagctccgattggctcgagttgtcggtaggggtccgcctcaaaataggccggattgtcaatgagacgagccgaccaaacgcccttgtagttcgggtttttgatcatcggatgagtccatttgccctatcatttgaaacaatcaatgaaaattaaccatcaggtgcaaaatgtgcttggccaaccttgtaaagtgggttcggtttcattggtcttttccagggcccacaacccgaacggtccttgcactccgggttaggcaccttcctggcctcccattcgccgtccatctgtaaaacaaagctaaaactcaattctcatttgaagtccacctcgtcgtcccaatctgccggtttttgagccgacggatccgcgacgagcgcctccgcctcttccaaccaatcgtccggctttaccgcgtcggtgtcctcaacttctttgggttgattttcatcccagtcctcgggtttctttgcttccggatccgcaatctgttctcgattatcccaatcggccgg

SEQ ID NO: 8478 - DNA, 1914 bp, Heterodera glycines
  misc_feature (155)..(155): n is a, c, g, or t
aatttgaaccttttttaaaaaaatttttcgatttataaactgctgatgatgagaaagccgccggcgtttttgatcagcgggaatgcgcagcaaataaatgtcaaaatgaattatacattaaacacagtcatgaactatattattattttttgtanatccatctttttttgatttgacggattttggaggttttaaatgaaaaagtaaattcaaaatgtgtcgagttttgtgtttttgagtccaattaattgatggttttgagtccaattaattatgtaattacctactcaattaatttcctttttcctttcatttttttaccaaaattcaaatattttatctccccgttttatcttatgacgccattttagtctccttttatctgttttcctccatttttatcacattttctcatcgtttgtctgctgccgcttggatcgttcccatttattttcgtcaaatttatttttattatttttattagtttttaaaaattttattttttcgccaaaatgctctcagaacaaaaataaacaaatcatcccattgcaaaacagcattcaaagcttttgctgattactaatttaaatttaatctttttctaaaaaaaatatttgcgcctatcaaaaattttcaattattttttagtatttttaattcgcaaaatgttttactgaatattaaaaaaatatttgtaataattttatttacgtaatttatgcatgttgtatcagcagagctgggagggatcacatccggcacttttttatgaaaatttgccaaattccggcatttttacatttcaaaaatatgccttaaagagaaaaatgactatttgaccctcaaattgaacttttgaataaaattgacacaaaaagatctaacttttggtaattctcaacaagaatttttcgaatttttgcaggtgtccgcctgacccaccattcttcagaaattcacaaataaatataaaattttggtgtttttcaaatttttatttttagaaaaataaattgaaaatccgcattccgacagtttttttgtcgcttctctgcggttactgccactgctatttgtattcctatttattcaattctttcgtttaaattctttttatatctttgtaattatttaataattataaataaaattttaaaatatttgaaaatgaaaacataatttttgcgcactaattagccttatttatggaaatgaattttcgggttaatagcaaccaattaaaacccatttacataattaactaattaggtaattagtaattggtgccaagttaattaaataggtaattagataattataaccacaatttttggctatcatggggcaggcagtgaattttcacattttcttatcaaaaagctaacaaaagctcaatagtgcagctgttttcacattatttattatttttcccttttttctcttccgatcatttgatcagtgccccaacgctatttctctgttcctctctctcactctgcattttgcactctatttctccccctcattttctctgacgatctctcatttttccttattcctccccactctattttatcgaaatttcattgataagaacgccattcaacaaatgctttttggttgaggtcagccctcagaaaaaccgctcaaaactggactcattactgaacaattcacaaaatttggctgattacggggcaatgcgtgctctgtgcgaaggcctccgaaagtccgtcaaagttcacccctccggcaaaaatgaaacgtaaattttttaattaatttttgacattttttgagtgcattttccggtgctttaatttgcttcatcgttcagtcaatagatcacatgccgacatgagtttataattaacatattggcttttagttgatctaagactttcgaccgatcta

SEQ ID NO: 8479 - DNA, 1785 bp, Heterodera glycines
  misc_feature (41)..(41): n is a, c, g, or t
  misc_feature (48)..(48): n is a, c, g, or t
  misc_feature (52)..(52): n is a, c, g, or t
  misc_feature (58)..(58): n is a, c, g, or t
  misc_feature (102)..(102): n is a, c, g, or t
aaaaatatgtatttcatatattagacaaagaatgagctctntaatgtnttcnaagttnctcataatattgttaatggaaaagattaattataatgcacagtntaaaattaattatgtaattaatcgactctaattagctctataatttttattaggacatatagagaattaacaatttttaattggttatttttagaaaacaatttattataaaatgattttttccataaaaatttgaaaaaatatttcttcagctttgtgcccattttgaattggctgccggcataccaatggcgtcaatgtttgctggccgatgccatcggcggtttgaccgttggcattatgcacgtgccgcagggtaattaattaattaaaaataataatttaaattaattaaaataaatttaaaggcattgcctatgcattgctcgcccgtcttcaccccgtggtcggtctttacacctcctttttccccccgttgttctacatgcttttcggcacttctcggcacaattcgattggtaaaattatttgtacattataatttaatttttaaaattaatttcgaattttctattttttaatttaatttttcgtattaattttcggctcttttgccgtcgtttctctgatggccggcatggcggtggaacagttctcttccaatgacactttcttcagtggcggtgacgaggacaaagtgaaaaataaatattttgaaattattttaattaataataattgtattatttaatgaattatttcacaataaaaaaatatttcaaaagatttaattttatttattaaagaaatttcagataaaattgaagtttaacatttttttatttcctgttttccctggccgattttttctaaggaatttattatattttcatataaaatttaaataaaatttctttttccattttttcaattttaattaaaattttaatttttttttaattttccgttcgatttgcgcctctccgacgcgtcgtcgcccgtccgcgtcgcctccaccctcgcgttcaccgtgggccttctccaattgctgatgggccttctccgactggaactgatcaccacttacttttctgatcaggtgcggccgatcacttctcttttttttgtcaaagttttaaattaatataattgtttattatttcattaataaaaaacaatttaagcaaaaataacatattatctttgaccaggagattttcaacacattgttttcaatcattttatcccccgcccctctccgaaatgcaaaattggattttttagtaaaaatcgacagttgaaaatttgtatcagtttgaactttttttcttaaactttaccaataattcttattaattttcggccattttttaaaacgctttacaattaattttgttattttaaatattttaaccttttctttttttttaattattttttggcataattactggctaattaattgcaactacatcttccaattacatttaattggtcccattttctctctaattggtcccatgttctcgctaattgtcaggtggtcgccggcttcaccaccggtgcctcaatgcacgtgttcgtggcccagctcagcgatttgtttggcctccgatccgtcggtttgccgcatcgcaacggagccgggtaccttttcatggggaaaagtttaaaaaaaacaaatttaaatataaaaacattttttatttatttaaatttttaaaaatttttttcagaagctttacgacaccgccagcaacattcacagggcaaatgccatca

SEQ ID NO: 8480 - DNA, 4094 bp, Heterodera glycines
  misc_feature (2743)..(2743): n is a, c, g, or t
cagtcagtgttcggtacacatcaaagccgatcatttgattgatcagaatgaaccaatcaaatctgatttgacacattctcggcattgaccagactgattaaatatgaattatttgacggtctcatcgctcagggaaactgatcacccatgctaatctaattagcctaaatttcaattgaattactgctcccgtctgatctgaatgacccgaactgacctgatcgactttgatcaaacatgcttagagctagtcattggcgatcagtttcttctgctgatccaaagtccctggtcgggtgtctgatcaatgcttattgatcaattcattgaatccatctgatccatgccctggcataatttgttttgcttttcatccaatcgtgctcatttatttgaccatgacctggtctgatcaggggctgacctgatcggacttggccaaaagcgatttccatctcagtctgcccaccccaattttgcccaatttgtcgctggtcccttcgctgctgcccgacgcacttggcatttccgcggttgttatcgctgtgcacatttcgttggccaaaatgttcgccaaaaagatggcctaccgagtggacgcgggacaggtgaaagagaatttagagaagaaaaactcaaaaaacaccccaaaaaatgtctccgagtgatcggatcaaattttgatcaaaattcatcgaccacaaaacatttgatcgattgtcaggaaatcaatagcgagtaaattttcgattgcctggccataaaatcgaaaatcaagttatttttggcaaatttatcgcaaaacctcttgtaaattttgaaatttgtgccaattaaaatttattggcggtgcctttaggaactgtacgcgttgggcttctgcgcatcgctttcctccttcttcccggtgtacccggtgtcctgctcactgggccgaacgctggtcaatgtggaggccggcaccaaaacgcaggcaaaaaattgggggaaataaaattaatataaattaattaaatggaggaaaagagtttaaaaaagtaattaaaacaatttttaattatttaaatatgttgtgccgtgtgttcagttctcaacattgttctcttctctgctgttgggtgcaattattctgtacattggccaatggcttcggacattgccaatggtttggccaacatttttcaatttaatttaaatttaaatattttattaatttaagtcattatacattattcattatttttaaatctttacttatttaaacatttcgatcatctaaactattcgattaataaaaattaatttaattttaaatattaattttgattaaattttaattattaatttttttattaattcattttctttttttccgccagtgcgttctgtccgccgttattatcgtcgcgctgaagggaatgttcaaaaaaatcaccgacctcaaaacgctgtggccattgtccaaaattgattttgtatgacgccactttaattaactaattaattgatttcaaattttaaatgccctcaggccatttggttggtcagcttttgtgccaccgtttgttgggatgtcaccgaaggcctcgcagtttccatcatttttgcgctgatgacaaccggtaataaatattccaatgtttgtgcccccccattttggcatttttgtaaatttatattttcattttttatttttttatttcgttagttttccgtacccaatggccccgctggcatttcttggccaatttgtcgggcaccaacgattttcgcgactcagaacgctaccagacagtctgcacatatccggtgtgagaaataaaacattttcaaaaatagtgattttttatttccattttaattaataataaaataattttaattcatttttagggcatttgcatttttcgcttcgattcgccgcttctcttcacaaatgtggacaattttaaagtgcattttgaataccaataaaataattaaaagaatattaaaaacatatttcttaattattttgcttatttattttaatttcaaagataaagctgattaatttaattttatttctcaatttttttcctataattaaaaattcatatattttccttccccaaggaatccattcacaaggcattccatcgttggaacaatgggcgccgtcggcacggtaaaacggatacattttcaaatcaaaaatgccataaattttaatgatacaaaaattgcataaatttaattaacttcattccatttcaaaatttaatattataattaaaatattaaacaatgattacatttttattaggaaatttcaaatgtcaattatttaattatccctaataagaattattattatttcattcttttttaattaatttgattataaactcatctcaattattgaattaaatcatttttatttattttttgtttttattaaatttaaatgccattaagagccaaaaatgaacgcggtcgaaaacggcactttgtcgctgggcatacaaattgggcattacgcggaacagcaacaaaagcttgcccagcaccagcagcattcattgccctctccgccaccgccgacaattgttgtgcacggcacgggcgacgacgccgaagggcaaaaatgggaggacgacgacgacggcacaattccgaccaaaatgggggttggcgatggtcccaaaatgccaattggtacaacgacgaagacagcattggcaccgcaagacaacaaaaatgngcacgacgaaaaggaagcggaagatgcagcagaaccttgaggatgaggaaggcaccaaaaggctcgacgatgccgagggcaataatgacaacgacaattaattggatgcacacaatggcattggcattgccggtgggcaaattaaattaaatggaccaaagcgaatgattaattagcaaattgatgaatcagactaattagtcagttggactaaatcagactaaaatattttattttaaaaatgttttaagttttcggagaaggcgtcgtccattttcttccgccatttcatcatcgactgttccggcttcaccttcgtcgactgtatgggcgtaaatgcactcaaagaggtgcatattttgttctattacaattacactaatggaccctaattaagctaattagggtaattattaaaaaagtgattaatagccgaaaaaacaacaacagattttcaccgaaatgcgagagcaaagagttcttgtgtattttgcagcagcgaaaggtgggcggcatttacttattaaaataaattgtcgaaacaaaatgccaaagtaattcagccccggtgcgcgacctgttcgaaaagtgcggctttttccgctacgtgcaaaagcacaacttttacccgacaattcgcgacgcggtggcaatcgcgcggaagcggcgaaatgcgtaagcggaaaaataaataaataattaaaatgtgaaataatggtaaaggagggagagggaagcttaaaaataatgaaacattccactaataaataattgttattttaaaagatgaaaaaaattcgttaatttaattattattttaaaataaattaatccatccaatttttattgaattttaataaaattaaatttcttattctgacaatagttttttttataaaattatgatcagggcaaagtatgcaaatgcatatttttttcctggcttctccatgctctaaatagtaggaaaaacattttcttttttgtgtttgcgtataaaaatcgggacttttatttacatatttcgagattttggtgcatattttgccattttttgtgcatatttttcgatttttttccatatttggccattttagtcaaatattttccgatttaaatatctcttaagaaaattttgacaaacaatagatgagatttaataccgaaaaccttgagaaatttttgatttgcgattgcaaaaacaaccgataaaatttatgaggaatacaatttttttttaattgaattttaataaaattaaattttttaatctgacaataatttttttaaaataaattatgcttataaatttgtttattgaacattttctaatttaaataaaaaaatttca

SEQ ID NO: 8481 - DNA, 2025 bp, Heterodera glycines
cagttggtagtgctacttttaaagaatatattaatatattttttaaaatttttttctttaactccaattttcatctctaatttttcactcagacctccattcttaccagtgcttgtttttcccggttcccggttgccctaccgggaccgggacctcggaggaccgggaattcctggcccggtcccggtcccggcgcactctactaaaaatcctgaaatatgcaataaaatatgtgccaaaaaatgctgaaatgtatgctaaaaaaaaattgccaaaatatgtgttaaaattggaaaatccattgtctttattcataaaaatcccagaaagatctcacattctttatcattttcgcaccacaattgaaaatcaattcatttaaatcccttttttctgataaaaatatttgccaaaatatgccaaaaatgttcggaaatattttaggcttctttcgcgtgtaaaatctgttggttaacccacatttgcgcctatgtccaaaatcggcttcaaatttacatttttttaatcctagatggactgaatggtcctttcgtcgtgtccgcctttctaaaaaaccaaaatttgcaccaaaaattaaacggattcgacttccggaattttatttggactctaaaatgcatcccatctgcttactccctaagatatactaaaattcaaaaatttttacatcataggaagttaaaggtaaaactcgtccggtgggactcgaacccacggaaaaatttcaacgcagaaatgcgttttttgagctcctttcttcaaaacaatcgagcaaaaaaaaagttaaatcactaaaagttgcatccctagtgatcagaaaataaaaaacaaaaaggatactttggttttgaaaaatgtaaatttatagtttgtaactctcaccaacaatggatcattttccaaacaaccggaagatttcccttttaatgttccaaacaatgtttacttaggaaaatgtcaattagcaataaaaattgaatactctccgaaaagttttggaatcgggttttccaaaaaaaatatattcaaaaatttcattaattttcaccaattttacgaatttgaggagggagagaattacattaattatcaataagtttcaaaaaagttatgatcaaaaatgtatgtctgaaaaatggttccttgggtacttttggccatactttgcttaaacttgacggacgaaatcttttcaaatttttgaggctaatagagaacccttagggttatcgaatgatatcaagaattaaaatttagttgctcttaaacaaagttatggctaattttttgttataattttcatttgatggtttttatataaacgactcagcacagcaaaaaatcataattttaaatttttttaatgtatagtaatgaccttgggggtttttgggtccctgatcactaatctttcgattatttgaccaattcgattttctaatctaaatttgaacaaaaaatcaaatcgaaaaattccatttttcaatttttgtagaaattggtcaaaatatgtcagattcgtgatcagcgacagcgccgattttttgaatatacgaagtttgcttccgtttctaccagctttgcttaacagagggaggataagtggggatattgtccatgtaatttccaactttaatcgtgtccagcaggactcaaacgaactttttgcttacagttggtacatgtaaaaagttggccatttgtgccccaaggcagacatgacaaatatttggagaaatctaggacgaaatcataaaacagtcaatgcctcaatcttggcacagttttacagcagcggatgggtggacgtgttggccacggatattcgcttggtcttctccatgggcatgctccactcgggcgaacatcccagctgcgcatgttcagctgcacagcgaacagtgagtttatttggcacgggggcatccgtttttggcccatataaaagtgccattttccactccttccctccccatggtttcagttggtcacatcgaagtcgaa

SEQ ID NO: 8482 - DNA, 3941 bp, Heterodera glycines
cttgggtacttttggccatactttgcttaaacttgactcttgaaatcttttcaaatttttgaggctaatagagaacccttagggttatcgaatgatatcaagaattaaaatttagttgctcttaaacaaagttatggctaattttttgttataattttcatttgatgtttttatataaacgactcagcacagcaaaaaatcataaatttaaatttttttaatgtatagtaatgaaaatttgttccttgggggtttttgggtccctgatcactaatctttcgattatttgaccaattcgattttctaatctaaatttgaacaaaaaatcaaatcgaaaaattccatttttcaatttttgtagaaattggtcaaaatatgtcagattcgtgatcagcgacagcgccgattttttgaatatacgaagtttgcttccgtttctaccagctttgcttaacagagggaggataagtggggatattgtccatgtaatttccaactttaatcgtgtccagcaggactcaaacgaactttttgcttacagttggtacatgtaaaaagttggccatttgtgccccaaggcagacatgacaaatatttggagaaatctaggacgaaatcataaaacagtcaatgcctcaatcttggcacagttttacagcagcggatgggtggacgtgttggccacggatattcgcttggtcttctccatgggcatgctccactcgggcgaacatccccagctgcgcatgttcagctgcacagcgaacagtgagtttatttggcaacggtggcatccgtttttggcccaataaaaaagtgccatttttccactccttccctcccattgttttcagttggtcacatcgaagtcgaaattggcggcggagtggtaagcacagacagaagggctggggacatttttgattagtgatcggaattcgcgaattttactttttatctttttggctcggggttcgcgatcaagcagtgcttgcaatttccgttttaaattttcgttttatatagccttgctattaatatattttggtggcactatttctcctctcatacggcagattccatggcttgtcaatttgtttcgcgctgagctcggcgaaacgctgcgccaaacactgcacaatcaggcaattatgaacacattttgttattaattacctgcgaatcggattggcgattaaatgcaaactaattagtttctgatttaaatggagcttaatctgattagagacatgagactgaatgcgtgcgatttgtccagagaccagtgatcataggtcccttttgatcattgtttcagctttgtcccatcctccaaaataacatcgtcagccaactgaacgccatgttggcctctttcccgacactgcttcaaattggggacggactgttcttgaaatatgcgttcaccagtgatgcgcaagtgaacaggtgaaaagagcggaagagagagaattattggataattgaaaatgatcagtgaaattttgctgaatttttgagtttgatcgaagagaatggagtctgataagtcataaaacggccttgttacccctcaaaatttccatgtgtttttttggaactgatctaaccgaatctcgagattcaaatctcattgatcagaatcaccactttttctgggctaatctataagcgtaattttgagtctgaaattcttgcccaacagatcaatagaaattttgtgaacgatcattcgataaggtataataatgcccacaaaattaatttatatttggtgaatggcttgcttaaaactgattattaataaatagtgaccagaagaacactgcttttcaacggaatgctcaaaaattttaatcggttttttataaagtcgcttggtaatttggtcgactccaaaattggattcagattttaccagaatcctcgttcattatacataaaaaatttttatgaatctctgattctgatcggacaccaaaagcattttcactctaaccctgctcaaatgttgatcaccggcgatcggtttaccaatcaataagttcatttccttttccccctcgccccattttagttcatttctccaaacattcgcgcttgtagaggtgtacttgcaacacaacaatgacaacagttcggtgcccatgcggtccccgtgtcccttctccgcccccgtccctctaccgatgccgttgcccgccaatgtgccaatggcatcgctgtggttggaccgcacagtgattgactgtttgctccgatcgcttcaggacgcaaaatacgtccaatttgtcattgggccgacctttgacggcggacacttcgccaaattcttgagcacaaggtaagtaagtaaaagcagcagcagagagcagaggaaagagagagaagcgatcagtgcaattaatgtggcaaaaccgaattgtggcacttaggaaaagcattggattagcgttaggggcttttgggattaaatgacattttaccgactgatgaggttcaaaaaagaggctgtaattctcactcaggaaaagttgcaaatccaatgtccttcttttcaacaagttcagtttaatagttataaattttgatcggcttttcagttgctttataattagaaataatcactaattagtgattttctgttccatttggtaaaatttaagcgattgattttggctttggttcgtcaattccgatagactcattacaagtgatttccaaggatatttgcccttgttactaattggtcaactaattagtgaatggccgggctttatcctcctttattccccgctgtgttagctgtgccttcttccaactgtgcattggccgcttcttccccccgttggaacggcttcatcccaaccagcacgtcgacctgcgcttccatcccaccaatttatcctccgttttgttcctcccctccgaatcggcgctgaacatcacttcgcgtctgttcatggacatgcacatttcaccatggataaaacacgcgggccaagtgcttgcccggctggagatgaacatcactggcacggcattgccacggctggaggacgggcgggtgaagggcgagatggacagagaaatcaaagtgggcaacaatttcatttctgttggtcaaattttggcatttttcgatcaattttgcactcagactgactcaatcctgcacattttaaaaaacaaaaattgatttaaaatagattaagtctcatttttatgtctcggtcttctcgggaaataacaatctcgagcatgatcactacagcaaaactggtcctactgtttgatatactgtccgagttccgaaaaatttctgccttttttcacaggtccactttgctgagttgaacagctccattggcaatttttcgcagaagtttctggacacattcgaccttctgttcaaggtcagaggctctgtttcgccacggacatttgaccccccccccccccgcccggacattccgtctcagtttacggacattccgtcttggtttagcccattctgcaaattgcactcaaatcggcactccgcgtcggtttcccattgccaacggtggagggcataaaaatgggcaacggcagtgctttgacggtgctggagcgggggctgcgagtggatgccgaactgatctatgcggagcggaatggcacggcacaaatgctgcagaagaaagagaaagcgcgggattcggcatttgtcgcgagtgatcacactgatcagtattgactcaacaaaacctttgcaattttaaattgatggctcaatcgaatcaaaaatcagaaataaagtgtgtccaataattataaaggcacccaaaattttttcgggtccgaggagggccatgatcatcatcattgtctggcttttttccatgcttgtttgcttcaaactttggacaacacagcgattccttacctctccatctctg

SEQ ID NO: 8483 - DNA, 2406 bp, Heterodera glycines
ctcaaaattacgacttttttggaatttcatgttataacttttttggtaattgtctaatcgcgaagcaatagcttagaaatatcttctaaacatgttaagctttcgattgataccaagcttgctgaatttggttaacaacaaaaaaagttataacccaaaaacttgggctggcgccaaaacgtcggcgccaaaacgatacggacccataatgcgcaccggtgccacggttatagtaattccttggccgtatacctatttcatgccagaaaccacagatttgctgaaaatattagttttacatgtagagagcttcaagaatgaaaaatcctagatctgggttccatgttggacctttacttaaattttctggacaaaaataaaaggaaattccatgtcaatggaaaaatcaaaaccttgatccatgctaagctctagttcatatagatagagctcgacattttgaaaaaagcctgtacttgtacctatacctgtatttcccgaatggcctgtacctgtattttctgtacaaaagtacaggaaaatacaggttgaaaaacttgcctgtacctggatccaggaaaaacacaggcctggatcctggtacaggtcgagctctacatataggtagtttttaattttgctgtcatcatttcaagataaaaaaacggactaaaaaaacattttcttaattcgccctcgaatgtctctttcttcgatccaccatatgtcacgtctgaaactttggatgaccccagtgcgcgacaatcactttgggttggatgacctcaaaattttcaacagcgatggttactctgaaaatgccccattttctcgtgagagcagccgaaactcttccgcggatggcagcatcgcatgcaacgcggatgctgctgatgcggtcattaacatgaaaattggcgtctggaaaccattggtccaattttttgaattttaatatgcggaatcttaggcataattttgaacgtccgggaatttatttttctgattaacaattttgtatttagcctcagaaaacttgtggcttctgctacatacaatacaagcgtcactgtcagcgactcggagttgcatttccgcgtgtcaccgataagggcttctgggtcggacacaccaccaaagacgagcacggggatgtcatgtaggagagaccgtattggaatttgattctatggtttaatacagtaacgctttatcattcaacattttgtttttcaaattttctttatttttcgtttgttttgcagctgtccggagttgcgcaagctgaagtgtccgttgtgttacgcttctggaaagaaggcgcacacattgaaattctgtccattgaacagcatcaaagggaggcgtgacgaagcataaagtttcgtagaacaactaccaaaataacttgtttgtcggattgtttttgtattgaattttgttatcaccttgcttattgttagtttgtccaccattgctattctgttggtttgtcatttttcgtttttgaatattccttcctattgccttcctttgcctcttttctctctcagctctctctcacttctctttctttgtagttttatatcatacgaacccattcatattgaaaaagtaaagtgccaccgaatcaatcttttcgtttgatgagtttttggagtatcatttctcaagcattactaaatattcaaataaaaatattatgcgaaatcagaatttagcatctgccgatgacttccgtttgtgaacagcttgaaattgtgtccgagatggtcaagacgtgttctgaggatgtgagggatgtgtggccaacatcctccgaaaattacacgaagagtaagccgtttttttcaattacctttatagcatacggttgttgttcacctgttgcatgtccagctgaatccatcagccgcggagcgtttggaattgtgcgctttgccgaagcttctgacccgactttcagcgttgacggacttgagaataggagttgcatcatcaaaacaatttaccttcgtcgccgcttggaggccattttagcagaggcatcggcaacgaatgtgagtgttgggcattatccaaaattgcttattcactgattgggttgttctaaggaatttgattttgttgatgaacaacaaccagcaaaagtttcccgtttctatcgtcgcttggtcatggagttgttcatcctttgccggtattattcgttttccttttttcattttgtttaacttttgaaattgagttgccgacatgcgaacattatgcatttgcatgcccttttcatctcaaattgggacctccatttggttttgcctcgtttgtatgtgcttgagaatctgataacgctgtacaaacggcgacgccaatccgaagtattctccccgtaaaaaattgcaaaaa

SEQ ID NO: 8484 - DNA, 4074 bp, Heterodera glycines
  misc_feature (72)..(73): n is a, c, g, or t
  misc_feature (87)..(87): n is a, c, g, or t
  misc_feature (91)..(92): n is a, c, g, or t
  misc_feature (95)..(95): n is a, c, g, or t
  misc_feature (103)..(104): n is a, c, g, or t
  misc_feature (106)..(107): n is a, c, g, or t
  misc_feature (113)..(115): n is a, c, g, or t
  misc_feature (121)..(121): n is a, c, g, or t
  misc_feature (123)..(124): n is a, c, g, or t
  misc_feature (126)..(126): n is a, c, g, or t
  misc_feature (130)..(132): n is a, c, g, or t
  misc_feature (137)..(140): n is a, c, g, or t
  misc_feature (144)..(147): n is a, c, g, or t
  misc_feature (149)..(151): n is a, c, g, or t
  misc_feature (156)..(156): n is a, c, g, or t
  misc_feature (158)..(158): n is a, c, g, or t
  misc_feature (163)..(164): n is a, c, g, or t
  misc_feature (168)..(169): n is a, c, g, or t
  misc_feature (188)..(188): n is a, c, g, or t
  misc_feature (192)..(194): n is a, c, g, or t
  misc_feature (203)..(206): n is a, c, g, or t
  misc_feature (209)..(209): n is a, c, g, or t
  misc_feature (211)..(211): n is a, c, g, or t
  misc_feature (216)..(217): n is a, c, g, or t
  misc_feature (224)..(224): n is a, c, g, or t
  misc_feature (228)..(230): n is a, c, g, or t
  misc_feature (233)..(236): n is a, c, g, or t
  misc_feature (240)..(240): n is a, c, g, or t
  misc_feature (244)..(244): n is a, c, g, or t
  misc_feature (255)..(255): n is a, c, g, or t
  misc_feature (263)..(263): n is a, c, g, or t
  misc_feature (266)..(266): n is a, c, g, or t
  misc_feature (272)..(272): n is a, c, g, or t
  misc_feature (274)..(274): n is a, c, g, or t
  misc_feature (310)..(310): n is a, c, g, or t
aaattgcttattcactgattgggttgttctaaggccctttattgtgcagacgaacaacaaccagcaaaaggnncccgcttctatcgncgcnnggncacggagnngnncagccnnngccggnannangcgnnngccgnnnngcannnngnnnaacgngngaaanngagnngccgacacgcgaacagaangcannngcaagcccnnnncancncaaanngggaccnccannnggnnnngccncganagaacgggcangagaagcnganaacgcngnacaaacggcgacgccaagccgaagaaaacaccccgnaaaaaattgcaaaaatgttttgtgtattttagccaatgccaatttcaataattgcgaaaattttgcgtcaactttgtttggcactcgaatatttgcagcaaattggaatttctcaccggtaatttttttgtattttttgttagtttttgaatatgtttgatttattactttccgtttctgctttttctttttaaagggctgtccaacccgacaatatcttcctcacccgtggtggcacagtaaaactcggacattttgcccaatcgcgggccatttttgaagaatctgtcgacgaagaactccactgttgcaaatcgcccgtggggagggaggaatttatgagttttgagaaggtaatcagtattcaatatgtcttatttcatggaaagcatttcgctaccgtatccttgtttacagtaacttgtaacacttacagcagcacaacctgttctttggcacaacgttggccgattgtgtcggctattccttctccgctgacctttggtccttgggcgtgttggttttggcaatggtctcctattatccggatgaacgcagtcaaaagttgcacaagaattttgcgatggcaatgcaccaggagcagatgccattcatttggttgaccgttgacatgctggtgagacgaattgacagatgacatggcaaaatcgaattactctcctattttccatttagcaactccgttctcggctggtcaaaagtggtggcgaagaattgaagctgttcctcagcgactatttgctcactgtgtccccaaaacggcgcgccaccgctgccacactgccgaagacggcggagatgaggcggtggtgcctaacgacggtggaagaagatgccaaattcttacgccggcacttcattgacgaagtggactttgccaaccatctgaaattggagaatgacgcaccaaattatgacctactcgaaacggtgtgaattcggtcccaaaaatgagcattaattttaatcatttgacttttaacaacagaaggacattccggcggaattctattgggacgaaacgtggaaaaagttggaagaaacggaattggtcatgcagatgttcatccttccgaactacacatcagaacagtggagttttaaatgctttctgtaaaaactctgtttttcagacaccgcattaaattttcggatcccgagccgctctttcgcattctttacacggaaattcttatgggacgaattgaaatcactgaccttctgacagtggattattggattaaacagaccatttttgattttgtgcaaaggaattgcgccaatccaacggtggaaaagaaaatatgcaatgacttaaatggcgttttacgtaagttttttgactagaaagcttcaacaaatatatgcagttttgctcaattttttttaaagatagtcatgtcttttagggcgtcgtataatgctgcataagtcgcgttcaatcgaagtcgaaattcgtacgtcttccccagtgcgacatcgactgcacttctcctcaatatcgccctaattgataagtgacgccttggatcaactgattcaataataatatcactatttgactgactaataatttttgatagtaatttgggtcgtttttaacctttttgtatttttaaataaaataaccaaacagagccaatcataaagccccatgagggaattccgtaaagttaagctttatgcctttttccaaacattctgctaattgtaagttaaacattttcggtagattttcggatttatcacaaaggggtccttttcgggaaaatttattcgtgtagtttacaaggctaaaaacgactggcatcccttacatatattatatttcttaataatttgttttcattttacaattattgttatcaatttatttgaattgacgaaaaaaataatgatttgattgatcatttgcttttcgtgtcacatatttcatttgtatatttttatattacattttacaatatctgttgttatattcttatttttactttccaaaggtaacaaaactaattttgccgatgcaatccgattcggtccaattggtcgaatgttcttcgtcgtctcacaatcggccgccttcgcctgctgacattcgatggcccctttctgcaaaatcggctcagatgttcaaatggcattttctgttcctgtttttgactttctctgttgttttactctgctgggttttgtatgtcaatgcttgcgacgattttatgttccaatttaaaaatgattcgtcggagcattcttcaggtgaacacatcaattttgattatgcattgtttatttagggtatttatcgtttttataccaccctttcaccctcttcttttcctttaaattatgaacattttttttatctcagatgattatgccttcccgacaaaaccggtcattctgatgtggacttcggtgtttggacaaaattcgctcaaattaggcccggactgcccattctttgaccagtgctttttcacctatcaacgtcgcgcattggcccacgcggacgccgtcctctatcacgttccggacatcaaatggacttcagacgaacgcccggactttccggaacaaatgttgctgccggccaatgtgaggaacgtttttctcacccaagagaatccgagtgcgctaagagattatcaccacgcggaaaagctcagaaaggcaggtaaattacccggtttttaaaatcgtgttcattatttctcgcttcttttcaagctcccaactttttccattggacattgacttatttgcgttcctccgattttgtgatgccttacggtggcttttggatttctcccgaggaaacacttcgtctcggcttttcggtttttcattaaaaaaaattattttacaattcgaattatatttgcagcaaaaaattgttttactaaagtaaataaaattcatttgatgtcaaaactacacttttgcatttcggtttttcgcccgtccgtctgcccactgatcgcactaccattttgaaggacaaaattgtgaggggcgccgtttggtttgtgtccaattgtcgcaccgagtcaaaccgtgaattggcggtggacgcactttccaagtgacttaatcatactgattttttttattgtctatagtattcaaattcggaaaggatttgctatatttatacggttttctgaattgttctaggaaattcgaatttccttaatcatttttgggccgattccgcttattttgttgtacctaaatccaagccaaatttaggcatatgctcataaacattggcggcaaatgtgccaaaactgagcagggcaaaaaactttgtccacgcaatgcgacttcctgtgaccacgtgttttccgcccattactttttcatcgctgccgaaaatgacatttgcaagtgcgcaattggacaaacaaaaactaaaaacagaaaaattaaatttataaaaatttccagggattatgtgactgaaaagtattgggaccgttaccgtcttccctccgtgccgatgtatgagaaaacacatttatgaagggtttggtgagaattgcagacaaattatgccagatcagattataaaaaataaaaccgacaatgccatcccggattcaacatcgctcccaataattcggtcattggcatggaccgattcgactcacccaaagcaatggctgaccacctcaactttctgatggacaatcctgccgaatacctcaaatatttcgaatgtggagaacaaaattggtccattg

SEQ ID NO: 8485 - DNA, 1572 bp, Heterodera glycines
  misc_feature (67)..(67): n is a, c, g, or t
cgggttcggggttcaaacaaagtcaaaaaagatcaaattcgtgctcagcgcatcaaataacccctanaaatatgttttttttttggatttttattctttttttttgtgggaccaataatcttcacaattgccaatgaaaatgatgcaagcaaatgaatggggggagagaagggaggcaggcaacacaaataatgccacaaaaaaaaagcgtcttttcccccttgtctctctgccccctctcccccttttccgttgtctcttcggcagagtgggaatcaaatcatcattttgccaaaataaaatctgtaaaaatcagcattttgaaaaattaaaaaacaacaacaaatatagttacttcggagaaaacttggatttgaattgaatttctataattttttgtggggtttacctataggtctttttaacttaagaatgtcctcatctcttgacgattcatttgttttgcctcgtgataattgtgacacggtatcttttaatcgaaaaattgtggctgaattaacaaataaccctaataaacttaattttgtgactttatgtcgtatcgcattttctgacttcccgcacttcgtttttaatgatttggacgaatgattcgcactttgtttctaagattcgtctggttgacgttttacatttgaaactcaacgccaacgcaaagcgtggcctcatttaccgtgtgagatgcttcgacagtttggcactcactcataaaaatgctggtaattaatattatgtttacctaaatgtttgtttggtaatagttaagatggttcggtgggggtcgattgggccccgccgattgggccccgccggttgggccccgccgattgggccccggtacgattgggccccgccgattgggccccgccgattgggccccatggggcagtcacttttttagtcgacttttggtttactctcactaaagaaaaattattacctatgtatatttttaaataaaaaatggtttttttaagcgttaactttgttgcacattaattaaaatgtatttttttcatgttgggttcgaacctggacctccgaaaaataggaatttaacccactgatccaccgttttttaattttccccacttcaccaccttccctgaaggggaaaacacagtcaaaattttgatttttgaggtccaataacttttctatttggcttcaacacaccgctaacattaaaaattcagagtagccggccctgcactatcaaatagttatgatacatgcattttctgacacagttctgacggttcccttgttagatttggcccaagctataagcttaattttgtaaaaaaaatgtattgtacgaactgctattgtacgagttattgcctttgtaagaatggatagaatttcatacttaataaatttatgaataatttaatttttttaaaacatgtgaaacgaaaaaaaagtggctgccccatggggcccaatcggcggggcccaatcgtaccggggcccaatcggcggggcccaatcggcggggcccaaccggcggggcccaatcggcggggcccaatcgacccggtccgtaaa

SEQ ID NO: 8486 - DNA, 2860 bp, Heterodera glycines
actttttgttcgaattcgggttcggggttcgaaattgagcgaaatggatgccagaatcgtgatcagcgaccccggaaacccctagaaacttgttttgaatgactttaaattttaaaaatttccaccaaaaaataggggcaaccatcttaactattaccgtttgtttgtccctctttttacttttcactctcatttttcagaatgtttttctgaggccgccgtttgtcagtcgcactctttggctatcgtcggtcgcctcttgcaaaagaagggtttgctcacgccgatggattggtccgtcttagacgttctgaatgaacaaattgcggctgtggaaacggtggacaatgtgacggaaaattcgacggttgatacttttcccaatcacgcgaactttggcattgtctgtccatttgctctccaattcgtcataatattcctcatttagtccgattttttgcgcagatttaaagaattgactcagaatttaatgttggccaagcgatacgaagccattgggcccatttgtcggttgatcattccattgttcgaacgcaacgccgactttaaggtagtgactgttgaagaactaacaaatgtccatttggttgacctccccattttcagtcgcttatcgcaattcactcgcaaatccaacaggcgtaccaatgtgtggaccaaataacgacgaatgtcatcagaaggcagcaattagccagctatttcagggtctctttccacggccgggctcaatttgggtaaccgtttccgtacttctaggttttgtcaccccttgaaatttcatataaccaaagacgacttttgggttgattaatagaaaaaaacaattcgagaggatgacatgccaaaccctagaagtattacctttccctctggtccatcatcctttcccctccatttcatccccagcgatgaccatggctctgaatggatttaccgtgagcgtccgttgacttcgttggccgaggcatgtgatcgtttgcgcgagtcggtgcagtcttcgctggccaattgccgtgttcagctgctgaacaccgccaacttcccgccctcccctcccccgcctcgtccgtcctcttcaaagtgttcttcgtcctcctccttctcttccgtttcgtctctgcttccgcttcctgtcgatgatccgtccgtcgcttacattggcgtggcccacgtggagccatgcaaaacggtgcggacgacgcattcttcggagaaagccaattgcgggggcaaattgggcggaagagcgatgtcgcgcagtcgttgcgaattgacatcaatgaatggcagcacttttgggttggcggaggaggacggcgaaggggcggcgatggaagtggcgcccgacccgaccaactattggctgcacaccaacgtacgaacttttgtgctaaacgaacgccaagcggactcaacggtgtcggacaacgcgcccgaattggcacggatgacattgcgacggacgacgctgaccggtgtgccgcggggcggcagagcggcttttaagtcgtcggtggttcttttgcagttgaaaatcccttcccgggcacacgccgtcggcaacgcgttgtgcacatggagcaaacggtgctcagtcccttggaattggcctgcgagagcattcttcaaaaggcggaccaaatccgacacattttgtcctccgccggactccgtcggtgtcgccaccatcacaaccaccaccgactgatcaactgcgggtacgacaaaagtgtgctgaagcgggtggatgtgaagcagttgcagctgtttctgcagggggccgtcatgccgacggtcagcggacgctgcccttttcattggcattgccttccctctatttgttaaggttaacgccggtcttttggcctacgcggagacattcaccgcaccggcgcagcagaaacggtacggcaacaaaggactgctccgcctttggaatgcactgaagtaacaaataaaaggataagcgaacttttattgtccatcgcttttccctttgggactttgctggacgaattggacgaggcgatgcgcgtcaacgaagcgacgatgggcaacgagcggcgcgagtatcagcaaatgctgcgcaacgcgtacgaaaacactgtggagaaactgaacagggcattcgcacgcggcagagagtcgccggcgatggacaaacggcggagtatgagcatcgacagggcgaagcggagcagcaagcagggcatgctgatcagaccgatttttgctttgtgataagcggggcgcgacccaaaaattttaatataatgacgtgcggatttaattcgctggtgcgttggccactattaatttgtgtaagcgtttttcgtgcattattttgtttgtttttgtgattttgatatgaaaataaataaataagaaactcattcgttcgttccttcattggcaacattcaattgtttccttcttttgcatacgtttttaagctccgtttttatttgactttttgtggggttttttctttcgaaaagtgcataaagacaaacggaaattgagaaggcaaactgacccaattttatgaagaaaagcggatttgattggaggggggggggagaaatgccaatgcgatgacatcggagggtttttttcaatttgttccaaaatggtccgagtgcaattggacaactgctgctgcactcactggacagcgaaaagtgatcggttaagcggagaaagggggccgctgttcatcccatggccaaagggaagggtgaaaatgggtgaatgctttcgcctgtcatttccctcttttatttgcccaactttaaactccgacaagtaattaccgctgatttgacaagtcattatg

SEQ ID NO: 8487 - DNA, 2629 bp, Heterodera glycines
atttataatttaatagaatgctgcttgagatttctgtctcggttatcaactcgagaaaaatcatggtttttttttgatcccaagttagggaaatcagtatattttcttgaagtttcaagcaattttcttaacaaattgcattaaaattctcaaaaattttcacggttgcctaccgaaaccgcctgacaatcatttaccatatttcagaaaaatgtatataaccacaatggcaaaaaatagtaatttttttgtcaataaacggataaatttttgtaaagtacaccccttaattcgggatttcaagattacgaaaaatacaccctaaaaatcggttggaaaaagaaaaatacacccgtaaaaaccgaatttttgacttcatcccacccccccccccaaagcccaaagccaagtgtcttgctacgcccttgtcctggactgggaaaacggggaatgaaggaaaacccaattattttattttcgccattttcaattaatgaaaacagttttatttccaaaaattaaggtcacctttagtgaattgtcctccaggggcacaaaatgcttttgagaattgaagcgaaataataaaaaataaaattataatttttaaatgcataattaaaaaagtgggcaagcaattagcgataatattttaagaatttgaaaatgaacaaattatttctttgcttgaatacgacgaatgacgagcattttttttgccatttctgccaaatagcgccaattgccaacgaatgtttggttggctgtggctttaaaagtgaattggaaattgatttctgaattttattttttttatttgctttttacgatttttatgcccatattttggcgtatttattggccgataaaaatgaattaaatttccttttaattgttgagtaatatatataatttcatattgatatgaagaatttaaagtaaatttgatgcgaaaaaactcaaggaataataaaataatttaattaattatataaataggtgccaatgaattaataatagattaatatttaaatatgaacttaaaaaaataacacaaaaattcaccattttgtataagggattatgttttgtaagattcaattttatccttgtacatctgcttgttaattttaaaagaggataagtcagggagcgatttcaaagtcaacattttggccttgggacagagaaggtgaagcttccccgagaggaatattaatggatcaattgaggtgatattatcgagcaaatagggtcgatagtagagactggaaatttcaaatttgcggatcccgctgcgggatttgaatgcaaaattttttgcggcagggaccccgcgggattaaccccgtaatcccgcattttccaaaaaatgcgggattgcggactgggatcccgcaaaatctcgcgttgaattctcgtcactagttaatataaactcaaggcggcgtatgtatattccacattttacggtgccaaaattcgaaattcaaatttgcaaaattgaaaatacggcaattacgaaatgcaaaaatcggaatttcgcttcatccctggtcttgaagtcatttttgcggcgcgctttatcaaaaacttttttgaacagggggtccggctgtgccgataggcgctgccgggaaattttttacaaatcctagatgaaacttgagaaaaaaatggctttattttattgattttatttataaatattcaaaaatatttggcattctgtctttgaaatttcaaaaatgaaatgcggatcccgctgcggcattggaactccaaattttgcgggacgggatcccgcaggtataaaacctgcaaatccgcattttcctaaaaatgcgggattgcggactgggatcccgcaaaatcccgtgcgtgatccgtcccgcaccgagctcaagtattagctgtaatatatctgaagattttaaaaaagatactgtattttatgtaattataaattctttgtaattcattaatcaacgaatgacattttattcttaaattttataaataattaaaaaatgtgtatttaatcgtaaatgctgtgtaatcaacagtttgttctcgtttctccattatttattgtttgtcaatattcctaaagtgaatttataaatttaaattttatttttaaattttaccattgtgccaattgttcactggtaacaaatgttgattttagcctgacatgttggaacaatcccttcaacacttcactttcatattctttgtatatttttgcgtccaattctttgctcaatttttcgtttattttttcttcattttcttcgtttatatttttaattgcatcgtttaattgaaggccaattagccaaattttgcaaagcggggcacttaagcaacgggttaattatttaattaatttaaaatgtctccgattaatggcattttcgctgttcatcccacggaattgaccttcgggtgaagtcggtcaggttgagggttgccggacattcgttctgctgaccgttggccatttcctttgtcggctttaaatgcccaaattcgaccatttggtcggtcatttcgtcgaaattcgcaatttttaagcgaattttgcgctccacgaattggcaaaactgagtgatgtgttcatgga

SEQ ID NO: 8488 - DNA, 4045 bp, Heterodera glycines
ttcttaggggtgtatttttcgtttttttgttgcatttttgttaaggattttttcgaaaatcctgaaaataggcacattaggcacaaaaaccccgaaaaaggcaaataggcattataaaagtcatcgtaaacacctcaaatcaagcggataatatgcgcaaaaattttaggcatttgcctaaaaaaggaagccatagaaataagtgaataaaaaccttatccgtaaaattttctccagtgaatagatttgttaaactgtttttgttcggctcattacgaaacattttcaattcaaaaagtgctaaattaattttaaaaaattaattaataataataatttgccatttttttttactttttctcatcgctttttgtattattttgaaagtcgctttgtttatattgtaagtgcaattttggcttaaaaagctcggcgtgataattggcattgtcagtgtttcttgctgggaaatattccacgaaaatggctcaaaaacgccaatgggtttatccgaatcgctcaatttgacgggcattggccaattcctgcacaaaaatatagcaattaggatgacgattttgcttaattattttctggaaattccggaatacaacatctcaatatttaataactagagaccggatttatatggacaaaaaaagccaaattaaggattataatatggaagaaaattctgaaataggataaaaatcctatggatacaaaaatttgccaaaatatggacaaaaaatctaaaattgagtttaaattttcgtaaacttttaaatcataattttttgagataaaaattttcacgaaattttatctcattgagaaaaaatgattttcaaataaagtttattttcaaggattttaggcaccaaaaaagtattcaatctttttcgagtttttttttcaaaatttttcgttttaaagagtgtttttctcgaaattttttggtctttatgcggtaaatttttcgaattttcttttgccgaaatatggatttgacaaatatatgaattatagaaatccatacaattcctgtctcaattaatagcaattatatattttttaaaactacaccaaattgtgaagatgaacagcaattgttcaaacaaaaataaaacggacccatttggatacaataatatgatttttgtagccaaaattgataagctaattccattgaaaaagccataaatattcccataaatataattgcctaaatttgagtgaatgattgcttttttttaatttatttgctcacttttggcccaaaattttagcgccagcgaaagggccctaaactttgtttgatttttctcatttagcaggccaattatttctttattggccaaatagcctaaaaatgagcgaattatttggcattttttgaatttggccttccgttttaagcaatttaatattatcactggaaggtagagctcgacctggatccaggtccaggcccaggccatttttcagcaacctggatttttgcccagtaaattcaggtgaaatatgaaaaaaatacaggtccaggtccaggctaaacaagaaaaaacctgaatttcctgggcaaaattttagaatttattattccaagagaccgatgttttttcaagttttcaaaaaagggttaaataaatttaaacatattttattattataaattaatatttttagatgttcctaagcaattaattgattttttcaaacatttgtttttgatttttaaaatgagtttcaaaaattccaggtccaggcctggatccaggtctcgaggagcctggatttttcctggatttttatccatgaaatccaggtccagatccaccatggaatccatgtccaagtccagccttttttcaaaatctcgagttctactggaaagtgttcggagcatcgcccgctgcggcctctgctgattggccaacacttccatcatccattcgatgtcgtcgccgtccaatggttcgtccggcaaatattccatgccggggatcagcaccagcgaaatgtcgaatttgacgccggacattttcagttgcagcatttgaatgtaggcactcgaaattttggtgatttcatccaattttgggttctgaaaatttaaacaaattataaagatgatcaaatttggccggtgatcggacaaattcaaagggaaaatttaattggccaattttaaataggaaaaagcaaaactccgattcattttaaaaaaagtgatggaattgagtaatcccgaagcaaatttaaatatgctattattagtcaatattattagttcactttgcaaaattggcagaacaaagaatcgtcgccgcattttctctcctccaaatttccgtcatttaaatgatgacaattaaaaatgtaattgccaaagaatttgtttttctcctccaaatacgacaatttttgtggcattatgcaaattgtgtcgatgtccgagccgggcgtttgggtgtccaacaaatgcgaacccgtcacaatcagtcgagcatcgccatttgactgaatattttcgcattcgaaagtcgatttttttgattttaatgatttagaaaatcatacaaaaattaatttttaaattagaaaattaaattacccatttcgaaatggtcctttttattccctccatcaaatctttcggcgtttcttttcttccgtacccattttcctccaaaatttgatgaagctgaattaaatagaaaattttttcgtttttaaaaattcataactcccttattttttcatatatttaaatactctttttttattgtatcttttgttgtctattcttaatttcatctcggctcggtcattaaaccttttctattctctgtcaattgcttcagctttttttccatgaccatgccaaaattggaaattggcccactaattttactcgagttttttaacgttaaaaacgtaaacctggaataacaaaaacgaagtttttctgcataatttagagcagtagaatctcaatatggccttaaattttatctatctttgctacatgagcttgtatatgcttcaactccatgcatgaagttggagctgtacaggtacagtgagaacccacaggtcaaatctaaggccatattcggactcagaatggccgatttaaaattttcgggggacaaaacttatgttacaccctaagtagataggctaatatcatttaatttattaattaaccatttcgtcctttgttttgtattctctgccctgaaaataaatctgttgcaaattctcgtgcatttcacataaattttctaaattttctctctccgtttcagagcgaccggaaaaacgttcagataattttttgtctaaataatttaatttttaaactatttgttatttatatatgcttttagccttcaaaattataaaaaaataaaataaaattattcggttaattattataatgttttttttaattactcggttaattaatgtaataatttatttattaattaattattttccacctaaattttgttgtctcaataaatttctccaattttcaatgtgttcattaaatctgtccattgagtttgcttttgtctgctttgtctcaaaaaggtcgttcaaaatgtcactttttgtcatttttggccaaatgtctgtcccattctcgccctctccaatgatcgttttggccattttgttcttgtgcaattgcatttgtaccagtttaatttccttttccaccgtactccttcctccatcgcctaccgtactctcatcaccacaatttgtgtctttttctgtggcaattcgcttcaaaattccacacaatttttgttttatctccaaagtgccaattcctccgttttcatttttgtgcttttccattaatttttttaaattttccttttcccctccaatttttcgttgtgaattttccatgccattgcttttgcttatcttctcaattgtttcaattctgtgctgaatttcgttgataaatgctccaatgttcagcatttccttctttgactttgaagggtttttaaaaagtcga

SEQ ID NO: 8489 - DNA, 7067 bp, Heterodera glycines
acggtagatgtaccgtaccaatcccccctcataaaattgacccaccgtcttggcaacggaccgtacccaccccctcccatggcccacggtcttggcaacggtagatgtaccgtaccatttccctcgagacggtagacgtaccgtacccatccccccccccccctttgccctccgtcttgaccacagcagctcctgccctcgacccctttttctcattgtattacttcgtttcccaccttaatacccaactttttccttaacaaaatgggttgataaataattttaatttttttttaaatgttgcacagcaattgaagcagctccggtggcatctgaatgccgcttttaccaatgcgaaagccttggttgcttttgtagtctgcaaaattggcgtcatggcaactcgtacacagggcaactcatacaaaaaaaatttctaagaattttcaactaaaacttagaatttttagattaaaaaaatttgaatggattttttagcctagaaaaactattaaaaaaatcttaaaagttttttttactaatttttcagctgatttttttaaatttcttaaattttttgaaaatttaagtgttttaaaaaaattttctaggcgaaaaaatccatttagatttttttaacctaaaaattctaagttttagttgaaaattcttggaatttttttttttgtaatttgtacgagttgcctttttgcacgagttgccattgacccgcaaaattaagcaaattttgtttctttttgtttattttttggtccattttaatccactcactcccccaaggcaaagaaggccatggttcgcccaaatgcacaaaaatgccgagaatgagcaacggggtgacaatgggcatcatcagcatttggcatcggcggtggatgaacattttgttgagtgcgcgaaaaattgaaaattttcgggacgaaaattaataattcttattaaaaaatgaagaaattaggaaatttatacaattttgaatttatttttgcgcaattcattgattctattttaaagtgattggaagtggcgttgcgattttgcctggaaaatcccaaaaaattttgcggattttgagggcaccgtgccgctttttggggtttgacggatttaattttcactcaaatttgggctagctgatttcacttaacaaattccatttttcgcccagcggcgcctttacgccggcccaaaaaaattagcccttttttaaatttggttcttaaactgctcaatgaagggtattttttggacaaaatttgttaattaaaagaaatttcatctctcaccccccccctcccttcacgaaatttatgaaaatttttttttgaaataataaaattttatcggagaaaaatccaaaagtgaattcaatttaatttaattccatccaaattggtaaatgcttgtgtaaaatgggcagaaatcggcagcagaaggacggacgaagcgaaaaaaagccaatggaaatgattcattttcattcatttagtgatgatcgcttaaaatgggatgaaaagccaaatagaagcaggaatgattaattatggaaaagcaaaataaaaaaaggaaaaatgtaaataatttatgaatcattgggaaaatgaaaattttatgtacaaaatttgtaataaataaatattaaaaagagtaaaaatatatgaataaaaaaataaataaataaagtttatacaacagcagggctcctccgatcgaaccaagtcacgttccaagtacagaggccatacacaaattgccaagtacacaaacgggggaaatttagtagagactagagaccggaaatttcaaatttgcggatcccgctgcgggattggaactcaaaattctttgcgggacgggatcccgcgggattaatcccgcaaatcccgcaatcccgcaaatcccgcattttccaaaaaatgcgggattgcggactgggatcccgcaaaatcccgcgcgggatcccgtcccgcgccggtctctagtagagaccgagatttccgaatctgccgggccaggccgggctgactttttcagaagcaacctgttcgggtgatgaccccgagagagacttttatttattttatttatgtaatttccctctctctgtctcctgcactatttctcccatttaattgtgtctgcactccctttgtaaaggtcagacacatcattcctcccccacattgtgacccccgctcatttccatcgttcagtctgtcttcttgttgattcccacattttcctccaattgtcctccgccccaaatatttatttatttgttttccaataaataattgattatttattggactgtttaagctcggttaggtaagaccgaacaattggcgacgcccctcttcgactcaagccgggttggctgagcatcatcatccaatttgaaattctaaagccgggtcggctatcatcgaatttcttaagccgggtcggccatcatccaatttgaaattctaaagccgggtcggctatcttcgaatttcacaaagccgggttggcattcgtcaaaaaagcagtaaaacgaaaactgcgaacttcaaagccgagttggcattcgacataaattgctgaaagcgaacacaactcaaaaatggctgcgaacctcgaccaattggtgagattgatgacgcagcaacagcaacaatttgaggaccaacaaaaattggtgcagcagcagtcgcaacaaattgcgcagttgctagcaaaccaaaatgctgcaaacatcgcagctggtcaacaaaatccgccaaatgcagttgccattccttcgctgccggacatttcgctgttcgaagtgtgtgatgagaagagtcgtgtgagcgaatggctcgaccgattcaaattcgccatcgactgcgcggctccaacagcaagtgatgaaattaaagtgaagtcgctgatgaacaagctgagcgagatggctttcagcgaatatagccgatctgttctgccagcttcagtcaccgattttgacttttcgaccacagtgcagaaactggagaagcttttcgccaaaccccagtcaatcttcatcgataggtatgaatgccttaaagcggtgaggggagagggcgaggagtttcggcacttcatcaaccgccacaaaaagctgctaaacgacttcaagttcgacgatttgaagaaagagcaattttatgcattaatgctcttaacggcacttaaatcgccgagcgacgcagcactgaggcagcgaatattggctaaattggcaacggatggacaaaacgtgtcgtatgatggaattgtggaagacctcatcaacttccaatcaacgattgcggaggctcgagcgatcgaaacgccgatcagctctcgaaatgttaatgctgtccaccaaaagggcaagcaaaacttcctgccgaagaacaaattccccaaaagtggacaaaccacaacggcgaacaaaagttgttggcgatgcggagaatgtgaccatcagccattcgactgccgattcaagttgacaaaatgtcacaaatgtggtaccacgggtcacttgggaaagaaatgtgaaagtgttcaggcatggaggaaagaaaaaagtgcaaagatgttgggaaacaagaaaatcggacatttgaggatcggtatgacctcctgttcgatcaatgcactttcgttgatgcagatcaaaattctgctgaaccaacaaattgtcaaattctacctcgacacgggatcggacatcgacgtgattgatgagctgacttatgccgacattggcgagccaccgatcgaaccgtgcaatgaaattgggaagacctttgatggaaaagaagtcccattcattggaaaaggaattggcatattcaaattcggcgagattaaagtgaagcgaccatttttcgtggcaaaagctggctcacttaatctgctgagttgccaaaccatggacaaatttggtttgttggatgaaatgaagcagaagatcagcaacgttgcagtaaatttgtgcaaagccggccgcccaaagggagagaaaattattcccagtggcaccaaacaaatggccggaacagaagccaaaattgaggcattgaaaagggcctttcccgaagtcgtaaaagacgggttaggactctgcacaaaagagaaggcacatctgtcattaaaaaaagacgccacacccatttttcgaaaggcacgtcctgtgccatacaactctttagaagttgtcgaaaaagaattgggccgattggaaaagatggacgtcatcagcaaagtcgatcatctgaactgggcagcgccgattctaattgtgaaaaaggccgacggctcagcgcgactttgcatcgactattcgacaggtctaaatgatgcgcttctcgactgccagcacccgctcccagttccagaggatatttttgccaccctgaatggaggtaaaattttttcccaaatcgatctgagggatgcgtatttgcaaatcgaattggacgaagaatccaaagatttgtgcggattggccacacataaagggaattaccgaatggaacggttgcccttcggtgtaaagtcggcaccaagcatattccaatcaattatggataaaatgctggccggactaaattttgccgccaccgcttacttggacgacataatcgttgtcagcggaacaactgaacaacacgtccgacatttggaagaagtgttttctcgaatccaaacttacggattccgagtcaaattggaaaaatcaaccttcttccgagaccaaatcaaatatttgggtcaaataatcgatcggaatggacgccgaccggacccagaaaaattcatgcaattgtccaaatgccgtctccaaaagacatttcgtcacttcgatcattcctcggcatggtaaaccattaccaacagtttgtcaaggacatgcgcttcactcggaagcctttggacgacatgctgaaggatgagatcgaatggaagtggacggaaaaacgacaaaaagcattccaaaaattgaaggaagtgcttacatcgaaactgctactcacccattatgatcctaaattggacataattgtggcagccgatgcgtcggaactcggaattggggccgtcatctcccacaaattcctgaacggtcaaagtaaagcaattgcacatgcctcaaggtcgctcactccagcagagaaaaattactctcaaattgaaaaggagggcctggttcatggatgcatttaagtgcaaaagttccacaaaatgatctacggcagacacttcacattacaaactgatcacaaaccgctgatcagtatcttcggaagcaaaaaaggcatacggcagtgcagcgcaaatcggctgcttcgctggtcacttactttgctggcctacgacttcgacattgagtatgtcaataccaacgagtttggtcaagccgacgcactgtctcgcctgattgccaaagaatttgaatgtgatgatgaacgagtgatcgccgcgtgtaacatcgacgaggatcttggaactgttttggatatggcaaaacaaattctgccaatcaaatttgaaaatttggtctcagaatccaaaaaggataaaacaatgcaaattgttatgaaattcgtcagagacggttggcctgatgaacgcaaattgacgccacaatcagaagaaattgagcttttcggcagacgaaaagccgatctgacaattctgaaagactgtctgatgtatggcgaacgaattgtgatccctaaaaaattccggaccaaaattttgacactgctacacaagggccatcctggaattaaaaggatgaaacaactcgcccggcagtatgtcttctggccaaaattggatcaacaaatcgaagaatttgtcaaaaattgtgaccgtgtcaattggccgctaaggcaccgacgaaaacggatttgcactcatggccaaaatcaacgcggccatggcaacgaattcatgccgattatgcgggccctttcttcggaaaagaatttctgattgttgtggactcatattcgaagtacccggaggtattcgaaatggccactaaatcagcggccgcaacaatcgaacgactgcgttatctcttcacacgtcacggtataccggaaacattggtaaccgacaacggaacgcagttcgccgctagtgaattcgcaaaattcacagaagcaaatggaattgcacatctcttttccgctccgtacaacccaatgtccaatggacaagcggaacggttcgtggacacatttaaaagggcttttcgaaaaataaaaggggagggagtgccaaataaggaaatcatcaacactttcctggtcacttaccgcacgacaccgaacgattcgctgccggatgcaaaaacccctgccgaaatgctccttggccgaaaaccgcgcacaacgattgatctcctaatgccgcctcttccacagccaacggagagagacacaaaaatggagcaccatttcaatcgccggtttggcgctcgaccacagaaatttgtgtcaaataagccagtttgggctcgacaccgactctcgcagaattggagagctgggacaatttgtgaatgctcgggagtcatctacacggtaaaattccccgacggttcgacaaatcgctttcatgcgaatcaattgagaaaccgggaaaacaccgaaaatggccacgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagccaatcaaaaggggaggtgttcgggtgatgaccccgagagagacattaattaattttattatgtaattccctctctctgtctccccactatttctctcatttattgtgtctgcactccctttggaaaaggtcagacacatcatccctccccc

SEQ ID NO: 8490 - DNA, 5580 bp, Heterodera glycines
  misc_feature (4606)..(4606): n is a, c, g, or t
tggagagggattgcaataacatgaataaaaaaatcttcttaaaagaaaaaaaaaaattttccattaaaacaaaaaaaaatttcattaaattaaacgctgacgccttctcaccattatttgctgacgctgtctcctcatccgagtaggtttcggcacaatgcctgaaattgtgttgctcgtcgtcctcgccctccgattgtggatgttgttgttgtccagctttgccatcgctgctgtcatccacttgtttgtcctagaaacccattggaaatttagtttatgtccttgcgaaattttaatttaactatatatgcataactggtacttttgcagtttacaggctacttttaacatacattttcagatgcttataaattactcaatttatatgtttgtttaagcatggaaatctaaaagactaatattcataaattatttactctctccaaaaatctgacgctgaatttgaagaatggcttcgaaaatttaaaaaatattattgaaactcattttgcgtcatacatgtgaaatttgaaaatctgtatggatggtaccctcatggacatctctgcccatgatggtactcttgtatacaactccaggggtgcacaatagcgctgatcagagcccgggttcgttatcagcaccattaaaaaccctttgaaacttatttccttccaccaattataaacacaattttttttgtgaaaaatgtacgttaaaagtagcctgtaaactgcaaaagtctgcaaactaaaagataaatttccaaacgctttttttatgcttgattactttaagcatatttaaaatagtgaagaaaaaatttgtgttgggtcaggcatatcatccatgggctatgaattagactatgaattataacaaagaggaataaactgaaacattgcaaaattattttgtatttttaaaaacaatagtattgagacaatttaaggactagactttcatttaaacatgtgcttatccatatactttttattcatattctttatcaaatatataaacattaataaatttttataaaaatattatgaaataagaattgaaacttaaaccaaataatttatacatttaaaatatctgtgaaaattaaaaaataaaaaaattaaactggtctcaattattatattacattaaaaatgttctaactataaattttgtcaatgaagaaaaaataaattattaacaacaaataaatattattttaatcaattctaaagatgaaggaatacggaatgcgagataaaacaaatcttctgcaagaaattttattatttttgatagttaagaacatttttataaatgaaattacaattacaaaattttcaatatatattatccaaaattaataataaaatttttttgtatggatgacattaaaaaaataaagttaacaattttaacgagaaattgcattctttaaaataatgacaaataatattgtgtatttttatatgcaagcaaacaccatttccttaactattaaatattaaaagaaaacaactagttagaaaacctatttaaaataaaattatattactatatctaaactagagtgcagcgggaccgagaatgggcaaaaccgggacagcgacttgccgggacctgagaagccgggaccgggacagggacctcgcttttcgtccggcaccgggaaccgggaattttaaaaattcaaattttgatttatttcaagtgaaaataatacaaaattaaattttattttgttttttattttataaatcaaaaagttaaaactaaattaaattaatgaaaattttcaaatcaaattttctttaattatttcaaaaattaatcattttggactaaatttttttgtgttcgttatacttttgccgttagaatttgtttttaatttattttgttaatattttttaattgagatttaaatttttgcattgatttattctcatggtaaaggctaccgcgtttgattacggcgtagttgaattgttaaagtaaaaatttccaataaaatttttatacgttttaaaaatcaaaaatgtaaaattacgttcgagcaattattatgcgcaaaatgtataagtaaatttgggttgaataacgtttaaacaattttttttatcacttgcatattataagtttggtatttcaatggttattattttcataatttaaatttttctcaatttatttgaagcgaaagtattatacatattacttcgtgaaaattatattttgattataaattaaaaaatatttcatttttttttgctatatttcaactccatgcacaatgtttgcttaaaggcaggcggcaatataaaaatgtaaataaatccgtttaaaattaaaaaaaattattataatatattttattagaaattttcatcagtcggagaaaccacaatagattagtcagatagtgtatgataattattcaattgttttaattattatgttatctaattaggttgaataaattaaataaccataaatttttcttcttctaatttttgatcttaatcactgaatttattcaaatgattaataaaattcactttatcatctgttaatggatattttatgtacacaaactatataataatattttttcattattctgtttttaattaattttatctttttaaaggtaaatttcttttcggttaaatatattttgttgcttacatggtaataatggtgattaatattaatttttaaaaggatataaaaggtatgattgtaaaatttcaaagtcttaagtcagatattttttatccataacttttttgaaattcaataaaattattttttttttgatttaaatcttccaaataaatatttctcaaaaatttttttttaatttttttactttattaattgcaatataattttagttgattgtcgcattttaaaaaattaaataatttttaaattattccagaaaattcaattgctcatcacataactcttttttaacttatcacattttaattggattaataagactttataaataataattaatttaaatgattattaaggtcttcaaatggttttttatgaattaataaattggaacaaaagaaattgaatgtctatggttttccacgtaaatatttagattataatgaaagtgcgaaaatcacgctaacgaattgataagaagaaataattagcttggaaattggctcaacaaatcgagaacgggtgaattaaaaaaatttttactgaaaattagcaaaaattataatcaaaatgaatacaaaaaacaaatacattttataataataatttaaattatttactaatattgtcgtttagcatgaaagtaaaaaaaaggaataaaatattgactctgagttaaaaaataaaccataaataatatgataaattattttatataattaaaaaataaactttcaaaatttagtaaatgcgattattaattttcttatttagcatttcaaagtaatatttattaattttaattgggtgaatattaattaatgttttaagttctatgattttaaatgtatattatataagaatctaatagggttcgagccccgctcccgcccccgtccccggggcgggacaggtttttggggctcacccccgtcgctgccctcgtgactctgaccccagcatcccccgcccccgcgacctttttttaaaatatttgtggtttagtggttagtgttctggttttggggtactaccttattttcatctaaaaaagggaaatttctaaaaaatttggctaatttctaacaaaattcaaataaagtcttaaaaattttccgcttgcggcgcaaatcggcaccaccggacctctcccctcgcacattcaccaagttttttggaaatgtgccgcaaaaaatgttaaaaatctgctttagtgatcccgaatgcactgaaatttatgaaaaatataataatagaatacattttggatcgaataaaatgtaaaaatatttgaagcaattttgcaaaatgttcttatttttgaccctaaaatcttattttttggcctttattcttattttgaaaattttgaaatagaaaccctggatttagacaaaaacacccataaaaattgactattctggcataatttataatccttaaatttggtcatttttagacaatatctgtgcaattataccaaaaaagaattgaatcgaagcgatacatcgataaaggaatgtggagccaaacaacacatcattcataaaaattaattttttgtgagattttttggagctaattaaaaacaatccccgcccttaattgaaaataataaatgaaagaaatcatttttaattataacaaaatgaaaataataaaaatatttttttgtttgaattattaaataattattttctaaaatttattttaatttatttgagattaaacaaatattcaaataataattaaaatttataattatttataaaaaattaaattgatttattgtttttacattttccgtcgtccaccttcaacttgatcagattgccctctctgttcacctccatcaaatgcattttgccatcatccacccgttcttgcgcatcaattgaataaatcttaaatntaagaaagaaaatttaattaaagttcattaaaacaaaaatttaaattcctatcacttaaaaaagaaatttgtgaatttaattttttatatctttaaaatttttaattcttgaaaaatttaactgactttgaaaaaaaattaagttagagacagtccttaaacagttctaaactgactagggacggtcccggggtggtacagacctccatcacccacattttccaaaaatttcgcttaatttttccaaaacgccagaaattaaacatttttttggtgaaaacctgtttaaaaaatgaaaaaacttcaaatttttccacttgaattacaaataaacatccaaaaagatactgtcaattatccacttcaaaaataagctacgatatttttattgaaaaagttgataaagtaaaaattaacaaataatataaattaatttttatcaaaaataaattctaaaaccatgaaaatgaaatcattaattaagtattaaaagtgaaggacacaaaacaattgcctcattaaataacgctgtttttgaagagtaaataaatttttttaattaaaaccaaaaatttctaataaaagctttttgaaaatttattaacagttttaaaagttcttaaatttttattcttttgatttaattaaaaattcaaaaataaataataaatagatgaaattgagctttgactaaataataattaaataataataataaatcacttttccatatttgctttttaattcacgccactttacaagagattcaaaatgatttacattatttaaatgtcaaatttttaagtttaattactctaaattaagctgtatgaaagtaattgtaaatttacaaataaccaatttataaattataattataaattttttttttaataaaaatgtaaagaaatgaaaaattaaactatattttatgggtgctaaaaggaatgatttaatctttgttctttccaaac

SEQ ID NO: 8491 - DNA, 1588 bp, Heterodera glycines
ctatggtcactgcgcattgatcgacccgatcaataaaccatgctataaggatgctgatcgatcgcttcccacagtgaatattgattggacctcctccaaatgcgtttgatggaggagcgcatttgtgcatttcgatcactgtgtccataagtgaggatgaaacccttctctgtctcccctgctccgttgtcaaatatttcggcccattgttgaccgggttgagatgagtccttcgatttgccgattgcatcgccgcagtcgctgccgattcggttcggtgtcgttgccgtgcctgattctccggatagtcggcacgtttgatgaacctgaacaaccatttccgatcgatgtttgggcaaagaattaaattatcaatcaattgatcaaaaatagctgtggatcaatcaatctgatcggtcctttttcggttgtaatcaccgcaaattgcccaacacttcgcttcgctcactttgtgttgtgctgcaaatttcgctgtgctgtaacacgtccagcagaagctgacgaggggctttcgttgacaaatctgaactgatcggaacacagactgatcagccgaccttaatttgctcgtactcaattggcctggtgctcagttggccaggggccaggccaagttggaattcgggcacaaacgcggaactcagcgcacacaaatggacgacgccggtgccatggtgcgggtggaagcaccaggccatggttatgccgccactcgccacgccagcggcaacttccgactcgtgatgatcattgccgcgaggggacgacttggcaccgatcagaggcttgaaaagcagcgaagcgatagagcggtggacgccgccgctgccggcggtggagcgacgccttccgctgccgccaccgctgctgcccatttcgtcggaggaaggagtcgcggctaacgaatgcgacgcgttcggtccatccgcggacggcgagtcgggctcatccacatagaaaatgctgtggccaagttcgccgcgctttgacttgtccagttcaccgcatgtggcacggcgcaactgaatggacgcggcacccccggaaagagcggcggagggcgacagagagtggtggtgaggaggagagacgcgccgattgagcaaggcggacagagagtcaacgccttaggggaggattatgacatgtcaggacgaatgccatcatcaacagcagcaaattgacgcttcaaaatacccagaaacgcccttcccatgggcgtggtgattcagtgttttcattatcgcaaatcttgccttcctttcttccccctctccaacagcagaggatataacgttactctctcactctctctcctttcccctctctctctctctctctctctctctctctcactcctttcccccctctctctctctctcactctctctcctttcctctctctctctctcactctctctcctttcctctctctctttctcctctcccattatctcttatttttatcatttgcccttgtagatgactcatccatccacaagactttcttaattcactttccgtgccatattaattccgctgattcggccccctcctccttttatct

SEQ ID NO: 8492 - DNA, 3415 bp, Heterodera glycines
gtgagtggagggaagagaacaaaaaacactcctcaatacaaaaaaaaacattccttaattacataaaaaactccttaattataattatatgtctaatgtctaaacaaaacacagattgaccattgccaccaaccgaaacaacaacaagaaaaagtggcaataatacaaagcactaattataaacaacaaaaaatgccgacaaaaggaagtaacgcaattagcaaggccaacccacctgttctgctgctgcttgtgcttttctcactgccattttcgcgtgccatcgccgcgccgtcgccctccgtcgccagcgatgccaattcctccataatggcaccgttgggtgttgtgacgtcggaggagcagtcggacgactccgtcgcgtccgcaaccattcgctggcgaactgcgttcgtgcgacgtgccgccttttgtgtgctgtgcggcaaattgacatactggcgctgcataatgccaatgaggtcgctatcgtcgcaaatcgcctcatccgtctcggtccagttcggttcagcgcggtctttgcgcagcggacagtccctctccggcccgacggatgagtaagtcgtgattggcggagtcggacgcttgagtttttggcatgcgttcatctgctgctgatggcctgaggggcaactgctcggcaacagcgacaagtaatcgtggggtcgactaatcggttgcggtgatcggtgccgaattttttgctgtttctaaagggacaaataaattttgccggaggggtggggggaatggaggtggaaactgtttggctaatgctttttgggattggtcaacagattggaagatgacttaccccgccggcgttttgtgcgccgctcattcccatgggaaacactttccctccgccgcttttcgtgcccaaaatgttcagttccgggttgcttttcgccgttttggttttcaccaatccgccgagttttttggcacagcacggatgggcacggcagcaggacgattttgggggcaaagcaggcggaagcaaattgtgagaaagaggtgactgaaaaagggaggtgagaagaatagaaggcatggcaaaaagtgatcagcagaaactggagctgatcagtgagtgccgatacttttttaaatgttggtgaatcatcactattcttttggacacggttaataactcctcccctctccataattattttattcttttcggtcaccttctgttgaggctgctgcactcggaatgtgcgtggcaatgtcgcgtatcccaccgccggcgccccgtttttgccgcctctgtcgccgccccgctccctgccgcactccaacagcgagtcgtgcgagcggtgcgactgttgccgttgcagcggtgccaactcggcatttgcatctgcgaaaagagacgagcaacaaatgatcaccaaccacagacgaaaagcagacaaaaggacgaagagggacaaaatgacgaaaagagagacggaggaacgaaaaggtatgctgtatagagagatgaaagtgacaaaaaaagagaaacggagggacaaacggcaaaactaatggccataaccattaagaaaaaatcaactcacaaagtttgaccgtcggttggtccccggaattatccgctcgctcgacctgtgccgacacaatgtgccgaaacccttaaaaggtaaaaaaaacggtttgaagttggcactgccctctccccctcccaccgcttggcgtgccaatgcttcgcttttccaacttcgccgttcgcttttgccgctttgggtccggcggttggaaccacgcggccaaaattcgctccatttttgtcggttttttgtaactttttttgtacaccctttccaagtacaactgcactttttgttccgaaatgctgaacatcttctgttgctgctgctgctgctgcatctgttccaaaacgacttcagccggcgcctccttttgctgcgtttccgtcgccaatttctgaagcggcgctttgtgaaggtaattaaaaaagatgaaataaaactcaaatttggcaagggaggaattggctaattgctttaggagaattaattaatggagggaggacattccctttgtcaattgcagagaaaatgaatgaccaacgatcagaaaaataccccgaattccgatcgatcccccgcttttttgtaaatctttcgcccgctttttcttttttctctttcaaatgcttgcccatttgtagcttctgtccacgctctgttccgccttgtccagctgcgttttcacctccacaatgctcggcctttcgtcctttttccattgccaacatccatcgaaaatctgtcgcagtgcgtccggcacatcgtcgggcaacggaagtggccgcccgacttttatgaaacacgcccagcgaatgaccgcctccaaatcgggcgctgaatggcaaggcaaataaaataatggcattataattgattttgcaattgataattactttgacgtgtcagaagctcccaaaagaacattcctgcggggaaagtgaatgatttgaaaaagtgatcagtgatcggacacaccaaaagaccaaacgtccattttggggtgcgaaatggcaccctgcatcatatcaggcgatttccaaggcatggagcccgaacagctgtcgcgcttctcaccagctggccgactgacgttaaaatctgaaaggggacggacaaatggtaaaacagggggagggagacaaaaggacgaaataaaaacgaagacaaatgaccaaaaatttaatggggtaaaaaccgcaccggccaatttgagtgtgagtctgtcgatgcgcatccctccgcagccgcggcaccgcccgtcggcccttcccccgtccgccagtgccttccacgtgccctccgccaatgcgcattcgcacggcttttgtttgattagcactgcactttttgatcaaatccaaccattccaaagatcaaaaaacgcaccattttctgcctaaattaaaaaagtggtgaaaattttgtgcatttaatgaaagaaatggccgtactttcatgtcggcgtagaccaatggttcattctgaacaatttgggcattattaagccattaattatgccctcggggaaagaaaattgaggaaaaacagaccattccatgtaaatgctcaagggcacatgcgacttgctgaagacaaacagaaaatagcaacggaagataataattagttaattaatcactttggcccaaaaaatgactgtgagaacgtcggaagattccattttgcggtagagagagtgtaaagtgccacctgaagagagaaacgaaaaaatgaattgggaaaaatgccaaaagtggaaaaagaggacaagacgaaagaagttgaattggccaaaaaaggagaaaccttcgcaaagctcgagcacaagaacaccg

SEQ ID NO: 8493 - DNA, 2788 bp, Heterodera glycines
aaaattttttggcaaaaaatttccgagttttctgatttcatggatgaaaatccaaaattagtcctataaagtgccaaaaaatgcatgaatttggtccccaaaaacctggacggacgggtccacgggccttcgctgtcgctgcaaatgcagccgaccggcgccgttcgccactccgttggtgaggccggcatgtgccgcagctgtcgttgtcgccgggttggccaacggcggcgggtcattccatccgggcgaaacgcttgccgactgattttgggccaaagtgtccgattccaacattttttaaaaatatttttacgatgatatacaaaaaatgctgaaaaatttgaagggtctaagtttaactcagaaatttgggatgggaaaaacgaagaaattatgggatttaattcccaggcgcttaaatcagtgatttttttgaaaattttcgagccttgtgaaaattgaaaaaactctgtcgttaattcccaaatagatttttttagaattttttttttggaattagaaattcgctggcttttctttttcattcacataatataaatttaaaataattatgattacgtaggactaaaattgcaatgacgaataatttttctacaaaaaatttaaaaatcaattaaaatttaatattaaattaaaaataatccatcatttttaatagtgaacgaatgattattgcctcgcctcgcgcgtacgcaatttcttccacgtcctccattttttacaatacaattagggcagagaacgcctttctcccgctgtctgtttgtacaatatttctctcatatttctcacttttctctgcattttcttcactccgttcacagggaaaataaataaaatttatttgattaaaaattaaattaattttaaattattattagggttcaattgagcctggatctctaggcctggatttttcctggacctaagtcaaggccatttttcttggattttcctgggcttttgtccaggaaatccaggccaattgtgacagatctttgatcccttaaaatttgttgtttttaagtgaccaatgtttatgtacctatttcaagatatcaaataatgcaacaaatactgaaaatattcagtttttgccgatcaattttggcaatgttaaatttttaaataacactgaaaagtttaattttcgtaaaaattctaaaccctcagtaaaatgccattgttcttttaagaggggaaccgttaattgtaaatcaatttaatggatgaatgtgttttggtttaaattaattaagtcttttaaagaaacagaagaatttgcgataaatataaacatttgttttatttatttaaaaatattttaattaccatccctaattttaattaccaacctaatgttaaatattactgattactatacctaattttattcggccagcctcgggatttccatctcgagtctaatcccataaaattttcaatcatttcttacacattgacttttaatcaggggatatacgaagcttaggcacaggcttagcctaagcatagcataggcttgtagttattaggcctattctacttatttttttcgaaaactaaaaagatattttgcttctaaagtctaatttttcaaaaaattaaagaaaaatattttttgttaatcttagtttttttcgaaaattaatgtaaaatattttttttttaaattaaattttcgaaattaaaaaaaaaatttttttgcctaaaatcataatttttttttacataattaaacaatattttgtgtaccttttccaagtacattttgtcatttaagtttttatcacttccgaatccgcattttacttcctttattttcgattccattaatggcgtcagccggcgggcggcaggcagccaattttcttttttttaatgaattctcctaactaagccccccccctcctcaatgtgtggcgcaatggattggcattggcattggcacaaatgcataatgtataaatacaataaataagggttgcggcgggggcgcaagaatacggacaaacatttccgtttccaaggcaatttgggcgacagcgatgacggcatggcgcgacctctctctccattttgctgggccacttgaattttatcagcgatttagtgggggctaaggggggggggggacaaaaagccgacgtgtaacagtgccataccaaatgtcgctgctgctgccaataaatacacatccaccggggcatatgcggcggcgacgatggcacaccaaaagggcgacgggggccaaggcattggcggcacacatttacccgtgcctgccgcgcctcgtcagcaattagtgaagtggttccattatcgcatcggccggccacggcggctgcgcatcttatgacgacggcaaatcaaaaaaaaattttttttgctcgtcagcagccggaggttattaaaagcggatttggcactttcacacggatttttgtccgttacgcacacacacagagaaggcttttgccgggttttatgtgcacatttcttgagattattcacagaattcaaatgcgtttgatcccacgctttcaataaaaggctcataaatagaaattaatcataaattttttgtgtcaatgctaatttcctcctccacattttctttgttgccacttccattttccatttttggcattttcattcccatttttgaaccgaatttttcaaaagcgtcaatcttttattttgtttaaaagctgattttgccacaaatgaacatttaaatgtttcaaagctaaaatttgtttgc

SEQ ID NO: 8494 - DNA, 1700 bp, Heterodera glycines
gcgcgatccgcaaccgcggcaatttcaatccgtgatcgcgggatttttgtgtccgcgcccagccctggctaatagagaaattatatcgtattttagttgtctgttatgacatgtcaaagtttgcggcaccaaatcccgcgccaaaagtgcgaccccaagactccgttagctctttcgtgtccattttttgtccgacggcaaaatctcaatgggccattaattatgtttgtatgtttgttgaaaagccgctaaattacattaaaaaaaatgaaaattatttgcaacaagtacatagcatcataaaatgaactaccggccggccgccacacattccttccaccgcttcttctctctcccttccatcataaatgtgttgggaacgggggaggagcaattgcattcatttttggagtaaacagccgaaaattcccatcaattttctccccgtcccccgaatttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaattccccacttttccccgttcccatcaattttctccccgtcccccgaaacaacactcaaaattttctaccaaaaaatctcaatatgactatattgtgtatatatgttttatatttcttgtagcattttttgtgggctttataatgataccattcactatcccctgtcaaaatgttattattagttacaaaccattttaccaactgcactccctttttggggtggtcatatgtttaacaacactacccatatattttttcatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttatggaaattttgagtaggcccattttatagagcacaaaattctctacaatattcaaaaaaccgcatgtctctatgacttataccggctgaggtatgggcacttcaattttgacgtagtgtaaaatgcactataaattttcccgtttcccccccccgtcccccgaacttccccgctttttccccgtctttcctccatcagcagagagaatagaaaaagagtgtgcccctttagcgtgaaaataaattttgtttttgcttttttctgctgtgtccgccccgcggccctcccaaatcgataaaa

SEQ ID NO: 8495 - DNA, 4113 bp, Heterodera glycines
  misc_feature (4063)..(4063): n is a, c, g, or t
tgtaatgagtaaggctaataattttagttttttttaactttttttttcctgaactctctatggcctaaaacgcacgaaaaacatgctttttcggttgttgttaagctatttttagagttattagcaactaatttctagtttttttattattagcacctaaaaagttaaaaaattaaaaaaaactatttcaactattttggcgttttgcgcaaatttgttaacaaaaaagcaataaaagggaaaaatacacccctaagaaattcatctcaaaaattattcatttatttaacaaaaattttatattttaaatttcaatactgatttggtttagttttgttgcttttttgaataaaattttgtcattttacacccataaatttaaaagtttttagctattattttcccattttagcacctatttttgtgttttttttagaatctaaaaactaacaattttggcagtttttagcaactataaatataaaccctagtaatttgcaatttcttttttttctttttaaatttcccatcaaaaacatacaaatcaatttttggcgctggagcaggtggtggagctaaataaaaagtgatgttaaacaacaaatattaaattatcatttggtatgatgaggtaaagaatggtggaaaatgatcgaattactgtacccctacggtaattcttattctgaacacgaattcgggcaccccctccccaattcaccatcgggcccgtctttgccgggcggcccctgctgccccggggctccgtcgctgcccggcatccccggcagtcccggcacgccttgcgggctctgtccgcagccacagcacgtgctctgttgcgctgccgccgcggcagcggtcacataagcaccgtcggtcaccgcagcgccaattggcgatgacttaacgggatcatttgttcaacaaattggtgagtacgattatgcaagaaagcaaaaaatcgacagtgtttgaattcgacagtaaaactcaacatattttaccataaaaatagaatttaatttttaaacttgaacagcccccctcccccaatggcacttgccccataagctccctgctgcagttggcgcttgtgcctttgttgttgaatctgttgttggctttcagaaactgaaagagttcctgcaacaaactgaaaagttcaaaagaaaattttcaaaattttcccattttgttttagctgacctgtgccctggccacttccttccaaatgctggtagacctcagcttgcaaaaatctgcctgcataattttgggaatgttttatgcaacgaaaaatcactgatttataaatttaaaaatttaaactccccccccccccctaaatgtccaacttcgtcacgcatttgggagtgcatttgctgcacataattgtacatcatcggcactgacatcaccgccatcagcgtggcaaccactgctgtcgtctgttgccattttcattatttatttagtttggtcgatttaaaatttgaaatttcgagaaaatgattcgatttggaccagattcgggatttataaaccaaaaatcgggttcaattccttcgtcaataaactttggttgatttttaaaatattttttacaattccccctccccctctctccgaactttactaaccacgccgaagaaggcaacccttcggaaattttctgcttcacgcagcaatgctttcaggtccgtctcctccgacaatgcgcacatcggagacaaaaatattagaaaattttataagaaaacaatttgatcactgaatacagtggtcagtgcaaaaggctgactgttcgataatttatagttttaattttaagtgtcgaggatacggtagaaagtgcaaatattcatttggctttttaagagcggaatttttttttgaaaataagggtttttgaattgagcggagagtgaaatgcacgggtggcaaatgaggcgaaaaatgaatgaatgagttgcggatgtaagccgaggcgagagggggagagagatccacacaaagattggggaaaaaggaagagggtggcatttgtgacaatgggatgggacttttcgcattcataaaatgaaatttgtgagttgaaaaaaaactaatgatcggtcaagcaaaaatcgccaaaacggcccccatcagctgaattctgatcacattttacaaataacaaggaatgcatatttattcgtatgcgatcttatttcgaatatttaaatcaaaatgttcaaaaatctggattattttctacaaaacttacattagacctttgttggaatatgagcctatgaccgaacagatcgagatttatttaaaatttttaagccatatggccgctttaactccccctcttatagacttaacacaaaataaatcaggcaaaaaatatattccctttgcgggaagggcaactaaactgatttgtgaggaatcaattagataaagacttgcaaaaaattaattcattaaagcaattaaaacattactcaaaattctttagagtaaaattataaggccgaatgactgaaaaagtatataaatttttaataaatagtttcttaagtgactcgataattttgataaaattgagccgcattgacttatatttatttttaatttaaattttagctttatcgtgttgtttttcgtttaaataatttttataccaaatttcgccatttttgataattttttttatattttgcgaattgaaataattttgaggaattataccctcaatttagaaaaatttatgtcgatatttttgacattttatagccatatttcgcgattttatatccatataattctcttccatactaatgaactactaatgacaatttgtttaatttttttatgatttcctaaaaatgaaaattccattggaaaaaatacactcaatcactcacaattttaagtgctggtggtggcggaatggattcaaatggaggagaattggataatgggcattttcttgcacaaaaatggtcgaagttgatggaagaaaatgcaaatgaacattgtgacagaaggaggatggaagaataaatgattggatgagatgaacccaatttggggggggggaaagaagtacctttgggacagttttgtcattacgcatctgttaagtgtaccgacaatgggtggtcggtcatcaaagcaatgggaaaagcgcaaagaaaaagccggattttgtacaacgattgtatttagggagaaaaagcaaaaaacgaggcaccaaattcagaatgaagagttaaattaatttagagaaatgcaaaaaagatgaacttgtgtttacaataatttttgggaaggaatgaaagcaatttcatacaaaacattttttttataatttttaaattcaaaaaatcgaatttaaatttttattcaaaaaatggtagcgataggtggcatcaatttgtcatgccgttttcagggccgctgaacatataaaaagcgtgagggtgagggcagcaaggagagaggtgggcgaggatggcatccccatgctgccacccacccacgcccagcgctttgtttgctccaagcattgtctccccctcccccgtggatcgctttctcagcccttccctcaaccacccgaatcggacggacggagggaaaagaaaccggttaaattaaatgaggggatttgctctgttccggagatgaccggcgatcgggaaaaagatctaatcgaggcgagttggaagcggacaatggcggactaacagcagcagaaaagcatagctaaaatgggagcgcatgacaatgcttttgcttctgctgcttgtgacaacaatgaatgagagtcgcctctctcttcgccctctcggccttttgtgcgtctttgtgcccatgccctcgtcgtcttggcgtcgtgtctctcgggtgttttctctgttgtcgtcgtgtttgggcttttcggttggctcttcctgctgcctggtgtcgcctctctttcggtgttttctttctttgttggttgctttttgggcttcctcttctgttgttgcttgtcgaaagggctcccttctcttcttttctctgntttgctcctttatggaaaatttttgtcgagactattcaaaaagataaaat

SEQ ID NO: 8496 - DNA, 2667 bp, Heterodera glycines
cccccgccttccttcccccctccctcaataaataatgtgcgccacggggaagggggcaaatttatttgttcggctgatggcaccgaatgaatggtaatggacgagggttgatgaaagaagctgctgaaatgcttctccttcatatgatgccctccggaattgggcttcttaccaaaattatacataaactaaaaatgaacagataaaaaagagagagagaaaaagaaaacaattccaatggcatttggaattttatgcttatggccaaagggcggcttttcataatggcacagtgtttccattgggttctggctattatccaattttttttatgaaaattgaatgtttgataaaacaagtctgaaaaatgttagagttcgagttcagaattttttaaacacaatgacacaatttttttgtttgctgaaaaattcaatttcgaattcgttagtttgttacaattaactcaaattattttaaaaaaatatttttcaatattttttaaatgcgtctgctccattagttaattaaattttcaaaatgtgcaaaaaaaaagaaaaaaaatgattgtttccccagaacttattattgttgtggctaaagttttttacgaaagaacggcatcatttaagtcattttaattgtgttttttaatggccaaaaggcatacggcaggagaagggtgaaacaaaaatggaaaatgtcttgaaatacgccaataagaattatttaataaattctttaaaagctttgtttctcatacaactcaagccttaatttttaaaaaatttaaaaaatattcacaaaaaaattttttgaaatggcttcaaaatatataaaatttttgaataaaacgcatgatgcaccatatttaaatgggacattttcaattaaaagataattgtcattgaaaataatgaaaacatttaaaaatttatatttttggttgaattattataggcaaacggaaacgatgtgggaaaaaaacattttaagaaatttaaatatgtaattggttgctttttggtatttgacagctgatggcaaaattcattttaagtgttacggtatccgaggaatttccgcttaattggagatttgtaaaatatgcttttgggttgttttcggagtcactgattattttagataaaaaatgaaatcgaaaaaaaaattttaatatctacatagatgacacttcgtgattagtgttcataattctaaaaattcaagagagggcgaggccaggtttaagtatactgtaaactcgagaagtggtccccaacatggcagagactgaaaaacttcaggtagttgcccgactacagtttggatttatgcaatcatttttcaaaatacgaattcggaattttgctcagaatctcgagtttgttaaagcaatgaaaaaaggcggatgaacccaaccccagcagagggcatcattgacaatggaggacgaacaaagcgattcttctcttttattcccactttcaatctgccattcattgtcaatgccaacaatattcgacagcaccacggaaaagggcattcattcactgtcccataaatttgaataaataaataatccatcggagcggggggggggggaggacgacaaatcggcacgaacaaaaagcgccgaattcgccgccccaccaattcattcaaaatgccgagcagcaacttttttcacaaaggccaatatgtgcacataattgtggaagatagagatgatgaaacagccaccaaggacgagaaacaaagctgatgtttgaactttaaaatgtttgaatggcacagggcaccgaaaggtcaagagtcttgagaggaattatttgattggttgagaagaagtgttgggagtcaatcagttattaaaatgcataattatggatgctaatgagttgttaatgaataagtattttgaataaaattcaagatagatttaaaacttttgtcaatgtttttgaacctaatgaaataggctaattaaaaaggatgacgaatttcgagtgatgacaaaaaagcaaatggctgacagcaaaatatgtgttataatgtccataattatcagttgaagagacccaagcaaatgccgagatttttatacaaaatggcacaacgggtgcaaaaaacaaacaaaacaaaagatggatgagtgagtgagtgggaaagggacgcgcctcgggggaggcggcggacataatgggaattaacggtacaacgacatttgagacgcaaaaactccgctccgcgccgctttgtgcccaccccgtggcgtaggcgtgtcacggaaattcggaaaaagaggcgtaaattttgcaaataatgaatttttggagaaacaaagaataatgaaatgaaagcaaaaggaaaagcctaatttgtgagatatcatcaaatgagcttaaacagtggaggacagaaaacgtttggcgaaatgatgtcataatttttaaggggtggggccggagaaaaaagaatatttggtacaacctcgcgggggtcgttgagctgctcttcagaaaatgggacaaatgcttttgtgattgcttggcattctgtcacgcaataaattgcctgacgtgagggatttttagaatttccgtttccatgcgatcagattttctttccttaaatgcaaaaagtgaagaaaattaaaaaactatt

SEQ ID NO: 8497 - DNA, 1466 bp, Heterodera glycines
ctcattcaactctctcgctccctttcctctctctttatctctatctccttccacactctccttcccttttttctctctctatcttccctaattccactctctccctcccccttttttctctccccccccctctctctgtggtcttttgtttttacctttgtctttcctcccactgagaaagactggacaattggcattcctcgtcggctcagtcccaactcctccaaatcttcctccgattttggacagttcaccgttttgagtgcctaaaagaatacaaattaacaatttgtcaggagtttaattaaatgatttttgtttttagtggcatactgtacataaagaagaacactgtaaatgaccgtaatgccacgggactttcgctttgcttaccatagtcactttgcgaatgaaatagaggaacttccgactgtaaacgtgttggtccgggttgttgttttcatcactaaaatgcgggtcctattgattcctttccattttgagtgcccaccttagctccatctgttgcatttgctcctccaattctcgaattcgctcctccgtcaatgcttcgttgctttcatcctgcgacggagtcagccgatcggcgccggaggggtcgtcttcgccgttcagttcctaattataattggaatttcaaacaaacagcaaatgctgtcgcatcctcacaatatattagcaattaattactcttaattgccttattaattagttaattattccttttccttacattttgactgccttttcgacttccgcctcccattggctctgtcgtgccctcctcctcctcctcttctggtggtgccgtcggactgaccaccaccggcggcggcgctgcttcgtccggttgaaaaacggtggcgccgacaattttcggcaccgtttggtgcggcggttgttgctgctgctgagtgtgaatctgttgttgttgtatttgttgttgttcgattggctccatttgctgctgttgctgttgatgctcaatcactgctttttgtggattttcaaccttaaaaagggacaattaaaaatacaataagaaacaaaggaatttcatcctaattaaattaatggcagagttttacagccaaatttggaaaaatcccccccccccaaaaaaagcaaatacgataaggtcgagaaggggccggggttggattcgcgggacagggctaagccgttgctgctggacaatgtgaatttgctgctgcgtgggcggaggggacgggtgaagaatcaccggctgaacatcataaaaatgcgttcactaattaatcccattttgtctttggttcgtcccacctgttgctgttgttgctgctccacgctaatcgtcggactggcggacaaccgcgtttggtggtggacgggctgttggacgataatgttggccactgttccgctcacgtgctgcggcggaatttgctgctgctgaaagctgt

SEQ ID NO: 8498 - DNA, 5364 bp, Heterodera glycines
ttttgctttttttcgtcatcggttgaccgaatttccatgggttttaccagtttcggtctctccgtttctctttaccaaattgacaatgaacatgcccagctcaccttggccatattggcgttgagaaggcggcggcactttttgtgtccatctctccgccgttggcccatcgttttgtttcgtctgatcatcatttccttccctggcgatctgaaagaattatcacagttttgcactatgtttttggcattttatttcggcactttttcacccaccggcactgccggcggcggagtgatcgtcggcactgtgccgttcccttccgctttaaaatcgtcgctgtcagccccgtacttcagccgttctgcgattttcttttggaactccttcgcgtggttggatttgtccgtttcctccgcctctctgtcctttccgtccgttgttggcttcgtttttctcttcgaatcgttcgttattcccgtggacaaatccaattcctggaaaattggtcacttttttgtgtgtgccaacaaaaataagccaagggaaaagccatggcatttttttaatggctaaaaggcattctcttgcccaagaaatgacctctttagtctccgggtgagtgaacttcagtaactttttctcgcgctgcaattgctgctgcggcggaattggttggccaggaccagtggaagtgaccacgacatttgtctggagggaaaaaggaaggtgtaagtaattaagtgattaatgactgtggtacaggaaaacgtcaaaaaacaaaatgggggggggcaataaacgaaaatagcccaccgtttgcaaatgcgttgtcccttgcggcactatgccatgcgcaaccgaaacggcggccgactgttgggcagcggcggcgacagaaacggtgccggcaccgctcatcacagaaacgggcggcatttgcgccacactggtcaccgacggcattggcatgccggcggtaccatggtgggccggcatgggcatggagccctgagggtgggactgttgctgctgttgttgttgagcaacggcaatttgctgggcagcgagcaactacaaaatggaaatggacaataagaaaaccgaaaaatcaattgggaaatttcgaaattggaaatcgattaattattcggtccgctggccatcacctgctgatgttgctgttggtgatatgcttgatgttgttgctgcggagttatcagcaatgcctgtggcatgtaagcgcccggcacgttcgtcccgtaatattgacccgtggatgggctaaaatactttccatcggtgccatttgcaattttttgctttttcctccgtgtccccctaaggcaattgctaattattaattaaggtgcccacttgtaataatactgctgctgaatgctttgatagatcggcgccgccgcttgcccctgcgggtaaatactcgccgtctgctgataagcggtcggctgcggcattccgccgccggcacccgccgtcggcccgtacatttcctgctgcgttgacgaaatggtgtccgaacgcataatggtggtcgagggcgggacattgatgattgccctgacagaggaaggagaaaaaaggactcaaatgatcagaggaacgataggataaaaaaacattattgatgggaaaatcggggataatcccgaaaaatggtcaaaaacgtcgggatcgaggggaccaacccttgcttaaaatgtaaaaaaacatttttaggacaaaaaagtattccttgacactttgttgcgttataaccttggcattaacgagtcgccttcgcggtgcgtctgataacgctgctgcggttggtgttggtgcgaatgtgtctagaattggcttaaactcagagatggaaaacaaagaattaatccattttattaaaatatttttctattttataagggctctaaattcgtttagataataattaactgcgctaatttgccaatgaggccaattataatgtattaaacttagaaaaatttctttcagactaatgcccatttaattttgcccatttattgggcacttttccctccctttcccatattccttcccttctcccccctctttggcacctgttgtgccattggcatgtccccccggttggccccctcctcaaatcctccgcttaatccctcctgttggtgcggctgctgttgcagcggttgcgtcgcctggggcggcgttgcggtggccaccggcgactgtcggttgtggccattcatttgctgttggtaggggctgcttgttggggcgcgaattttggaagcttttattttgagaattttctaaatttacaatgcttttttaacaaaaaagaaaaatggtcagaatttatttaaaaattatattaaaaaaacgattgcgaaaagcccaaaaatttgtcgaatgatttgctgggaaggacgggcacaaacgacgcacagccgccgctatttaaagcaaattttaatcgggagaaagaaaaaggcaaaacggtggaaaatgctgaagctgcaacaggcgaagattacgcggcgatttcttttctccctttctttcttaattttaccattttttgtggtggcggcgccgtttgagagtgaacaaaagagtaccagcaaaaaatgaagcaaaaagcggtcaaatcaaacaaaggcacacatttggaaagcattcaaaataaattcaaaatattaatcatttatttatttcactttagaaaatttgtgttattttttcaaaaatatgtaactattgactaattgctttagtgcagagctcactttgccattgccattagtgtgactcggttcgaccaattggcctgaaaaagcatttcgtttcaatgttcggttcacatttctctttgccactttgtcggcattttcatagcacttgatttgcccgcctaattgctctttcctacctcaggcattgttttgccatttcaatcaatcgataaattttgtgtctttctttttgccactctttcccatcccactgaatacaaattgtaaatccccgttcgttatcaaagtcgttcgctgataaggccgtacgaccctcgcctcaagcggtgatttgggaaagtgaacggccattcgaaaaacggtggacggaccgaaaccaaaagacggacggacaaaacgaaggcaaagggagggacagacgggcgggggggggggggggcgctaatggccttttttgtttctttttctctcaaaatgggctgctatttatgcccattatatgtatgtctggcattgcctctcagttctgctgttttcctccttcactttgcctaattagactaattagtaattacaattttgttgccccaattgaaaaatgtcaattgtgcccctttttttgactgatagataatttagtgaatttttgagtagaaataaaaacaataaattaactaaatacataataaattgattagattcggccatttctttcggtttcctttcaccacacacattaattaattaattattattcattcatttgttaattcctccgttatttgtctttcggaatgcaaagtgttctctcctccagcaagtgatgagttcagcttcctgtgaacgttatcgccctcgtcgtgtccgtttgttgaacaacccaagtgcctatttgctgcacaattgcgagcccggcatgagcaaagagcggcgaaagtttttgataggtcaattaaactcatttaaatgtttttcatttaaattgcaattgaaaagaatgcccaaggcaaataggaaaaaaggaaataatgaattatgagtaaaaaataataatcgccactgaactaattaggcaataattgcatgttattagtaaagttaacctttaattgattggtttaaaattaaagtgaacgtgttcgactttgtcctctgcgctttgctttggcttctctccgcggtcaccaaaccgtaccagcacagttggttcgacgcctttctcgaggaggtcgacgtgttcagaccccgcttcctatataattcgttgttcgatttgggtttgttgcccgtgaaatttgcccaaattcgaacaattaaattttggcacagccatcgccgcttttctccgcatggccattctgctgattgcttatgcgctactcaaatgcgaccattggtacgaaattggcagaaaggaaatttagaaaacaatttctaagaattaattagacaaaagaatttttaattaggcgcaaaaataatttaatatttggcacttacctaaattgaatgctctctctcacagtgaaggttaccggtggcactgacaacggcaatcacaacaattttcgtggccatcaaaattttctttttcttcgacaaggacaaaagccaaatgcaacaggtcatttcgaaaggggaaaggaggaaaattggaaattcaaaattaaattaccatttcaaatggtgaaatttaattttatgaaaaatttgggaatggaattcgaactcacaatcagccaaatttgtcatgtaattgcaaattttaagaaagaataagccatgcagaattatgagacatataattaacataattattgttaaattcccgcactctttctttgtgtctttgtggctcagtggtaacgctttgcgttttgagtgtttcgaggaggcaatgatgataacataaaatgtttaggatgaaacaataatgacaactttattcgtactgtttgagccttcgaataataaatacttttattgttttttcttttatgtcctttttgttggcacatttcggccgcttttcaagttactaattgttttatgttgttaattttaaacgaatttccttttctatttaaattttgatcaaaaatataaattaaaaattttattttaagtgttaagaagcgaaaaaggaacaaaaaaatatttggggttcgttcgtccccccctccccctttctcctctgggatacacaggaattctggtaaattaagaacgtaacaaatggctcagttggtaacgctttgcgtttttgaatatttagggcaatgatgaaaaaagtgatttgtttaggagctaaacaatgacaacatcagctgtaatgatttgagcctttcaattgccattttcttatttttattgtttttcactttttgatcagaatttggtgatcattgcctcgctttgcgtcgcgtggttcgaactttggctgatgcccttcagagttttgcaacgcgaacagcagagagaagtgtaaacaaagaataaattaatgaatcgagaattgaataaataaaaggatcactcagataatgccaaaacgaactgccgggaagaagtgccaaattaatcactaattacataatttccgatc

SEQ ID NO: 8499 - DNA, 3107 bp, Heterodera glycines
aggtttttattttttgcagcattattcggtagtaatttttaggcgttttttgtcgtttcgctaatccttgaataaattttctcatttttttctatgaaaaaaagaataataaacaatcaacattgttttctcataaaatttgttttcattcaagaaatatctaatttatgtcaaatttaaatgcaactactcaattgtttctaccgattttatttaatttttttaaaaaagccttaaattttcaccacatttttgcatttttcgttatattgataaagtctagaataataattaaattattatacctgaattctttttatataattttaaaaatttatttacaagattttagcagtatttttaatttaaataattttaaatgatgtcttcgagttcttttgaggtttaatttattaccattttttaatttaagtaattattgcatttcagcaattatcgtgcgaaattgccgaattggagaagttacgccaacaatcacaactcccaaatgttcaaaaggctatcgatgagctaattggaagatggaaagtgaaaaaggaagaacagaaaatggttatcggattgctggactttatttaatcgacagaattgcatttttaattcaaaaattaatcagaaaacggacaaagggacagcggagacactttcagccccgacagaagcaccgaaactgatcagcggaagtgtccacgttcgtccgacaaagaaactgaccacttacggtatggaaccactgacttagcggaccgacgaccactttcagaccaaaccaaatcaaatattcttggtatatttcgataaccctaacataagtgttctctattagcatgccaaattaaaaaataatatttgttgagtttgagttcaagaaagcttgtttttttgggcccattggtcgcgaaatatccaattagctttgaaaaaggcagagaaatcgaaagataccaacaatatttaatttggctgactatgaaaaaagaaaatattttttggtccattaaaggcctttccgctaattacccattccgattttattctactaattggctcttgcttttgggcttttcctccttaaacccaaaaattttgggttttgaggcgaaagaggtttcccttcccgcttttccattgtcatcgtttagcgtttgatgagagtgacaagttcgtgaagctgtactattccctgcccggtatttccgactccgtccccggcacaatttcgaccgatttccgtgaaaagttaaaaaaatattatatgagaagaaaattaataaagcatatgctaattgcagctctttttccattgtttgctccgacgtcaaagggattgactacgaaattcgagtgcaaggactttgtcagggtgagttggcattttgtcaagaaatgttttatttaaataaatttcccattttttgagctgttgagccggaaaagtgtgtggtgaaggtgcttatttttatgctgcttttttgaagtaaatcgaaatttaagcaaaaaagcggtgaccaattgttaattatgctgaagaaggcgaaagaacgacaaaattggggatcccttctgaaattggaaaaggaagtgggcaaaagcaagtgagtggtggtaagacggggctcgaagtttttacaaaataagggcaaaaggcttcaaaaaaatgaggttttaaatatagattttgaggtattttttaattgataaaatattcaaaacaaagttttactcaaaaataaagacagtctctgaaataagggcacttgagttctaaaattctacctctccaaataaagaaaagtcttacaaataaagttaggtacttacaattaggagtaatgttctcagttggtctgtccattggtataaaataaaaggtctcatttgttagggcgaaaacgatggacaaagagagcgacccgcaagaaggtctgatgaatatgatgaagcaaatgtacgacgacggagatgacgagatgaagcggaccattcgcaaggcgtggcatgaggcacagagcaaaaagggaacaatgggcatggacatggagccttgaagcgagagagagaacggcaaaacattcaaatattggcgttttattgatcttttctttgttggaatcggatttaatccatttttcattttattttttaaaccgcctaattaaatcgtcacaatttttcaaagggttgtgattttggaattggattgatccctcctaaaaaaataagcaagaatgtcatttagtgcaagtgtggtggcgtggaatgatcggagtcaccgcagtgtcactttgacatttattcgtccgtttccgccattccccaatctctgccgattcgtccgtccactcactgtccgccgctttgctttctcttctcagcctctctcttcgctttggctttcgtcggtggcggatgagtgcacctgctgctgtccctccccctttctttttccctttttttccgtcttcctttttctcttctccctattttccttttctttctcttctttttgaatatccgattccaatcaacaaaaactgcgaacttacaattcgatctgaatgtagaacagtagccgcagcggagagcggacggacctgcttttgttcaattttcacagctaatccatcattggttttgtaaaagcattcaaaaaatgcgatcgtatgatatgcaactctttccgttttccgaactttaagcaaatcgttgatccaatgctttctcttcttccgttctttcccataaattttatttagtaattacggaatatatgtcatttaatacatttacatccttttcgttctgtttgaattgccatgccgtcgatggattttcattctgtgcatgacccctccccccattcggcggtcggcacaattttgcctccgcggcaacacctctcgacgtccgtctcttcttccctaccccatggcacttccatcgccaatggcggtgtccgccaataccaaattcccgacaacacgggaggggtgccccttggtccgatgatgtcctcctccctccaccatttctcgccccacaatccgacggacatcgcttcggttgccaccaatccgcacaatcag

SEQ ID NO: 8500 - DNA, 1880 bp, Heterodera glycines
  misc_feature (9)..(10): n is a, c, g, or t
  misc_feature (29)..(29): n is a, c, g, or t
  misc_feature (39)..(39): n is a, c, g, or t
tgcaggtcnngcgttctggttgagcacanctttgctccncgcttgtccaacatttttagcaaatctgttttctttgtttcgaattggaattcctttgacttttgtcagatttcaactttggtgaccttccaaaaggagagcatcatcaccggttcgcgtccaaagtcggaacgcgcccttagagcagcgttaaaagtaatttgcaccaaatgacaattttgaatggcttttcgcagattggcaccgccgtcgaagcggcggtcgaacgttttgtggccgttggggagacaatcgcagatgaaaaccccgacattcagccggagctgtacgacgcgtgcaacgaggcgcgaatggcgggttagcgatgggatgtaaccccaaaatttcataaataactgaaatttgccatttttagcgatgcgatgggttttttgcataaaataaaacccaaaaaatttcataaatattctgatatttccaattctgaggttcttccattgccaatttgcacaattcgctgctggcggaggagcgcagcgccgaccatccgccggaatttccctctgcgccggctgtcgtcgtcgattccgcccaattggtccgtgccgctcgccaactcctctcatccgtcaccaggtttaaacccaacaaatgggcaaaatgtccacaacatgcaatgaatgcgtcaaaatatgtcatcgtttaattatgaattgtttttgaaattccccctttttttctcaaataattttccgtatttttatgctgtcaaattccttttcacagagttttgctattggccgacagagtgttggtgaagcatattttgagagcggaggacaaagttcgtcagcagcgattaattaattaattactattaattattagttttatactattcatttgcaattcctttaatctaattattaaattttctttaagattgcctattccttgacaaaattggaacacacggccaatttctcagaatttgttcaaattttcaccgaatttggcaaccaaatggtcgatttggcccatcggtcgggcgacagacaagaggatttgaagagtgagaagaggagggcacaaatgcaggtgatgggacttctctgctggtcactgtgtttatttgttgggctgtccccccagggaatttattttttttaattttcaattccggaatcaaggcccaaaaagctccgaaattcgaaaattacccaaaattttaaattttataaaaatgccacttttgaagaatggagaattagtcagcaccttaagaaattttttatttgttaaattttatttatgaagtacaataatatttcagaatattctcattttttgatttcgattaaaaataatcggattttcttttagataaagatttttggagccaagaaaattttttgttaaaaaaataaaggcggaaatcgttaaaattcattttttttaaattttaataaaccaaaaaacaatgccaattgttccctttgtggttggttcctcagaacacgcttccccctcctccccccccccgttcaattccaattcattgcctaattaattggacattctgcgcaggttgctcgtgctcaactcgaacggctgaccatgctgctgctgacctcctccaaaacgttgctgcgtcacccggcggacatggcctcgcggcagtgccgggacggcgtcttccaccaaattcgctctgcccttcaattggtcgcgatttgtgtgacggacggagtgatgccttttgacgcgagcgcggcctatccctccccactggacgaactgtcgcggacacgagtttggttcagaggcaaacttggcacatttgtgatggcacattcgttaaggatggcccacttgacatc

SEQ ID NO: 8501 - DNA, 2197 bp, Heterodera glycines
atattttagaataatatcgccggaggggacgaacaaaggcttcaaaatgggagcaatgagataactgtggaacggctgaaccgaaggctaaaagacttgcgaaaacaactccaagtcgtggcattggaacaggtccaaaagggactaaacgaactccactgggcggagcagtccgtccccacccctcattagaaatgaatttttaaatttgaaagggggtgggtatggacgtgcaccccatagagcgggaaatgcctcgtaaaatgcacacatctctttttttaatttggttagattgccactgttttccgtcaaaatgaagaccaggcgattctgtcctccctgaaaacgtgctcaatctccggggacatcgatggagtggaacgtttcctggaacaattccgtcttcatgccgaacatctccaagaagtaaactcactcactgtttttaaacaaataatacttcttcaaaggtttgccgtttgctccaccacatttcgctgaccgatgccctccacgtgttcaccggccatgccgaacggaatttgcgcgcactcgcaccactggtccgatttaaagcatttatttactattaatatttttcaaacttacaatttttattttccatttgaaagtaaaattccttggaaaatgccaatacaaaaaaggcatttgccgaactctgattttatgttccggtgattgttttatcactttccctgctcatgtcagactcttctcgcgggccgtgtcctttgcgtccatccatcgtcgcgcattgcccgcgagaatttggaagtgttctgcgacacttgggccataaatgttcgtctgatcagtgccccctccccctccccccaaattcaacccaattaggtcaacgacttggcccggatgagcaaggaattggacgcggcttgctccggccggttggctgccgagaagcaggcttacatgtctctaccgaggcccggcgtgagtttgcctttggtgtccccgtcgcccgtgtcgtcccgcagttccgcttgtgccgtgccaatgctgtcccataacccgagctcgtccttctcttcaattatgtccaaaagcgtgtttaactctgtcagtgattgtggggatgtggtggttgtgcatgatagttgcgccctgtcaaacacattgccaagccagcaatgtgccaaaaacatgcaaaaggcagtggaatcggccacgaacggcacgcggacgacgccggtccctttcatggcacagcccaaaaagcaatcggtgccaaattcggacagcggatattctcaaacgattgccaacgacgaaagagaaaggaacgacacatcattttcaatcagcaaaggaaaaggggaagaggaggaagagcgatcaaatgccaaagagacgacagttaatgaggggaaaagggaaaatgcgacaactaaggaaaagcatttggacgacaaagagaagaaaaggacgtcgaaacggtcaaaggaccaaaagaaatcgttttcaaaaagcttatcggttttgtggcgtcggatgagaggggaagaagcgaaaacggaggaaaatgaacggaaagagggactagaaaataaggaaaatgggagaaaaacgatgagaccaaattcagtggaaaacttaccgataaaaggacagatggatattggagaagaagcattcagcaaatcattgaaagttgaattggaaagggaaatgggaaagacgaagagcgaacggagccaaaattgtaagcggaaaaaagatgatccactttactcgaccatacaaaagtcaacggcaggggacacgactaaacaagtggaaaaggtggggggggggattaagcattcactaatcattgaccaataaaaagttacccgtccatttgcaggactcaacggagcacccaattagactaaattcagcatttactgcatacaacgaattcaattcaaaatgccaacagagaggacgcaacggcattttgccattcgctgtcacaccgccgagaccgaggagaatgaaagcaaaagaagctgacggaattggaaagacagcggaggacgaaagaggaatggtccttttcaatcggatttacgggagggaggaagaaccggtcatagttcgacagcaaaaacagaagaagagggtggactggccggagaagaggaagcccagcggggaagaagaagagcatgga

SEQ ID NO: 8502 - DNA, 5295 bp, Heterodera glycines
cccgttcagggaaaatttttcttctgggtgtcaattaattgaaaaacaaaaataaattctgtttttttttccggcaacgaatcgtttgaacttttaaaaattagatattaaaactgttaacaaaaatttgttgaattataaaaaaattttgtaaataaattttggtcacagaaaaattgattatgaaactatcccaagaaatattgtcaaatatttacgttgataaccttttgttatgttgtgatgacccattggttggtaaaaataagatttcgaatgttatttccctttttgaaactgtgtcattaccaataagggaatttgccagcaattcgtccgaagcaatttctgatctccctaatgaccgtatgctcagtggtacgatacataaatttcttggtgtatcatggaacactctaaatgacaatttgttgttaaccgtatcaccaccccctgaaaatttatgtactaaaaggtcaattttgtcttttattgcttctaattttgacccccttggactcatttcccccgtaattcttcccctaaaaatttttatgcaaactctttgcgtggaatctgtcgaatgggaccaaccaattacactaaattcacaaaataaatggaatcatctttttaaaaattgggtacccgctgagaaaattgaaatcccccgaaatcccctcactctcccccttcaaaatcgatcatatgaattacattgtttttccgatgcttcaaatctcgccatgtgtgccgctgttttcctatgtgtttccaatcccaattccgagttttctgattgttttttaattttttccaaaaaaaagttaaaaccaaacataaaggaacaaatttgactattcccaaaatggaactcattgctgcagaaatgggctccaaaatgcttaatttactaattcgcttttaacaaatatttcactaaatccatccttaacctctcagcaacaatttggaaatttcgtacacccgcagccccctggaagggtggccattatgaacgttttgtagccctcgttaaattccatatccgaaaagttttaattggtccccgtccacgtgtttagataatgaccaaataaatcactacattgctttgtgaagttgaaactactgtaaatactcgcccaataacattcgattccgctaatcctggtgacctcagaccccttcgtcccattgattttatacggccattgggctttaatgagcctctattttcttccattgttgagaataccaaaaaataccatatagaaaattttgacagtactaattcatctctaaaagacttatggcatacaattaccaaattatccgaagcctttaaatcaaaatggacaagagattatcttctttcgctaagggagcgccacaaaaaattgggatgccattcaaattgtgtaccaaaaattggggaactcgttctggtacataatgaaaatactccccgctcattatggcacctcgcaattatattggacatattcaaaacagaaacaaagttgcctaatacggcaaaaataaaaacaataacgggtcacattaccacccgttcagtcgcccatttatatccccttgaaacggaaaatgaattttgtaatcgaacatgtgaaccacaaaagcccccaatccaaaaaattaaatggacaccataccccccaaattataaagcaaattctaaaaccatcatccctcacacttccgttccaagggcgtttgtcgataaaaaatggacttgggcccttcagccaccgacagtaccccacataacaacataatcacatttccgtgcccgggagcgcgctgatcgcgttcaatgattcaatgaattttcccacagcccgctccttacgatcacatattaaaatttacacttttccatgtttatcaacttttgccccccccctttttttcctttctgccgctaacatccggcgggccagcgaatgggttttcgccttttcacacgttttcccttcccatcccgtattgtaaattaaaatttcattgaatctcggcactccatttccttataaaatggactttaattaaaaaatattcatattcttcactgtttctcactaatgggaaatattctctcgcttgagtttgcgttccatcacaacccagccccacagcaatcccaatccaacccaatcccacttttggccatcctaatccctatttttttgatttttgcagcggtaatttcatttgtctgcgtccgatttacaactcattccttgtccgttttggcctctgctcaaattcggcacatgtaaatcggcaaatctcaccgccaccgctccaacccactgaacttccgatcaccgccaccgctccaacccactgaacttccgactactcatccgctcccatcgtccctatccccctcaattattccgacggtcgtgttcctttttgtaatttttgtgctgcttccccccattcaagcgcatcccaaaattaaattatccccaaaaggaattgctaaaaataccctcccaatccttgcttcatccgccctgtatctttgccttgattccctagcctctgaacctgaaaataaaccccaatttcccatttcgcttgtgttggctatttttcctgtttggcaggaatcctccttcttatttttattaaaatcttttttattttgcgcaatcgtctttttggaaatattgccaattcccctaattccatttcctcccccgaatccatcgaacttggagaagttcgacatgccattcaagagttggttctgcgaaccaaccccccgctccgctaaataaatttgaatggaagcacgaaaggtgccaaaattgtccccaatttcgatccaaaatatccataaacacttaaagcttagtccttttaaccctcccaatttctctgacgccaatatgccgactgaaaccgatccatcccaaatcgacattacccagaattcactattgtccgttgtacccagccttgagtcatccctcccccctgaaattgccgacattgaattgaacccccgaactccggacactatctattcttcatgccctcccaacacgagaccaacttctccgacaaacatccccaccgaattcgttgttacaattccttcggatgaggtaagttcgactcgtgaacgaatccgaggaccatcaccgccgaccggccaatccatcacaaaatccaagtggtcacaggggtcacgggtccacaaaattcaaatttcattcaccccctttcattctcccacaattgctcgccgtgctcgtcctcgcatcatctctcgtaccagagtcggaccgcatggccaattgcagcactttccgatgagcactcagcgaataccagtccggtccggtccggcatttttgaaaattccgatctctaataaaaaatgcttttttatgcgttttactcaggagaaattaatttgaaacgcaatttaagtatttttggagatacatttttggtcaaaatatgccagattttttgaaaaaagtatttgttaacacttgttttttatgcagatttatgttttataagcagtattcggatttatatgtgctaaaaacgatatattttagcaaaaaaccaccaaaatatttgctaaaaactcgaaaaggctaaaatatgtgtctacaattgaaaacaaattgcaatttttcaaaaaatcgtatgccttatccattccactagcataatttaaaaatccaaattatattgaaacttttcaaggacgaagagcaacaacatttatgtggtcaacgtgggttgacgacaaattttacgaaggggtccttagttggtcgcaatgctcgaccctttccttgacttcgccgcttcctttgattttctaaaattttttcaagaaaaaattgtcaaaaattttttataagaaaatttctcgaatttgaccgggatggacggatgccagattatctgccgctgagtgaaattaatattatattcgtgatcagcaaccccgaaaaccccagaaaaaaacaaaaaaaaattttttttttgtgtggcgtaaagagaaacagtaccgatttgaaaactttttatttttttcggcggagttttgtcccgctccgaattctttaccattgacgaaaaaaatcattacgccatcccatggaaaagtttctaatgaaaattgccgatttctttctgttcagcttggtgctgatcaacgcgctgtacttcaaaggcacatgggtggacaaattcaactcaaaatgcctgggattgcttttagtttgtctgctactattaaatttctggacgagtgactgtactgttttctcaagtaagctttacctaagcccaaatacttttcgaaaaaaatgtttttttgttttctgaagtcgtgaaaaaatatttccgagggttttctgggtctctgatcacaaatccggcattcatttcgatcgattcttaaacctggacccaaatcgaacaaaaggtcggaaattcaatttttcgattttccattagtctaaaaatggtccaaatgattgaaaaccgaaaaatttgaattttcgactttttcttcgagtttgggtctgggtttaagaattgatcgaaattgtctgcgccatatttttatttagttattaagaaattaattatttttggttttttagggatttggcaacaccgctttttagtaagataaaaacttttgggggattaattttttgtcacttttccattttttctccaaacattgctaatctgggcccgtatactgtgctccgcccaccccgatggcgccgctatttaagaacgatgtgccaatgactcgcgtcttgcttttctcacttttgcttcgctgaacatccacgacgaattttctcacccaaattttgccgaattcatttaaaataaataaaacaaaaaaatctcatttgttcacattttcccttgtctgtcccttgctttaacaaatttgggcgttccgacatttggccctttgccttcccttttgtgtctttgcttacaattagaccaattttggcatttgccatttggccgcctttcgctttcctctttgcgttgaccaattttggcgttctgcgatttggccatccctttgcctttttctcgcctttgctttggccaaccctttgtcactctcgccttcggcatttgcctgctttttctcgccttcgcctcggccgactcctttggcttttcccttcggacgccattttcaatccccctttaccctggtcagcattcacatgcctcgggaaagggaaacgtttt

SEQ ID NO: 8503 - DNA, 992 bp, Heterodera glycines
ttttttccaactatgtccgccataattcgccaacaactccaccctttgttgttggatattttggcgtatgttgccctgggaccaccattcgaggctttgcccaatgagctttgctcattggacgccaacagctcaacgagagaaaatctcgctcgtactttggcggtgacaaaggatcttttgaaggagtggacatatgtctactttggaatggagtggcccccccctctcttttccccggccaactctgtgtggccaagcatctctccaattgcacattttctcggatgcgggccctaacactttttctgccgctgtttacctgtgcgccgaacaaaatgggtgcgcgaaaatcgctttaatttttgcaaaatcccacctaagacccaaaaaatttaaaaattatggcttaaccatccccgggttggaattgttgggactcataacggctattcgtgccaaaaatttcgtgatttccaattttgaccgacaattcgaaaaggttcatttttgggtcgattcacaaatagttttgtcttggttggccagtaacgcccatcagcccatttttattgccaattgaatttctgaaattaggcaggaaaaaggggccatcttcaggtacgtaaggtccgcagaaaatgccaaaatgccacaggccgagactgctgagctcatttggagagccaccctcctggtgcccaaatcagcggaattctcggcagttttttagcaactaaaaatatcatccctaattaaaatatggcctaggttaatatttcaccagcagagtgccactgcgtgtaaaatcaaaaatctttgactaaattttaaaatcaataaataattggtttctctttttacgcggaaacaaacggcgcacactgctaacgagactaatccaaccttctatatgtttgcaattaaattataattaacccattttaattaatggattttttctatacaaatctcatcgccgattttcatat

SEQ ID NO: 8504 - DNA, 5218 bp, Heterodera glycines
ttgtgccaattattgaccaattcagcggagaatgggaccgttcggaattaattgaaaaaatgaagaaatgtgttgatgtttttgtactttgactgctcgacagatcttcttcaccaaccaatctcaccaatttcttaatttattcatttctgtactgtttgtcaattttaaatttgaaaattaacatcttccattcattaaattaaagaaatatctgtaatttaatctgctgctggttatacccgtttcaatatgcaatggaaatatccccgttttttatatagtcatttaaatcggtaattactaggaccccgttacaatactgccgatgttatgcaggtttttcgagacaagagaaaaagttcgttctagagactttttaagggttggagaatccgagacgggctctcacttggcaaatttatctttttaaaaaatattttttggttttagtttcttattaaaatctgatttcggggttagaaatgggacgaaatggatgttggaattggattctcagacgccgaaaaccttaaaataattatctctatgaaacaaaaggtttccctcattggttttcgatcaaaactatggatttggcaataatttttaattttatggaaaaaaagaaattgggtaagaaacgagaaattgtgacaatttccattaaattcaaggtgtgtaattaaagtcaaaaggcgaaaatttgcattttgtttggacaagatttttaaaaaaaatattttttggtactttcctatatttgaggccacacccaaattttaaaaaatcaacaaaagggcccgcaaaataatcaaggcgcgcgtaatcctctctctagtgaggagacataaatgcaataatgcacataaaatttcgtcatgatcagctcctctgtgtttgcagtcttcacgccagagaaattcacataaataagaattgaatttttgggtgtggcctcataacaggaaggtacctatttttttataattttgaatttaaattttaaaaggcattaaaaaggtttatgcaaaatagaaattacaaaaaaaaaaaaaaaaattgcataaatgaaaaaactagagttgagcgggaccgggaatttttagcaaaaccgggacctaatcgggttgaaaaaccgggactttttgactgggaaaaccggaaaaaaaccgggactagtcccggtcaaaaccgggaccttggtactcagttgtccgctaccaggtcccggtcccgctcaactctagaaaaaacccatcaaattaaaaaaaaaacatacaactaattgttgtccaactgttacgccccccagtcccaaatgaatggacatacgatgaaaagatgaagcaaagaaagaaagacagattgtccaaaaaaaggattttttgaaatgatcggtgatcaacgggaaacattttcgctaaacattcgttgggttgggttgtttgttttctttcttccgttctctgtgctgtatgcagttccgctgctgatcacaagaaaatggttgtatctttttcaatgccatatctattcaatgtttctccgtccttaattacaccgtatgggacgcgtctaatttgtccgggcacaatgccaatcttttgtccgatcttttgcctcagtgttgccacagtgtccgtgcccttcacttcaacggtatatgatttgtaaccatatcttgcgaatatttgaaatacttcatcatcatcatcagcgatggatgaagagggcatcatcaaaagcattgccattattagccaagcagaagcgatgccaacggcggagagcagtgaaaagccaaaatgattgttcttcatttgggcaaatttggtgacaataagaatgttaattaatgagtgaatgaatgtgggatctgttgcttcgtgataggtatagggctgggaatttaagtcacgaaaaatctccaaaaagtggactaaaaaagccataaaaaatcgccaaaaagtcacaaaaaatgcatgttagaagcttcaaacaaagtgtggaacattttaaagtcatttttaggccatttaagatcagcaaaaaaaaagtcagttgacttaaattcccatctctagtgatcactttaatttggcaaaattatagtgaattggcaattgaatgatcactttaatttgacataattatagtgaattggcaattgaatgatcactttaatttgacataattatagtgaattggcaattgcaaaatatgtatgaaaaaatgcgaaaaagtcagaaatatgtataaaaataagtactatgtaatatatatgtagaaaaaccctgaaatatgtaaaaatatgtaaataaaagtcccagcttttgttcacaaacacaaaaaagaaagtgtttttcctactattcagagcatggagaagccaggaaaaaaaaaatgtatttacataaaattggtagccctagcaattatagtacatgctcatttttgttcaaaaattcaagtgattttcttaacaaattgcatttctaaaacctaaagtttcgcccagccttgttcccaagtgattatgatatttttttataaaataatttcattttctggtcaattattattattttcattttttgccatttattacttttattgatcaaattcaatttataattttagcatataagcatgccatttttctaataatattggaggcatttctttataattcatgcccatttacaggcacattaatgcgttggcttaatgccattaaataatgttagatttgagaagaagcaaaaaggcaaaaattggcataatgccaattccatggtctagattttgtgactgtcttttcacttatccaattaaatcttggtaatatttaatttttgtgtcaacggtgtcaacaggcgcggccggcaaatttcagaaattttgttacaattttaaacgattttgcacctaaaaggaaaacatttttaactttttagtctatattttagaatagaagataatatttaattgtttttaatttttaatggtaggtaattttcgtaaaataaaagaaagactggaggtttagtcacaaggttatatgtttctgtacaaaaggtggtcaaaatatgtacataaatatgtaagaataatcccgaaatatgtacaaaaaaaaaaaccaaaatatctaccaaatatgtaaataaaatttttaaaatggttttttttttgcaaaaaaattcttcttaatgggtgaaataggcacaaaatgcaataaaaataagctaaacagtcttagaatcacattttaatatttataaattaattttttatttttatgggtacatttcaaaaaataaagaaaatatttacgaaaaatttgccgaatttttggatttttgaggatttcgaaaaatttccgtagtaaatcctcaaaatatgtaaaaaaaaaaaatgaaaatatctaagaaaaaaagtccaaaatttgtaccaaatatgtataaaatccctaaatatgtaaattcccaacatttgttagcaaaacacaaaaaaaagcaagtgtttttcctactatttagagcatggagaagccaggaaaaaatatgtatttacataaaattcccagccctacaaatcagtaattaattaatggggcccggtatttttatggatttacaccaaagcgcgcatcgaaactttgctagttctgccgatggtagcttttccgagacaagataaaattgttgaagagattttcagagtctgggaatccaatccgcttctggtgctggataagtcggttccgccccactttatggcaaaatttgttttaaaaacaattaattttcgacttgttcgagtctagcttagggggttagaactgggtcgaaatgggtgcagattcggattctgcggcccttaaaaccctaaaacgatcactcgaaaaatcctattttgtcaaagttttgcttttatcattctttaattttataattaatttttaactcagtaaaagtgtgtaacacttacctctgtgaagaatatttttctttaaaagagacatcttttcgcagtgggacacttgcggacggacatttgcggacaatttcgggaaaaaataaaaaaatttcgtaaagaaatttttaaaaatttctgaaaatatggaatgggactgaaaactaaataaaactttgtttttgggcttttaggcctaatattttatttttacatttctaagaaattaatttcactactggtattttaagtgattaaaaaagtaaaattggtccccaagatcggggatgtgaaatttttccaccgacattttttaaatttctctagacatacagacaaatcttgttggggaatttgctactcgccccctgaattttcttttccttttgttcgggatggagaagaacccaagacacataagtcttgctctacttttcatcagcagggaaagcatttgaggccccaaaaattttcaaaaaaggaaatcggaaatctgatgcccaaaaatgtcgggaatcagattttagtacagctgcttagaatttattatttaaatccaaatctttttaatttaaatctagcaagacaatgctcttcatttttgtggctgtggcatttagtttcatcctttattattatcattcaagcagttaaaaattgtgctttaaatttaattaacaaagttttaattaagatttttcttatttcaatattagtattatttgtaataaaaacattcggaaaacaattttaataaagatttaaaattgaattaaaaaggatttaaagttgtttttgaaaaatatttttttctttttacatttaaataattatttgataatcaataaatcttttgtttattcaaattcttgattattttaattttaaaatttaattataaaaagattagttatagccttttcattttaactccaattgtcagtgttatcacttcttaaaataataaattttaatctgttttatgaaattaaaataatttttataaaaatattttattaattgttcaaacgaatttaactattccaataaaattaattattttttattacctgatatataattatcattttttaggataataaattttttaattaattatttattatttatactgacaaaatgtttatgttgtttctcatgttagttttttcaaaatataactttccttttaaaagaaatacataatgatttaattttttttcaagtttaaaacgactct

SEQ ID NO: 8505 - DNA, 1148 bp, Heterodera glycines
cgcaaatgtccgtaaggccatcttttgctcaaatgaaagaattggacagagggcaaaaacgcaggaaagactgggaaaattttaaaaccacatattgtgagcccacccatatttacaaaattgcttttcaattagacgatttaaaattacaattaaattattattattttttcttttctccaatttctattaataccaaatttggtaattttatggaattgggagtcgaaaaccaaagggcggaagagggactttttgatttgtaaaaatgatcggtgatcaacgcgaagcattttcgctaattattcgttgcggcattcttttgttttctcttcttccgttcttgctgatcacaaaaaaatggttgtttctttttcaatgccatatctattcaatgtttctccgtccttaattacaccgtatgggaagcgtctaatttgtccgggcacaatgccaatcttttgtccgatcttttgcctcagtgttgccacagtgtccgtgcccttcacttcaacggtatatgatttgtaaccatatcttgcgaatatttgaaatacttcatcatcatcatcagcgatggatgaagagggcatcatcaaaagcattgccattattagccaagcagcagcagcgatgccaacggcggagagcagtgaaaagccaaaatgattgttcttcatttgggcaaatttggtgacaataagaatgttaattaatgagtgaatgaatgtgggatctgttgcttcgtgataggtgtagggctgggaatttaagtcacgaaaaatctccaaaaagtggactaaaaaagccataaaaaatcgccaaaaagtcacaaaaaatgcatgttagaagcttcaaacaaagtgtggaacattttaaagtcatttttaggccatttaagatcagcaaaaaaaaagtcagttgacttaaattcccatctctagtgatcactttaatttggcaaaattatagtgaattggcaattgaatgatcactttaatttgacataattatagtgaattggcaattgaatgatcactttaatttgacataattatagtgaattggcaattgaatgatcactttaatttgacataattatagtgaattggcaattgaatgatcacttaatttgacataattatagt

SEQ ID NO: 8506 - DNA, 2898 bp, Heterodera glycines
cgattgtgtcgttccaatttttccctctcattttccattaaaaaatttctccaatgttctgttttgtttattcaacatcaaaacaattgccgacctccataaattgagtaaattttattcaattttattttacatattaatttgtcagtttggagttttgtgaaacattttggaatttctttggagggaatgactgtttcagtaaaatgaaaagagagtgggggcaaaagagacccgtctttttgtcggttcgaatgctttgtcttttttggccttccgtttttcactgtatcgttgtcctcattctctgcccagtcggcttctctgtcctttcactgcttttcctcgtctcaatgtacgcttcgtctttactgtctcgagtataatgcaccccgggcaaactcagcacagattcctacaattgccaaatggaagggggggggggtactgtactgagaaaatgagcaattgtttcatactgtgtctgggagggagaacaattgtgcgggaaaacagttcagcatcggatggcgcattgcatcgatggcagaaattctgtatttcccttcgtactgcaaaacgacggccaattaaatgactaatgaatcatcccctggggcaatactaataaaaatatccccaaaagttaaccttcaagagtttgctcaacaggtcggcacgttcgggcgaaattcggggagggttaagcaacggtttggcattgtgttgtcgaaattggccatttttgaaggcctggagggcgcaaatgtcggcatggaccgcgggagagggcgtgccgagcttttggaagatcagattcaattgttcatcagttgtgctgccggggaacattggctgaacaaatgggcaaatcgaattaacaaaaaaagaaaaagcgatggcgacggaaacggcactttgtggagaagcatttcgtagagaatgcatccgacgccccacaagtcaatgtgcgtggaatagtccgtggagcctgggaaatggcaaatgaaatgccaacgccgcgggggaaacccattggccaggcttaccgagcagcacatcgggcggtctgtaccacagagtgaccacttcgttagagtacgttttggtgggcaccgactgagcccgggctaagccaaagtcggccaatttgagttcgcccgtccgattgatcagcaaattctgcggcttcaagtcgcggtgcaaaatccgccggcaatggcaataggccaacccgcgcaaaagctgcacaaggaacagcttgacattggcgatgctgataatcccgtccaactcctccatgtactccctcaagtcgcgctccacaaattcgaagaccaacgtgagaatcctaacggatggacttttgggtgagggcaatgagagataagaagggattagttggtcattctgcgcctcaccccccccccccctttggccccattgcttttcgtgggtttaaatggcaaaatgccatcctaaaagtgtgccgtgtcacctgtccgtgtacacaatgtcgtgcagcgtcacaatgttcgcgtgtcgtaagtttctgagcagtgacacttcccttattctgaataatagggattcttttcattttcgtccatttcactaatctccccatcatttcccccatttatcccctccaattggcttttcctcctccccccccctttttcccctttcaacgtgtgccatcggcggtcccttacgctgtgcacggcgcgccctcttcgtgttccaatcgtatttccttcagtgccacgtttttgccagtcaacaaactcttgcccagataaaccgtcgcgtacgttccctcgcccaaatcgaatatttttttgtacgtctccaatttgccgaatccgatttcgttcagcgacgcccttttgctcttccgcgtcaacggattgtccagagttggcgttctattcaatttgtcgatcacattttggggcagacgaatgtccggcggaagtgacagtcgcttttggatgtcttgctaaaggggggaagtacagcttcacattcacggaaaggccacgatcagttgaaaggacgagactctcgagcactgtccaacacaaattgttggcattttacgaagtttcaaatgatgccattcttttcacttttcattttttcctcattttctttccttttttccttctttcaccaattattttctgatgatgataaacaagaatcgcattctctctcggagattattatgtaaaaaatattctttccacgtcccatttaattgagtggcactaaattaaatcgaaaatgttttaattggggggggggggaattggaaaaaaagggggataatggggaggaaactaatgggggggggggaaaaccccggaccaaaagtgtgtagaaatgacgtcattcattgcaacgcgaaattaattagtgacagatgaatttgttaataatcccccaaattggccaatgatttccaattcgctgctcacttcgctccagcgtcggttcggcttttggcgaagtttgaccttcggaatgtattccgtcttcgtcgtctgtcgcccctcccccaaatttccgtctccgccacccgccgactgatcgctcgtacacggcgacacttcgatgctttcgccgtccgagccgagcgcactgctctcgtggacaacggctaaacaaaggcttattcttccgctgttccgtccgtccgtttgccgtgccaatcattcgccatttgccgccccccccccggcgaaaagccttacagagagagacggacggtcggagcggtcctccgttgggcccggcgacccccgcgtagcaactttggtgcatttggtgcatcgtccgactccgattggcgcccgttgctgccgcaaagttaaaatagcattttgccggggg

SEQ ID NO: 8507 - DNA, 1045 bp, Heterodera glycines
ctcgctaaaaatgaacagttcggcaaaagagaagtgacctcatccctcttctttcttctcactcccgtgccttctcggtcccttttccccctcttccccttcttcctccctcttccttgcctcttctttttcatcagtcctttccccctcttttttcccctcttcccctactgtctcttcttcctcacctcctcctcctccccctgctgctcctcttcgtccatctcttcctcctcttcttcttcctcctcaattcgtcctctcgatgacagcttcagctggcccatctctcgctgagtcaactcacaaaaatcgtgaaatgtgatggattttgataattcgctgccgccggcacttccaccgaaaattcggctttgaggacccattgaaagtggcggcacaaaaggaaaggtcagcgaattgtgaattttgcgaatttggcaatttgatgtgtggcgatctctgatctttcatccaattggcccaaagaaataattacgctcctttcgccggcgtttttgccgttagcgttggcatttgccgttgcatttcttcaaattgaggggggagggcaatgaatgttttagctaattatcgcgacaaaatggcgccaatgtgtgcaataaaattaggagaaagggagggggaggggaaggctatttaagtatttatggagaagtgccatgaaaaaccgtttaagtgagagggagggggagaaagaacggaacaaatgcatatttagtgaattcctaatggaatgaatggacttaaaaaggggaaagtgcgtgtcgagagtgttttgttgtacaacaaataatggggaaatgttttgtcctcagacgcgacaaaacttgcccggtttgggaaataatgggcagaagagcaaaaagagagaaatgcacaaaattggggggggggggataatgaggggacggaatgattaagaaaaatgtgacaaaaggggggggcaatgggggaaaatgggagaaaataaaaatgaatgaatgaggcggggaaaaggcacggcaatgggtttggggggggg

SEQ ID NO: 8508 - DNA, 1884 bp, Heterodera glycines
  misc_feature (283)..(283): n is a, c, g, or t
atgcagcgggtcagacgaaattggggagagtggaagaggaaaagggaggggaggggggagaggtggtcaaaacggatgaaattggggaagggtcggtcgagtcgaccgtacggacggacggacggacgaatgactaataaatggaaggatggagcaaaaaatagatgggatgaatgaagaatggaaacgaatgggcgaggaaaagtggcgttcagtttatgccaaatttgccccgtttaaatagcgacaagagaagaagctcgcagtcgcctcttcccccccncaaattggcggattgccgttcaatttgaagatcctccagtaatatgccatctgacaacggctaatacaaatttgaagtgatgcgggaagaggtgacgcagaagggaaggggcgaatgattttcttttctccggccaaacatttccggcccagcgcttggctgagtcggtgatggacggacggacagacgggcgaaggacgaggacgagattgaggagggacgggagggaggaggacgggaagcggcaaaattgtccgtgacaagcggcaaacactaatttggacttggtggagaccaacagacggataagggagagaaggaaaatgggaggagtgaagagaggaagcatggcatggaaagaaaaagaaaattatacaaaaagaggggaaattaaggggaagagaggagatgaatgggggagaaggaggaagcacggaatggtaagaaaataaaatgatacgagaaaagggaagggagggaggaggcacggtatgccaagaaggaaaggagggaagaatgggaaaaaggggaaagagagggaggcgggaagagaagagatgatgagagagaagggaggaggcacggaatggtaaaaacgaaaaataaggaagagttgaaatgaataaggaggggggggggcgatgtccgctcttcccgacattaggacagaggaaacacaaaaaaagcgaaggaggatggatgaataaaaaaggataggggagcacagggatataagggatttgtgggaagcaaaaatcgatgaacaaattttgagaggataaaagccgatttatgggaagagagaaaggaaaaagcaatgggaaaaaagaaaaggaaaagcggatgaatacagaaaaaagggacgaaaaggaaagaagaagggaaattcgaggagaaggcgcatttggaaaggggagagattttggacgaatttgggaaggatggaaaaggggagagaaagggcgaaagggcgggagtcccttgggatatccatcccatgccacacaaaagcaaaataacctttccaaagccactttggcacattgcgaccatcggcccgggggaggctttatttgccatgggcaaaaggtctcctggcaactcaatccatcatcagcagagggagggggaggaggagagggaggagagactgttgctcggatgcgagggacgaaaagcggcaaatcccttcggcgggggacagtcattcattgacaaatgagcggagagtctgtcaattttttggacgggggaagaaaggaaaattaagcgaaatgagaggcaaacggaaaccaattaataaattaggcacttggaaattcatgaaagagcctcggtggatgaatgttaaaagggcaagcgaagtgttgaaaagggcgacgggggaaacgccgagagagaggggggagggggaggggacgaagtgcgcaggttggcgaattcggagacggaatcccccgaggggcgcgagcggccgacgaaactgacaatgacggacgacggatgggatgagtaagtgcggcggagggaggatggaggatgatggggcaagggaagggtggtgggggggaggagagtgaattatatcggtgaatgagaat

SEQ ID NO: 8509 - DNA, 5011 bp, Heterodera glycines
tgaatttttgcaggctaatagaggcctcttggggctctcgaatgataccaagaatgtttaatttgcatgtttcttgaaaaagctatggagaattaaagttgtcaaaatattttatggttgtgtgaactacaatagagccattatttttggtccatcaaaatttggactaattaagcctcgaatttttttttgcaaaatatatttttacgtggaatttattccgcctgccaatgtacctgttggcattggtgatgctaccaaaccaatggtgctgtgacaacaaaaattcgctgcagtcgtcgagaaaagtcgtcttggggcgaaaaatgaaagatttaaagtcggcattcaataaaaaataatcgatttgcaacaaagtaaaaaaaaaaattaaattagtaagttaattataaaaaacatttgaaaaataagtaatttaaaaattttagtgaaattttccagttttttaaaaagtgactttttgcctagagaccggggcgggaccggatcccgcgtgggattttgcgggatccaagttcgtaataacacattttttggaaaatgcgtgatttgcggggttaatcccgctgaatcccgtcccgcaaaattttggagttccaatcccgcatcgagatctgcattttggtttttgtgcgaattacattttttgaaaatctaaagacataatgccacatatttttgaatggatttattaaattcaattaaagaaacgcatttttagcggtcagggtcgttttcgtaccgccgttttcgtacgggggacattttcgtacgagttcttgtacaagcgtcagattcaattagaaaaacttatgactaactaatcaaaccaaaattttatcattttttaatttcccatccataaaattttgtagaaaattcataactttaacaataacaaaatgggacaaattagggtcgcatctcatagtttcgggaaataccggcgagaaaattgttaatgttttcgggattcacattgggattggcataattgtgattagagaccggaaatttcaaatttgcggatcctgttgcaggattggaattcaaaattttttacaggacaggatccggcaggattaatcctgcaatcctgcatttaaaatctgcaggatcctgcgcaggattgcggattttaggaaatttcaaaaaattctgtattaataaaaaagtctttcaaagtataaaaaagtattcaatatatttttaaaccaaaaaatgatgaagatgaaaaattaataacgtttttttgcttacactccaagcaatcgactgattcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcacgaaaatagtaaaaaaaaatttttattaacgctttttaggtagcaaaacacataaaaaattcaattgtataaacttttttcgaataaggataagtttttaaacgaaaaatttttattagaaaaaaatttttgaaaaaagaaagtttctgaatatttggcattctttttttttaaattttcaaaaaatcaatgcaggatcctgctgaatcctgcataaaaatcaaatttgcgggtcctgttgcaggattggaattcaaaattttttacaggacaggatccggcaggattaatcctgcaaatcctgtattttccaaaatatgcaggattgcagactgggatcctgcaaaatcctgcgcaggatcctgtcctgcgccggtctctaattgtgatcattttgggggacaatattgacatcgttataacgttggacgagacgaagaatccgtgaatcggcatcgcgatacttccttttcttttggggtgcggcttctcccatcatgcaacgtgccatatcagcatcaagcgccttctgctcacatctgatcgtgtcaatgaatcgccaaattgttggatgagttcagctaaattgccgataaagtttccgatggaatgcctcggcgaagttgttcgtccgatcagcaccatccaaggtgcgctgatgaacattccattcgtgtgggtcaaacagaggtgcgtcattggaacattgaagcgcattctgcccgtgtagttgtctagaaacctagaaaaaaaaaaattcataaaattcgtcttcggacttaaccaattgaaaacgccattaagttgtggctagtgtaaatgaccattatttaatggtttaaacggtaaatgtcttaccgttggggtccattctgtccgtgaattttaaaaacgccagtgtccgccaacaggaattgctcctcgtcaatctcagtgcgcttataaacacgatatgtattcggaatctccaactgctccaaattgagaggttcggctcgcggtgcattttcatcacggcgcaaacgtttgatgacctgaataaaaagaaaacaaaattatttacaaaattgtttttgatagtaacccaccttttttgtggcatctttgctcggaaaagaggccagcacaggtgtgcatgtgttttgaagcacttgagcacgaatggtcgcaggtgcttttcaaaatatgtaaaaaatgaaaatatatatgaaaaaatccaaaatatgtacaaatatgtaagaaaatcccgaaatatgtaaatatgtataaaaaccccgaaatatgtaaaaatatgtaaataaaagtcccggtttttgttcgcaaacacaaaaaagaaagtgtttttcctgctatttagagcaagaagccaggaaaaaatatgtatttacataaaattggcagccctagtgctcagttttcagcacaaaaaatcaccgattaagcactataacagcataaaatttttccaaaataagcatgaaaaaagcacaaaaaaggcaaaatcagcacaaaaaattggaaaaaagcataaaaattaagagattaaaggcaccaaaaattgaaaaaagttgtcaaaaaacctttgtttgctccctgattataaaaaatctccaaaatatgtgctaaaaatggtaaagagtagagcacgactaaaaaggcaccaaaaatcgcgaaaaaggcactataataggcaccaaaaaaatttaaaaaaggcatgaaaatccctaaaaaggcatgaaaaaaagcatttgaaatttttctattaaggattttagggagcaaaactcgtaaaacttaatcaaaaaaatttaatttgggtcatttaaatgattattaaaaattttataatttttttcgaataagaaaaattttttaaccttaaatttttatcaagaaaaaaaagaaattttggcgatcaatttttgaaaaatttttcaattcttagtggtgtattttctaaattttttttttttggtcatttcttagggtgtatttttcttttttattgcgtctttgttaaggaattttcggaaaaagccaaaaaaggcatttaaggcacgaaaatcccaaaaaaggcataataaaagtctaagtagaagcctcaaaccaagtgaaaaatgtgttatttatgcttaatatatataaagtagtacggagaaaaaaaaggcatatgcctcaaaagtcgagctttaaaaaagcaaaatcttgtcaaaaaaataaaataaattttggtttcttagtggtgtatttttctgaaatttttcggatcgattcttagggggtgtatttttcgtttttattgcatttttgttaataaattttttgaaaatttctgaaaatattttaaaaagttgctcaaaatgacgaaactgcacaaaaaaagcaccaaaatgccaaatcagcacaaaaaatcgggaaatcagcaaaaatcagcatgaaaaaagtggacttagaagcctcaaaccaagttagaaatgcgtttttcatgcttattattagggctggtcgggaccgggaattttgacaaaaaccgggaccagaaaagtcgggatcgggaccggaaccaagtttttcgaccgggaccaggaccgcgagaaaagccgggaccgggaccaaccgggaattttcccaagagaaaattttttgaaaaaattttgaaaatttgagtgcactttgttacaaaaatttcctaaattcaaaaatgtgcccagaagaattttaaattttcttttgggggaggaattcgaggaattttctattattctctgtttcatttcggggggggggggatctggaatcttggaattttctgggtcccaaaattctggatttttaataaattaaaatttcttaaactttttcttttaatcgctgtaaatgaccaatatttggttaatttgttattttttagcctgtttgaaaattaaataaaaataaaattggaatattttattttttaattgaaatttcaattacaaaaatggtaaagaaaaactagaaaatattctgctcaagtggggaattgaacccaagcgaaaaataatgaaagacagaaggtttagccactagaccacagaaagatgtgaaaaaaaggcaataaataaaataaataatttatttttttttctcaaagatttctccttcttcaccaattcccttctattttctcacccagaccccattcttaccagtgcttgtttagtcccgccgggaccgggactggcaaaaccgggaccgggatttctgtttttccaaaaaccgggaccgggacctgaaaaacccgggatttcccgccccggtcccggtcccgaccagccctaattttattgcattttttaaacaaattttgggcaaaacgccaaaataggtgaaaataagtttttaaaaatttttttaggttttttagttgctaaaaataaaaacctagaaaataggtgctaataactagggttcagaccccgcccccgtccccggggacgggacaggtttttagggctcacccccgtccccgcc

SEQ ID NO: 8510 - DNA, 2421 bp, Heterodera glycines
gtggacgaaaaagacgaaaattttgaaaaaagaaaccatctgacaaacattgtcagtgttccgtttaattgaataattttcattttttgtaattttcattttttaacgatcaaacttaatgcgatacatataaacttaatccttcttgaacaacacagctttctttttttatgttatgtacaaaggtgtataaaacattttattgcaatattatttattttcaattttgatcattatttagagacagaagagactgtttgaattcaaaatgcaaaatcattgacggtgacgatggttttgcaccagggctggacgtaactgattttcaattacggaaatccgtaatccgtaattacggcaattttttcagttacggccatccgtaatccgtcattacagaggtccaaaaaggccgtaataatagggctggtcgggaccgggaattttgacaaaaaccgggaccgggacttgccgggaccagaaaagtcgggatcgggaccgggaccaagtttttcgaccgggaccgggaccgcgagaaaagccgggaccaaccgggaattttcccaagagaaaattttttgaaaaaattttgaaaatttgagtgcactttgttacgaaaatttcctaaattcaaaaatgtgcaaagaagatttttaaattttcttttgggggaggaattcgagtaattttctattattctctgtttcatttcgggggggggggatctggaatcttggaattttctgggtcccaaaattctggattttttaataaattaaatttcttaaactttttcttttaatcgctgtttttgtggcgctgttttccaaaaaaaaaacttttgggaacattggtgagggggcggcaggatccggaaaatttttgaaattttgagtgaaatatgttaacagaatttgtcaaaaaatgaccaatatatggttaatttgttattttttagcctgtttgaaaattaaataaaaataaacttggaatattttattttttaattaaaatttcaattacaaaaatggtaaagaaaactagaaaatattctgttcaagtggggaattgaacccaagcgacaaattatgaaggtcagaaggtttagccactagaccacagaacgatgtgaaaaaaaaggcaataaataaaataaataatttttttttttctcaaagatttctccttcaccaattcccttctattttctcacccagaccccattcttaccagtgcttgtttagtcccgccgggaccgggactggcaaaaccgggaccgggatttctgtttttccaaaaaccgggaccgggacctgaaaaaaccgggatttcccgccccggtcccggtcccgaccaaccctatttattatcacgctccaagttagcaaaaaaataacagcatatgctgcaaaatgagcactctactcattttccatcgcaaatttcatccaaaagacttttgcgcaatttcatgtataacttttttggtaattgtctaatcgcgaagcaatagcttagaaatagcttctaaacatgttatgctttcgaaggataccaacaatgttggatttggatgacaacaaaaaaagttatagtggaaaaactgctggggcccaaatatgacgacccaactgaggtagacctggaaaaaaggcggatttttaatttttggttttcgcacatctctgttctgctggtgcccatggtgttggcagacgccaccgttagataatttgaaaaattattactctatgtacagtattttaacatactttactccaaatggccaatttgttggtttttggtcaaattttgaaaatttttgtggaattttcgaggtcctgcggcgcataaatcctccggggaaaattaataaagcgacacctaactcatttctaaggatcattggatgaagcaaatccgccgagcctgctgaccctgataaacaacgaacacgacatttctcaaccccgacgatggtgggcttgacttcgttcgaatcaatttataaagttaaactctgacaaatcgtataaagcaaatattatacaattcattacaattatatttttacttatttgcatattctgtatgccttgccaactgtcaatagctacgcattaaaaccactctctgccaattctttcttcaatgttttaatgcatagcgtttatttcttatattttatttcagctatatttttgcgcttttccatattctgtatgccttggcaataataaaagtcattagccacgtaataaattcaatcctctgacataaattgtaatacgtcactaaatctgttaataaaataagcaatttattcgggtaaaagcaaggcaaaataaagggaaagaatacagcgcaaaattcatttttggcatctgcaggacccaggactttatttcatttgagaattaa

SEQ ID NO: 8511 - DNA, 2468 bp, Heterodera glycines
  misc_feature (2385)..(2385): n is a, c, g, or t
  misc_feature (2436)..(2436): n is a, c, g, or t
attttcattcttttttcaatattcctaaaatatacctccttagattggaatcccacaaaagcctgctcagaattacaatcggtgcctgatattatttttaattttaatctttgttaaagatttcgctggcggctgttggcaaaataggcgctccgaatctgcacaggtgttcattaattttctgtcatagctctgccaatctatgaatggagtgagcaaggtttaatgaggaaaacgagatactcgagccttttaatccatgaaaatgtataatcatattaggtgtaatctaataaaatcattacattaaaatgaatttttggacaaaatttgcgattttaaagctttttgtttttacatgagtaatcaatatcttaatatcgtcccgatctttttcaatgccttaagcttggagattttaaaaggtctaagttgggaagtgttttcaattatctagacatattcaaaagctgtataccatcttatgtcacaaaaaaagcatttttaagggaagaaaattaatattataatttaaacattcaaaaatgtaaaacggttaaaatatatattcaaaagaaaaggttcgggaactcaaaaggattgccttttcatattaaattatttattgaaatatttcaaatttttaaatgcaaaaacaataataaattacgttaaagagttaaaagggaatcttttaccagagcattatttgtatataaattagctcagcgggaaaactttagatgaaaatcccctacaattgagtttgggaattcaattaaatttgaaatagaaagaataacaacgagaattacgtggcaaagacataagagtaattatttttaacttccctaaatccaaaatctaaaaataatgatgaataacagaaaaaaacaatttatggggaaggggtgaagggagcaaaaaattatcaagaaaaattattttttaaattgctacgaatgagtttaaacaacatacattcagaattttcaattttattatttttttatatgggatttgaattatctttgggtcattcagctgactgatgataattaattaattttgcttaaattttcaaaattttgggcagcctatattttgaactcgttttttaatgtaaattgcgcgcatattgtgtaataaatgagaaattcgaaataataaatccatcaatcaattttgcttggcagtttttcagaaattgttggtcaaatttgcgaaatagttttcgattttggaaagaaatatggtacacagcaccaacaattgaaaatttcaatttttttaatttatctttacgtttaatttttcgttttattttattatttttattttaaaatttttcgtcggaccataatttctttatctttatgttcagttaaagaacactttcgctctttttctaggatttggaattttaaacacgtattagtaaattttaatgaaaagcattcaaaaaacagcgacaaagtatttgggatatgatgtataagaacttgaattttggttgaaagtattttcacatgtcccatttgtggcaggggaatgattgattaactttccgcggcggtgcgcggcagggcgacttcatggcgcaccggtggagaggaagatggggacaaaaaaaaatacccgcacggttttggaaatcggatttgcgtgggcggcgactttaaagggttaaactaatacaatatctttgatttgtgaacctgttcataaatcatccaacggatttcaccccttcaatgggttaggggaaaatcccgcggcggtaacttcaaagggaaataccccttcaataggctcgggattttgcggggaagtatcacgtagcggcaatttcaaaagaaaataccgcccccgcaagcgggcggtaacttcaaaggaaaataccccttcaataggtttcggattttggaggggcccttccggtacccgctcggttttgggtctgtcacttgcacattgtgctggaaaaggataaaaactcattaatcatttcaaaaatgggtccatattgcgaaatcgtttcaaaaacggaaagcctatcaatcaaagatttttaaaaaattttttggcccatattgctaaaaatcattaatcatattttattgacagatgacctacttttggaaaagttttttttcatcatatttatttattcattttcgattttgtttttaaattggatttggataattaattttattgtccaattcattaatttatttatcggcattatttgctgcattaccaattaaaattgcacttctacaatttcattatcgatttaatttgcgtgacgcctgcattgtacctcatcgtcggggcggggaggaaatgcaaaaaaaaaccgcacggttttggcaaattttncaaatgagtttaatttcaggatcagaaaaagcatcacaaaaaaaatctcangattgcgaataatgtaatgtctaagtagtttg

SEQ ID NO: 8512 - DNA, 3788 bp, Heterodera glycines
  misc_feature (173)..(173): n is a, c, g, or t
  misc_feature (216)..(216): n is a, c, g, or t
  misc_feature (221)..(221): n is a, c, g, or t
ggggtcaaatttttaaatttgcaaagaaaaaattggattttcttccccctgtcccttttggtggcaggtggaggattgagacctttccgcggcggtgcgcggcgcgggtgaaaaaaaacaacccgcaacaatttggggaaatccacaaaggcggcagagttcaaagaaaatcncataggctcaggatgtgagcgggcactttcaaggggatgcacncctcncataggtttgggattgtgcgggaaaatgtccgggcggcaccttcaaagggttgcacccctcccataggcaagggtttgtgcggtaaacacccgtgcgcaaccgtgcgcttttgacgccatatactactacaaattagggggcagcagcaactgacgccgtttgcaactatgcaaagaaaggatgggaaatggaatattgaaaaacagaagaaaggatgtggaagggtggaggggatggggccaaattttggggccggatattgggccttatactactcaaatcttttaccaatttgcaatcaaattttcaaaaatttttcttgcggcgccaatcggcaccgccggaccgcctcctccccttataaggaaattttcaaaaagtttaaaaaatgtttatgtttaaaaagttggaaaactttgagtttttaaatacgcgatccacgatacgcggaatttttttgcgcgatccgcgaccgcgggatttttctgtccgcgccccacccctggcacaaattcagaaaagaaatgtatttgttactgatcagaattgatgggttgcatgaaaatcaattattatcagagcattatgtgcctatccgcagttgttctactgtaattgatttcttcttcctgctatactgtcgtcgtcatacggtacctcgcacgaaattattttggagtgttgcaacttgtttgagttcgaatttcttttgaatatggttggaaatgccttatggtatgcttgccgatattccgtactaaataaaaatgggaacatttccatattgtattccatggttgccttaacattttgttatcattcgatagccctaaattttttctataattctgcataattaaaaagaaattcgttaagtttcaaaaaagttacgacctgagaaactcaaaaactaagttttttgaatatttttgttcataatttactttaaactatacgaaatttttgatgtcgggagtgaattttctttcaaattttctcggttataaattaaaaaattttattttttcttgcaattctttaattttagtgagatttcagaaaaataaataatttttgccgcatatgttttcacaaatctttaatgaacagaggggcccgtctgtgaagattagcttcgtctgagaaattttgatattctttttagaacagatttttgcactaaaaataaccattttttggagcatttattcgcattacaaatccaatgtaaatgtaaatcaatgaaataattccaaatgatcgtttacataaattaattgttaaagtaatgaagaattaatcaaaaatcccatcgtaattaacaaatcccattttatggtcttaaatcagcagtccttcccttctcatcaaattcctcttcaattttgccattctctgtcatcagttatttcttagcatttttgccttttttgactttgttggccaatgcgcgttttactggtcgcatttttttgaccaatttagcgacggcgttcacctgaaaaaaaaatccaaaattagggagaggtatacggtaccaaaatttacatactaatttataaaaaaataattgaccggaaaagtgacggcacgccaaaacagacgacggcatttgccacggccacgaacggcactgaccgaagcgcaaccgacagaagcaacgccaatggcatttgcattcggctgagactgaaccggcggcactgtttgatggacaatctgttggctgcactgagcacaaagtttggcacctgcagcagcagtgttctgcctctttaaaatgattatttagaaactattgaaaaatattttaaattcagtgcaaacttgatatcaatcgaaagctcttcacatactcacatactatgttaggcctacaaaaaaccaaaaattttcaaacctgtaaagaaatccttacgaaaaaactacaaaaatgtcgacttcttttttgcaaatttcatgttaaaatttttttgttaattgtctaatcgctatgcaatagctttgaaacaattactaaacatgttcagctttcgattgggaccaatttgttgcatttgattttggcaatgaaaagtgatagtccaaaaacttgggctggcgccgaaacgactcacaaaatttgtgtatttttaaatttaaagaatttgtcttccaatttgaaaattataaaatatatttttatttccagaactatttgcgatttacacatacgaatttcgttatgaatgcttgccgtagtgaaaggcgccgactgtcaaaccattcctaagtgatttaataaaaattattataattaaattatagatttttccttattaaaccctacttcaacttgtttctccgtaagcccagtttccatggccaattgtgcacattcagaagcatttgcgactttcgttatggcaaatttgttttccaatttgtccaattgatcggccgaaaagtttttgttgttgcgtcttcaaattaaaattaagccaataaattccgggcccaattttgactccaaatttattcaatttacaaaatcatcactagggctgggaaatttaggtaagaaaaaccgcgaaataggtattaaaaaactcaaaatagttattaaataatagggatgtgcgagagtctcgattcccgagtcgagaaatttctcgggttttttgggtctcggttctcgtatcgtttcccggggtcatttctcggttctcgtatcgtttctcggttcccggtaaaaatcacttctcgcacatccctattaaataagtacaaaaattctgaaataggtagaaaaataggtaaataaattttttataaaaaagcaaacaaaaaaagataaaattttgcttctattactgtgtaaacgaatattttaaatatttctcccaaaaccattttgtcctccatttctttgcaatagagttgagcggtaatcggtaattgtaaaaaaaccggtaccggtactgaccggtaatgcaaaaaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagttttttttcaaattcaggataaagaacactaaaattcagattattgcaaaacaagggatcagcggccaattttccaaaatggtaaagaaaatatgaagaatattctatcccagtggggaattgaacccaagccgagaaataataaaatcagaaggtttagccacttgaccacttatgcatatgaacaaatgctttaaatcaaaataaataatttaatttttttttctcaaaaaatttctccttcaccattccctactcttttctcacccagaccctcattcttaccagtgcaaattgcacaatcaacacaaacaaacaagtcaaacgacggaaaccccaaggtgtactgcttgacctccgtgtcagcagtacaaccacgcaagtgcagtaagtgcagcaag

SEQ ID NO: 8513 - DNA, 6160 bp, Heterodera glycines
aatttttggtgcaattttcggaatttcgaagccattttttcagatagcgaaggcaaatgtagccatataatagctgaaattagagccacagttctcttggatttattattatcacccgttgaaacgagctatcatcttatatttatggccttaatggtctcaaatgtctattttccgtgatgaagttatctccaattcaaatggctcaattggtgttgaattttccaagcccaaattcattttgtaactgagtgaagaagtggcacggagaaatgtctaagcaaatggaaacgcaaattatacgtaaatcaattagtcagtcgtttaacgaaatgtggtcacacctctttgaaattggtgatccattcgaggtttaggcaatgcaaactcttcggatggccatctttgctcggaacaaatgagcattattttgaaagcccaaatgatggacatttgtcgtcgtaaaaatgggccaaatttgacggacaaaaacatcccaaattggctggacattgattctggttgaacacaaaatcaaatacaaattggtgactttgtcacaaatttgccgattggagcggagaaattcgatgacggaatggccaatgtacctgaaaagggagtaacaaaataataaaaatagaaaattattttgtatgtattactacataagccgaatgaaatgaatgcgaattttgttcggcaactgacggtcaggaaatggaaaatccacatgattgcactcgatatacacagataattttgcttttggtcctgctttgtccttgtaaattgtgattggtttccaaagcgtaattccgtttttccatcgaaatgcgtgtccaccaaagcatcgaaacgtggcgaaatcagtgccaatttgagtccgagttgagcataattaaaaaagggcagaatatccaacaaaacgtcgccacaaatccaaatgaaatgcgtgcgtaaaaaattactgaaaatagaaattggcacttttcgtagtttaaggacccgatcaaatttttgagccaaagtttgaatttttttttaaatcgacagtgaattatgtatgttgagaattgcagatccattcgaagagatattaactcaaattgtggcagttaggtatgcctccgaaataattttggtgcgtagttttagtaattctacgcgccaaatgttgatttaaaaaaaaaaaaattttaaactttgaccccaaaatggaaaagtacccaagcaaacattccatgatttgatccgctttttctttttcttcttccgctggtggcgacaatggcataaaattaagtgcaatttgaattgagtatatcattttttacactcacccaatccaattattgtcataaagcacaaaatagactttgttcaaattggcatccaaattttcgcccttttcccatttaactgccccttttcaatgcaaaattcattctgtagctgactgaagcggtgcatggataaacttctaaacaaaaggaaacgcaaattaaaggcattaaatcagccagtcatttaggctctattgcatgcagtttacgcatcttaacgatttatgcatccaaaataaaaagtttacgcttctaaatcaatgcaagggcctcgctccctattctgggcaaaaataaattgtccaaaaacgaatcatccttttaccagaaaattttcggctcgaatcagaatggcaacaaaatgattttgtcccacaaaaatttttcacgctgatcacgaattccggcatccatttcgacccatttcaaactccgagcccgaattcgaacaaaaagtcaaagactcaatttccaactaaattcactttgttggacaaattagaattaccccaactaataaacggctccaaatcgtattaagatacacatgactaatttgtaacaaattgcgcaacggattaggcgtttgcgagaggcattttatgccgaattgcgccttgttgtgcttggcgcagataacagggcccggacctgtctccacggagccgggcacatcggcaaagcccacttcgacccggattttccggacgaattcatccctgtactatttgggcttaatacaattatgaaaaacacaattaagtccgagctcttggcagtggaggaaggagagaccatcttccacggacctccggaaggcatgttaactctggaggagttaataagccgtctcgaagagaaggttgccggctacgaagccgagaaacacttctgcgtcgggccactctatcggcaaacggaccaccgagaggccaaggagctggcgcagacagtatttgtgaagtttaaaaaaatgaacaacatgtgtttagattgcgcaaaagcaagcagtagctgttcacctgcagccgactgctgagcaacttgagcaaatggtgttccagttgatgtcggccgccgaggaaaccactcttcatttaattgaacagagggaagaggattttaaatgggtacggtgaaggcaaaaatcggaaaattttatttgttggaatttcaatcttttgtttttcagatcgccattgagctgttcgctcgcaataagcttaagccgaaggacctaaatgagttttgtcacagagccatgattggctaaattaatcttgacatttattttccagccaatttggaccaccggcgaagctcaaggcgatgaagaggaggacgcagaaatggaggaggtgcaggatgatgattgggaagattgagggggtttttttgtgggattgttaatggcggccacataggatggtttagcaactcccttttttcttttatgtttgggtggccgccaaccagggatgcaacaggcataagaagtttaaattttaaaagtttcgaatatttccgagaatagtgacgagattcaactgattaattaagaaacgttttggaattaattatctcaaattttttgggaaaaaattttctcaaaaatatagtcagccgaagcaaaaaaatgcggcttcttggctcagaatgttctgactacggcggaaaacttggcattttaaaaagtgaacacacaaggctttgttttggtttcacgaccaaaaatttttttacccgactaatgaaattttaaaactcaattaaaattcaaactttttttcattaaggagtaaagaatttttcaaataattttttaaggtcgagcaaatttttttgaggtcgtgaaaccgaaaccaagtctaatctcatccctaaaagctgttccaatttttcaagggttgcattcctggtctcaccatttgttcatttgctttttgttggataaatttttgttggaaacaaggaatccttctgtcttggttcaccccccccctcccgctcacaatcgcttttttccatgaaaaaaataaaaacaaaaaaaaatcgatggctgatcagcgatcacagcttggcgtgtctgtcgctgcttggtgcttttgctcatgtcgaccagcttggtgaacgcctcgtccaatgtccgcacgcgcaacaatgcaacaccgtcacacatttgcgaactggtccatgaaaggaaagggaagacaaaaacatgctgtctcaaaatttgtttttaattcctaatctaaattgtggtatccctccccgctcaaaaattgcaaaatctttagaccaaccgggaagtaaaattcgaacaaaatttacaattgttttgaacaaaatatttttaagtggtggcgatcacacgacccatttttaagccgggccaaaaatacaacgaaggatagggggtcaaaaaaagggagggcgggcgacgcttaatttgacattacataagggagtccatccagctgtgtcaatgggtgatttttttttgcttttcgaaaacaatttttgcggcactcttttttcggcaccgccggagataccttagttctggtttgagaccaataaatttcacgataaaagctgattcatttttggccaattctatttttatcaggatagggatcgcccaaactctctccccctgtacaggtttgtcaagtacataacgggagaaatttatgaaatccaagtacatatacgatttttatctaaatgtaattaaaaagttgaagtttctttaaattactatttttggtaatgctgtcgatggtaccctccttttttgaaaaagttttctttattttcaaaagaaatgaaagcatttttcctagtggtttcagctatttcgaccaattttgaaccccggacctgaattcgaacaaaagtttcaaaattttctaatttcatatttttaattaaaatggtttaaataattttttattgcagtattaatgagttactggttgattccgcgtatttagccggttttgaactaaaattcaaagtgaagattttgaattttcgggcttttgctcgaattcaggtccgtggttcgaaattgtgtcgaaatagatgccggattcgtgatcggcgaccccgaaaaccctaggaagtgcaatattttttttcactgatcattttcctcattttcacaccgcttttttggcgcccttaaaggaataaaggggtaggtgatgccgatacatttgatggcgtccggagggagcaatgcgttttttttttgttttttttattcacaaaacttcgaatgaaacaacaatttcaaagaggtggtgaaacgacggagaatgcatggaaattgatgcgatgtctattgtttgacgaagcaatgccaaattaaagagacggcggtccattaagaaaacttgtgaacatttattttttataaaaagaaattgggagaaaaaaaaattccaaattataagaaaacccataaaaggcagagaaatttacagataatgtcattttttgcaataataacttacgacaaaagtgtgctcagttaattgccacaaaatgaaccgacaattaaagaaaatgtgaggaatttttaaattgatgatttatcatttaataaatcttttcacacatttcagctacatttgtacggatgtttggatggacattctcccgttctttgaacgagttgaactcggcctcacattggcacttctctctccgcgtttcgatgttttggtggacgcgcatttcgacggaaaaagaaaattgacaatttggagacgtatcattgttcgaaaaggcaaaaatgccgaaaaagttcttgttggaatttattggtgcaaagaagagcattacacactcatggactgctgtccgttgccgaacaaaattcgcttcgattgccttcaaattgagtaattcttacaaaattttctgtgtgtattatgaacgcgttttttatgtcccctttttcagatacatcgatcattctgtgctcgcattttttcgctccaatcagcaaatttttgacaaaggcaccaatttgactatacatatacaatcatccaaaaccgaaagcaatgtgcagccaatttgggatgttttggtccgtcaaatttggcctatttttacggcgacaaatgtccatcatttgcgctttggcaatgctgatcatttggacactttgcttcgcctcacatcgccgacaattccctccgatctgaacattaattcaatccagtcttatcgtggtctgttccccgacgcgcttggtggtgatgatgggccaaatatttcaaagaggtgtgaccaaactttcgttaaaccactgactaattgattgcttttaatttgcgtttccctttgtttagacatttctccgtgccacttcttcagtcagttacgaaatgagttttggacgactgaacaatgcaacgccaattgagctttttgaattggagaacgaacggactaatgagaagctgacattgaagggagtgtcacgccatcctggcaattggctgttgaagcgatgcccaactaatggagaaacgacgacggttcagcagcagaaagatgaaaattcggatgtcaatttgcacaatgtccattttgtgcttgatattgacaaacaatgcattgggtgagcaataaaaaaaacatttgattttgtttaaataattcaaattgcacttaattatttaggccattgtcgccaccatcggaagaagaaaaagcgggtcaaagcaacgatgaaatgttctcaacgactcccgagcccagtaatcagcggaatgagtgattattttgaaaatgtc

SEQ ID NO: 8514 - DNA, 3782 bp, Heterodera glycines
tatatattttgcattagcactatttaaaattgttttctttctttatttttaaacattcaattatttgctaatttattctgtttgttaattaaattttacttttatgtaatttactcgatctgttgcgattcaatatgtacaattcatcatcgaatatatatatttcacgaaattattttttgaaatttataatattcccttattttataattgatttattctttttgatgtatcaaaaagtctatttttctgttaaattgttttttctatggtcatttcaatatcatttttgtgttaattcttttatttacaattttaattcttttttttcttttaattatgaaaaaatttagtttttttattatttttttcaaacattggatgttggcgaattaatgtcgagtgcgattttgaagctttggtttctatcattaaaaaaagaaaagttggtcctttttgccgtgctcttgaaaatatttatttaatgttttgttattttttaaattattttatattttacttagtttttttcagtgtttcgttatataaatatatgtatttttaattattatcttttcattaaatgttccattcgaccatatacgttcatttctattcttataatttttaccgaatttgttttcactcatcaaacatataaatattaattgtgataacttttttttacctcactagttaatttattatttatttttaaatttttatactaaatttaaatgtgtatatttactaatcgtgtttattatgttatttaattaccgtatgtttgttgtagcattttattagaatgaattattttactattatatatttttaatttaatgttattcgaaaatccagaaataaaaatttaaattcttttgctaatattttaatcattttgtgcattttattcgccttttctttaattatcatgttttattttttatttttcccctttttcgaatataaatgtgcagcgattcttatgtaacaaatatttttttcaaatatttttaatgttattaatttaatatttttatttatttttcaataatacttttcttaattaatgttaaatatttttaattattttctcgatgtctcggaaaaagttgtaccaatctatcgtagtgtgttttacgtgttgattgataagttgaaagtttaagtatgtaattatgcaatcatttattgaattaaattatatgaaattaataatttttctctctttggatataattttttgggcattattaattattttattaatcttttttgctgatgttttttatttatatgaaatggatttttttcttaaatttgattgtatatttgaatatttgtttataatttaataattaattttttattataatttccatcgttcttttcttattttcgtttaaggctttttctgacaatagccaataaatttaaaattaaataatttttttttgtctttggcatcaaatgaaaaggtaaattaaaataaattttaattatagcaattatattccgaattgaagtacttttaccagaagcaacttatttattccaaaaaatatttgatttaattcattttaaatcttagatatgaatttagttttcttgatttctttaatatattatcgttgaaaattttaatttatataatggttattctatttttaagagcgtataaaaatatgaaaaatataatatttttcaataatatacctaacacttaacatttttaataatttcaacttaatttttaatcggaaaaattaaacccaaacagaagttacaaaatattttgtaatacaacgtagaactacgtctatttttttaaactaaaaaaatatttggggtggcaaaaaattagttcgtattaaggccggccgaaacccgcttccctaacttttactaataatgcattttgcattctaatttatagccgggattcggtattttaatagctaaccaacagagaaatcaatttgattttctaatattgtttttaaaaccttaaaatgccaataagcgcagcgatgacagatgaaaagtctcaaaaagcctcaatgcctcattttaaaattagtctcttcagctcaaaaaaaccaacatattgagggaggacaaagccattcatctgccatccaagaataatcactacggaaaaaagttccgaggatttttgagacaattgctatgcatatgagtaggattaagccccgaccctcggtgagagaaaacgcgtggaaaggggaggaattccacgttcagccattttttaaatttattcatgaaaataaaattgtttgtttttccaaatagaaaaatcaaaaaacaaatttgcgatcttgatttcattgatatatttttatgaaattcatctttcatttaaataattgttattcattttttaagcgcgtgtaaaaaaaaagaaaaactaagcatttttgaataatataacgaacatataacatttttattagcatttcaattaattttttaaaatttctatagttagaattagtgttaattatgtgttgtttatcttttgcttttcaatttttagtaatcatttatcatttactttaatttattttgaattaggttttttgttcacaaaaagactgattggctacatcaaaaaaaaaaaaattaaggtagagaaatccatagttcaattcatattgggccgcatgatcccctcctaacctttattaataatgcatttttgaattttttttaaattattcgagtaaattatttctacaaaaaatatttactcaaaattctgtaaatctaaatgaaaaaagaaactgataaattgggaagagatttattagtttttatattttttttctccggctttgtttatttttgataatttaattctttatattttttcttaattttaaattcctttatctcttcatccatcacttaaagctttatttttcgttcttttttctcatttttgaatatattttttaaaattagtcatttgaaatggtgaataaaagtcaaaatgaatattgttctaattcgttaattcaattgtttaaagtattcaaaaactttacaaaaaaaaccaaaaaacaaattatggtaattggttattgtatgtgtgttcgttctcatggcaattcactcttaaatttcaaatgtcatattaccttatctccttgatttttgtgtaatttaatgtgggttgacttgttttcctaaacctgcaatcataaagaaaataaaagaaataatgggttaataattagttattccttccaaaatttgatagaatttttcaaactaatgccgtatattattaaagcaaaattaaaaaataatttgtttcgttattataattaagattatacatctaattggcacttggcaaaccattgccattgccatcgccatatattggcacaatgaatttagaattccaatccattagattacaatttaataactaatatttctccatgtttatctttttcttcttcctaatgacgggatttaggaaatgtccgagcaccaaattttagcggcgatatagtagagttgagcggtaatcggtaattgcaaaaaaaaccggtaccggtactgaccggtactgcaaaaaccggtaccggtaccggtaccaactttttcaaccggtaccggtaccaactttttcaaaccggtaccggtaccggtaaaaacctggtaattttagaacatagaaatttttggacaaaattttccaaatacaaaatttttattcagttttcgcgcgagtgcctgttttt

SEQ ID NO: 8515 - DNA, 3631 bp, Heterodera glycines
  misc_feature (40)..(40): n is a, c, g, or t
  misc_feature (3490)..(3490): n is a, c, g, or t
taatttttcttcttcattttttcaactttcgattaaactnttattattttattttttggtactattaggtatattataaaaaattgttatcgtatttataaatttttattcccatttctatttgattttgaatgttaaagtaaatttccttttaaattatagtccattaattagttttctcttgacatttagtgttcgatatgatttacggatctcccctttattattttttataatattgttatatcatttaatacttattattaatttttaattatttttatcattgataaatttgctgttgttttttttatttttgtaattttattattaaattatgctttaatttcctgaaaatcggctatggcattgttaattaaaatttatttaatttatcacaattttttaatagggggaaattaatttttccatttaaatttatttattaatctttgtgattggtcatcaattatgattattatgtgctgccaattgtttcattttacattattttggttttgttttctgttataattagggtcgcgactttaatgacgaaaactctagaaatagttaactagaatagtgacgaaaaagtgcgtcaaaaaagtccgaaatagtgacgttatagtgatataattttcagcaaaaattgagcaaaaaattttgttattcactgaatgcagttgcaaatgaggtacatttcttttctaatattttcttaccaattatttaactttttaaatcaaaatttttgtcaagaaaaaaaatttggtagatgaatttttgagaaattttttaggtcgattattaggggtgtattttttggttttattgcatttttgttaaggaattttccacgttttttgggtgctgggacgttagtcaaaaaccatcaaaatgggcgttagtcaaaaaaccatcaaatgaataatttttgacagaaaattattcataattttgtctaaaatggatcaaattttataatatagatatttttcgatagccctaagtgttttctattatcctgcaaaatttttaaaaaattctttaagtttaaaaaaagttatgacctgagaagctcaaaaaaccaagtttttttgaacattttagtcataactttcttgatacttaacgaaactttttggaattttgtaggctaatagaaaacacttagtgctatttaatgatatcaagaattaaaaatttagatgcttttgaacaaagttatatcaaaaaatattttcatttgatggtttttgactaacgtcatagcaccgttttttgagttcctttcttcaaaacaattgagaacaaaaaaaaagttttttcactaaaaatcgcggccctaattataaatatgaataatatttcgttaaattaattatctttttaattctcatttacttttcctttttttccaattcacaaaaataaatcgccatttccatccatcattgggtgaatgaataatttatttatttgcgttaaatttatgtagttcttttctatttattaggttacattatttttatttattgtactcaagtatttaaaaaactatgcatttataattcattttacttttttcaaattcatgcattcagcgatcaacgctttcatttctggtgatatttcgaaaaatcaattatatgacttttctgtaataattctttatattatattttttatttattgtattctaatgttaaaaaacacatatatttatatagtacaatataaaaagattttatatttattaaatattttgatattatttttccctttttatttgttaataatttcaaaatttttatttttaattatgcaatatattctgttgatgataaatattgcaaaatattgtacattttaatatttatttatttatcattatttaacattaggaatttattttagtaaagaacaaaaattaattgatatcattcaaatctaatagtagtaaaaaaaattgtttattttttctttgataatttgatttttcatttattcaattatttttctttctttcttaaattatgcttaacttcttccaaattctaattattttaatggttatttcattaaatacatttttctataccatttctaattttgccagttcctttgctgatatttattattaaaaaatagatttttacagtcttttttcacttgtcagcaaattgttttccatttttggatctttatatgtctttttatgtaatcttcaactctttttgttaaaaattttaaaatgaaatatccatttcttcgaatttattttgattttgtaataatttggacggctcatatttttgataatttatttttattttttgtaaaattcattaattttttattgtctttctgtccattaattcgcattagaactgtttaattgttttggcttttatttttaaatgatcaattaattatttactaaaaataataaatattcattcatttttttgtaataaatctttggtatatttaaaaaattaattatacaattatcattttcttctatttgttactttcttattgttagcttggcaatgtgaaaatgtttttctttttattttctgtttaaatattgtcagttattttccatgttttggtctataatttatgtttttaaatttctaaaatttagttaccaaaaccatttcaattgacatcattttactattatttttttgtcattttatgcgttatttgcaatttattttaattttattttagtttggttcagttttcattatatctgcccaaaatttagcgtaaaaaattatagcgcatcctctacagttttttttctagaaaatacttaaaaatctgaaaaaggcttgaaaccgggaattttccagaaaaaattcttacggggctggaaatatttttcgtgaaatatgattatgacggacagaaagagaacaacattttccacaaaatgaaacaaaattactgaaaatatactattttttagattaatttgccaagaaaaatgttaatgttttggaatgttaattgtactgtatttttttagaaatattgtgggaagaattttttcaaattttacgttgtttctaagaaaacttgtagatagtgcgctataattttgttacgcaaatttggtgccctttcgaaaaattcataaaattttatttcatttttaacatcaaaatattttcaaaataaattatttaaagatttccaatttcaaattcatatgattttgttttatctgatttaccacaaagagttggttggaatcactgttagcctttcataaataataaattgttttcgtttttttgtaaattttttaaaaattatattttgaaatcgatgaacaaatatttttgtattggtcagagaaggacgacaaataaaatataaaaattcattttttaaatcattattcattcttacataaatttttttcgaataaatttgttgcattgggttatgaaatttaaattatgattanaataatatacatagctgtttaatattttctcctctcctttaaccgttttccctttgaaataataccatattttgataatctttctccatttattttgaatgatgagaataattcacatttaaaaaataaaaatgtcgttgc

SEQ ID NO: 8516 - DNA, 5192 bp, Heterodera glycines
  misc_feature (615)..(615): n is a, c, g, or t
tggactaactatttgttgttctattttcgaattgaaatatggtaaaagtaataaacttacagaaatggataattcttcagaaaaaaaattattaccattttctaatcatcctaatattgatgaaaacacaccattgctcagcacaaggtgatttacagtactctacaaattttctatttgtattcttcggtaaatcaatcggttgataattttgtgctctttccaatgtgcctaataatttttccagtttacctaacctcaaagaattttttaaaaatattaaaatttactgaattttttaataaattttattgaatttttgaaatattttttcgtttatttcaataatgaatttttaaatttttcactaaattcgccttcagaaaaaaatcaaaaaatttttttaattaaaatttataagtaaataaattttattaaattctcaatttggcaaaaacccctaaaataatttttgaaaattgttttaatttttttgaaccaataaattttaatattctaatgtagtaaaacggactcgaacctccgccctttttccctttattatcttacaaaaaccactaatttaagccaattatgcatttaattttgaactgngagccccaaattgagtcaatgtataaagttaagcaaagcggtttttttgctgcagacggacagcccttccatcgattattatttgtagcataaaaaaggcagtggctcttcttttcttcgttgttttaaatgaatatgagagggttaaaaaatcaatttacgcccaccccctcccctcagccttcgtcggctgttcgtcatttttcattcacaccttccttttctcttccttttgcaacattcttttggcaatgaaaagatatagtagcaaaatttaatttttgaaatgcatcatccttctgccaaaaaccaacgccatttgtgctcttttgaatcaagttcattgccctccgtactaactgatccgttgccgtcctccgatgtacaagctgacgatgaaagaaattccttggttctcggcacggaggcacaattttccatgcaaatgggcaattcgcaatccgttgaaaatttggggcgccgaccacggcgaaggaatggccctcaagcgaagcactcgtcaagaaagcgaacaaaacgacggcgcacgcacagtgacacggacattcgtaaaatgcggttggtttaattattgactatttacaataaataaaattacttgttatccatttctatgcatattaaggccattcattttatctccgtttatgcctacaatagcaacacaagtttccattaacaacggtcagccggatagacatcgtgccacgacaaatccatcggttactctctcctcttcactgcctcaaccgccaattatgacaaaagcaaaagtgattgttccacggatcattggagggccttctgaacgtggcgatgttcgtgtggttggtcaggcaaaatatggtgcggtgcccaattcgacgacagataaaaatgttacggtcggaagcgtcgtgaaacatacaattgctgaaagtgaatcggagagtagtgatgaggatgaagaggaaaggtaaagcaacaaatattccgaaaagtcgctctttgttgttcaagtgagagtagcagcagcgtctcctcttcgtatacgcgtttctccgatctgacaaaaaagcaatgggtcactattgggatgttggcaattgcaaatctctgcagtactgtggcgttcagttgcattgctccgttttacccgggcgaagctgaaatgaaagggtgggccattggcgtgtcttcccagtgactggcaccattcagaatgactacctcagaggttggcttagtcttcggcatctttgagctggtgatgttcgttgctgcgccaatccttggcaaatatgttcgtttcatctttcaatcccatttttacaaaaataagtaaagatggattttattggctcaaaattgatgttcactgctgggcttctgattactggtttaactgcaattgcattcgggtatttgtttttgccttttgcacattttgggctgaaataggaattcgtttgagcgaattttgggcaaatttttgagcattacaatcatttttaatccgtttattttcttttgatgacagatttttaaatttgcttcctggtggaaatgtctttttcttcgcttctttgatcattcgttgtgctgaggctttgggcgacgcgtgttttgtcacctcctctttcgctataagtgcgaaatgttttcccggtcgaattgccaccattgttgtgcgtttcgcaatttttaagaaactacattgcttttcagggcattatggagacttttgcgggtcttggttacactgcgggccccgtcattggaggtgttctgtacgaatatggcgggttccaacttcctttctttgtcctcggctctgttcttataatggctacacttctgtcctattaccttattgaggaaattgaaggtttttatttcatttattgagtgcaatggcaattgtaattggcatttgaagatgaaccaaccgaagatgcagttggaatgttaaacatgctgagaataccggtcatttggctcatggtgtttgccgttgtgatttgtgccatttcactttcgtttttcgatccgactttgtccggccatctcgcatcggtcccttatttatgcattgtaatttatttttcaatttatttactttagtttaatctgtcaacgactatggttggccttatttttctgctctgtggtggtttctactgtttgactgctccgttgtggggccttatcctcgaccgttgccagtgctgtaacattctcatgcttttcggctcgttagccaccattttctcaatgctttttgtgggaccgtctcctctcattcccatagaaaagtgaggaaccacaaaaccattttgtaattattcgtaccattttaggaatctctttttcattggtctttccatggccgttcttggaattgcggcgggtgctctttacattccgacctttcagcgatgtttagacgcagtgaagtcatttttatttcaattttttcctcaaagtgactgattggtttaagagagaatggttacgacgactccttccaaacttacggctgtgtgtcgggggttttccagtcagccttcgcatttgggtgccctctttactaagcattaagatgttgctcatatttactaaattcagttcattcattggtccaacgcttggcggttggggcgttgaatcaatcgggtttcctctcaccacaacaatcattgctggcattaacataatttttgtaataattaaaatagtttaaacttcttattttaaattattgaaagacagttagctaaattatgtttttttttagatttttgccttattctgtttcatcatcacaaatcgttttatcggccggaattccgcctcggacaccggttcgacaacaaaagaagacccgccttcacttgaagaagcctaaaacaacaatgtttttgtttgaatctgtgcatttttaattcttactggtcattttttcgtgcactttgtcattttactcaaattccgttaagttgtcaacatttttcatttgtttttgccattaaaaactgattcttattacatattagtttattggttatttttacctaataatttaatattttaaaaagaatattgtaagttgcaagtgttggtccatcagtttcagtaaaagccgacattttgttcagtcccaatggattatttccaaaaaattcggtccactgttgccgcacaagttcattccgtcgctgcacaagtcagccaagcgcttcctggaaacccaattttccgtgaatacacaatcggagctcaaatcggaagtgctggccccgggctctgttggaaaatattcagtgggaccaaaaacacaaccaaaaaggtgaaacgaaatgcatgcagaagttggagtcaaatgcgactgttcaggaagtgaccatttggcttttcgagaagcgtcaaacagaaaattgggccccggccaaaagggaggaattcccggagattctgaagcgaggcgtcagtcagctgacccggctcagacacccgcgcattttgacggtggatcgggcgttggaggagtcgcgcgactgtttcgctttttgtacggaggtaaattcgatgactgacgcgaccttttgaatattcgttctgcttttgtcatggacagccactcttcgcgtgtttggccaactgttttggcgatttgaccaacgttttttcccctccggcccatttgaaagagtttcagctgttggacgtggagaggcgccatggcctttaccaggtgcacaacggtcaattgtccttccaattggcacttttctgtttctttattgtttgtagtccttttttgtccatagattgccgaagcgttggcatttttgcacaatgacacgaaaactgtccacggaaatgtttccccttcctccgttctgatcaattcgaagggcgcttggaaattgggcggattggacttttgcattttgggaaacacttcgattccgggaaaggtagtaaagcttcaagttaaaaacatgtttttcatgcgaatagaacacaatatgttagcagaaaaatgacaaatgcctctaaaatgtatctgttgtgtccccgggtttaaggctttcagccatttcaaattaccgttttaggagagaggaatttattataaggaaaagcattgacaaataattatgaattgaaaaccgggaatatgtttggctcaacaacaacctcagagcattttgggtgggtcagtgcaattggttatttgggaaaggattgccaaaggcaagaaatggcacagactgacccaccgcagacatctcgcagcccccgagggggaaattggatggacttatatactggtacaatggggatggactttggataggatgaggggtaatgacggaaaacacaaaagggaataagagaaatggatggcatatgcaacagaggtgaatgggatagaaatggcacggtaaataagagggacaggattggcttgggattggatgaacagacggacaagtttatgacgggattgggtcggggaatagggcaatgaacattatgcacaaaatatgaaattttgaatgctgcggata

SEQ ID NO: 8517 - DNA, 2532 bp, Heterodera glycines
tttttgtccataatagccgaagcgtggcattttgcacaatgacacgaaaactgtccacggaaatgtttctccttcctccgttctgatcaattcgaagggcgctggaaattgggcggattggacttttgcattttgggaaacacttcgattccgggaaaggtaagtaaagcttcaagttaaaaacatgtttttcatgcgaatagaacacaatatgttagcagaaaaatgataaatgcctctaaaatgtatccgatcatttgatcacaaatgaattttttgaaaaaataataaagttttcaaacaacagaattaatgttcctaataaactagaaggtaatgtgttttaaatttaatgctatttcggctatcagggcttgaaaaaattttacttcgaatccgattttggacataggtgcaaatgtcggggccgcaaatgtcgaggctccgtaaggtggcattctcactgagtctcggaatgggataatctcaaaagaggtgtagccaatccggccctataaatcaaatgcttttttaaccaataatcgatcataaacaggttaattttgccgttcccggatggagtcaaaatgaaatatcggcgctttgtcccgatttggactttgtctctcccgaacttgctgaaggccttcgctgtgacactttcgtcgatattttttcccttggcgttttgtcatttgcagctttcaataacggaaaacctcttttcgagtgtaacaattcgtttagacttcaccgggaaaatttgaaaaaggtaaaaaggcaaatgcagtttttgccctaattgggatgttcagcttaaacagtctctacaaacattgctttccattgtgcccgagccttttgacgacgacataaaaatgtgtttgaatgaaacgcccgaactgaggcccgatgccattcaattcaccaaagtcagtgcgcatttcccgtttttactttttcaactgattcatccgaattttcagttgtcctattttgagcatccgttgctgaagacactcaactgtttggagcagcgtttggccatggacaacacacagaaaatgcaactgttcaaagggctccccacaattttggcacaatttcccaaagtgtttttcgcctctgaaaatgatcccatatgcttccgttttagcgctctttgctcctaacggtttttccgcatttggccgccgaattcgccgcccctccgctcattcctttcattttgccaagtgtctttcttatcgtcgaactcacttcccccgaggagttcgtcctctccgtaatgccttctcttctgtccgtctttcccatccaaactccatatcaggtgcccaaatccatcccaatttgcttaatttcaccccatttatcccctcagattggtcttttgcttatgcaacgggttaatttacttttggaaaaaatgcccccggatgctgtaaaacagcatttgctccctttgatttacaattctctcaccggcgacaatgtcagagtccaggcaggttttcagttaatcaatttgaaaagaaacctaacattggttttttattcccacaaaattctaggagttgacccttatagaagtgccgaacattgtcaaatttgtcgaccgagagcaaatgcgaactcaattgatccccaaactcatccgtcttatgctcgagtcaaaggacctttccgtaaaatcgcaattactttttctaaaattcatttttcgtttttattttactttcaaaacttcgaaaaaatgctttgtaatattagctttttatttttaatcacttgtaaagagtttgacattacaagttgattgttttgcaataatgggggggggagagaagcagagaaatattattttcttattttagattcgtgtccaaacaatggtttgtctggccaaattgcttccccacatggagccttggatggtcactgatcagctgttgcccgctttaccgaaaataaccagcaaagacccgagtgttttgatggcagtgctgggcatttacaaaattgttcacgaaaacaccaaattcgggatcaacaaagagcaatgttagggaggaccaaattgggaaaatttaaaaaatttatttttcatcaacaaaaatataattactaattgatgagagctgattttgtgtccaaggtgctcggagtgtgctaccttatcttatttccaccgcagtcgagcccactctgaacctccaacagttcggccagtacatggaactggtccatcaactgatccgacgggtcgaaaccgagcaaaggcattgtttggagcagctgagtgccagtcaggaggaacaaaggtggacggagaggagccactcgcatttgttattgaagcgattgttttcatttaaggaaaatcactgactttgcggactttctgaatgcccaatcgaatgaaatgaacaaaaccaatcagagcgaagtcgatttgggcgacttggcacgagcattgagcggaacatcggcaaatgatggcatctgcaacagaacaacggacaaaaggga

SEQ ID NO: 8518 - DNA, 1494 bp, Heterodera glycines
aaagcccggggggggggggaacttcgcatcacaaagcgaccaaatgaccgcgtgtcgcacgtattcgagcacagtgtttacgtgcgacttctccaggtgaaacacttggccgaagctcgcggcggcgatgcgctcgaagactttgtagccgggggcggaccgattgccacaatcgccggtcatcacgaacaccacctgccgggggagggggcgagtgggagaacgaaggggggacagatgaggggacgagggaattgagacggcgaaaggcagacgaatggtccattgttgtgagacgggtgataataatgccattgaaggggacacgcgacttagagagagatgtcgcaggaagagaatggcattgagaaaagttggcaataattttggaaaggatggctctttcggtgattttaccatgtgaacgtaacccaaaacaactgtcatttgaacacaccgagctttgcttctcctggatcagattgagcacggtctcctccaagtgataatctttggaacgggcgtccgtaaaaacgtaaatgaatgagccgggaagagacacttccaaagcctggataaatggaaaaagtggacgaaaagcatgactggatgcctttttgatgccggaaagagtcatttcgggacagtcgccgcccccttggacggagacggatgcgagctgctgctggaacatctccggatcggtggtgatcaatggcgggtccacttctgaatatggccgatcagtccttctcgagattggcttttcttattcgagagagtcccttttcaaattcatttctgaccagggtcgtggaaaaggaccagcacatagttgaagatgaacttctgccgctgcttcatcaccgtctccaaaatgcccttcgcgccttgtcgcacttggttcagatcgtctgcaattgtcagaatcatttcgatcactttcaactcattcgttaccattcattgagccggtccgatcgaacacaaatgtcagcgaggacagtcccggggcgatttcctgctgatcagtggaattgcgaattaagccgggggattgatcagagacactaatcgaagaaacagaagatgaaaaggaaaaatggagcacaggaagagataagagaagaagcagcaggggatagacagacaaaacaatcatctaaaaaagaaagtgatcagtggattaatggcaaaggaaaggccaaagagagaagggaaagcaacgcttggccaaatcagaacaaacgaaacttcaaatcagtgatagggagcaacgaatgggaaagagcggaatactgatttatgcaaatggacaagggagagagatatggggagaaagtacggggcatagggaaaaaggggggggggggggtacaggggagaaagggggagagaaaggggcatggggacataggggtattggaagggaatgtggggcgggggaggggggaattccctctacatgcttctctcctccccctccccccacca

SEQ ID NO: 8519 - DNA, 2052 bp, Heterodera glycines
gagaggaagaataatgattagatgagacagataaaagaattcctttcaaatatggattgacggatggtgtggaacttcactactcatgctacggagaagtaattagcataatcgttatgttaattaacccattaattaatggattccgtcggatagggaaaagagaaaggcagcgaaaaggcaagaaaatggcaagaaacgatgggaaactaacgaaccaaatacggtcacttaaatgaccgatcattatttttaactgagatggcttttttagctaatttttgttaagttttaaacaaaagtttaaagcaaaagccaatcattaccattattagcaaatcagcagtgaataattatgagacaattaatcaatcaatcactcattttgtggcaaatcaatgtccattgaaacaaacaacagttaaaggggatgatcgatctgctgttataatttgaaagtgatggcattgattcattgatctgtcgtcccggcgaggcttaaaactcaccatcccccaccctccctcaagcaatcatttcaatcatttttagccaaaggcttttctatggccttaaaagctgacaatgcttacaatcagtcaaatataaataataataatatttaatatttgtaaaatatcacagaacaaaaagtgggaaagggcaaaacaaaaagtgagcagagatcgaaaaattattataaatggaggcgatttgctggtcatggccatttccaaggtttgaatctcttcggcctggtcatttggtcgcaatggaagcggcgaatgtccacagagtaagaaacccttaagcaatttcaaaagccaaatcagtgacccctttgaaagataaaagccgttgaaaacactcacgacgaatttttgctgttttttgtgccatcgccgttaattttcctcagattggtgatcagatcaaaagcgatcacttcctcgccgtatttgtccattatttcttccccctcgaaatattcgccaggtctaatgatcacattcgaatacaattccttcgaaagtgtggggagcatttcgaactcgcagcattggaggtacaaactgaggggaagggggggggggtaattagtgggtaattaattgatcaattaattaaacgatttaattgttaattgggatgatttgcaaattttttattttaatttttttggcatttccccacagatggccccgtttccctgtcgaaatgattacggttggaagtcgccgtaacccttgtcaaaaccgccgacccaagtcgttttcgagtcgcacgcctttcgggtggcgcgttcgtcgcaatccttcgcaaatcgaaaaaccattcgaaacactcaaaagggacggactcaccgcgtacattttgtcgaagcaattggggcgggagcagagcaaagacggcattccgttgtggtaaatttcaatgcctaaagcgaaaggaaatggcattttttggacgatgtgttttattagggaaatcggactttgggggacttttaactttactttccgtcatttatttaccgtatggaattcgattgttgccacaagtgtgcgcggaaacgaaagaagacaaaatgccaaaacaaagaaagaaaggcagaaaaaaataaagaaaatttgacggattcataggggaaaaaaagctccaaacggaggcgaaaacgcactgaaaaagcggaacttatgaagcgccagtgagtcgaagtcaaaaaactttcacttgcaacaaaaggcaaaaagaaaaaggaaaagcggataaaattggtggggggagggggaggagagaagcaaatagagggaattcaataaagggaagaggaggtcaaatgaaagtggaaaattgggggaggggagtgaaacgaatgggcggggcggggaacggaaagaaattcaatttaatggggggaagtctcgagccaaaagacgagagcattgaacccgttgatcaaacacaatgaatgctttttgtttattagcgatattggcttggattagggcgaggatgaaaaagggtgttaaatggtgagggggggggggg

SEQ ID NO: 8520 - DNA, 873 bp, Heterodera glycines
tttttcgccatccttccaattctcgtcgtccttcgcccatccattggaaacacaattaattgatttggttttgggaggtccaattgaatagattttggaagaaagggaaaaacaaagctaagacagtgataatgagcaaaataagttgtagaagtggaaataaaagtgattcacccgaaaataaatcgttaaatcgaaattaaatgtggaaagagaacgatagaatcaaatcccctttaaaggcgataaatttgttaagaaatgaaacaaaagatgtccatgataaggcatgttccaagttttttccattttgcctttggggagagggaatttaaaggccgccgacagaatgggccaaagactgagaaagggaaaacggagcaaacaacaaattaatttcgtacctattaaattttttatttgtattattaataaaactattctgctggaatgaattacaatacaaagagaggtgttcaaaaagaaaggaggaaaatgaagggaaaaaagaaagaaaaacggtgagaagtgacgacaccaaacaaaaccggagatgaacacatggaagaacatggacaattaattgtattagaaacaaatttataacggatgaggaatttgaaacgatcagttgactagaaaaaggaataaagaggagcaatgctactgattgtgaacggaattgtcaatgggctgaggaaatgttcgatatttggctgatccttttggttgtgtaacggcccatcctcggcccaaaagaaagagtccgttgaatcggcgattggtgccgtccgccagcgaagaatttctgctgttccgatggattgtgccattggtcccgtgccgacggcgaccccacgggattctcgacgc

SEQ ID NO: 8521 - DNA, 1672 bp, Heterodera glycines
cgttggtctttattgctggcggaaaaatttcgtagtactttaattttttgtcacaggaaaattttttgaaaatgaaaatccgatcaagattagataaattaaatttatcggaaaactaattctttgcattgtacgaatagccttaagagggagttcttcatttgcctgcaaattttcacaaacttaatacctgtgaatgaaaaaaaaacaactgattttcttatcttttgagattttataaaaaaaaaattattttttttgaaattttgcacattaataaaagaacattttgaactatcgaatggcaaaccaagaaaatgctcaatttttttagctgcttctgatagaattatatgattacttattacaaaaaaaaatgtattaatcaatatggtcgtcgtccgggtaaaatgtgtgtgcttgtttgatggaggaggtggaggaggaggagggagcaggaaaggaaacaaattatgcgagtgagcgaatgaatggaggcaaaaaagggggaattttttttttttttttgatgggaaggttagttttttttatcagaaagaatggaaaaaaacactttgtccttgtgagcgtattattgtaaagcctggggccagcgtgggccgccgcgttaaattcgcgaaatgcgaaaaatttgaaaaatttccattctcttgaacattcaaacagcatttatgtatgtacaataccataaatagaaattgaaaacaaaaaggaaattgtaaaattattccgggtgaatgaatgcggcgaaaaatggtaagatttgggcaaccctaactgggcctttccaagaagaaatttcatcggtttagacattttttgtcacattccttttgtacccaccgccctctaaaaaaaaaaaaatttttttttgtttttttttcgagggtaatttatgcggtgaacatttaggaatttatcatgaaaaattgtcaaaaaaatttttcaagcgaacataaaagaaccaaatttttaggttagttgccaaaatgttcaaaaatcaatacagggttagttaaaaataaaaattattatacatagaagaaacccaattttatttaggacccatttaaaaagggcaaaatttttttatgggccaaggcctcctcacaagcgcacacaaccattgagaaggggggaagataacatgaaaacatgcaaataattgggggagaaaaacgcatgacaagcaaattgaccgaccaaaaacgagaaaagcatatgacaagcagcagcagcagtgatatttccaaagatttgcccttaattgggcgtttcatcatcactctttttttgtataaaaataaataaataaataaaaaattctttttttaaaaaggaataaaaaaaatttcaggatgttttgccgaatttttattggaaagaaaatgcaatttttaggcattcaaatcacgtttaaaaaatttaaccattgaaattttttgctttttgaccattgattgataccgttattttcaaaatttctttgttttcactctccaaatattcttcgacctaaccaattaaatcataatgaagggattttgggatatatatatataaaatcagcaacagagggagggggaggaaggaaatctttaagaaaattcgtttgtttggattttagtgggtggaggaggggaaggggggg

SEQ ID NO: 8522 - DNA, 3600 bp, Heterodera glycines
cccccccccccctcgggggaaaggttcaccccccccccccattttcccagcccccagcagcagcagcaattcttgtcacccaacaacaaatgcacacacacacacaaaaatatattaaattgtgatacatatgtaatcacttatgattagtttctgatgaattattaatgatgatgatgaggttgggaattgcattttttgttgtttttgtgcggcggtgtgttgttaagtttgtgaaacggtgaaggaatggattaaagtgtgaaactgacttgactgatgtatttgtatagatagagagaagagagagagagtttcggtggatcaaagaacaacaacaaattgtgattggttgataatgatcggaagaagagtggtggaaatgaaatattatgccaatgatcagcaggccaaagattacgctgaccatgtgacccgttttcttcgagagtccaagtctcgaaaatgtaatgccgagagtactaaaaaaaattctcgctcccgagtatttggtagcttcagtctcaggttcgtacaaaatttctttgtaaaatcagcattcaaaaatgagtaaattttgtgaaaagccaaaaatttgattttttatatacataaacactaagcaaagagagacagctttttagcaatgttaattgacgatttaaaaaatttttagaaaaaaaggaaattatagttaaggaattttttaaaaaaggaaaaattgacgatttaatgaatttagaaaaatggaaaattgactgtgcaaagtttagcaaagaagaaaacgaaaatatttatcgtttaaggaattttgaggaaaaaaacggaaactttacagttcaaagaattttaggaaaaaaagagaaaaattgacgatttaatgaatttagaaaaaaaaaaccggaaattgagggttcaaagaatttttagcaaagaaaaaaaagaaaaattatgtttgacgaatttctagaaaaatttaaaaaattgacggttaagagaattttcagcaaagaaaaacaaattgaatacaaattgaatacctatgttacacaaagaatgcaaaattgaagaaattctctacgtctagaaaaatttcgattacaaatatgtatataattagctttttagcaaagggggggggcaaatgttatggataaaatacgtctgctccattcatcgatttgtcgttggcatttttttcaaatatgctaattaagaaatcaaaaatgcccaagtatgtacatataataatgaaacccattaaaatttgaaatgggaaagggggggggggggaattgcccctcgcccaaaatgaaaaaaaattttacccgaaaatggattttttttaaattttagtcaattttcttaatttatcaatttttcccggcggcggctaacacggacggcattgttggatcacaatttcccatatttttacaaaattggtggcacaagccaagcggaagaaaggtgaagtgaggtgaaagtgtggtgtggtgttgacaattagcatgagtgatgatgggatgggaccacagagagagaacaatcatcagaagagcattaacggggtggtacacacaaaaaaggaagggattttgtgcctggggcaattttctgggaaaaaagaatttccgggttgggagaggcatgacctgacgattttaattcattttcaaaaacagtccagaaaaaaatttcagcaggtggggtgtgaggggtaagggcgaaaattttcaaaattttcaacctcaatttttgagttcggtagggctgaataaatgaaaattctgtattatttttaaaaaccgtttaggttacgacgaccggatttttttttatagattttttgcaacaaaaattttcacagtgatttaattatttcttataaaaatatgtaaatgtaaaaaatagtattattaattacaaaacatttaatagtgcctccctttttaacgtaccaaaagacaaaaaaaaatatttctcatttaaaaaaatatgtataaagaaattgtagggattaaatttatagtcaggtgatttctaatttatttattttatcatttttaattaatccctcccccgtaaatttattttcttgaaaatatttttttctctaattgattgattctcgaatttgcttttctttaaacaaatgagagagagagagagagagaatggaataaacatggaaatgctgaggccatcattacaatataatgatgtatttgcctctttaattaattggcagcgagaaaaaaaatatggtaattagtgtttttggggtaatgagttcattagcagaaactatagggatataccatatttactaattagtggcccccgggggctctgtttttacctcccccccccccccccgaaaggggggctttatttcatagggaggctataattcaggggggggggggctctaatgaagtaaatgcggtaattttgtattgcacggctttgtacagtatgcaacaaacatacagaagtatttacaaattcattgtaaatattattattatttggctgtgcctttttattgccattgcagtagacgcctttccgatactgtacttactacctaccgtacaccatcgtactcccacaaaaaaattatttgaagcgggcaatttaaatttttataggggacattagtcatatcgcgaaaagaattgaaaaataagaaaaatgtttttttatgattttaagagatttaatttatatatattttttaaatggatatgtggaatctttttttccaaaaatcaatgcgccaaaagagatcaatgctttcaaatgaataaatttagctaattttaattgggcttttttattgggaaacaatcatcctcaaatcaatcaaatattccttcttctaagctcgtcgaatactatatgtttttggactcgggccaagaaatggcaactgtcatcgatcatcgaagagagcacactcctaattagcccaattagtaattcattaattacccatcattgaatgacactttaatttttgttatttaaaaattacattaattgaaaaattaaaaattagatcaaaaaagaaaatttacattataagtaattttttaaatcaaaaaaatcgctataatttttatgataggaattaaaggcactctttcgggattatttacgtaaatttacgtaacaatcggctgactaataaaatggatttgtgaattaattgttgcataatttacataatgtatgtagtcagtgggactattacatataaatatgttgccatttttgtgcatatgtacagaaaaatatatcatataaaatggggggagcctaaagtttgttaatctgcattaaactaattagcccaatcattaattgggttgtttacaatctacttttttgaattgttttaacaacttaattagcacctcgttaattggtttatgcattgttatgtatgtatgtaagatctatggccccatgaaagagaagcaataaagcgtaagataagtgaattttaaggaaagggatagtcccctcgaagattaagcaatatttgcatttaatttttttaaaagcgaaaataaaaattttccatttttaaat

SEQ ID NO: 8523 - DNA, 6130 bp, Heterodera glycines
attctcaccgcattccgtagaatgtagccgaacagcccaaatatttgtattacaattggaccttgcataaaaacattgccagccacaaccttaatgagcacatacgtaattcgtgccatttcaaacttaaaataaaaatttaaaaaattatttaatttttttttttggcataccatcacaatgccagcactttggcccaacaaaatgcgcttcaaattggcatggaaaaccgatgttttgatgattaatacgacaaaaaagaatgtgctcagcagtgaaattgggtgaactgccaattcaatgtaggtcaacacaatgccagaacaaaaaatcagctcagatggcgatgaattggtggtattgtttggcattgcaatggtcgaattgttagacattttatttaatctaaaaatataaattttatttaatttaaaaatagataataatggaatattcgcaatttatatgttcattttatgcaattttaatgacattcaaaccagggatgggccaaatcgaaaaataaaatgcgaaacgagaaaacgcaaaagcgaaagtaccgaaaaaatctaaatttgcgaaagtaaaacgcgaaagcgaaagcccatccctgattcaaagtaatattaaatggcagttttgctgctgaattaaggtaaaaccttaattaaaattttattgaggtggtaagactaataaatttgattaataattttcattacaaattttttttaaggaaactctttatattccagttatatttagggtaaaaattacagattatatgaaagaaaaaaatttaacgaattttcaaagaaatgccacgaaatgccatgccagaaatagtataaaaatgtattctttttgcaagtaattagcgttacaccaattattttcaacaaaaccatttaaatgtgcaagcatatcaacatacaaaatattttaatgagatgagataaaacgtcagtatttaaaaaattaatgataaaagaaaaaaacttttaaaaaactatttaaaaacaatttttttaaattaattagttttttgagtaattttttttattgaatttaattatatgtatattaaagtgatttggtacaacttaacaaaatttgaataaaaaaaaatgaattcaaaaaataatcccagaaaataattttaaattttttttttactatttaaattattttgttttatgaaaaattaacagaaagatcgcattgtgtcattttaaaattaaaaaagagaatgacatttaatgaaaagacacaaatgataatgcgcacgagcattaaaaggtattcattataatgagatggaaatttcttatggaatgccaattaatttctacaaaattatttttatgaatttgaaagaaattttaatattcaaatctctcttctcgctcaattttcggagttacgagtcaaaaactctaaaaattggtttatgagaaattttggtttttccttttttttgtttgtaaattttgtgaaaatttttggtaaggtaataaattttatttattggcactgttatattccattttattaatataaaatataataattaaacaaattaaacaaaaatggattttttttaatttgtaaggctttaaaatttcactaagttttcaatttttattgaaaagcgtaaataaaaaatagcagcttattactaaataataattttttccaatgataattcaaaatatttggatggtcattattagggactccatttttaggcaccaaaaatcgcgaaataggcacctaaaaaggcagaaaaaatcgcaaaataagcactaataggcacaaaaataggcaaacaaatttttttattaacactttttagatagcaaaacacataaaaacataaaaatttcatttgatgaaattaataaatattttaaagttttttcgaataaggtcaaatttttaaaccaaaaatttttattaagaaaaaaaaaaattaaattttgaggataaatttttaggaaaattctttcatttcttaggagtgtatatttttcgtttttattgcatttttgttaaggattttttcgaaaagcctaaaaaaggcgtcaaaaatggcgaaataagcacaaaaataggcatttagtcaaaattccaaaataggcaaaaatcggcattataagtcttcgtatacacccaaaaaccaaacggaaaacgcgtgtttttcgtgcttatctgtgcgtattaagtgcgcagaaattttaggcatttgcctaaaaatggagtccctagtaattataagtagagtccggaaaagagggtcggtcgaacggtttcggttaaaaactgaaaaaaaccgaaaccgaaaaaaaccgaaaaactcaaaaatttatcggtaggttttttcggtcaaaccgaaaccgaaaatcgaaaaataccgaaaaaaaccgaccggtccgataattataagtaataaggcagattaaaacattccaaaaggactgagcactaaaaatagatattatttagatttgctatttgctgctaatgcattttaattcccacggaaatttgagaatggcccaaattatttaaaatcgaagaaattatttttgcaatgaaataaatgtacatacctattttaatatttagaaaataattatgaattcaaagaatcacacaaataaaatattctcaattaattttatatattttgtatttaccgaaaaaaaaatcagaaaaagaggcttaaatccatccaaatttagctacacataattgcttaccagaattggatagttttttattcatttataaataattttgttaagcccaaaaacacgcaatcagaaaacgagtttagcatgttaagcggaccaaaaatataactgaatttttacggcagaatcttatgattttgaagaaaaaaaatgttgttatgttttgtgatgattttatttttttagaataaatgtattgtattaaaattaaattaattcgaataaatgtgttttccggttgggttataaaattttttattatttcaattctgtaaattcttttataaaatagtattagaaagaaaaagttgaaattttttcatataaatttgatcaaatatatattactcattaaagaaaatcaatgagaaaattctaaggtcaactgtccttttatatattaaaaaaccagcagcaggacagctttttgtcccctcattttggaatggtttcaatttcaatgaaagcacgcattagtaagaggcgcttcatctacgataaacatgcaaaacaaacaaaaataacaaaaatgtatatgaggaatagactataaattaataatgaatgttaattatatttaattaaatacttttcaaatttccaatttggtcatgagatgttggattatttgaaaaaataatgtttttttttattttataaaaaatgaaaacaaaataacttgtattcaataattgaaaaaaagcatgacagacaaaattttaaaatgacttttatcactctcaacaaaattattatttttatattgttttgaaacaattgttttttccgtttaaaatgtcttttgagaaatgcccaattccttcacaatttttttctgttttgtgttggccatataaatttttaagttcataaattcgttcaatgaaatttcgcgtttttcttcataaaaatgattttttaaatttttttatttaaattcatttcttttttccatttatattttttgcgatttatgctgaataaattaccaatttcctctcaatttttatgtcattttttcagttggtattttcctttttctctcattttttctttaatttgtttcaaattttgaatgatttcatttttctgttgatcatttgattttgttcaatttctatcgctttttcttctcttttatttttgtcccatccctcgccaaatttattttgtcaaaattttgttcggattttgccggatttaatttcataaaataacaaaataataaatattaaaagccatgaattgattttttacaatttatacacgtcataaatcaccactatttaatttagggttcggaccccgcccccgtcacccccgcccccgccgggggcgggacaggttttttggcctcacccccgtccccgcccccgtgactctgacccccgccatcccccgcccccgcgaccttcacccccgcgggggcgcgggggtgaaaatacacccctaagaatgacatattcatggataaaaggcaaaaaatttatacaattttgattttttttaaccattttgacaaattttttatgaattaaagttaattttattattggtcattgatgtgtagtgtggtgtagtggttagtgaatcaatcttgacattactttctgtcgtgagttcgattcaagttgacggtttcttttttaatttatttttttaattttaaaattcgcctggcgctgcctatcggcatcgcagggcccaaaaattcgtaaatcttattaaaaaaattctctaaaaattgcaaaaacctatcattttttggacaaaatctattaacagatccatcagttttcaaaaaaattttcccggcggcgcctatcggcaccgccggacccactccctcgcacattcaccaagttttttttttttgggaaaatgtgcctcaagaaaatatgttacaaatctgagttccaattttgcttgagtaaatcatgataatttaatatattaaaaaacaaaaatttatcgtaaaaatcttatattttttttgtaaacatctgttagaaatcgagcttaaatttcaaaattcgccaggcggcctatcggcaccgccggccccccaaaaacctattttttcttaaaaaattagccaaaaatctctaaaatttggtaattctttagacaaaatctgtgtaatttatgccaaaaggaattgaattgaggcgatacattgactaaaggaatgtggagccatcacatcattcataaaaaattaattttttgtaaaattttttggagttaattcaaatcaaacccccgcccccgcccccgcgggggcggaattatcgtgcccccgtccccgcccccgcgactctgacccccgccatcccccgcccccgtgaaaagccacccccgcccacggggtccgaaccctagtcaaaaaccatcaaatgaaaatatttttttgatataactttgctcaaaagcaaccaaatttttaattacttatatcatacaatagactttgttgttttctattagcctaaaaagtttcaaaaagtttcgttaagtttcgagaaagttatgacaaaaaaagttgtaaaaaaacttggtttttctgagcttctcaagtcataactttttttaaactttaagaaattttttcatattttgtaggctaatagaaaacacttgggcctatcgactgacatcaagattataaaatttagttcattttgggcgaagttatgcataattttctgtcaaaaattttccatttgatggtcttttgactaacgcctattttcaatatgcattaagtttatgcaaattctataaaatataaggacatagatacgtttatttcggcattcagtaacatacatatgtataactttaaatagagtttatcattatgggcatagatttatattcatttgtagcgactctacacttaactttatatagagtttatcattgaaaaattaaaaataaatccaaacatcctttttactgaacttttctataacaacaaagaagaaaaaataataagaaaaaaatattaagattctttaaaagaagagttaaaaaaaaataagaatttgacttgatttatattttgaaaattatgttttatattcaaaaaatgatgtaaacaaatataaaagtggaaattcattctctattttgtattttatatatctttttttgtacaatgtttcattaattctggagtttcaacaatgaagcgttttttttctaatccggattttttgacatcaaaaaacaaaaattaagattaaaaacgtttaaaatactattttgtgttctaataggaaaatgtctgtttaatatttttttattttttttttattttttctttcattgcgcgctataaaatgatgtcattttataagcatattaattga

SEQ ID NO: 8524 - DNA, 3959 bp, Heterodera glycines
cgaggctatggaaggggaagaggacgatgatgccgttgacgaggacgccgagaacaactggatgctgggatacgaagaagccggggagaagccggagtcggtgacgacctacgcatatgcacatgccggtaaattcaattatttaaaaaaattttgaaatataaaattaaaaaaaattaaggctctcggtatgatcacgtgttgatatacggggaaatgctgcgcatgggcgtgcggcctgaactcatccgccaaggcaaccatctcctagagatgaaggcgcgcaaaacgggagtctacacacccaccgtgtttcgggacaggtaaaaattcaaactgaataattttttattttgtcctttcagctacaagctgattccgatcaaattggcaaattttgtcaagacgtttggcctggaaattgagggcgtggaaaacaagaaatattttccacacaaattcaataaggtaaagataatttattgaaaaaaatgataaaaaattaataaaattttaggcggaaaattatggcactatgttggacacactgccaccgatggaggactattacccaggtggactcttcccggtagagcgcgaaaagttcgagcaatggtacgacgagaaccaagaaactggttttgagctgagcgaggtcatcgcggactactgcaagacgggtaaaaaattataaaaataagaaaaattttttaacaatattttgaagatgttcaaatcctggcacatggtatggtaaagatgcggcagctgttcttgtccgagactcggcatgacatcacggattcggttaccatcccatccggctgcatgaagtattgggtacagctggcgcaccacgacaaagagcgcgtcgccatcatcccacacttgggatacgagaagcgcggcaagcagagcacaattgcccggaaatatttgaaggtgcctaaaaatgattataaatttacattttgccatttctaagtggcgtgccgaagaagagttgcgagagaatggccgagtcctccgccatgtcgaaagccctggaggggagttcaaattcggcaactacagcttggatgggatgatggagcgtccagatgaggacaaaaatttggccattgaggtcaatgggtaaggaaagaattccgaaaaggtgccaatttccccattgaaaaaggtgctattggcatggatgcccaagctgcttccccgacgatgcggcaattgtgggcggaggagaaacagccggtgccctcagggcccgtgatgccaagcgaacccgggacattgcgcgggagttcgaggtggaaatcatctgggagtgccacctgaacgcaatgctggaggacaacccagccatgaaggcgtacttcgacaactgcccggactccggaccaatttggccgagtcctgcgccatgtcgaaagcgctggaggggagttcaaattcggcaactacagcttggacgggatgatggagcgccctgatgaggacaaaaatgtggccattgaggtcaacgggtaatgaaaaaaattccaaaaatgtgccaattttcccattgaaaagatgctattggtatggatgcccgagctgcttccccgacgatgcggcaattgtgggcggaggagaaacggccggggccctcagggcccgggacgcaaaacgaacccggtacattgcgcgggagtttgaggtcgaagtcgtttgggagtgccacttgaacgcaatgctggaggacaacccagccatgaaggcgtatttcgacaactgtccggattctggaccaattgacttccacgatgcattctttggcggtaccttttccatttaatttttaactaattttccggcacaggtcgaactgggcccgaatacttgggcgcatcggtgatcaaccctgagacgggcgactggaaaagccgaacgatcaaagtgaaagactttaacagtctttacccatcgcggtatgaaaatgcgaaaaaaataattaaaaaatctttgaaaattaaagaaacatgttcaccaattacccggttggccacccgaccgtggtgcagtttgacaaggacgtggaatggaggagtccagcggacattgtcggcgacgacggcatccgcctcgagggcatcatcaagtgctacgccgtgccgccccgccactgtcactacgacatcccggtccttccctaacggctcaacaaccggacgttgttccccctgtgccggacgtgttcggaaatgtacccgcgcggcttgatcgaccccgagtacaactgcagacattttgaggactctgaaaggggtgggtttagaaacttttattaagcaaatatttttcttgataggattttcgacaactgtgacgcacattgagctggaggccaccctccgctctgggtacaaggtgacgcacgtgtaccgtgcctacatttggcggcttgcgtgcgattggagcaatgggctgttccactcgtacctgctcaaatttctcaaaatgaaatttgagggtaaaatttgaaaaacttaataaaaaaaaattaaacaaacaaaattttaagcaagcggatatccagcgtcttgtacgtaggcgggcatcagtgaggaggagtcggcacggagaaagcaggaacacatcgacaaggccaaagaaaaggcccaagtccatcttgaggcggaccgaatcaaacacaaccccggactccgctacctgtccaagctgtgtttgaattcgctgtggggccggttcgcacttcggtaaaactttttagaaaaatttataaaaaattaaaaaatcaatagaaatcggctcaccaaaaccgaaatcgtcgagtgccatgcggagctggccaaactgctgaacgactcgaagattgaggtcagcagcatcgatcagctgacggaaaagttttggatggtctgctacaaggccaaggatgagcatgtggtggaacacagcacgagcaacgtaagaaaaaatttttaaattttgaaatttatttgcctttctcaggtggccattgccctatggaccacctctgctgcgcgaatccacttgctggaatcgctgaaaaaggtgtatggccctgcaccaggtgtagagcgctacgacacccgcattctctacatggtaaaaaatttggaaataaatgaaaatatgaagtaatttttataatcaggacacggacagcatcttctacgactacctgacgcggctgggggacccacttccgggtggtgagcagctcggggagctcgccgacgagtacccgaaccacacgattatggaattcatttgtggtaagactcattaaaaattaaacaaaataaatggaatgtttgtttagctgggcccaaggcgtacggattgtggctgcgcaacaacgcaacgggggaggacgagtacaagctgaaggtgcgcggcatcacgctcgactcggatgcctgcgagcgcatcaccttcgagaagatgaaggacatggtgcagaacaagctgggacagccggacaacaacgtccgcttcaactacccaacgaagaacttccggatcaccaagaagggagagattttcactgtgcctctggtgaagcagttcaacccgaccgtcaataagggggtgatcagggatcacggcttgaaggtggtgccctttgggtacagcgacgaagagtggtgtaagtggaactgccctggcgcttgcacctgtctgttcaactcagacctcaatgtgaacatgttcacagaagaggagctgaacgaccccgacattatgccataattgtttttattttttaattttcattaaatttgtaatatttttattcatttatttcatcatttttcacccaatatttttccggaaacccaatgaatttcaccaatatttctctttttccatctctcactcgttctttgtatttctttttcattcgatacattgtggtttcatccacttgtact

SEQ ID NO: 8525 - DNA, 2599 bp, Heterodera glycines
tggaatcgttgaaaaaggtgtatggccctgctcctggtgtagagcgctacgacacccgcattctctacatggtaaaactctggaaataaaatgaaaataggaaataattttttataattaggacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttttgtttagccggacccaaggcgtatggattgtggctgcgcaacaacgcaacgggggaggacgagtacaagctcaaggtgcgcggcatcacgctcgactcggatgcctgcgagcgcataactttcgagaagatgaaggacatggtgcagaacaagctgggacagccggacaacaacgtccgcttcaactacccaacgaagaactttcggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgcacctgtctgttcaacccagacctcaatgtgaacatgttcacagaagaggagctgaatgaccccgacattatgccataattgtttttattttttaattttcattaaatttgtaatatttttattcatttatttcatcatttttcacccaatatttttccggaaacccaatgaatttcaccaatatttctctttttccatctctcactcgttctttgtatttcttttcaattcgatacattgtgttttcatccacttgtacttttgttaattcgggcaaataaaattttctcttcaactttgtgccataatagtctttgagcaaatagtgctgggggttggttgagcgggcctcgtctactgtgtaaacgtgatcagagtaattgggtatataacctaaaattaaaataaattgaccgaaaaaatgtgtgaaatactgtacccttctcgaaaatgtgcttaggctcgggaattctgaccgtttcccctgctctgatttttggtgtcttgtccaattgtgcgagcccttcgccgtacaccctcttccagacctccctcgcattggcgtcgctgatttcgttgggtctaagtccggtcgcgcggcacaccgagttgttgatggcactcaaaaactttggaagcacatccacccacaccgacgtattgttggcggaaaaatatttgtacagccgagtctttagggtgcgtatggcacgctccgcaacggcggccttcttctttgaactggtctcaaacttttgaatgcccttctccgcgtaaaactccttcaacggttttgccacaaactccagccctcgatcggtgtacagtgtgtccggcacccttggcatttgctcgaaaagctcctcaaaagcccttttcatgtccgctggtcgcttactctttacgggcgcgccgaacattcgcctcgatagaacatccaccgccaacagcaagtaccggtagccgctgttcttgcgcgaaagtgcctggaaatctgccaagtccgcctgaacatctgaaccctgaattgtgcacaataagccccagtacaacttaccggtcatgaaacccgtaggcacagtgcgtaggcgtcggaacttgtctctctttggcttgaacagcgtgtaggtggtgttcctttgcaaaaagtcttcaaactcggtacgcttcaacttcgggtgcttctccttcaccgccgcgtacagagcactcgcccccgcatacccgcccggattggccgggtcggtgtatattttgtttattttcttgtccattttgagggaataaaacgcccgctttgtttgacttgtccgacgaacccagacccaacaaacagtcgattgagtaggctactggcgagcggattctgtgcgagtttcctcttcaactctttggttccgcgtggcgaaggggcattctccgggcgagggtccaccaggcgttcaattgaccaggccaggtccgagtcgataaactctcggcccgtctttgggttaatgattttcccacggtcagttgcgccgaatctctgcggatcagacataatgatggccaacaggtggtccttcttctcgatcaatttttgctgttttgctgctttcttattggtcctgggtgatcggctgcttccctgcgtcgggcttgttggggttaaaaactttggcacttcaatctcttcctcttcatcttcgtcggtaaccatcacggacttgtccttcggttcgtccggaccaggccgtacctgcacacccgtctccactgttttatttagcagttgagcaccgttgctgagctgtacccggacgggccgctccttatgttccttgcgcatcttcaggtaccggcgcagctgctggttgtacattgcgttccgctcgctgacgtttcccttccgcttctgtactgcagcggtcacttgtcgtttgacaaagcccaagtttgtccgctcagcaatg

SEQ ID NO: 8526 - DNA, 3432 bp, Heterodera glycines
  misc_feature (27)..(27): n is a, c, g, or t
  misc_feature (981)..(981): n is a, c, g, or t
  misc_feature (1028)..(1028): n is a, c, g, or t
ttcaaattattaattcattttataatntcggtattttaatacactgacatttaaatattttattcaattaaaatttcgataaaacactatttattattccacaggcgacgaacggattgtacaatcacatggtggcccagtgaattgtttggtgttttgcagtaagaatgaaccgtgtgacaaatgctttatctgttgttgttcaattcatttaaaaagctttgttctcagtgaccataaaaatattcacataatttttttactaaaaagaccaattaaaaaaattgaatacacaatatttctaacatgcgctatcagcttataattttttttcgaatttataaaatattctatgaatactaaacaagaaaattttcagttgaaatttctagtccaatgacttttgaccatttttccaatgccctcaactttttcatcaattagaaaaaacattggccctaagacacttccctgagcactccctaaaatattcagtaactcaccaattttaactttggattttcaaaaaattagataaaaagtcaaccttcgattgaaatgttattgattctatgtaatattaaatcgattgaaacaaacagattaaatgcctagataaatcaatattagactcggtgttggacgggatcacgcgtgggattttgcgggatcccattccgcaatacagtattttttgcagaatgcggaattataccctacaggatccggtcccgcaaaattttgcgggatcccattccgcaatacagcattttttgcagaatgcggaattataccctacgggatccggtcccgcaaaattttgcgggatcccattccgcaatacagcattttttgcagaatgcggaattataccctacgggatccggtcccgcaaaatgtagacaaaaaatttgaaaattcatgctagtataacttttcgatgctgatcaaaagagtcaattgcgtgatcagactacgccnttcttgtatgtgatcggtagtgatcaaaatttaagaaccccagaggnccttgagttgcagctcgattggccgacgggaaatagaaattaaaagaaattggataaaattttcaatttctaaattatttcacaaaatttgcttttgtcaatctcgggttgtggtccaggcgttagtctcactcagtcttggtcccagtttttctcataaatccagatcccgtgaaaacattttttgagaaaattttaggaaattgtcaaaatattagtaaaaaaacactaaaatagttcaaggtgaacacgcacaacttcacttctgctgttgatcattagggctggtaattgtattgagaagtctaaaaacaaaagacgaattaaaaatttataaaatagaactgtaaatccatctgagtacggaccactcttccagaaaattttcagaattccgttttttggaacccttccgtttttgggcattgctggttaattaaaaatatatttactgacccatcatccaaattttcctcgttgacatcaatttcaattaggtttcgattccgctggttcatattgtcctcccattcctctgcttccttctcccatttggcccatttgttctcatcgcggcacatcggagaacggaccatcacaaatttcgtaacgtattcaggtacagtaatcgtcccgtactgcccgtactcgagtactgtctttgtcaataccattcgctctcccgtcaaatcattcgtcaaatcgaatggcaaaatcgaagtgtgagcaagcgaaacgagacaaatgttaatgatgaaatttgcaggggaagaagcatacaaaaaggcctgaaattcgatcatgcccatttaaagggtgattgatatccttgattttatccataataacaaaagaaatatgtcgtgatgtcttaaaaatccctgaaaaacaaatttcaagttttcgacgtcctaaacacataaaaaccatgtagttaattaattaactaccgctttaaattcgtctatttttggtgccagttggtactcctgctcagtggattcgagttcgcaatgaaacattcgcggcgaaccgtccggacgagggggcgagcacagtaaccatttggccaacgcttggcaatctgtcgccgtggcactgtcgtcggccggaaaggcgggaaactgtccataggaaaacactgagtgaagggtttggcaatcgcgcagaatggacgaggaagattgacgaaaatggtgcaaattgttgtggtgagtaaattcaatggcgcgaatttcgctgcgtaacattggccaaatgttgcgcacaacgaacgccaaaacgcggtcactttccgtttgaatggcaaaatttgtgccataggaagcaaaaatgggaagaaaacggcacagaaaaacgacgacattgtggtcaatgtaactgaaaaataattgagaactgatgtataatctgataaattttgtcattttttggacgggtcgttgaaaatttcttagaatttttcaatataaatgggagttaaatttaagaaaaccttcaaaaaataaagaatttttcgggcagagtgaaatttgtcacaaattgtttccaaaagacaaattgggccaattaaactgactgtttaatataaattgggctaattttgaaaattcacctattttatgtttaaaccaataaaaatttaaaagctaaactgtccattcccatttcagtgagccttagaatatcggcctcaacccagaaaagtctcgagttttttgaatactcaaacccctgggttgagtctcggtgtcgaggccatgaaatttccggtctcgaccaacactcattgttttcattactttatttggatgcgtggaaatccgatgacgttgttaggcaatggcttctgcggaattggcaacattttccaaccccaattagggatttttccatctttttaatttccatttccttggccccattctcgccaattttgcagcaaatttccatatagtagagcgtccatttgcgtgttttgaagtgttcgtccactcgtccgtcaaatcgacggctgactaacgcaatgccaaggccgagttgagaaggcggcagcaaattgaacaccgcgtgccaatcagcaggacaaatggaacagaaattgaaatttattaaataaatatgttaaattattatttaaataatttttaaattaaataaaatcgtaaattattatttttattaaattacatttctttgtccatttgtttctcctcttctttcggattgtccgacattttcagtatcaaaaatagtttaagacccatttttaaatgctaaaaaataaattgaacaggtttcaaaccaatattcgggtatttaatagcttaaaaattaagcaattttcaggtccaattcatttttcttaaaaaaaatggaacaaaaatgccaaaagcagttgaaa

SEQ ID NO: 8527 - DNA, 3649 bp, Heterodera glycines
ttttaactgcttttggatttttgttccatttttttaataaaaatgaattggacccgaaaattgcttaatttttaagctattaaatagccgaatattggtttgaaacctgttcaatttattttttagcatttaaaaaatctattaaccggccaattttcaaaaatttttattaatgaacaaaaaatgagggcaaaaaaggttcaaaatactaggttttggagttcctcctgtccataatttttcttacatttctgaaaactgaagaaattatctgaaaattttcaagctaataaagcaattcaaaagcaatcgtatgatacaaagattatttaacttagaagtgattaagaaaaaaaattgttgccgacgaaaaatggcctggacctggcggaatagatgagtttattgatcaaagcatcagatcgtaatttctgttcattgaaggtattctggtcgactgcctgaaacatttgacaacgatcatgcccaggagctaatcgaaattgcggagaagtacggactggagccgatgaagatcatttgccaggacaaacttagctctcggtaagctttttttaatggacggacacctttccacacaaatttcccaataaattttataaaatttatcagccacgacggggctaaattaacaatttaaactgtttgtagaaaattggaaaacgaattggatatgttgaaggagctgagcttgactgatgttgagaattgtgccaatgaagaaatggaccgtaccgaaaaacaagtcaaaataagtgttgtgtccaaagaacaaaaatatttatcgacaataataaataataaaagtctgaggagagagagtgaatgaagagaagagaaggcaaaaagcgaatgaatggggagagaacgaaatgtgtaaggaacagtcactatttatgcacttcgacgggcagagagaaaggaaaagacattgagggaaaatagcgaagggaaaagatagagacaataaattaatgcatgtctattttgtcttatcccaacatctccctttttaaatattttgcccgggattgacaagatcgtattttgttttcgtcgtgtccatgtcaaatatttgtgtttgttttctttgacgtgttgaccgtcttggctcaatgatttggacatgttcaagcggttcattctcctcgtcggcaatcgcacatgacgtggtgactgaggtgcttcttgttgctgttcattctgatcttgttgctcgtttggttctgaactgtctctgtacgggatgggaaaagatttcctgatctgattggaatggcgagtaaccactgcgtttaactgtggggaatatattcgccaaacaacaccatttccggaaacaattcttcctgacaaccacatttttgagccgttcctgtagttggcaaattgcactggattgtcggtgcaaaacgtgcgttctttcgtcccataatggcggttgaattgttgtgccattttgtgccggtattgcttatcggttgtgtccgaatgctttttcttttcgtttggcctaactaatgacagaattgtgcggactggacggcctagaaagaattcagctggcgtcttgccgtttagacttgcgtttggcgtgctgcgatacgccaacaacgagttttggacccaatgcgaatcggtttccccacacttcttcaactgacgcttcagcgtgtccacaaagcgctcagcgcgaccgttgctcatgggatggtacggtggtgcaaaagtgtgccgaattccgtgttctctgcaaaatttggaaatttcaaatgatttaaatggctgtccgttatcggtaacaatctcttttggatagccatatcgagagaataaccagataaacttatcgaccaaaattcgagcagtcgtcgtcttcattttgaaaatttctggccacttactgtacgagtccacaacaaccaaatatttatttccatccgcacacgggccggcgaaatccatgtgcaatcgttcgtacacttcgcttggagagggccatggactcaacggcactttcggtggcattttggcagcggacagacactcctgacaatttcgcacccaccggtcaatgtccaaatccattcttggccaataaacgaattgtttggccaaacttttcattctgacaattcctgggtgtgtaaaatgcaatgccgtgagaatgcggttgcgcaatgaactcggaataacaacacggtcgcccatgagcagacaaccatcaacttctgtgagacgtgcgcgctgtgtgtaaaatgcagaaagaggggaagaatgtgccgtttttggccaatgattacgacaattttgcaaaacttctagcaactcttcgtcctgatttgttttctctgcaacttctgttgctgtcaccggtaattggtccaatgttgcatgcaaaacatactcaacagcagccgtgccatgttcaattgaatcttctgaacttgaattgaaatcggaatttgtttgtgccgttgcgatgacatagtcgtcgtcctgctgtgcctcgcggtgctgcatgatcaatcgagagagaacatcgacctgtccaaaatctttggtggaaatgtacttaattttgaaatcgtaattggacagtgtcaaagcccatctttgaagcctggatgctgtataaattgggatgccatttttagacccaaaaatgctaattaacggtttgtgatccgttaatagtgtaaatttcctcccatacaacatgcggtggaatttttgcacggcgaaaatgatggccaatgcttctttctctatctgcgagtagtttctttcggccggagacagagatcgtgaagcatgttcaactactttttcttttccatcggcgaaaacatgactgatcgttgctccgatccctttgctgctcgcgtcagctgcgactacgattggtttggacgggtcgtagtgagtgagcaaaaggtcagacgtgatgatttgtttcgcgttttcaaatgcttgctgctgttccggtccccaattccattctttatcctttttcaacagttcgtccagtggagctctgatgtctctcatttggctaacaaatcgggaataatagttaattgcccccaaaaatgatctgagcgttcgttgatcagacggtgctggcatttccttgattgaccgtgagcgatcagggtcaggacgaataccatccgctgaaatgacatggccaagaaatttgagctcggtgcacaggaactggcatttgttgattttgacacgaagaccccagtcctgtaaacgtttgaaaaatttggacaagatttgaaaatgcttttcggtcgtggttgaggcaacaatgaaatcgtccaagtagacgaaaacaccttccaaccccgacgtgagttcatccattaatttctgaaaaatggacggggctgacttaaccccgaatggtaatcgctggtattgaaacaacccacgatgggtgttcagaccaacaagttgttttgactcctcgtcaagttcgacttgaagataagcgtctttaaaatcaatttgactaaagactgtcgcgccacggagagcattgaagatgtcgtccggccgtggcaatgggtgcctgtaaagttccaaacaatcatttaagcctgtggagaaatcaata

SEQ ID NO: 8528 - DNA, 2708 bp, Heterodera glycines
taaaaatttaaaacacataatatttttatttcattttttatagttttcattttctcaacccaaaaaattgtggtaaaattttgagcgttgggacttttccctttctctcctttttatatttttttatcgcacattgaatcgcaaaatttgtttgctgctcattagtttaaacttttatcccgccaaaaacccatcgtattagcttttattaattagtttaatcgatggcatcccaccattttgatcattttttaattttcaataatttaataaaattaatcaaaaaacataataatttgcttattttccaattaaatttaaataaaaatgactttataatttgtttatttctcctttagtgttgccttcattgttttgtgaatttgccatgtcttcttctccgccaaaaagtgcccattcgccgcttttggcccaacaactgtcgtcgacggctttgtcctccactgcttcctcggcaacaatggcagcactggaaggcacgagtggcacatcgacggacaaaacgacaaaacggacaaagcgaaattccatggaatcgaaggaacgcgaaaatggcatctcgtgagatatttaaaggcttttataaaatttgttgaatatttttttttattgttatttatttttcgtacaaaaatttaggggcggattttttgaaagttcaccccagaaagatcaaattaacctttattttatattttttaattttaaaaatttaaatgagagagagagagagagggtagcgcaaaaagggattataataccgaaaaacaaacatttttcttaaaatataatatttatcaagatgtttttagcacccatctgaccctggtcaacttcatgaagggaatgatcggctccggcattgtaaaatgcttattccgtccattcatttgcaacgccttttctgttctttgaagctgactttgcccatcgcctttaaacaagccggcctttggacggcgtttgggcttgtctttgtgttcggcgcattgaacacaattaccatgcatatgctggtggtggggggtggggagttcaattaataattttgtgatgttaattactataattattgctataattgcggcgcagttaatttttacaaattttttcaattgtccgatcgcttagctttggattgattttttaggtgcgttcggcacatcacttggcaaaaacaaagtgggcaccctcgcaatcatttttttttgcttttttttgtcattacttttccagaaaaggagcgggaaacggtgggggcccattgagttacggtgaggtgatgcacgagtcgttgacggacagcttcgaatgggcacggccatatgccaaaacagccaagtaaaatgccgtgttttggttaggggccgtcccagagggagagggactggcacgaagaaaatgaaaaaatacgaaaacatttggttgtcacccaaaccccgaaaatcatcttaagaccgcggactgttccggtattttggttgcaccagtttaagcttaaaggcaattttcttatggggaatgggcatccctgaagaattttatcaaaatgacggtgttcccaatgattgcagagttttcgttaatgccacaattgttgtgctacaaatgggcatcggtgtactcaaatatgacttcatcgttgcgcaccttcgtgaggtgtttagcgcaaaaatttgaaatttattaaatttatatttttgttaattctatatttatatggagcaaatattaatgaaaacaaacacaaaaaggaggaatgtaaaaaaataattaaaatgagaatatttgtgtggattttggtctttgcaataaaaaattgaaataatagaattcataaatttgatcgctcattctctccccccccccccacaaattgaagctgttcaatgagttcacctccttccacgtgtccaccttcgtttgggctttgataatttttcctccgatggttttgctcaatttcattcggacacttcaacgaattgccctgctcagttccatcggcaatttgtttatgttcggcgcttacggcgccattttttatgttcgcttttttaaaaatttatttccggtcaatttatgtatatttaatatttgaattgtcagaatttgcttctgccgccctatcgaattgccgaattgccgtggtggaacactcccgcaggcattttggtgttttaaaaataattattaatatttttataaatttaaaatgtttttcccgttatgctttagtccgcctgcggttccattctctactgttttgagggccaagcaatggttctgccgatggagaacaaaatgcgctttcctggcgagatggtcagccgcgttggcgttctgtccactggcatggcactgactgcgattttcgacgcggcggtaaaaatcccaataaaaaatgccattctaaacccaacaataaatgttcaggtcggctttctcggctatgccaaatttggcgaacacatccagggatcggtaacgctgaatttggcacccactccgctgcttgtgctcgtccgtttgattttcaccgccatttcttttctcgattttcttcttcagcaatatgtaagtttgtgtgatgcacaaggaaaagtgtattgtagaaagtgggataaaagatttggcgaactttttgaaggggacgaaatgacttataaaacattttttgaatataa

SEQ ID NO: 8529 - DNA, 1886 bp, Heterodera glycines
gcgcgatccgcggccgcggcaatttgaatgcgcggtgcgcgcccgcggttttttcttttttgcgcggtgcgctgcgcattttttggttgtaaaatttttatgtttaaaaatttttcggttttttcgtttcgtttcgtacgaaaatggttattttttcgttttcatgtttcgttttcgtccgtcaaaattttttcgtttcgtgtttcgttttcggttttcaaaatttcttttttcgtttcgttttcgtgtcgaatgctccttttcgtttcgttttcgtatacgaaaaattttttttgtgattttcgcacatcccaatttgggagtttttatataattgggttaggaaatcggaattccgaggctcaaaaaacgaaatttgaacccattaaattcaaaattgcagaaaaacaaaatataattgaaaaaactatttttgctattttagcccctggtcggcttcagcggcggtgtctttttggccttcgtttttccgcccctcatcgacacgttcaccttcgtcccctcattaatgggcgagcagcaaaatgcaaaagtgtaccgacggttggcccggaatttctgctttttggcattcgggttgttcggcagttttgcgggccttaaaacgacgcttgaggacatttttcggccaacggcagcaacgaataatttaattaattaatcgggagaagattttcacattattttgaacacttaataaattccgattgttcggctgctcgaaattctcgggtcaataagtttcgggttctttgggtctcgagtttccgactctcgagcagcccttttgttttgatttttattttattatatattgtaattttgatagtatttatttgtatgtactgatgaagcaattttgttctatttttcgaatcatttcatcttttgctttatgcctaaacgatggcattgtcatactttttgttttgatcagatttgatttgtgagtgggaaccgcaaagtcaaaattttggaaaataaggacaaaagagttcaaatttaataacaccaaaaaagtgataaccatcttctttaaattccttttgacaacttttgttttttcggtgcaattaaattttagcccctctaaaaatttacagcagtatcaattcgcctaataacttaaatacagtaaattcgttaagcattttttttgtttggaaacacatattgtgaggagattatcaaaatttgtaagattctgatttaatagaaaataaaattaaagaggcggaaaagggaattgtaattcatcaaattcatcagaagaaaaaggtacatattagagtgcagcgggaccgggaattttgggcttaaccaggaccgggaccttttcgggttgaaaatccgggaatttttggctgggaaaaccgggaaaaaaccgggactagtcccggtcaaaaccgggacttcggtactcagttgaccgtgtttaggtcccggtcccgttgcactctagtacatatctatgctctctatttttccgttcttttttccataaattttgaattagtgggttaacagagaaaaacaaatagggatgagatcaattacttagttttgaataatttttgttaaaattacatttttgacgctctttcgaatcatgcccattttattgtttttggaagctaattgaagagaaaaaaatcattggtttttctgcgtcaatgataaatctgagtgttcgcttttcgtgaccggcgcaattttcgacccttccattatttgttgaaactttttgaagggtcataattcggcagcattattactagagaccggcgcgggacgggatcacgcgcgggattttgcgggatccccatctgcaatcccgcatttttggggaaatgcgagatttatac

SEQ ID NO: 8530 - DNA, 2137 bp, Heterodera glycines
  misc_feature (1977)..(1977): n is a, c, g, or t
  misc_feature (2002)..(2002): n is a, c, g, or t
  misc_feature (2022)..(2022): n is a, c, g, or t
  misc_feature (2058)..(2058): n is a, c, g, or t
  misc_feature (2121)..(2121): n is a, c, g, or t
tttttttgtcatgataaatattatttttactttacaacaaaagaacaatttgaaaaacaaaatatttttccatcaaattaagaaataaaaaattcttttcgggtattatttaacaaatggatggagagaattagcaatgtaaaataataaaaataattccttaaaaagcaactaacataattaacaacaataatattttaatgttttaaaaagtcgagctctctgcaagaataatcaactgctgattagagaaattgtggttttcggctttatgaattgcccttttaattaaattgatcgaaaacataaaatacttacagatttttgtttaatattaataatgcaattaatggctcatcatcatttgttgttcattttcggctttgtttttggtacgaacaaagaaatgaatgaatttaaatttttaaatttaatttcctctcaacgaaagaataaattacaaaggtttttttgtgttcgatatggcggcacagcttagccaaaatgagcagaattattgcgtcgctttcaacaacaatctccgccgcgtggtggccactggcaatcagcagaacaaaagcggcggcaaattgccaccggccacgaatatgttggagatggcatataacgagacaattggccaaactgcgcaagtgagtggacggacgaattgtacaaattggaccggtggtgtactgtaacaattagagtaacggttgaaaaattaatatggtgcatcttcgggattcccgcctctttgctgttctcgctaacctcgtagatttaacaggaattccgccggaaatatgaagcacataattgagatattctttaatcaaaaacatttcttttacaacgcaggcgtgggccgacaaatgccaattttcgcattccaaagtgaacggactgggcgagaacatttactggtccacgaaggaggggatcagcaacagtaattctgggcaattcaaaaactataaaataaaagaaataatgtttctagccgaggcgttaaataaagcattcggtttttggtggaacgaagcggtgacaattggcatcccggaaaatttggtggtcggcgcaaacaattttgagccgattgggcactttactcaggtgctttcttacgcttagactgaatgtttaaaatccatggccattgttttttcagatggcatggcacagtacgacagacattggctgtggcgtggccaaatgccaagatgcgcaatggaaactgtttgtggtctgcaattattggccgccgtaatttcaatttttttctttggaatttttacttaaacaaaccaattaattttgttttcggcttttcgggattggctttgtgagaaaagaaaaacactcagcctaattgactcattaatgccggtacaatttcaggggtaacgttttgggccaaaccatttacggctcgggtgacacgtgcagtgtgtgtgagtcggggtgggcgtgcgacttcggcagaaggggcctttgtgttcggcaaaatcagtgacaaaatgccaaacaaaaaatttgaagaaacaaagcaaaaaaaaggcggaaaaggatgatgctttaatgatgtgatgaacaattttaaataataaaaatatataattttatcaatttaattgtatagaaataaaccttaaaattacacaaaattacaattacacctataatattcttaaagtttatacacataaatttaaaattgttccccgaatcacttaccatgacgaaaaaataaagtaattgtcataattgcagcattaacgagtggatattgagtgattaatttggaaaaagtctttataggtattttgttttaatccaatatttatatagcaataatacgaccatatatcacgaggtttattttcaatatccaattagattattttgtttgaaaaatccaaaaaagggatgaaatgaaaatgcataaggaattttatttattagttaaaaaanagaagaattgaaaaaaataattatnaaaaagtaataataaaattngattgagtgagtaaaaattaaaaatgatttgtatgntaaaatttgttagaaaatattaataattaaatggatgatttgttcgggtcggtaattgacganatcactaaacagtgcc

SEQ ID NO: 8531 - DNA, 657 bp, Heterodera glycines
gttttaatttatttttaattaagtgaatttgataaatttattaagacttttaaaattattacaatatgaaccagcagcaaaaattaaaacaaaaagaaacaaagttaagttagaacatgacggcgcactctatgttttcgaccaatttagcgcagatgggcttaagatattttggcgatgtgagatgccgacgcacggattctccgactcgtccaccgttataacgatattaataacaacattctcccccaaaatgatcacaattatgcaaatgtcatgtgaatcccgaaaacattaagaatttcctcattggtatttcccgaaactatgaaatgcgtccttagtttgttcccgattttgttatttttgttaaatttttgaatttttataaaattttattttttttcgttcatcgctgacaaattattaaagaaggtaccagcctcaggaaataaaaaaacaaacaaagtaaagaaaattttcgaattcgggttcgggattcgaaaaatggatgtttggaacatatccgaccaatttcattcgtaaacaggtacttacgcgaaaacgtaccccacgcgaaaacggccacgcgaaaacgtatcccagccactcgaaaacgtccccacgcgaaaacggccacgcgaaaacgaccccgac

SEQ ID NO: 8532 - DNA, 3347 bp, Heterodera glycines
agcgcatcggctacgccttcaagaccaccaaaccggagcgcaagaagcaactcgtcatcgagtacaacatctgatggaaggacgcttcgtcacctcaacatggacatgataggaccccatcccaccgcaccaaaattcttcattttgtcccccatcatgtaaattgttgtatctgtatgtaaatttttgtgattgaatgcatatttaatttttgcctatgatgggaggaggagtgatcagtggaagatggggaggggagggatggttaatggttgaccgaccgagcagggctcccagcgagattccgattttagaaaaagcaagttaatacattaaggcatctttgaaatattcgtaaaacggtcaccactactctctttgtttatacatcggaaattttgaaaagaaacacgtattttaaaatgaccgttatttattactgcactgggttccggtattagtgcagttggtacgccacaaaaaaaaaaattgtttcaaactcgaataaaaaaatatttccaggtcgaaaaagttgattattagcagttttcagcacaaaaaatcaccgattaaacactgtaaacagcaccaaattttccaaaataagcatgaaaaagcacaaaaaagtcaaaatcagcacgaaaaattggaaaaaagcataaaaattaggagattaaaggcaccaaaaatatgcaaaaattctgagtttttggtagtattcatttgcaacttttttataagttcttcaatcgcttagaaatataccttatcaacagcttctaaacatgtagggctttcgaatgatgccaaatttataaaatttggccgatgttcgaattgaccaagtattttcaacctttcccccttcgtttcgaactcaaaatcaaaattaatttttcaacaaaattcaatgtatttccctgagttttgacgttttgttgaaaattcaattttcgattttagttcgaatcagaactcatttgtcagggttataattcaaatcaatggagacaattactaattgaacatataataaatttccatttattcctcctctttaatacatatacaaaaatgaaaatattttgactgttttatacaatacaattgggcatggcatttatttgaattcaatatcacactttcggcacttcattctttaactactgggctgattattattctcggccgcctcctccgtcgtttggcggtgtgtccacgccgctgtcattggccactttgcgctcctcctccgcggacaccgcctgctgttgttccgcttccacaaggggggccacctcgtccaatttgacctgaattagggcacagtgtttagacggggaaaaattgcaatttcttaaaattttcggcgaaaataaaaaaacattaataaaaggtggggataagaaaaaatattttttattttttgaaaacatgtgttgcccacgaccccaattcacctgcggaatgtccgtcccttccaccacaaaagctgcgtatttctccgccaccaaacgacgcaaacggtccaacgcggaggcattgctgtaaatttggggaaaatttgacaaaatgcatggatttcccatattattggtcaaattgtatcaaaaattgttagttttggattcaaactacccctccaccttacaaattagggagagcagagctcgtttcacgcccgaaaatttttttctaataaaattttaaaaaaacgaaaatttttcagtgattttttttacttttatgatgcattactaaatttattcaagaaatcgctggaaatttttttttggttttttccgaaaaattctcttaagtttgaaaatttgttgatttttcggggggtggggaggaaacataatgaactccaaattaaaggtaatgccctgtttttcaccttctcgccacttcgtcctgctccccttgctcagtccgcacattgctttgccctcctcctcctctctcttttgactccttctctccttcctcttccttttcttcctcttccaactcgtcttcttctccttcttaatcttccgtgtcctcctcgtcctccttctgttgttgctggtgcagaaattgcgactccatgaactgcagaaacatctcgaatacggctgtgccggtcaacagcgggtccaagtcgccctgaacgccgatgtaacgggcgacacggccaggcaccaggaaaccaaagtcgctgaatgatggatgtagtatgtccctgaaaagcaaaaaaataaccgaattttttttgtttctaaacaagaaaatatgtataccgtatttcctcgattataagccccggggcttctattgttcaacccccctccaaagggggcttatattcgagggggggggggcttccaatcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaatttaggaaaaattcgttttttgagaaaaaaaaattaatagcgctgttctgaaaaggttttttgaaaaacatgaaattcttcctctataagcttctgtttattctatatttttataagacttttgaaaaaagtacaaaaataaactgattttggaattcgggatcataggtgggagcaaatggtttttttggaccatgggttcagatccacttgcctgtaaaaatgtttttttagggtttttgggaccactaatcaagaacttggcatccattttgcccaattccaaagctttgatccaaactcgaaaccccaaaaataatttttaaaaaatgttgcaggcatgtggatttgaacccatggccaaaaacccatttttaacaaaacaaaaaatatatttggtataatatttctatatttgcttgaaaattttttagtgattttcatcaaaatcttttccagtgcaatttattaacagaaattttttctaagctattgcttcgctattagacaatttccaaaaaagttatacataaaattgcgaaaagtcgaaatttttgaagttttttcttttccaggcttgaaaatcttttcgcttttggtaaggctaatagagcatatgttaagagctttcaaatgataccaacaatgttaggttggatgtcaaagaaaaaagctatcgggaaaaacga

SEQ ID NO: 8533 - DNA, 1932 bp, Heterodera glycines
tgaacccaggactcaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttcgtaataaatttttttccaggcttgaaaatcttttcgcttttggtaaggctaatagagcatgttaagagctttcgagtgataccaacaatgttgtatttggatgtcaaagaaaaaagctatcgtagaaaaagagctggcgccgaaacgcgagcgccgaaacgcgtgggtcccgtttgtacatttagtctttctaaaatattttatgaattttaaaaaaatactattttttcagaaaatttttgtgttttaaaagtatttaaaattaaaaataacagaaaattttttgtttataaacacgaaaatatgtatatttttgcttttcccaccgcttctcccaccactcactttatcgtgaacatcattcggctgtccgtgttggtgacactcggctgtgcagttgctgctgtcgttgcggcgccgtcctgcgactgttgctgcggtgccgtcgttgttgtcgctccgttgctgttttgtcgtcattggtggcagtggtcgctttcgttaacagtcgctgcattcgtcgcacactgtgtggccattgccatttgctggcgttgagcatcagcacgggctacaaaagtggggaaaaattttaaaatttccagtggcgcctatcggcacccttccgccggtcctcaaaatttttttccaaaaaatcgcatttcacacacctgcacagcatacgtgtacaaggggtggtcacttccaagggtcatacgacgtacgatcgggccaggggggggtggtcatatgcgattttccttatgacggggtccaaaatttttgacgacctttttttttttttgctttttaaaatctcttttttttgcggcgcggtcttctcaaaaaaatttcgcgaacgcgggagccggcggtgccgataggcgccgccggggaaaattttgtatttttagtgccatttgctagcagattttgactaaaaaatgcccaaattttgagattttgggctaattttgttaagaaaaaatagggttttttttgagtccggcggtgccgataggcgccgccggaagaaaacatgcggacagcgacgaggcgccgccaaaactgtggcccatgcacacgcagcgatccaacgcgagacgattctgaaaaaggggggagggaattttccattttttacaaactttttcactttgaattgtgcccaatcgaatgtttggccgagaagaatttgctgttgtccaatttggcgttcgttgttgttgtccgtcgtcacatttttcagcaaattggcgtccatttcggctaagatccgtcgcatgtgcaccgtctcggcaacacgtcgtttcacctgagtttaggggaatttgaaaattccaattataaaatattaaaaaggcatgaaactcacggaaatagttgaacgtgaaaagacgtcttgcgtctcctccaaagcgcccactgggatcatttgcatcggctttcgcacatgcaggggatccattttttttggcgagggcggcggtgttggtgatagcacctgctcaagcgtatacgtccaacagcaggagccgtccctggaaagcgagagggggaggaggtatagtttgaattttcaaaagcgccatgccatgcccgactcactcaccggtgttccaacgctgccactacgtagccatgagaagccaacgatgcgcacacatccgtataaacgaggcgacagccgccgatgccatgcgagaagatga

SEQ ID NO: 8534 - DNA, 644 bp, Heterodera glycines
tctttgatcgcaacgacacggtcatttacatatgcgcatttttacacaaaattttcgagtttgttgtccgagttttgccaattttttaagagttacatatgcttcgctcccatccatgcttgagcaatggtaatgtactaggtatttagtaaacaatccaatgcatgaattagtccactaactgtaagtcatattttggctgctcgagagtagaatttcaagactcgagacccaaaaatccgaaaaacccggcccgagaagcgaggatcttgagcagctccagtcatatgttttttaatgacacaaaaaagattaattgtaagacgagaagcgaggaggaaaacaaaaaaatttgaccagcatcagaattgaattgaatttacagaagaactcagacaacaaacccaaatatattttttaaataattaaattttaaaattgtgttttttgaaaattaacggaggaaacgaaaccaagaaatggaagaaaaaaaggaagaagtagaggatggctgacaactgtttgatcacaggaggggtgagaaaatgtgtgtggaagcaattggctgtaaaaaaacgcatgaaaaacagtcaccaaaccaataaaaaaaaacacatcatcatctcattaataaaaaaaataat

SEQ ID NO: 8535 - DNA, 1845 bp, Heterodera glycines
  misc_feature (1788)..(1788): n is a, c, g, or t
  misc_feature (1818)..(1818): n is a, c, g, or t
gaaattttgaaaaagcgatctttggaaaattttttaatttcttgaaaataagttcttttatcaatcaatttttttttcttcataaatttagcatattcgaaagctctgcaagtttattgttaaagaagctacttctaacaataagtgattgaagaatttataaaaaaaattgcaaattgcaaaaaaaaatcaaattttttgtccaatgtttatttatttatttttgcttatctgcaagtgtttgggcattaattcgggcaattataaaaggagttatacccccgccaaaaaaaaaccggctatcgcccaattatcccttttcggcagtttggactcccacccaaacccacgaatgaaatttacatcatggaaaatttgacacccatcatacataccatggttgacgggactgatttggccgccgaggcccgagtcttcgcccaccgagctgaccaaacttgacggactgtttgaccgcttgacgacattttcgttgcgcgctggtggcggtgggtgtggcggcgctgcggcgtttgttgagacagcggcggcggcggcggccggagccacagttttgttggacgacgcttcaccacaacgtttgttgttgttgttgttgatgttgtggttgtccccattttgagtgatgactgctgccggcgtcggcgttggctcgacagcgcttacggcgggcactgcaaaaaatgtgtgtgtgaaaaattgaattggtcagcttgtaggcattcgaaccacggcatttgcatattgtttttttgagtttgtttcctttctttgttttaaagaccatagtagtaaaccaggaaattctgatcaattcaaaaaaaaaatgatagaattctgtgacataatcttcaaagttgtacataaatgacaccaaaatggatgatggcccaaaaaagttttttgatatttgagggggaaacaaccacccaacttgcaatttataatttccgaatatgttggtttaaataaaatcattttacgatagaatttgaaaacccatctcaattatgtgtcgaaatcggacaaatcgattaatggacaaattgaaacaggacaaattaatcgaaactggatgtcccttgattaaaatgtgaaaaaaccaaccagtgccaagttggctgatggccacactgatggccgatgatgcgttgttgtcgcacagaaaacgggcggtcagcgccacctccaaatcgtccgtctttttggcgttgaacttctccatacggctcacaaacgatgcctttgcgctgctcttcgccttcccactgtccgcaatcagtgcatgaagagtggcaaaacgtgcgtcaaaatagcgttggccatcggtccggcactgcgacagttcgcccaccagtcgctgctcacgggcagccaacacatcacgaagttcctgaggaaaaaaaattttttttttcaaaatttccatcttgaatttatatctgatttttttccctaaaattttcaagtttaaaaattgaaaaaaatttcggggaggggggtggggagaaacgtaatgcaccctccttccgaggaagtttgaaattttagtttacggagcaaaatcctctaacaatttcatccaaattctcaaaattttcatatccacatctaataggacacaattaagcgctttcaaatttgtatttgtaatttgaagaatatggtctactttttcaagaccattggcccaaatgggcaaaaaaatagttcatgttatagcaatttttcaccaaaaaaaaaccaaatgcataatttttgagttgntttgttaaaactttgcccaatcttaactanatttgctatgaaaaatgacacaattca

SEQ ID NO: 8536 - DNA, 3051 bp, Heterodera glycines
  misc_feature (2733)..(2733): n is a, c, g, or t
ccaattgcttaaacggacacaaatttcgcccgcgcctgtttttccatttttcttgcctggatggacaaactggtgcttctgcggctgttgttggtgattgtggtgatgattttgtgttgttgaaaatgatttctcctcacaatccgcaacaccatcattgccccgctcattcaacaacaacgatggttgttgttgttggagttgttgatgggtgacgacgccgacggaggcgttcgttggcaacgccgtggcggcggggccgcttccgttcgtcaacaacaatttgtccgccaaattggtggccgacgacacgttggagcagttcaccaacgaggaggcaacgctcggcgttgttgtacccgaattgttggattggtgggacagtgacgacgcatttgcaatggctgcaccacccttggacgacgacttctttttctggttccgctttttggcaccgccggtccgttcccagtcaccgagtgccacctcagaaccacctaaaatttgtaataataaatatatttttaatataattgggaccacgattccggttttagacaaaaattcggcaattcaatattcagcagattcacagttatgctaaaaccggaaaatcatttagccctgctggtcacataaaaatggattaagtagtttttatgcgattttgagatctattctgaggttttcgaaaacccttatcatgaaaaaaatcaatgatatataaatccatccaagctcagatttgaaatcagcgcattttcctaccctagaagtgtgtttcataaatttttaaatctttttttttatttccattgcacaaaaatccattgtttaaaatcgaaaaaatgaaagcatacacattaagatatagaccagataaacacaggacaaatttgatgcaattcatgatcagcgagcgccccttgaaaacctcagaggacatcccaaaatcgcataaaaaccactgatcaatctcctactccgatggaaacaatatttcagttttaaaaccatacaaataccttcacaaaatgcgtggatggtccgcgcgacgtccaattcaaagttgtgcaaggccaaaacaatgtctgtaaatatgaatggtgttgaaaatggtaataagaaatgaaaaaacactctttttgcggcgctacttgcaaagaggaaacttttgaattttatcaaaaacaaaaggggggacccttttgttttgcaaaatttttttgagataaaaatccatgaaaatttttgttatccgggggttttagaggtcgctgatcacgaatctgacatctaattcgaggtcttggaccccaagaaccccagggaataaattttcatgacaaaatattaaaaaattttgcaaacaaaagggtcactcaccccttttgtttttactttttgatagaattcaaaagtttccttctttgcaaggtacgccccctccttttgattgagtttaatggacccggtgaatgaccatcttcagtttccaaggcaataacttgccaatatttgctcctttttgtatttataaagcattgattaacaataagcaagaaaaacaaagttatggcctaaaaaactgagggtagttcactgattgaaagccaaaaggtaacaacagagccaaaatcggtttaggtctatgagataagtcactgaaccctaaaaaaatgtaaaatacggacatttttatagactagggaccgacacagaatcagagttgggggtcgaaaatcaaagggagggcttttgatttttttgtcgaccccattctataaaaatgccaaatcacaataaaaagtgactccttttccttgggcccactaaactgcaaaagtgccactctctgccgtccgttcttaccatttgtgctgatgttcttgacaacctcgcgaactttggcaattttctcgtccataattttcttctcgactttcggttgagcagcgacggcggccattttcgttcgcacaacttgggatgaattaatgttgcgtaaaatcaaacaaaaactaaaaatgaaaggaatgaaattcaaaatgaaatagcaaatagcattaaaaaacatattaaacacaaagcaatcagaaaagcgcattaaaaaaattgtcaaattaaaaatcgaagtggaaaaaatgaatgagaatgagtggtggcaatggtgttggctggcactgaatggtcgtgtaatgtaagcaaagcaatgaatcgaaaaaaatgattttttcacttaaaaagacaagcattgctaatacattgggagtgatggaaaagggggagcagacagggagcaaagaaaaggggagaaaaggggagggaaaaggaggggtcggtcgaatggtggtcgagaaagacaaatgatgcaagcagtcagtcagtcacaatcaaagtgaagaaaattttctaaatgtgtgttatttttttgcctcctcctccctatccacaccactccaccacaccacaacctaactctacacacatacatatatgtacaaaacaatccaacaactatctttttgttttatcatcatcatcccattggtgatgagggaatggaatggaagggaggagaaagcacagggagagaagagggaggggagggaggggaagggagggacccagcagcagagccctaagcgattaatgattttgaatggcggacagggaggaaagggaaggaagaggagagggaaggacagtcaatgggggaagacgggagaaggnggactaccccaaccgcccccaaccccattccatcacatccacaccatgttcagagcagcacagcagcagagcccgtcagtcaagtcacagtcaaccctctccccccccccccccccctccccctagcccccgacaggggaagtaagaaaggaaggtggaatttggtgatgatgatgatggtggtaaaggaagtgaagagaagaggagaggaaaggaagagaaatcggtcgcgcttgcactgcacacctccaccaccaccattaccaccacccactgtgagaatggatgaatgaatggcgaatatgtgtgcatgattct

SEQ ID NO: 8537 - DNA, 6488 bp, Heterodera glycines
ttaacgaccttttgctcgggtttaacgccaaatttacgtcgaaaaggtttttccatgtcgcgaaattgcccaataaaatcaattaaagaattattgaaattatgtttcttagcattgaattttcataaatttatttagggttttttgcgattcaatgtccaaacaacagaaagttaatggcagcaacagttcaagcggagatgccggaaggacaaaggggccgaaggaagagaaacaacggccagagacatcgctctaacaaaaaaaagaaaagccgaaaatttaaaaaacgaatttaaaagacaaaatatgacaaattcaacatttaaatcccattttttgggatagcgaagctaataaatccgatttatgaaaagccaattggtgttgaaacattgtatgttaaatgttttagatacaatgatcaaattatgcaatttataaattctttcggtctgtcgaattgagtgcaaatgaaaaacaaattccaaccaaacaataaaatttaaagcgctgtgctaaaagaaaaaattgtgttggtttcgaccatcgcgccccaattcagtcagccgaaaaatcgaccatgtcccactttttggcgcacaattaaaattgcaaaatattaaaaggacggaaggaaggaaggacgaaattcatccgaattaccaaatgaatgtttaatcatttttaaatttaaacaatttttaatcattgcaattaaaattcaaaaattcgctttgctcgtcccccgtccgatgactgattgtgagcatcactccgtgcccccgtccgcccctcccgtcgacttttgtccgtcttcgccccctccgagttatgcttcctctcccacggcaccgcgcaacaatgccaacgacagacagcagcaaaacactgcaaaaggctgctttttaccctcgtgtaaaaatgccaaaagagcgacaaaagagaatgacgcgggcggcactgaaccatcccagccgacttcggccactgtggtcgttccaatggccaaagacaaagtgaccattctatgccttggccataacagccaatgtgagtgccgcggtgagagtccgggagcaaaaataaacatgttgaaaacatagaaccggttaagggaatggccaaattcggaatttctttgtccgatgtcaattacatttttgctgagtcccattttgccaaaggttgccaatccgccgatcgtttcgccatttttcaatccgtttccgggcgacgttcaaagaacaaattgcgcaaattgttggcattcggctgctgtgccttttccgttatcattttcggctttttcgctttcgccgtcggatttatttttgttgttttggtcgactcacaaatgacggaaaatgatgcctttgaccaatatcagatgagaatgtttggacatcacttcgggtgaaagtgcttcccaccatttacaattactgtaaaataaaatttggttttaaattaaaaaataaaagggcattagtcacttttgaccaatttggccgatgtttttgttttaaaaaattggcaatgtcaaaaattcgattaatcaatcattgtttttagagaaaagttgtcctttttgtgtttgtaatgggttattttgatattttattttaaattttattcttttatttgacatggcccccattctttccgtccctcccccctttttttcgctttcgcatggaattttagtgcattttcgaacgttggccgcgtttgttcccatttttccattttgaatttaatttttgatttccattttagtctttctttgctgctttggccgtttggcattttgtcccacttgaaaattgcctttggcgtgccctttcattgttggcacaatatccgaaaaattgatggccaaacattgaattaattcttattttctattaatttttaaatggatcattttatcaaaaaataaataaataaaaaataaataaactaattgtaagcaaattattgctgtgagtaaaaatttttcgacttttaggttaatttaataaaataaaaattaattgactttgagatctttcctttgataattatgaaaccaggatttacaaagatattcgagaaagataaaaaccaccagcagcagcagcaaaggagaaacattctttgttatgaagctgcaattcctttttaattttttaacaaattctgagactaaaaggcactgaaaattgactttaatctgtcaaaaataaattaaaatattttttttgttctaaatgttaacgtataacaaaattaaaaattgtaatggtttaatcaaaaatgcttacaaatcagcaacaaaataaatgaaagaatccaaagtgattgtgaccttttcggcaatttgctgcactttgactatcttctcttacactgtgatcattccccaattgtattttaacatccatcagattgacgatgaggtaaaagcacaacagttgccgcgattgttcaattaaaaccccaagaaattttaaaaggtccgcaacagcgtacaacacttccgagtggagacgaattcggcgtggactgtgctgatgcaggtgggtggaaacacttaaattgaatttcggggggagggggtgtggtcctcattagctaatttagggggagtgcgtagcatcattagttagtttggggggagtacttagcatccatcattagctaatttggccaggggaccccagagattattgcaaaaaattttttgtgcgcttagttccaaggctctgctgctgcgccgtcgtctcccactatagaacccttctccagcattgtcaaccgtttgcgtcgacaaaagagtggcgaatatgccgcacttccttcgtggtttgtcattgacatttttaacagattttacaataccatgctcattaggtgtcagtgtgaaccaataaagccccagtgccctccgggaccgcccggaccaccgggtgagcatggcatcgacggacaacccggacagcacgggatgccgggaaaggactacacattagtctatatgccatccgcggtctgtcctgtcatggactacagccaatgcatgccatgtccgtccggacctcccggcccaccggggccacccgggtctcaaggccgtcccggctgcgagggagagccgggagaaggaggacgactgggcaaacacggagcacccggtaaagaagaatttgggaaagtttttaatcgggttttaggccagcggggcatggctggtgaagcgggacttccgggactaccaggtctgcccggacttcccggagcagcgggggaagacgcggaattcgccccaacgctggtaagagcatcgaaaaacaaaacgcaatagtcacccatgcctttaccatgtaattagcagaatttgcttggtttttagcccggtccaaaaggattgccgggtcagccgggccttcccggcttaccgggcgaggcgggcctcccgggcacacccgggacgccaggccccgagggcccacccggcccagctggacagcttggcctccccggcgcgcgtggatcagcgggcatccgcggcacaattggacttcccggcacagatgccggtggggggaatcaaacattttatttcgggtttcattttaagcatattgcccatgtccgaaccgatcgcccgtttatcgtcgacagaaataatggcagaatatataatattttacatattattatatactataaaattattcggaaaaaaataaaattttatttatcaaatcgcactaaaaattaattgggttttccattatattatatattttgttcattggatttcaataattttatatttttcgaggaaatcgagcttgatcaatggcattctattgaatttccgtatttttcgcaaaatctcaccggaattttctaaataaaaaaagttccggatccgtaaagaaattctcgtcactattttaaatttgaaatttaattcttatggcgaaatgttattatttttttgcatcgatttgctttccattccattcaccattcatttctcctaaaaccagccaaaagccaaataaatattccttgaaatttttttattgcaattatggagttggagccgatcatcaaacagaaacacaaattgccacgagaaaaggtattgtatttgtttagaatttttaaatttggtgtttttaatgttcaaaagagaaatccttacctcaatgtcaccagggactaagattttagcctcagaactattctttagggtatcttgaaaatctttttttacaaataaaagattgtttgattggtcagtttcccaacgacgtgtggcacagagagcgttatgcccgtgacagtctgataatgctcacctttggcagtgccacagttatcggtgtcatttacaccaccagaccgacctggtccaagtggcttttgaagctttctcgcaacagagttgggaccaaaggagcaggttctccaatttttacttcttttacacattttagcaactgacttcccaacctttgtattttttaattatttgttcgaattcgacctgaaaagaaagaaagacccgggtttgggttttggtctgcgaaatacagactggccaatgtgaagccctgactttcaaaatcttttttttcttgtctttcattttgttttttcctttaggttcgtttcgccccaaatgtgccgcccttcttgtgccattcgtcccgatgttgtccaaccgtgccaatcactccactttcccgcacaatttggtctccccaacagtgcatcgccgttttgtggttatttttttttacctaaattagatgccccccccaccccctaaaataaagacgacacatttttcactttcggtcatattaaaaaaagagcccgacgggcttttgatggcccgtttcaaaaaaacaccgggcccgtgccgcccggttagacgggctttttttgctgggcctgacaattctaaaagtccggtactttcctaaattccggctctattaaaaagcaaaacaaatagttgatacattattttatatttcagattgtcggccgggtcattgctctctccacctttttattcgccatgtatatttttcggatggatgagcgttttattaggctttgcgagaacattatgaaagagattgacgatgacgatcattgaatgattgatttggaagggatgaccaatgttaggctttgtttgtgctatcgagataaaaataattcataaacggacgaattattcaacaaaaaattggttcgaatgatgtgaaatttgggacggagctttggttggccgggcttttaaactttaaaaacaccgtcctcttctggtccccattttttggaaaaaatcctaaccgatttgccggcgaaattaggctttaaaagcagaatctgagcttcgagctttgggcaatcaaaaaaaaatttacctttaaagatttgtgggtttgggaaaaatttatttcacttgaaagtttgatcaattttttaaaatcacttctcacaaaaaagcattaaattaaaggatttaaaacccttttaatacgaaataaaggttgggcaaaattgtagacctgtgagggaaccgaaccctcgacgggggtgcagccagcgatcagcttctcacccaacccgtgctcttaccgtctgagcggatccggacatttggacagaagcggacaattggacacatatattatgacagtgaatggaattttttaattattttaaattgtttttacattgaattaaaatttttagattataggtatattgaattttcttaaatacgaacatgtaataaaatagctaaatgattgagtgtttcgtgactttaaaagtgctttttgcattttgctatttgatgtggctttattaatcaaaaaatgtttgcgcatccaccagcagcagaattattttcattcagcgttaagcgatccgactactgtagagactctcgggactgtagtcagtactacggtaagacgcgcgaaagaaggcactgtagaaacggtcgttttgcaaatggtaatgattcgggaatgaataagtgccggtgcgagtgaaatatggcgaggaataattggggccaaattcgggaaaagggccaaaaagacacttttctggattttttagaaaataaaaattcatataggtaactaaaaattttgcagttttgacaacagattctaggttaggccctaaaattaagaaaaaggtttggtttgtcggaagggaccatgacatttttagggggttcggcaaagcagaagagtaccagttttaatttctcttttcaaggacagataaagctaaaacatatttccgtttcaaaatttcacaaaatgacgcatttgtcaaactgaacaaattggtggattatacgtgaaaaagaaatgaaaatttaatttgtttagctgtgatttgaatgggaaataaaagcacataaaaggagcgaatgaatcagtgaaattattcaa

SEQ ID NO: 8538 - DNA, 1435 bp, Heterodera glycines
ctagtgtttgacctttgcatttgctgctgctgacttttctgctgaaatggttgaattatctgttggtgctgctgttgttgaacctgagacaccggaatttggcccgtcaaaaaattttgaagcatttttaaagatagaaaaataaaaatatttttgcccgtctaagtcacaaagtttagagagtgtaagtaagtgtaaggcaattggatgaattaaaaaggaacggggaaaatggaaaataaaaaatatatattaaaaagagggattgattgaaaagcgaatacgtaaaaagtggggatgaatgaggaaaagaagggccaaagaatagtgagtacaaagaagaaaggataaacactcggatggtcaatgcgataatcgggcgtggccaaatgagcagtcatcaagaaataaaaatctatgaagcaagtggaacatatgttgtaaaagtgaaagagaaaaagcaactcaagaaaaagatggaaagggtagagatttattttattcaataaaacgaaatgaaaaaaacaatgaaattattgttgatgtaggaagggaggtgatgagtcgctaaattaggataaaaaattttaagggaaaagtacagaaaatcacaacacgacaaattaattaacgaaccggcgaatgcttaaatcgtaaatgatgccaaaatttacaatgtctgactacagctgtgtaaaaagtacagtgaaattggttccactattgttaggttcgcgttttcacttcctttgcttcttcccccgcagagccttttgccccttcgagtccttcaatttgcttgccaagatattcccaattgtgcaccattaacttttggattgctgaaaaagatgtttaattatctggccacacgcatagttctcttattatccctactcacctaacaaagcgtggtaccgaacgtttgggtcctctgcactcaacaacttcatcactgcttgtttgccttggtattgttcgacaattctaaataaaatgaaattgttttgttcttctgaaattttgcggtaggataaacgtttttccgcgatggtaatgccggacgtattcgccaatgtcatgagcagcaacactgagcggcaatgggtcgctgctggtctcgagaattttgatgagtattctgagaatttgtttttgttatttataagctttataaaaaaaagtaataatccactttatcaattcaaagttcttttcattgaagcgttgtgcattttcgcgccagaatttctccaatttatgcaccggactccactggagtctgcccgatcggacctcggcacagtattcgtcaaacgaactcaaatcctgcaccgaggcgtgaagacgttcagacagaaattcaatgtcgtccacctgaatttgatttaatttcccatacaaaattgccaaaagatatgcagtctctccccaa

SEQ ID NO: 8539 - DNA, 3303 bp, Heterodera glycines
  misc_feature (69)..(69): n is a, c, g, or t
gtgaaggaaattgaaataagctgcagtttcttgtccatccataagcacagagccatagcaagccaattntgagaatattgcagacatcttcagaatggaaaaaggttaatgatacagatttataagcacgacactattaaggaaattttcatgattaaacattgagacaaaaaatgaaatgaacgagtcccttttaaaatttctaaaaccaatttaggaaaactaaactcacttggttgacaatgaaactgtcatttcgcgttaaaatcccttggaaccacgaccaaatagttcgtttttgccgtcttgcataatcatggaaaatctctacccgggatttgtcctcctgaaaacaaccaagaattaaattaaatatatttaaaaataaattaaattcaataaaaaacgattttaattaaagtttaaatggaaatgaaagacctgcaaaaggtcgtcgaaaagggtgagaacgtaacggatcagctgatccttcgcaacttcggtgatcaaattgataatactccgtgccgaattcgtcttgtccttggctaacgcttcgtccctctcctgcttgtttttggccttttccaattcaataatgaaattgtactcattttgaggcaccaattgagagcgcaaatacgatgaccaattcggtttattcgccggatttcgcacttcggcagccgaaaattaagttttcattgaataaaatttaagtaaaaatgtaattggaatcaatgaacacacctcaagctgaagtttgctggtagctgttgtcatgtccacaggcgtaacgtgatgcccagccgcaatttcctcaacgtcaacagcaaaagtagcgccattctgttccgtaaccatttctaaaattgaagtgaaagaaaaacaatatttttgaaatatgaattgcataataataaaaaaaatgaattttgccgatcaacattaagaattttgctaaccgaaaaatggataatcagagaccaaaagttacttttaaaaaggcattcgtttcggaaatttaataattttaattcaaataaattaatatggattcactaagcttttatatttcttcggttaaatactgttagttttaaataccacttagaacattaaattgtttttttttcagaaattaacatccgtttccaattcgcgcaaaacaaaattttaccaatatgacaaaaatattgatctactaacaaaggaaatacgaaaacttgcgatttcaaatgaatacaaaatatctcgtttgaataggtatcagaaacaagtttatgtcagactttgtctgtattttgctgtctcaatttgttttctcccgcacatcggacaaatgcctttctgatacgagcagtctgaaaacatagaaacaataaaaagattaatgtaataaattatctaaagctattgtttagccaatcaagccatattggatgtttttgctaggtaagagaaaaacaaaatttcagttaaaaatcccaaaccttgacaataatacgctgaaatatgatgtgtcatcttattgcagattctgcatttcttaaattcctcacttgcaggtttgaatctaaaaaaaaacgttcaacattagaaatgaacctaactgggcctctcactttttaaataataaaaacaccctttaaaaaaaaattaactacatgagcaaatcgaataaaatctgttcccacatgaatactaaagcttttgcgcttacaattagtttttgtaaaaataaccaaaaaggaatcatgtcaaatttagcaatataagccattttttcaattttctatgtccgtaagactcacttttgtttcgaactcaacaatttgttttcatttgtcactcgtttcgcagtttggtcacttttctccacatggacagtagctaactttgatagtttcttagtgcctatgaatagaaatatttaaaaaacaaggcagccccattaacttacatttctcacataccataacggacaatggtcttaaaatggcgtgaaattagttcttcccttttactaatttttaaggtatttgtgcaataaatagcattcgaatgaatatttattttgatttcaaacatttgttattgatcgttgcaaaaactataaagcataatggaagcaaacaaaacattcgcagcggagatttaagcgccataaattccaacaacggcgtaaaacaatgagctgatgaccaaaggccaaaacaggtcaccaaatcccttcatcattcacattcgtcttcgtcgtgcggtttcttttcgattttgtccagtttgatcaagtcatcaatgcgcaagattgtgattgccgcctccgttgcgaacttgagacttttcactttgctgataagcggttcaaaaacaccggcgtcacgattctgtgccacagcgccttcctccaaatcaagtccagacctcaaaatcgaataacatagataaaaattaattaaaagcaaaaatgaccatttcatatgctcgaactttttgtcggtttgactgcgattatggaaggcacgcagtttggcaagcagagaaatggcatcctgtgccgcatttgtggccagagttttcgggatgaccagcaatgaatcggcaaaagcggccacggcgagttgttcacggctagtctgaacaacaattgtgtaatacagtatgttgcagggaaatgcactattttcactgaccaaattcaatgcaaaattctccaaataaacgttcaatgctgtctcgacagcaccaccgccaacaacaagtttcttgccttcgagaactcgtttgacaacagaaagtacatcatgaacactgcgctccatctcttccaacatcatgtcattggccccactaaatagggattaaattattaaaacaaatgaatacctaatctaccgcagaatgatggaagcagccgatttcaacttcgttcctttgatcaaaattaattcgtcgtctgaaatgcgagtctgtacgacttcgtcagcactgccgagcagtgacgcatcaaattgctcatcaccctccaaagtggccaatgaggcggtcaatgtcgctaaacgggcaattcttccgtttttattgatcaaagatacctccggttgctttcgctatgcgcttcaagtccgcctttttacagcgacgcactccgatcgcaccagcctcaacaaattctttcaaacaaaggtcgtcgatgccgccggtagtcagaacaacgttggcacccgatttaattattttttcaacgcggcgttttgtgatgtccaattcccttaacggattaatgcgcaaaatcatcta

SEQ ID NO: 8540 - DNA, 6107 bp, Heterodera glycines
  misc_feature (5)..(5): n is a, c, g, or t
aattntcgatcactcaatttgatgatcacgtacattcaatttcttctgcccaaattctcatttatttttattattaattatgctttaattttaaatgctttttcaatcatttgaattgttaaattctattttcattttctctcttgttatctccgacacatatctctcgcaaattgacggcggtctcatccgccatatttaagccattcattttttcccatctcgctctcacattattcacttaaaaaattgtttttaatcgacaattccgctcttttgcaattctcatcacatttttgaaattaaatttcttcattggaatttcattgaaatttgtgttttgcaaacagcaaaccggaggttttctgagcaagttttccgccacacaaaactaaactgctcgatttcaaattttggcggaaaaccggttccagcctaaattattgttttttcaattaattttgtctcatcaaaatttcataattgttttccccttttacaagtgaaaagtatctgacattggacaaattgcaaattggacgaaccgaacaaattggaaattggacgagccgaacaaattggaaattggacgagccgaacaaattggaaattggacgagccgaacaaattggaaattggacgagccgaacgaattgcaaattggacgagccgaacaaattggaaattggacgcccggaacaaattggacattggacgcatcgaattggacattggacgcatcggacaattgacgcatcgaggaccaattgagtgcactgtcttggtgcacgtctcagcgcgccggccaaccccatctaccaagacgtgccccggacaactggcgaccttttgtgcacaggcgggttcaatttttttcccaaggggaggtctgattaatctggtctcatccagaattaatcagtgctttaatttctgttcccacctcctcccaaaaaaggcaatcaagttcagtctggactgaaattttcgaagtctcatcttcgaacagtcaaacatttaaagtgcccaatttgaatttgcccgaaaaatctcggcatttcatttccatttcacattttttttgtttttgtccaattacatttattcaaaaaatctcgaaatctcattttcgagttcaaagttttgtccaatcctatcatttcatttctatttcacattttttttttttgtttttgtcccaatctcgaaatctcattttcgagttcaaatttttgtccaaacccatactgtccaatttttcgaaattttattttttgagtttaaattttttgtccaatcccatttagtccaaaatttcggaatctcatttccgagggtctaaaattttttttttttttttgtttttgttttgtgttttgttgtgttgtttttgtttttttttgttttgtttttaacccaaattgtccaaactatccgctcttgataaaatcagagtcttagctctgacagtgcgtggtaaaaagggctcacaaatcgtgaatcgtgtacccttccccttttctgggtttttgttcccctctttctgggtttttaattactgattctcaactcagaacgcagttcggttattgattaaattggagtctcagttccaaagttttaaattgttcggtcacagttcggttattgattattgaattggagtcttatctccgaattttcgaatttggtcagtgatttgagcaatgacagcccccatccaggcattaatcagggggtgtgccagcaaattgggagcattattgggtaccgaaattccacctgacctgggaataaatgccctaccgaatcaatgccaaagaaggctgtacaaattcagaaaccttctgaatgacttagaaagggtggtacaaaagattgaagataatttgggtttggctaatgagtatattggtaaactgagtcgagacaatgcaatccgtaaggaaacggaaatgcaggaattaatgcaggagttacaaattaatgagaaacaaaaggcagctgatgttctcattccaattttgagggacaaaattgaggcattagaagagaggttagacataactcacaacacggatggtgacactacttccggcattggccctctcaaggagcgtgccaatgcgtaaaaatttgccaaaacctgagcttaagagatttgatggtagtccatctcagtggataccattttgggattactttcgtacaataattcatgaggactctcatgtcccaaaaattgataagttcagttatttagactcatgcattgaaggcaaagccagtgcaatcattcagggtattccaattagtgagagtgggtatgatgatgcaatagatttacttttaaagacctacggggagaccaaacgtctaattcgaacgttaaaccgggaatttatgtcgcttccaattagtgagtcattggaagacgacgagtccttgtatttgaagtctgaaaagatttttcgacaactgatttcaatgaatcagaatgtcgaagacggtatgtattacagtaacctggagggcaaaatgtctccagcagaggtgttagataagtactgtgttatcaaggatgccgaagaaaatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaaaaatgataagtaccaagggaggaataaatttcctcaaaggaattcggatcaatcgccccctcgtgggcggaaatttgaaccaaggaaatttcgtgatcagaggcacgataatagtgactcatcagtcagccattcaccaatgagggataggaggaattctccttatcccaaaagggattggtcaagttcaccagagcgtgaaaaacggaaaaaggatgagcagagaaaatgccaattgtgccaaggtgagcacagtgcgagtaaatgtcctaaatatatggatgccctctcacggcgcaacaaagtattgaaaatggaattatgtttcatttgtctaaggactggtcattgggcaagtcaatgtacgttaaagggatataagtgcaacatttgcaatcgggcgggtcatcacatctcattgtgtagatccaaagacatacccaaggataggaggaatagtagttcagaaagttcaccagttcggtcgaagataaatacgactcaagacttctcagagtctgaagaagttgaaaaggaaataacatcggtcacttcgtgtgttacaagtaaaacaacgaaattgtctttgctgaaatgtaaatatgttaccatttataatccagaaaatccaaggcaaaggaaaaggattttggttttcatggacgatggaagtcaaaagacatacatttcgaccaaattggctcaatttttgggtttgaagccaattggtaatcaaaggtttgaactctcaggtttatcgaatgtcgaattgggtaaattcgaatctccaatttatgagtttggccttaaaaagggcaactttgacattctgatgaaatgtcgagcccttgataaaattttgaagaaaattccggtgattgaactcaatcagctctctcaggagcaattacggaaaacaaaattgaaggtaccagaggtatatggtgagcctgatttaattattggaaacgattattataatcgtttgagcattagtgtcttagaggaattacaatcgggactgtatatcaatgactcaaatattggtcaatttttgagtggacaaggaaaggttcaattctttaagtcattaaacggatctcaatccgacatatcatcgtcagtcattcaccatactgtaaaccaaaagtgtggcaatgatattcaatggattattggtcaagtatcggactccaatcacgaaggttcagtagaatgggaactgaatggtgaccaactgagtccgaatgatttaaataaaatgattatggactggaatggtctagaacatgtcggtatgtctgatctcaattcagataagcaaaacgtgagacaaagaatgattgataaaatatcattcaatggggataggtatcaaacagaattgttatgggatgaagaattggctgctcaattgccaacaaattatgatatggcatttagacagttaatgtcaaatttgggcagacttagaaaaacaccggacttgcttcgacaaatccatgaaatcataatggaacaagtcgaaaccgggtttattgaagaatgtgagccattacctattgaagaaaggtatttggtaggaagtaaggttcattatttaccacatcacccagtggtaaaggaaacgagtgaacatactaaggttcgaattgtgtataatgcgtccgctagatgcagaggaggtctcaccctcaaccaagtgttagaaaagggagataatgattataatgatttagcaggcattttaattcgaagtcgaattaaaccaattctcttgacatgtgacatagccaaggcatttcaccagattttgatacatcctaaggataggaatgcaatgcgatttctgtgggtcagagacccatatgtagaagattctcccctcatggagtatcggtttacgagagtcacgtttggagtcatttgttcgccagctcatctctctttgacaatcaaacttcatttgtccaaatacaaggacaaaaaagtaagagaaatagagagagacatttatgtggacaacataatacttggtttagaaagggctgaagaaattcagtcatattactctcttctcaaagagattttttctaaggcaggtatgaatgtgagagaatttgtgtccaactgtaccaaggaaatagagaaattaccaagtgaagaccaagtggtaaaaggaggagtcaaattgttaggaataaaatgggatatcaacaatgacactctggtcatacattttcccgtgtttaagtctgagaagttgacaagaaggaaggtcttagcacaaattgctaaaccttttaatccgaacggatttgcggccccagcaattttgccagcaaaattatttcggcaaagggtagaaacgaataaaaagctcaaatgggacacctcgttgtctaatgaagagctaaatgaatggataacactgatgaaagactgggaaaatcagtcaataacagtaccaaggaatatcattccgaaagaaatgattaaaaattgtaagtgtgaattgcatgcgttctcagacgcatcacataaggccatgggaacggcaatatatttgagagtcattaatcaaaatcaaataaaggccaatctcatatttggtaaaagccttgttgttccagcaataattccatcaaagtatcggaccattccgattttgtaattacacgcaatgcttttgacttcgaaatggttaaattatgtcaaaggtcaaatagaaaaattgctgaaaattgagacggtacaattgtggacggattccacggatgtattagattttctgaatagcaacaggaaattagaaagatacatcaaaaatcgggtagagaaaatgagacaatggaatgtcaaacatattgagggtcaatcaaatccggcagacgttgcctctcgtggcacaagtccggaagatttacagaccaatgaattatggtggaaaggaccgccgtttataagtctaaaaaatacacagtggccacaaacaatcagagaatttgatccaaatgtatgggcggatcaaaatcaagaggtcactgtttgtgaactggcgaatccggcaagggaaagaaaccaaaggaaattgggttcctttctcacagtttatgtgaaccacttctcaaagtggaagaggattagaaatacagtggcgtatattaggcgaatttacaaggggcctcttcaatttgtacaacaaattgagccaattcaggaacgcaaattgctcaaggcaagaagtgaaactataaaaagaattaagcctctcgcggcgaatgaattaagagaggctgaggaagtaattatcaaagagatgcaagtaaattttcctccagatgaaaataccaggaggaatttacaaat

SEQ ID NO: 8541 - DNA, 4479 bp, Heterodera glycines
  misc_feature (4453)..(4453): n is a, c, g, or t
cccattgattttttggctgcgtccattccttccacgccttcattcgctcttcgctttttccctctctcagtcggtcctctttttcccggttttcttggcacttttgatcgtccaatcgtcacccaattcttcacctcgcgggtcaaaatgcttcccacaattttgggtgtccatttttcgctaattgtctccatattttcttcttagcgccctcaacatcgattgagacattcccttctcttttcccctttttttctttttcactgtgtattttgccgtgctttctgcgtctcttttgtttctactgccgcttcctttccctcttcctctctcttcgccctttcttcagcgtctctcttctcctctgcttctctgttagccttttcttccgcatctttcttcgcttctgcttctctattcgccctttcttcagcgtctctcttctcctctgcttctctgttagccttttcttccgcatctttcttcgcttctgcttctcttctcgcctttttttctgtatctttcttcgcttctgcttttctattcgccttttcttctgcatctttcttcgcttctctatgtccctcattgagtttttcggcctccaaatttccattttccgtgtcctttcctttgttgttcttcgattttttcttttttggtttgttttcatcttcttttccccccacttcggtactcattccaattttcttaaatgccgctttgacctcctccttgtctttttttgccttttcttctgctttcttttcttcttcccttttcttcaccttttcatccaattccctctttgccctctttctctgctcttccgctttccatgccttttcttttaaaattcgtccttcttcctcagcactctcttcttcttcaatttgcttttttgcggcttccatctcctttatcttctgattaattagtgctagctgctgttccctttttaatttttctgcttgcgctggggtcataatttggacatggttgattggcaaagaatgcacagtcgatgagtagggccgatcggggttaaattgttgttcacgtagttgttgttgttgtttttccgacaataataattttctcaaatgagtctcgtcgtcgcttaggtcctcatcagaaattagtatcggcgaatcagcattagccattattagagacaggggtaggatattgatttttttgtactgtaaatttgaatttgaacatttttttgcattcaaaaaaatcgttgaagaggagcatggcgagattcatattctttacacatttcgggctcattataggttatccaaaattctggggtgattttgtttttataaatgagtccgtccatgtccaaataagtctcccagtaggttgcttctccattttcgcaaattacattcccgttttgatttaaccacgcttgaattccgttcccaataattaagtcttccctttccccagttataaaaagctgaatattttcgtcaaaaatccaagcggttaaatattcatctccttctttggtcttgtgtatttcccactgggattgaaccatagatttcgggattgatgaaaattcaaaagagtctttcggatatagggcggtgatgacaataccatccaaaattatttccatccaaaataataatccgtgcttgttcaaattatttccatcatcaaattcggtaagcatttccatgcttattgtatttatttcggtctcttcttcttcgtctgtatcttccaagtttttgtccccgatttttctcttggatcccgaattcggctcttcgtttggtaccagaatttgttcctcttttgaaaaatacggtttgcactggtccatgtgtaccgtaaaccccatagcatctgcatgcatctctttgagtgtcaaatttggcttttctacagtaattattcgaaaagggccatcgtaattttgttctagtttatttcttttgtcaattctccgcttcagtaccagcattccttccatccatgggatctcttttgtccatttttgttgttttatcatttgatcggcacatttcctcagattttcttttactgttgtcttaacctcttccattcgttttgtcaactcctgcacatacactgccatatccgaaaaatgatcttccacttttccgagtgtcacttcacttgggagtctagggtcgaaaccatgcattacgtaaaaaggagaattgccgatttggtagttaattgaagaattgtaagcgaagcaaattaatggtaacgctgccgcccaattttttccttccgtgcttgtgacaagcatgtccacaatggtacggttatatcgttccacttgtccgttggccgattgatggtagggcactgtggtttgatgttcgaatccccaagtttttgccaacgatttgaatgttgagctcataaattgggtaccacagtcggtaactactatcttcggcaagccaaaggaacatagaaatttttccacaaaagccgaggtgattgttgttgtcgactgttctcgtagtggtattgtggtcacagaattttgagaaagaatcgatgatcgctagaatatattggaatccgcttttggccgtttttagaggccctcgctagagagatggcgttgggccgttcccgctatgcaaggatcggcgcgcctccggttcttttgccccagtgcatctttccttcattttggcccctgttgttttgctcccacagcattttcagctcccatagctattttcgatcagccattacattcccctcctctcatattcgagcgccctcgctcgagagatggcgttgggccgttcccgctatgcaaggatcggcgcgcctccggttcttttgccccagtgccagctgttgtttctggagtgtcgagtggtgtgaagaccaaacgacctggggtgtccgccaagtgtcaccatattatttaggcgaaaaattggggtggaaggccggatttgaaccgccgctcggggccccttacgtggatccgttgtcttagccactagaccacatccaccactggagggatgactgttgttatggggccatctttccttcattttggcccctgttgttttgctcccacagcattttcagctcccatagctattttcgatcagccattacaaatggctccattggcgacaacccaggcggcggcaccattcgtcgctccgacccattctgcagccccgcccaatcagaaccagccagtgggagcggctccggatggcgtgagtcgccggctgttgggctctatcaatcgctcgttgatggacctcctgcaagcggcccacgtccagagaacagttttggaacgtttgttgatggtcgtagaggcccaacgatttggccagcaatttggtactgtgcgtggcggggacggtaggcgcggtaatcggcgttatcgccgtagtggaaatgcgggaggcggaaatgcgggaaattcgagggcaaatgggggggcccgtcccactcgttttcaggaaacaagaacggccgtaggcccagtgggagtggtcgaacagccggtgcttggacaatctgctggtcaaaatgttgcttcaacttcggaagaaatgccatccgacacttcatcgacttcggctgtcggggtttgagggttgaccgtcctcccgctcctgctgcgggggcgggaggctgtctacgccatattttttgattatttaaaaaacaaaataaaacaaactaaaaacaaataatttgcaaaacaataaaaataacttttcacattaataactttttgggtcggggattagtaacttttgccaatgggccaatttgttgagttccaaataaaccactaatctgtaatcagggcctacggcccccaaccccccccccttttgttaatcccctaaagtgaagtggtgaatttggggcgctgaggaatttggacgctcgcgctgatgctatcggggccaattctgtgcgatggcgtgcctttctgctgttagtctccccattggctgatcatcccctccggcactgttctcgcctaaacaatttgcccaccaaacgacgccctgccccctcgacaatccgcccaaaacgacgccctgccctcccgacgatccgcccacccaacgatgccctgccctcccgagcgagtataaaagaaatgatgagccaagacttgggacttgctttttcttcttcatttccgtctcctacctatcacttttttgtgcttcgacgaccttttcctctgctttacaaaacccaaaaaccacttatttttcattgcttttccattcgttttttcgttaataaaccctttttttgtggtgaagtcttgcctctaggctttttcgctttcgttggctttaccatttccccctcgtaacccattgcttctcgcccccccccccccgtttgtttgacccattttttcacccttttgctccattgncttacaagggactcagtccccatttt

SEQ ID NO: 8542 - DNA, 1055 bp, Heterodera glycines
tgctcattgggctcatttctccgcttgctgatctgcttgtgctcgtcccaattagcttgttccgtctccatttgtggcgtctttttacaaatttatttgtcgaaacgaatttaattggtaaaaaaaaaattttccgttttcccctccaaattttgtgcttttagtgctggtatggagcgtgtacagctttcatcagttcgttttgtacattcagccaaattggccattgttggaaattgtgaaattggcgttcattgctcaagtaaatgccacaaatctctaaaaaaaaatttcaaaaaattgaccccaaaaaattccaagaaattggaggtttttgctcgagaatttaccattgtttaatggacagtttttttctcgaattgtgactaaggggttctaacctgttagcccctcgaaaatttttaccaaaaaatttcaggtctatgaaaaaaaattcttttttcaatgccactccatttttttgcagtttggcactctgttcgcattggtcatttgctcgctgtttctgtacgcttttctcggcctgatcacgcccttttatttggcaccgatcagtggcacttctgcgctggcaatggccgcgctggtggcgcttaaacaagttggcatttaaaaaaaattgaatttcaaaaccagtgaacttatttaataaaacccttggagtgccaaaaaacctagaccattttttggtgaacaactcttttcataattgtccgaattgaaaccttcaatttgattcgatgtccccaatcaagctagcaaaaaaaaaaaaaaaaaattttcggaggcgggagcccgaaattttttctgctatccaggctttccaagtgttattttttcataattttcaacgctggagcgaaaaagcaggaatttatagaggtttagcgtcaaaaaggtgacaattttttgccatttgggtcaaatttctaaaaataattagaaaattgtgtaaaaattttttttcaaggctttaacccaataaaaaattaaaaagccatttccagtacattccggacactgtctgctggcaa

SEQ ID NO: 8543 - DNA, 1294 bp, Heterodera glycines
cccccccccccccccctcctttaaaaaatttatttattttccttcataaatgtccgttttttagtttttccgcccaaatcagctggacttatctgcgtttcttccagtcccggggcggcatgcccgagccgatggtcggagaccgcagcgaacacttcacatgggccaggttgaacatggcaaatgcactacgctttctcccccccccccccccagaatgtttccaaaaaaaaaaattgttgaaagaaaatttgcaataaaattgttttgattgaattttagcgatttgaatagaaatggaatgtgaactgaacgggaatgggacttggaaagtggaccgggaagggatccgggaaacgggattcttatttttgcgggattcctatcatttcaaaaaaaaaaattttttcccggtataaaaactttttcgacggcacggtggggatccaaatttgcatcattttttgtgcctgtttcacaaatgcgaaaaaatgggagaaattttcgaaacgacgaattaaaaaaaagtttctcgcccgcctactactccttcaaaaatttaaaaaatttccataaaaatttgtttgcagtttgttcccccgccgtgcccaaccgttggccacgctgtgcggtcggctgacctttcgctcgctgcgtcgcgcgggtgtgctgcggcgcgtgctgcgcaccgagcggctggcccaggcggaggaggacacactgcacgcggacacgctgcagtcgctgcgcgtggtggacgcgagtgcggcggtgttggcgcccgagggttgggacgcggagcggcgccggtgcgttgccgggggccgaggcgcgaggcgtttgccgccgcggggtcaatgacggcataacacatgtttaacggaacggggacaaatttttaccgatagaaaaaaaacactgaatttttttcaacttttggaaagccttggcagcggtcaggcccgtaaaaaaaaaatttgtgacataaaatcctaagtttttttaagaaagttttcgccatcagattattttccaaaaagtagacgttgtggtgagtgaaaaaggcaggcaacaatttttttcttaaaaaataccaatttaaaaaattttttgtagggcagcgcgatgcacgttaggtgccgccagggaaattttttttttgttgcaaatttaacgaaatttttaagaaaattgacacaaatttcaaaattaaaaaaaaaattcctttcaacctaaattagacgccttcacaaccaaataaaattaattaatgcatttttcccaatttgcagac
